United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 18

SEQ ID NO: 281111 - DNA, 20 bp, Artificial Sequence
  Description of Artificial Sequence: Synthetic oligonucleotide
  Target: ATXN1; (+) strand; PAM type: YTN; PAM sequence: CTC
caaacataaagagagtatta

SEQ ID NO: 281112 - DNA, 20 bp, Artificial Sequence
  Description of Artificial Sequence: Synthetic oligonucleotide
  Target: ATXN1; (+) strand; PAM type: YTN; PAM sequence: TTA
aattttaagagagaggctat

SEQ ID NO: 281113 - DNA, 20 bp, Artificial Sequence
  Description of Artificial Sequence: Synthetic oligonucleotide
  Target: ATXN1; (+) strand; PAM type: YTN; PAM sequence: TTT
taagagagaggctatcatca

SEQ ID NO: 281114 - DNA, 20 bp, Artificial Sequence
  Description of Artificial Sequence: Synthetic oligonucleotide
  Target: ATXN1; (+) strand; PAM type: YTN; PAM sequence: TTT
aagagagaggctatcatcaa

SEQ ID NO: 281115 - DNA, 20 bp, Artificial Sequence
  Description of Artificial Sequence: Synthetic oligonucleotide
  Target: ATXN1; (+) strand; PAM type: YTN; PAM sequence: TTA
agagagaggctatcatcaaa

SEQ ID NO: 281116 - DNA, 20 bp, Artificial Sequence
  Description of Artificial Sequence: Synthetic oligonucleotide
  Target: ATXN1; (+) strand; PAM type: YTN; PAM sequence: CTA
tcatcaaaacgaaggcagag

SEQ ID NO: 281117 - DNA, 20 bp, Artificial Sequence
  Description of Artificial Sequence: Synthetic oligonucleotide
  Target: ATXN1; (+) strand; PAM type: YTN; PAM sequence: CTG
acaagcccatattgataaag

SEQ ID NO: 281118 - DNA, 20 bp, Artificial Sequence
  Description of Artificial Sequence: Synthetic oligonucleotide
  Target: ATXN1; (+) strand; PAM type: YTN; PAM sequence: TTG
ataaagcagagataaaagtt

SEQ ID NO: 281119 - DNA, 20 bp, Artificial Sequence
  Description of Artificial Sequence: Synthetic oligonucleotide
  Target: ATXN1; (+) strand; PAM type: YTN; PAM sequence: TTA
tctccaggttacatgcccgg

SEQ ID NO: 281120 - DNA, 20 bp, Artificial Sequence
  Description of Artificial Sequence: Synthetic oligonucleotide
  Target: ATXN1; (+) strand; PAM type: YTN; PAM sequence: CTC
caggttacatgcccggtaca

SEQ ID NO: 281121 - DNA, 20 bp, Artificial Sequence
  Description of Artificial Sequence: Synthetic oligonucleotide
  Target: ATXN1; (+) strand; PAM type: YTN; PAM sequence: TTA
catgcccggtacaggcagtt

SEQ ID NO: 281122 - DNA, 20 bp, Artificial Sequence
  Description of Artificial Sequence: Synthetic oligonucleotide
  Target: ATXN1; (+) strand; PAM type: YTN; PAM sequence: TTC
tcaatgtatgaatgagttgt

SEQ ID NO: 281123 - DNA, 20 bp, Artificial Sequence
  Description of Artificial Sequence: Synthetic oligonucleotide
  Target: ATXN1; (+) strand; PAM type: YTN; PAM sequence: CTC
aatgtatgaatgagttgtat

SEQ ID NO: 281124 - DNA, 20 bp, Artificial Sequence
  Description of Artificial Sequence: Synthetic oligonucleotide
  Target: ATXN1; (+) strand; PAM type: YTN; PAM sequence: TTG
tatacagaaagttcatttgt

SEQ ID NO: 281125 - DNA, 20 bp, Artificial Sequence
  Description of Artificial Sequence: Synthetic oligonucleotide
  Target: ATXN1; (+) strand; PAM type: YTN; PAM sequence: TTC
atttgtaagtcatttatttg

SEQ ID NO: 281126 - DNA, 20 bp, Artificial Sequence
  Description of Artificial Sequence: Synthetic oligonucleotide
  Target: ATXN1; (+) strand; PAM type: YTN; PAM sequence: TTT
gtaagtcatttatttgaaac

SEQ ID NO: 281127 - DNA, 20 bp, Artificial Sequence
  Description of Artificial Sequence: Synthetic oligonucleotide
  Target: ATXN1; (+) strand; PAM type: YTN; PAM sequence: TTG
taagtcatttatttgaaact

SEQ ID NO: 281128 - DNA, 20 bp, Artificial Sequence
  Description of Artificial Sequence: Synthetic oligonucleotide
  Target: ATXN1; (+) strand; PAM type: YTN; PAM sequence: TTT
atttgaaactccaaacacat

SEQ ID NO: 281129 - DNA, 20 bp, Artificial Sequence
  Description of Artificial Sequence: Synthetic oligonucleotide
  Target: ATXN1; (+) strand; PAM type: YTN; PAM sequence: TTA
tttgaaactccaaacacatt

SEQ ID NO: 281130 - DNA, 20 bp, Artificial Sequence
  Description of Artificial Sequence: Synthetic oligonucleotide
  Target: ATXN1; (+) strand; PAM type: YTN; PAM sequence: TTT
gaaactccaaacacattttc

SEQ ID NO: 281131 - DNA, 20 bp, Artificial Sequence
  Description of Artificial Sequence: Synthetic oligonucleotide
  Target: ATXN1; (+) strand; PAM type: YTN; PAM sequence: TTG
aaactccaaacacattttct

SEQ ID NO: 281132 - DNA, 20 bp, Artificial Sequence
  Description of Artificial Sequence: Synthetic oligonucleotide
  Target: ATXN1; (+) strand; PAM type: YTN; PAM sequence: CTC
caaacacattttctcagaga

SEQ ID NO: 281133 - DNA, 20 bp, Artificial Sequence
  Description of Artificial Sequence: Synthetic oligonucleotide
  Target: ATXN1; (+) strand; PAM type: YTN; PAM sequence: TTT
tctcagagaaacagtgttat

SEQ ID NO: 281134 - DNA, 20 bp, Artificial Sequence
  Description of Artificial Sequence: Synthetic oligonucleotide
  Target: ATXN1; (+) strand; PAM type: YTN; PAM sequence: TTT
ctcagagaaacagtgttata

SEQ ID NO: 281135 - DNA, 20 bp, Artificial Sequence
  Description of Artificial Sequence: Synthetic oligonucleotide
  Target: ATXN1; (+) strand; PAM type: YTN; PAM sequence: TTC
tcagagaaacagtgttataa

SEQ ID NO: 281136 - DNA, 20 bp, Artificial Sequence
  Description of Artificial Sequence: Synthetic oligonucleotide
  Target: ATXN1; (+) strand; PAM type: YTN; PAM sequence: CTC
agagaaacagtgttataaat

SEQ ID NO: 281137 - DNA, 20 bp, Artificial Sequence
  Description of Artificial Sequence: Synthetic oligonucleotide
  Target: ATXN1; (+) strand; PAM type: YTN; PAM sequence: TTA
taaatagtgcttagttttgc

SEQ ID NO: 281138 - DNA, 20 bp, Artificial Sequence
  Description of Artificial Sequence: Synthetic oligonucleotide
  Target: ATXN1; (+) strand; PAM type: YTN; PAM sequence: CTT
agttttgcaggaaggcaaaa

SEQ ID NO: 281139 - DNA, 20 bp, Artificial Sequence
  Description of Artificial Sequence: Synthetic oligonucleotide
  Target: ATXN1; (+) strand; PAM type: YTN; PAM sequence: TTA
gttttgcaggaaggcaaaaa

SEQ ID NO: 281140 - DNA, 20 bp, Artificial Sequence
  Description of Artificial Sequence: Synthetic oligonucleotide
  Target: ATXN1; (+) strand; PAM type: YTN; PAM sequence: TTT
tgcaggaaggcaaaaagagc

SEQ ID NO: 281141 - DNA, 20 bp, Artificial Sequence
  Description of Artificial Sequence: Synthetic oligonucleotide
  Target: ATXN1; (+) strand; PAM type: YTN; PAM sequence: TTT
gcaggaaggcaaaaagagct

SEQ ID NO: 281142 - DNA, 20 bp, Artificial Sequence
  Description of Artificial Sequence: Synthetic oligonucleotide
  Target: ATXN1; (+) strand; PAM type: YTN; PAM sequence: TTG
caggaaggcaaaaagagcta

SEQ ID NO: 281143 - DNA, 20 bp, Artificial Sequence
  Description of Artificial Sequence: Synthetic oligonucleotide
  Target: ATXN1; (+) strand; PAM type: YTN; PAM sequence: CTA
tagagcttataatatagaca

SEQ ID NO: 281144 - DNA, 20 bp, Artificial Sequence
  Description of Artificial Sequence: Synthetic oligonucleotide
  Target: ATXN1; (+) strand; PAM type: YTN; PAM sequence: CTT
ataatatagacaaactctag

SEQ ID NO: 281145 - DNA, 20 bp, Artificial Sequence
  Description of Artificial Sequence: Synthetic oligonucleotide
  Target: ATXN1; (+) strand; PAM type: YTN; PAM sequence: TTA
taatatagacaaactctagt

SEQ ID NO: 281146 - DNA, 20 bp, Artificial Sequence
  Description of Artificial Sequence: Synthetic oligonucleotide
  Target: ATXN1; (+) strand; PAM type: YTN; PAM sequence: CTC
tagtaccatgagcaggggac

SEQ ID NO: 281147 - DNA, 20 bp, Artificial Sequence
  Description of Artificial Sequence: Synthetic oligonucleotide
  Target: ATXN1; (+) strand; PAM type: YTN; PAM sequence: CTA
gtaccatgagcaggggacag

SEQ ID NO: 281148 - DNA, 20 bp, Artificial Sequence
  Description of Artificial Sequence: Synthetic oligonucleotide
  Target: ATXN1; (+) strand; PAM type: YTN; PAM sequence: CTT
acaaatgaactttctttttc

SEQ ID NO: 281149 - DNA, 20 bp, Artificial Sequence
  Description of Artificial Sequence: Synthetic oligonucleotide
  Target: ATXN1; (+) strand; PAM type: YTN; PAM sequence: TTA
caaatgaactttctttttcg

SEQ ID NO: 281150 - DNA, 20 bp, Artificial Sequence
  Description of Artificial Sequence: Synthetic oligonucleotide
  Target: ATXN1; (+) strand; PAM type: YTN; PAM sequence: CTT
tctttttcggtacctggaaa

SEQ ID NO: 281151 - DNA, 20 bp, Artificial Sequence
  Description of Artificial Sequence: Synthetic oligonucleotide
  Target: ATXN1; (+) strand; PAM type: YTN; PAM sequence: TTT
ctttttcggtacctggaaac

SEQ ID NO: 281152 - DNA, 20 bp, Artificial Sequence
  Description of Artificial Sequence: Synthetic oligonucleotide
  Target: ATXN1; (+) strand; PAM type: YTN; PAM sequence: TTC
tttttcggtacctggaaaca

SEQ ID NO: 281153 - DNA, 20 bp, Artificial Sequence
  Description of Artificial Sequence: Synthetic oligonucleotide
  Target: ATXN1; (+) strand; PAM type: YTN; PAM sequence: CTT
tttcggtacctggaaacaac

SEQ ID NO: 281154 - DNA, 20 bp, Artificial Sequence
  Description of Artificial Sequence: Synthetic oligonucleotide
  Target: ATXN1; (+) strand; PAM type: YTN; PAM sequence: TTT
ttcggtacctggaaacaacc

SEQ ID NO: 281155 - DNA, 20 bp, Artificial Sequence
  Description of Artificial Sequence: Synthetic oligonucleotide
  Target: ATXN1; (+) strand; PAM type: YTN; PAM sequence: TTT
tcggtacctggaaacaacca

SEQ ID NO: 281156 - DNA, 20 bp, Artificial Sequence
  Description of Artificial Sequence: Synthetic oligonucleotide
  Target: ATXN1; (+) strand; PAM type: YTN; PAM sequence: TTT
cggtacctggaaacaaccaa

SEQ ID NO: 281157 - DNA, 20 bp, Artificial Sequence
  Description of Artificial Sequence: Synthetic oligonucleotide
  Target: ATXN1; (+) strand; PAM type: YTN; PAM sequence: TTC
ggtacctggaaacaaccaaa

SEQ ID NO: 281158 - DNA, 20 bp, Artificial Sequence
  Description of Artificial Sequence: Synthetic oligonucleotide
  Target: ATXN1; (+) strand; PAM type: YTN; PAM sequence: CTG
gaaacaaccaaagttttttt

SEQ ID NO: 281159 - DNA, 20 bp, Artificial Sequence
  Description of Artificial Sequence: Synthetic oligonucleotide
  Target: ATXN1; (+) strand; PAM type: YTN; PAM sequence: TTT
tttttttctggcatctgtct

SEQ ID NO: 281160 - DNA, 20 bp, Artificial Sequence
  Description of Artificial Sequence: Synthetic oligonucleotide
  Target: ATXN1; (+) strand; PAM type: YTN; PAM sequence: TTT
ttttttctggcatctgtctg

SEQ ID NO: 281161 - DNA, 20 bp, Artificial Sequence
  Description of Artificial Sequence: Synthetic oligonucleotide
  Target: ATXN1; (+) strand; PAM type: YTN; PAM sequence: TTT
tttttctggcatctgtctgc

SEQ ID NO: 281162 - DNA, 20 bp, Artificial Sequence
  Description of Artificial Sequence: Synthetic oligonucleotide
  Target: ATXN1; (+) strand; PAM type: YTN; PAM sequence: TTT
ttttctggcatctgtctgcc

SEQ ID NO: 281163 - DNA, 20 bp, Artificial Sequence
  Description of Artificial Sequence: Synthetic oligonucleotide
  Target: ATXN1; (+) strand; PAM type: YTN; PAM sequence: TTT
tttctggcatctgtctgcct

SEQ ID NO: 281164 - DNA, 20 bp, Artificial Sequence
  Description of Artificial Sequence: Synthetic oligonucleotide
  Target: ATXN1; (+) strand; PAM type: YTN; PAM sequence: TTT
ttctggcatctgtctgcctc

SEQ ID NO: 281165 - DNA, 20 bp, Artificial Sequence
  Description of Artificial Sequence: Synthetic oligonucleotide
  Target: ATXN1; (+) strand; PAM type: YTN; PAM sequence: TTT
tctggcatctgtctgcctct

SEQ ID NO: 281166 - DNA, 20 bp, Artificial Sequence
  Description of Artificial Sequence: Synthetic oligonucleotide
  Target: ATXN1; (+) strand; PAM type: YTN; PAM sequence: TTT
ctggcatctgtctgcctctc

SEQ ID NO: 281167 - DNA, 20 bp, Artificial Sequence
  Description of Artificial Sequence: Synthetic oligonucleotide
  Target: ATXN1; (+) strand; PAM type: YTN; PAM sequence: TTC
tggcatctgtctgcctctcc

SEQ ID NO: 281168 - DNA, 20 bp, Artificial Sequence
  Description of Artificial Sequence: Synthetic oligonucleotide
  Target: ATXN1; (+) strand; PAM type: YTN; PAM sequence: CTG
gcatctgtctgcctctccta

SEQ ID NO: 281169 - DNA, 20 bp, Artificial Sequence
  Description of Artificial Sequence: Synthetic oligonucleotide
  Target: ATXN1; (+) strand; PAM type: YTN; PAM sequence: CTG
tctgcctctcctatacttct

SEQ ID NO: 281170 - DNA, 20 bp, Artificial Sequence
  Description of Artificial Sequence: Synthetic oligonucleotide
  Target: ATXN1; (+) strand; PAM type: YTN; PAM sequence: CTG
cctctcctatacttctccca

SEQ ID NO: 281171 - DNA, 20 bp, Artificial Sequence
  Description of Artificial Sequence: Synthetic oligonucleotide
  Target: ATXN1; (+) strand; PAM type: YTN; PAM sequence: CTC
tcctatacttctcccactgt

SEQ ID NO: 281172 - DNA, 20 bp, Artificial Sequence
  Description of Artificial Sequence: Synthetic oligonucleotide
  Target: ATXN1; (+) strand; PAM type: YTN; PAM sequence: CTC
ctatacttctcccactgtct

SEQ ID NO: 281173 - DNA, 20 bp, Artificial Sequence
  Description of Artificial Sequence: Synthetic oligonucleotide
  Target: ATXN1; (+) strand; PAM type: YTN; PAM sequence: CTA
tacttctcccactgtctaaa

SEQ ID NO: 281174 - DNA, 20 bp, Artificial Sequence
  Description of Artificial Sequence: Synthetic oligonucleotide
  Target: ATXN1; (+) strand; PAM type: YTN; PAM sequence: CTT
ctcccactgtctaaatgctt

SEQ ID NO: 281175 - DNA, 20 bp, Artificial Sequence
  Description of Artificial Sequence: Synthetic oligonucleotide
  Target: ATXN1; (+) strand; PAM type: YTN; PAM sequence: TTC
tcccactgtctaaatgcttc

SEQ ID NO: 281176 - DNA, 20 bp, Artificial Sequence
  Description of Artificial Sequence: Synthetic oligonucleotide
  Target: ATXN1; (+) strand; PAM type: YTN; PAM sequence: CTC
ccactgtctaaatgcttcat

SEQ ID NO: 281177 - DNA, 20 bp, Artificial Sequence
  Description of Artificial Sequence: Synthetic oligonucleotide
  Target: ATXN1; (+) strand; PAM type: YTN; PAM sequence: CTG
tctaaatgcttcatcccagc

SEQ ID NO: 281178 - DNA, 20 bp, Artificial Sequence
  Description of Artificial Sequence: Synthetic oligonucleotide
  Target: ATXN1; (+) strand; PAM type: YTN; PAM sequence: CTA
aatgcttcatcccagcccat

SEQ ID NO: 281179 - DNA, 20 bp, Artificial Sequence
  Description of Artificial Sequence: Synthetic oligonucleotide
  Target: ATXN1; (+) strand; PAM type: YTN; PAM sequence: CTT
catcccagcccatataagag

SEQ ID NO: 281180 - DNA, 20 bp, Artificial Sequence
  Description of Artificial Sequence: Synthetic oligonucleotide
  Target: ATXN1; (+) strand; PAM type: YTN; PAM sequence: TTC
atcccagcccatataagaga

SEQ ID NO: 281181 - DNA, 20 bp, Artificial Sequence
  Description of Artificial Sequence: Synthetic oligonucleotide
  Target: ATXN1; (+) strand; PAM type: YTN; PAM sequence: TTT
aatatagttaaccctttttc

SEQ ID NO: 281182 - DNA, 20 bp, Artificial Sequence
  Description of Artificial Sequence: Synthetic oligonucleotide
  Target: ATXN1; (+) strand; PAM type: YTN; PAM sequence: TTA
atatagttaaccctttttcc

SEQ ID NO: 281183 - DNA, 20 bp, Artificial Sequence
  Description of Artificial Sequence: Synthetic oligonucleotide
  Target: ATXN1; (+) strand; PAM type: YTN; PAM sequence: TTA
accctttttcccaaactccc

SEQ ID NO: 281184 - DNA, 20 bp, Artificial Sequence
  Description of Artificial Sequence: Synthetic oligonucleotide
  Target: ATXN1; (+) strand; PAM type: YTN; PAM sequence: CTT
tttcccaaactccccttccc

SEQ ID NO: 281185 - DNA, 20 bp, Artificial Sequence
  Description of Artificial Sequence: Synthetic oligonucleotide
  Target: ATXN1; (+) strand; PAM type: YTN; PAM sequence: TTT
ttcccaaactccccttccca

SEQ ID NO: 281186 - DNA, 20 bp, Artificial Sequence
  Description of Artificial Sequence: Synthetic oligonucleotide
  Target: ATXN1; (+) strand; PAM type: YTN; PAM sequence: TTT
tcccaaactccccttcccaa

SEQ ID NO: 281187 - DNA, 20 bp, Artificial Sequence
  Description of Artificial Sequence: Synthetic oligonucleotide
  Target: ATXN1; (+) strand; PAM type: YTN; PAM sequence: TTT
cccaaactccccttcccaag

SEQ ID NO: 281188 - DNA, 20 bp, Artificial Sequence
  Description of Artificial Sequence: Synthetic oligonucleotide
  Target: ATXN1; (+) strand; PAM type: YTN; PAM sequence: TTC
ccaaactccccttcccaagt

SEQ ID NO: 281189 - DNA, 20 bp, Artificial Sequence
  Description of Artificial Sequence: Synthetic oligonucleotide
  Target: ATXN1; (+) strand; PAM type: YTN; PAM sequence: CTC
cccttcccaagtccagttat

SEQ ID NO: 281190 - DNA, 20 bp, Artificial Sequence
  Description of Artificial Sequence: Synthetic oligonucleotide
  Target: ATXN1; (+) strand; PAM type: YTN; PAM sequence: CTT
cccaagtccagttatctggc

SEQ ID NO: 281191 - DNA, 20 bp, Artificial Sequence
  Description of Artificial Sequence: Synthetic oligonucleotide
  Target: ATXN1; (+) strand; PAM type: YTN; PAM sequence: TTC
ccaagtccagttatctggca

SEQ ID NO: 281192 - DNA, 20 bp, Artificial Sequence
  Description of Artificial Sequence: Synthetic oligonucleotide
  Target: ATXN1; (+) strand; PAM type: YTN; PAM sequence: TTA
tctggcaatcaaaggctaat

SEQ ID NO: 281193 - DNA, 20 bp, Artificial Sequence
  Description of Artificial Sequence: Synthetic oligonucleotide
  Target: ATXN1; (+) strand; PAM type: YTN; PAM sequence: CTG
gcaatcaaaggctaataaag

SEQ ID NO: 281194 - DNA, 20 bp, Artificial Sequence
  Description of Artificial Sequence: Synthetic oligonucleotide
  Target: ATXN1; (+) strand; PAM type: YTN; PAM sequence: CTA
ataaagagttcagttcagta

SEQ ID NO: 281195 - DNA, 20 bp, Artificial Sequence
  Description of Artificial Sequence: Synthetic oligonucleotide
  Target: ATXN1; (+) strand; PAM type: YTN; PAM sequence: TTC
agttcagtaaagacttgttt

SEQ ID NO: 281196 - DNA, 20 bp, Artificial Sequence
  Description of Artificial Sequence: Synthetic oligonucleotide
  Target: ATXN1; (+) strand; PAM type: YTN; PAM sequence: TTC
agtaaagacttgtttctagg

SEQ ID NO: 281197 - DNA, 20 bp, Artificial Sequence
  Description of Artificial Sequence: Synthetic oligonucleotide
  Target: ATXN1; (+) strand; PAM type: YTN; PAM sequence: CTT
gtttctaggttttgacagca

SEQ ID NO: 281198 - DNA, 20 bp, Artificial Sequence
  Description of Artificial Sequence: Synthetic oligonucleotide
  Target: ATXN1; (+) strand; PAM type: YTN; PAM sequence: TTG
tttctaggttttgacagcag

SEQ ID NO: 281199 - DNA, 20 bp, Artificial Sequence
  Description of Artificial Sequence: Synthetic oligonucleotide
  Target: ATXN1; (+) strand; PAM type: YTN; PAM sequence: TTT
ctaggttttgacagcagatc

SEQ ID NO: 281200 - DNA, 20 bp, Artificial Sequence
  Description of Artificial Sequence: Synthetic oligonucleotide
  Target: ATXN1; (+) strand; PAM type: YTN; PAM sequence: TTC
taggttttgacagcagatct

SEQ ID NO: 281201 - DNA, 20 bp, Artificial Sequence
  Description of Artificial Sequence: Synthetic oligonucleotide
  Target: ATXN1; (+) strand; PAM type: YTN; PAM sequence: CTA
ggttttgacagcagatctaa

SEQ ID NO: 281202 - DNA, 20 bp, Artificial Sequence
  Description of Artificial Sequence: Synthetic oligonucleotide
  Target: ATXN1; (+) strand; PAM type: YTN; PAM sequence: TTT
tgacagcagatctaatcttg

SEQ ID NO: 281203 - DNA, 20 bp, Artificial Sequence
  Description of Artificial Sequence: Synthetic oligonucleotide
  Target: ATXN1; (+) strand; PAM type: YTN; PAM sequence: TTT
gacagcagatctaatcttga

SEQ ID NO: 281204 - DNA, 20 bp, Artificial Sequence
  Description of Artificial Sequence: Synthetic oligonucleotide
  Target: ATXN1; (+) strand; PAM type: YTN; PAM sequence: TTG
acagcagatctaatcttgag

SEQ ID NO: 281205 - DNA, 20 bp, Artificial Sequence
  Description of Artificial Sequence: Synthetic oligonucleotide
  Target: ATXN1; (+) strand; PAM type: YTN; PAM sequence: CTA
atcttgagagagaggaatgg

SEQ ID NO: 281206 - DNA, 20 bp, Artificial Sequence
  Description of Artificial Sequence: Synthetic oligonucleotide
  Target: ATXN1; (+) strand; PAM type: YTN; PAM sequence: CTT
gagagagaggaatggggaca

SEQ ID NO: 281207 - DNA, 20 bp, Artificial Sequence
  Description of Artificial Sequence: Synthetic oligonucleotide
  Target: ATXN1; (+) strand; PAM type: YTN; PAM sequence: TTG
agagagaggaatggggacat

SEQ ID NO: 281208 - DNA, 20 bp, Artificial Sequence
  Description of Artificial Sequence: Synthetic oligonucleotide
  Target: ATXN1; (+) strand; PAM type: YTN; PAM sequence: CTC
tgggtatacacacaaagaat

SEQ ID NO: 281209 - DNA, 20 bp, Artificial Sequence
  Description of Artificial Sequence: Synthetic oligonucleotide
  Target: ATXN1; (+) strand; PAM type: YTN; PAM sequence: CTG
ggtatacacacaaagaatga

SEQ ID NO: 281210 - DNA, 20 bp, Artificial Sequence
  Description of Artificial Sequence: Synthetic oligonucleotide
  Target: ATXN1; (+) strand; PAM type: YTN; PAM sequence: CTG
ggaggactggataatttcag

SEQ ID NO: 281211 - DNA, 20 bp, Artificial Sequence
  Description of Artificial Sequence: Synthetic oligonucleotide
  Target: ATXN1; (+) strand; PAM type: YTN; PAM sequence: CTG
gataatttcaggaatttccc

SEQ ID NO: 281212 - DNA, 20 bp, Artificial Sequence
  Description of Artificial Sequence: Synthetic oligonucleotide
  Target: ATXN1; (+) strand; PAM type: YTN; PAM sequence: TTT
caggaatttccccgtaattt

SEQ ID NO: 281213 - DNA, 20 bp, Artificial Sequence
  Description of Artificial Sequence: Synthetic oligonucleotide
  Target: ATXN1; (+) strand; PAM type: YTN; PAM sequence: TTC
aggaatttccccgtaattta

SEQ ID NO: 281214 - DNA, 20 bp, Artificial Sequence
  Description of Artificial Sequence: Synthetic oligonucleotide
  Target: ATXN1; (+) strand; PAM type: YTN; PAM sequence: TTT
ccccgtaatttagtaatggt

SEQ ID NO: 281215 - DNA, 20 bp, Artificial Sequence
  Description of Artificial Sequence: Synthetic oligonucleotide
  Target: ATXN1; (+) strand; PAM type: YTN; PAM sequence: TTC
cccgtaatttagtaatggta

SEQ ID NO: 281216 - DNA, 20 bp, Artificial Sequence
  Description of Artificial Sequence: Synthetic oligonucleotide
  Target: ATXN1; (+) strand; PAM type: YTN; PAM sequence: TTT
agtaatggtaaacaagaaca

SEQ ID NO: 281217 - DNA, 20 bp, Artificial Sequence
  Description of Artificial Sequence: Synthetic oligonucleotide
  Target: ATXN1; (+) strand; PAM type: YTN; PAM sequence: TTA
gtaatggtaaacaagaacag

SEQ ID NO: 281218 - DNA, 20 bp, Artificial Sequence
  Description of Artificial Sequence: Synthetic oligonucleotide
  Target: ATXN1; (+) strand; PAM type: YTN; PAM sequence: CTC
ctaagaagtgcagatgaatg

SEQ ID NO: 281219 - DNA, 20 bp, Artificial Sequence
  Description of Artificial Sequence: Synthetic oligonucleotide
  Target: ATXN1; (+) strand; PAM type: YTN; PAM sequence: CTA
agaagtgcagatgaatgaag

SEQ ID NO: 281220 - DNA, 20 bp, Artificial Sequence
  Description of Artificial Sequence: Synthetic oligonucleotide
  Target: ATXN1; (+) strand; PAM type: YTN; PAM sequence: TTC
ctgaccaacaggtatagatc

SEQ ID NO: 281221 - DNA, 20 bp, Artificial Sequence
  Description of Artificial Sequence: Synthetic oligonucleotide
  Target: ATXN1; (+) strand; PAM type: YTN; PAM sequence: CTG
accaacaggtatagatcaaa

SEQ ID NO: 281222 - DNA, 20 bp, Artificial Sequence
  Description of Artificial Sequence: Synthetic oligonucleotide
  Target: ATXN1; (+) strand; PAM type: YTN; PAM sequence: CTT
ctatcccacacctggtttct

SEQ ID NO: 281223 - DNA, 20 bp, Artificial Sequence
  Description of Artificial Sequence: Synthetic oligonucleotide
  Target: ATXN1; (+) strand; PAM type: YTN; PAM sequence: TTC
tatcccacacctggtttcta

SEQ ID NO: 281224 - DNA, 20 bp, Artificial Sequence
  Description of Artificial Sequence: Synthetic oligonucleotide
  Target: ATXN1; (+) strand; PAM type: YTN; PAM sequence: CTA
tcccacacctggtttctagc

SEQ ID NO: 281225 - DNA, 20 bp, Artificial Sequence
  Description of Artificial Sequence: Synthetic oligonucleotide
  Target: ATXN1; (+) strand; PAM type: YTN; PAM sequence: CTG
gtttctagcggcagtatcta

SEQ ID NO: 281226 - DNA, 20 bp, Artificial Sequence
  Description of Artificial Sequence: Synthetic oligonucleotide
  Target: ATXN1; (+) strand; PAM type: YTN; PAM sequence: TTT
ctagcggcagtatctagaag

SEQ ID NO: 281227 - DNA, 20 bp, Artificial Sequence
  Description of Artificial Sequence: Synthetic oligonucleotide
  Target: ATXN1; (+) strand; PAM type: YTN; PAM sequence: TTC
tagcggcagtatctagaagg

SEQ ID NO: 281228 - DNA, 20 bp, Artificial Sequence
  Description of Artificial Sequence: Synthetic oligonucleotide
  Target: ATXN1; (+) strand; PAM type: YTN; PAM sequence: CTA
gcggcagtatctagaaggtt

SEQ ID NO: 281229 - DNA, 20 bp, Artificial Sequence
  Description of Artificial Sequence: Synthetic oligonucleotide
  Target: ATXN1; (+) strand; PAM type: YTN; PAM sequence: CTA
gaaggttccttgccttttca

SEQ ID NO: 281230 - DNA, 20 bp, Artificial Sequence
  Description of Artificial Sequence: Synthetic oligonucleotide
  Target: ATXN1; (+) strand; PAM type: YTN; PAM sequence: TTC
cttgccttttcatggggagc

SEQ ID NO: 281231 - DNA, 20 bp, Artificial Sequence
  Description of Artificial Sequence: Synthetic oligonucleotide
  Target: ATXN1; (+) strand; PAM type: YTN; PAM sequence: CTT
gccttttcatggggagccac

SEQ ID NO: 281232 - DNA, 20 bp, Artificial Sequence
  Description of Artificial Sequence: Synthetic oligonucleotide
  Target: ATXN1; (+) strand; PAM type: YTN; PAM sequence: TTG
ccttttcatggggagccaca

SEQ ID NO: 281233 - DNA, 20 bp, Artificial Sequence
  Description of Artificial Sequence: Synthetic oligonucleotide
  Target: ATXN1; (+) strand; PAM type: YTN; PAM sequence: CTT
ttcatggggagccacacatg

SEQ ID NO: 281234 - DNA, 20 bp, Artificial Sequence
  Description of Artificial Sequence: Synthetic oligonucleotide
  Target: ATXN1; (+) strand; PAM type: YTN; PAM sequence: TTT
tcatggggagccacacatga

SEQ ID NO: 281235 - DNA, 20 bp, Artificial Sequence
  Description of Artificial Sequence: Synthetic oligonucleotide
  Target: ATXN1; (+) strand; PAM type: YTN; PAM sequence: TTT
catggggagccacacatgac

SEQ ID NO: 281236 - DNA, 20 bp, Artificial Sequence
  Description of Artificial Sequence: Synthetic oligonucleotide
  Target: ATXN1; (+) strand; PAM type: YTN; PAM sequence: TTC
atggggagccacacatgact

SEQ ID NO: 281237 - DNA, 20 bp, Artificial Sequence
  Description of Artificial Sequence: Synthetic oligonucleotide
  Target: ATXN1; (+) strand; PAM type: YTN; PAM sequence: CTG
cctgctcttcttcccatgaa

SEQ ID NO: 281238 - DNA, 20 bp, Artificial Sequence
  Description of Artificial Sequence: Synthetic oligonucleotide
  Target: ATXN1; (+) strand; PAM type: YTN; PAM sequence: CTG
ctcttcttcccatgaagata

SEQ ID NO: 281239 - DNA, 20 bp, Artificial Sequence
  Description of Artificial Sequence: Synthetic oligonucleotide
  Target: ATXN1; (+) strand; PAM type: YTN; PAM sequence: CTC
ttcttcccatgaagataaca

SEQ ID NO: 281240 - DNA, 20 bp, Artificial Sequence
  Description of Artificial Sequence: Synthetic oligonucleotide
  Target: ATXN1; (+) strand; PAM type: YTN; PAM sequence: CTT
cttcccatgaagataacata

SEQ ID NO: 281241 - DNA, 20 bp, Artificial Sequence
  Description of Artificial Sequence: Synthetic oligonucleotide
  Target: ATXN1; (+) strand; PAM type: YTN; PAM sequence: TTC
ttcccatgaagataacataa

SEQ ID NO: 281242 - DNA, 20 bp, Artificial Sequence
  Description of Artificial Sequence: Synthetic oligonucleotide
  Target: ATXN1; (+) strand; PAM type: YTN; PAM sequence: CTT
cccatgaagataacataagg

SEQ ID NO: 281243 - DNA, 20 bp, Artificial Sequence
  Description of Artificial Sequence: Synthetic oligonucleotide
  Target: ATXN1; (+) strand; PAM type: YTN; PAM sequence: TTC
ccatgaagataacataaggg

SEQ ID NO: 281244 - DNA, 20 bp, Artificial Sequence
  Description of Artificial Sequence: Synthetic oligonucleotide
  Target: ATXN1; (+) strand; PAM type: YTN; PAM sequence: CTG
tcagttcagacccgggtggt

SEQ ID NO: 281245 - DNA, 20 bp, Artificial Sequence
  Description of Artificial Sequence: Synthetic oligonucleotide
  Target: ATXN1; (+) strand; PAM type: YTN; PAM sequence: TTC
agacccgggtggtttaaaag

SEQ ID NO: 281246 - DNA, 20 bp, Artificial Sequence
  Description of Artificial Sequence: Synthetic oligonucleotide
  Target: ATXN1; (+) strand; PAM type: YTN; PAM sequence: TTT
aaaagatgaagagtcctggc

SEQ ID NO: 281247 - DNA, 20 bp, Artificial Sequence
  Description of Artificial Sequence: Synthetic oligonucleotide
  Target: ATXN1; (+) strand; PAM type: YTN; PAM sequence: TTA
aaagatgaagagtcctggcc

SEQ ID NO: 281248 - DNA, 20 bp, Artificial Sequence
  Description of Artificial Sequence: Synthetic oligonucleotide
  Target: ATXN1; (+) strand; PAM type: YTN; PAM sequence: CTG
gcctggcgtggtggtggctc

SEQ ID NO: 281249 - DNA, 20 bp, Artificial Sequence
  Description of Artificial Sequence: Synthetic oligonucleotide
  Target: ATXN1; (+) strand; PAM type: YTN; PAM sequence: CTG
gcgtggtggtggctcacgcc

SEQ ID NO: 281250 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 281251 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 281252 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggtgggcgg

SEQ ID NO: 281253 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggtgggcgga

SEQ ID NO: 281254 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggtgggcggat

SEQ ID NO: 281255 - DNA, 20 bp, Artificial Sequence
  Description of Artificial Sequence: Synthetic oligonucleotide
  Target: ATXN1; (+) strand; PAM type: YTN; PAM sequence: CTG
aggtcaggagttcgagacca

SEQ ID NO: 281256 - DNA, 20 bp, Artificial Sequence
  Description of Artificial Sequence: Synthetic oligonucleotide
  Target: ATXN1; (+) strand; PAM type: YTN; PAM sequence: TTC
gagaccagcctgaccaacat

SEQ ID NO: 281257 - DNA, 20 bp, Artificial Sequence
  Description of Artificial Sequence: Synthetic oligonucleotide
  Target: ATXN1; (+) strand; PAM type: YTN; PAM sequence: CTG
accaacatggtgaaacctcg

SEQ ID NO: 281258 - DNA, 20 bp, Artificial Sequence
  Description of Artificial Sequence: Synthetic oligonucleotide
  Target: ATXN1; (+) strand; PAM type: YTN; PAM sequence: CTC
gtctctgctaaaaataaaaa

SEQ ID NO: 281259 - DNA, 20 bp, Artificial Sequence
  Description of Artificial Sequence: Synthetic oligonucleotide
  Target: ATXN1; (+) strand; PAM type: YTN; PAM sequence: CTC
tgctaaaaataaaaaataaa

SEQ ID NO: 281260 - DNA, 20 bp, Artificial Sequence
  Description of Artificial Sequence: Synthetic oligonucleotide
  Target: ATXN1; (+) strand; PAM type: YTN; PAM sequence: CTG
ctaaaaataaaaaataaaaa

SEQ ID NO: 281261 - DNA, 20 bp, Artificial Sequence
  Description of Artificial Sequence: Synthetic oligonucleotide
  Target: ATXN1; (+) strand; PAM type: YTN; PAM sequence: CTA
aaaataaaaaataaaaaatt

SEQ ID NO: 281262 - DNA, 20 bp, Artificial Sequence
  Description of Artificial Sequence: Synthetic oligonucleotide
  Target: ATXN1; (+) strand; PAM type: YTN; PAM sequence: TTT
agctgggcatggtggtgtga

SEQ ID NO: 281263 - DNA, 20 bp, Artificial Sequence
  Description of Artificial Sequence: Synthetic oligonucleotide
  Target: ATXN1; (+) strand; PAM type: YTN; PAM sequence: TTA
gctgggcatggtggtgtgag

SEQ ID NO: 281264 - DNA, 20 bp, Artificial Sequence
  Description of Artificial Sequence: Synthetic oligonucleotide
  Target: ATXN1; (+) strand; PAM type: YTN; PAM sequence: CTG
ggcatggtggtgtgagcctt

SEQ ID NO: 281265 - DNA, 20 bp, Artificial Sequence
  Description of Artificial Sequence: Synthetic oligonucleotide
  Target: ATXN1; (+) strand; PAM type: YTN; PAM sequence: CTT
gtaatcctagctactgggga

SEQ ID NO: 281266 - DNA, 20 bp, Artificial Sequence
  Description of Artificial Sequence: Synthetic oligonucleotide
  Target: ATXN1; (+) strand; PAM type: YTN; PAM sequence: TTG
taatcctagctactggggag

SEQ ID NO: 281267 - DNA, 20 bp, Artificial Sequence
  Description of Artificial Sequence: Synthetic oligonucleotide
  Target: ATXN1; (+) strand; PAM type: YTN; PAM sequence: CTA
gctactggggaggctaagac

SEQ ID NO: 281268 - DNA, 20 bp, Artificial Sequence
  Description of Artificial Sequence: Synthetic oligonucleotide
  Target: ATXN1; (+) strand; PAM type: YTN; PAM sequence: CTA
ctggggaggctaagacagga

SEQ ID NO: 281269 - DNA, 20 bp, Artificial Sequence
  Description of Artificial Sequence: Synthetic oligonucleotide
  Target: ATXN1; (+) strand; PAM type: YTN; PAM sequence: CTG
gggaggctaagacaggagaa

SEQ ID NO: 281270 - DNA, 20 bp, Artificial Sequence
  Description of Artificial Sequence: Synthetic oligonucleotide
  Target: ATXN1; (+) strand; PAM type: YTN; PAM sequence: CTA
agacaggagaatcgcttgaa

SEQ ID NO: 281271 - DNA, 20 bp, Artificial Sequence
  Description of Artificial Sequence: Synthetic oligonucleotide
  Target: ATXN1; (+) strand; PAM type: YTN; PAM sequence: CTT
gaacccaggaggtggaggct

SEQ ID NO: 281272 - DNA, 20 bp, Artificial Sequence
  Description of Artificial Sequence: Synthetic oligonucleotide
  Target: ATXN1; (+) strand; PAM type: YTN; PAM sequence: TTG
aacccaggaggtggaggctg

SEQ ID NO: 281273 - DNA, 20 bp, Artificial Sequence
  Description of Artificial Sequence: Synthetic oligonucleotide
  Target: ATXN1; (+) strand; PAM type: YTN; PAM sequence: CTG
tagtgagccaagctcacacc

SEQ ID NO: 281274 - DNA, 20 bp, Artificial Sequence
  Description of Artificial Sequence: Synthetic oligonucleotide
  Target: ATXN1; (+) strand; PAM type: YTN; PAM sequence: CTC
acaccactgcactccagcct

SEQ ID NO: 281275 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggcgacag

SEQ ID NO: 281276 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcgacagagtga

SEQ ID NO: 281277 - DNA, 20 bp, Artificial Sequence
  Description of Artificial Sequence: Synthetic oligonucleotide
  Target: ATXN1; (+) strand; PAM type: YTN; PAM sequence: CTG
ggcgacagagtgagactccg

SEQ ID NO: 281278 - DNA, 20 bp, Artificial Sequence
  Description of Artificial Sequence: Synthetic oligonucleotide
  Target: ATXN1; (+) strand; PAM type: YTN; PAM sequence: CTC
cgtctcagaaaaaaaaaaaa

SEQ ID NO: 281279 - DNA, 20 bp, Artificial Sequence
  Description of Artificial Sequence: Synthetic oligonucleotide
  Target: ATXN1; (+) strand; PAM type: YTN; PAM sequence: CTC
agaaaaaaaaaaaaaaaaaa

SEQ ID NO: 281280 - DNA, 20 bp, Artificial Sequence
  Description of Artificial Sequence: Synthetic oligonucleotide
  Target: ATXN1; (+) strand; PAM type: YTN; PAM sequence: TTC
cgattgactcagtggtctcc

SEQ ID NO: 281281 - DNA, 20 bp, Artificial Sequence
  Description of Artificial Sequence: Synthetic oligonucleotide
  Target: ATXN1; (+) strand; PAM type: YTN; PAM sequence: TTG
actcagtggtctcctgctgt

SEQ ID NO: 281282 - DNA, 20 bp, Artificial Sequence
  Description of Artificial Sequence: Synthetic oligonucleotide
  Target: ATXN1; (+) strand; PAM type: YTN; PAM sequence: CTC
agtggtctcctgctgttcct

SEQ ID NO: 281283 - DNA, 20 bp, Artificial Sequence
  Description of Artificial Sequence: Synthetic oligonucleotide
  Target: ATXN1; (+) strand; PAM type: YTN; PAM sequence: CTC
ctgctgttcctgagacagag

SEQ ID NO: 281284 - DNA, 20 bp, Artificial Sequence
  Description of Artificial Sequence: Synthetic oligonucleotide
  Target: ATXN1; (+) strand; PAM type: YTN; PAM sequence: CTG
ctgttcctgagacagagata

SEQ ID NO: 281285 - DNA, 20 bp, Artificial Sequence
  Description of Artificial Sequence: Synthetic oligonucleotide
  Target: ATXN1; (+) strand; PAM type: YTN; PAM sequence: CTG
ttcctgagacagagatataa

SEQ ID NO: 281286 - DNA, 20 bp, Artificial Sequence
  Description of Artificial Sequence: Synthetic oligonucleotide
  Target: ATXN1; (+) strand; PAM type: YTN; PAM sequence: TTC
ctgagacagagatataatgc

SEQ ID NO: 281287 - DNA, 20 bp, Artificial Sequence
  Description of Artificial Sequence: Synthetic oligonucleotide
  Target: ATXN1; (+) strand; PAM type: YTN; PAM sequence: CTG
agacagagatataatgccct

SEQ ID NO: 281288 - DNA, 20 bp, Artificial Sequence
  Description of Artificial Sequence: Synthetic oligonucleotide
  Target: ATXN1; (+) strand; PAM type: YTN; PAM sequence: CTG
caaattacagggtactcatg

SEQ ID NO: 281289 - DNA, 20 bp, Artificial Sequence
  Description of Artificial Sequence: Synthetic oligonucleotide
  Target: ATXN1; (+) strand; PAM type: YTN; PAM sequence: TTA
cagggtactcatggccaaat

SEQ ID NO: 281290 - DNA, 20 bp, Artificial Sequence
  Description of Artificial Sequence: Synthetic oligonucleotide
  Target: ATXN1; (+) strand; PAM type: YTN; PAM sequence: CTC
atggccaaatctcgggtggg

SEQ ID NO: 281291 - DNA, 20 bp, Artificial Sequence
  Description of Artificial Sequence: Synthetic oligonucleotide
  Target: ATXN1; (+) strand; PAM type: YTN; PAM sequence: CTC
gggtggggctgggatgggag

SEQ ID NO: 281292 - DNA, 20 bp, Artificial Sequence
  Description of Artificial Sequence: Synthetic oligonucleotide
  Target: ATXN1; (+) strand; PAM type: YTN; PAM sequence: CTG
ggatgggagtaaagatgacg

SEQ ID NO: 281293 - DNA, 20 bp, Artificial Sequence
  Description of Artificial Sequence: Synthetic oligonucleotide
  Target: ATXN1; (+) strand; PAM type: YTN; PAM sequence: TTG
tggcagaaactggttagttg

SEQ ID NO: 281294 - DNA, 20 bp, Artificial Sequence
  Description of Artificial Sequence: Synthetic oligonucleotide
  Target: ATXN1; (+) strand; PAM type: YTN; PAM sequence: CTG
gttagttgttgaaaaaacag

SEQ ID NO: 281295 - DNA, 20 bp, Artificial Sequence
  Description of Artificial Sequence: Synthetic oligonucleotide
  Target: ATXN1; (+) strand; PAM type: YTN; PAM sequence: TTA
gttgttgaaaaaacagtttc

SEQ ID NO: 281296 - DNA, 20 bp, Artificial Sequence
  Description of Artificial Sequence: Synthetic oligonucleotide
  Target: ATXN1; (+) strand; PAM type: YTN; PAM sequence: TTG
ttgaaaaaacagtttccctg

SEQ ID NO: 281297 - DNA, 20 bp, Artificial Sequence
  Description of Artificial Sequence: Synthetic oligonucleotide
  Target: ATXN1; (+) strand; PAM type: YTN; PAM sequence: TTG
aaaaaacagtttccctgtac

SEQ ID NO: 281298 - DNA, 20 bp, Artificial Sequence
  Description of Artificial Sequence: Synthetic oligonucleotide
  Target: ATXN1; (+) strand; PAM type: YTN; PAM sequence: TTT
ccctgtactccttgacatac

SEQ ID NO: 281299 - DNA, 20 bp, Artificial Sequence
  Description of Artificial Sequence: Synthetic oligonucleotide
  Target: ATXN1; (+) strand; PAM type: YTN; PAM sequence: TTC
cctgtactccttgacataca

SEQ ID NO: 281300 - DNA, 20 bp, Artificial Sequence
  Description of Artificial Sequence: Synthetic oligonucleotide
  Target: ATXN1; (+) strand; PAM type: YTN; PAM sequence: CTG
tactccttgacatacaggct

SEQ ID NO: 281301 - DNA, 20 bp, Artificial Sequence
  Description of Artificial Sequence: Synthetic oligonucleotide
  Target: ATXN1; (+) strand; PAM type: YTN; PAM sequence: CTC
cttgacatacaggctgacaa

SEQ ID NO: 281302 - DNA, 20 bp, Artificial Sequence
  Description of Artificial Sequence: Synthetic oligonucleotide
  Target: ATXN1; (+) strand; PAM type: YTN; PAM sequence: CTT
gacatacaggctgacaattc

SEQ ID NO: 281303 - DNA, 20 bp, Artificial Sequence
  Description of Artificial Sequence: Synthetic oligonucleotide
  Target: ATXN1; (+) strand; PAM type: YTN; PAM sequence: TTG
acatacaggctgacaattct

SEQ ID NO: 281304 - DNA, 20 bp, Artificial Sequence
  Description of Artificial Sequence: Synthetic oligonucleotide
  Target: ATXN1; (+) strand; PAM type: YTN; PAM sequence: CTG
acaattctccactttacctg

SEQ ID NO: 281305 - DNA, 20 bp, Artificial Sequence
  Description of Artificial Sequence: Synthetic oligonucleotide
  Target: ATXN1; (+) strand; PAM type: YTN; PAM sequence: TTC
tccactttacctgcagttga

SEQ ID NO: 281306 - DNA, 20 bp, Artificial Sequence
  Description of Artificial Sequence: Synthetic oligonucleotide
  Target: ATXN1; (+) strand; PAM type: YTN; PAM sequence: CTC
cactttacctgcagttgact

SEQ ID NO: 281307 - DNA, 20 bp, Artificial Sequence
  Description of Artificial Sequence: Synthetic oligonucleotide
  Target: ATXN1; (+) strand; PAM type: YTN; PAM sequence: CTT
tacctgcagttgactatgtc

SEQ ID NO: 281308 - DNA, 20 bp, Artificial Sequence
  Description of Artificial Sequence: Synthetic oligonucleotide
  Target: ATXN1; (+) strand; PAM type: YTN; PAM sequence: TTT
acctgcagttgactatgtcc

SEQ ID NO: 281309 - DNA, 20 bp, Artificial Sequence
  Description of Artificial Sequence: Synthetic oligonucleotide
  Target: ATXN1; (+) strand; PAM type: YTN; PAM sequence: TTA
cctgcagttgactatgtcca

SEQ ID NO: 281310 - DNA, 20 bp, Artificial Sequence
  Description of Artificial Sequence: Synthetic oligonucleotide
  Target: ATXN1; (+) strand; PAM type: YTN; PAM sequence: CTG
cagttgactatgtccacatg

SEQ ID NO: 281311 - DNA, 20 bp, Artificial Sequence
  Description of Artificial Sequence: Synthetic oligonucleotide
  Target: ATXN1; (+) strand; PAM type: YTN; PAM sequence: TTG
actatgtccacatgactaaa

SEQ ID NO: 281312 - DNA, 20 bp, Artificial Sequence
  Description of Artificial Sequence: Synthetic oligonucleotide
  Target: ATXN1; (+) strand; PAM type: YTN; PAM sequence: CTA
tgtccacatgactaaattct

SEQ ID NO: 281313 - DNA, 20 bp, Artificial Sequence
  Description of Artificial Sequence: Synthetic oligonucleotide
  Target: ATXN1; (+) strand; PAM type: YTN; PAM sequence: CTA
aattctggtcaagggaacat

SEQ ID NO: 281314 - DNA, 20 bp, Artificial Sequence
  Description of Artificial Sequence: Synthetic oligonucleotide
  Target: ATXN1; (+) strand; PAM type: YTN; PAM sequence: TTC
tggtcaagggaacatggaag

SEQ ID NO: 281315 - DNA, 20 bp, Artificial Sequence
  Description of Artificial Sequence: Synthetic oligonucleotide
  Target: ATXN1; (+) strand; PAM type: YTN; PAM sequence: CTG
gtcaagggaacatggaagga

SEQ ID NO: 281316 - DNA, 20 bp, Artificial Sequence
  Description of Artificial Sequence: Synthetic oligonucleotide
  Target: ATXN1; (+) strand; PAM type: YTN; PAM sequence: TTT
caccaacaaacctcccagga

SEQ ID NO: 281317 - DNA, 20 bp, Artificial Sequence
  Description of Artificial Sequence: Synthetic oligonucleotide
  Target: ATXN1; (+) strand; PAM type: YTN; PAM sequence: TTC
accaacaaacctcccaggag

SEQ ID NO: 281318 - DNA, 20 bp, Artificial Sequence
  Description of Artificial Sequence: Synthetic oligonucleotide
  Target: ATXN1; (+) strand; PAM type: YTN; PAM sequence: CTC
ccaggagactgctcactctc

SEQ ID NO: 281319 - DNA, 20 bp, Artificial Sequence
  Description of Artificial Sequence: Synthetic oligonucleotide
  Target: ATXN1; (+) strand; PAM type: YTN; PAM sequence: CTG
ctcactctctcgcttcccca

SEQ ID NO: 281320 - DNA, 20 bp, Artificial Sequence
  Description of Artificial Sequence: Synthetic oligonucleotide
  Target: ATXN1; (+) strand; PAM type: YTN; PAM sequence: CTC
actctctcgcttccccactt

SEQ ID NO: 281321 - DNA, 20 bp, Artificial Sequence
  Description of Artificial Sequence: Synthetic oligonucleotide
  Target: ATXN1; (+) strand; PAM type: YTN; PAM sequence: CTC
tctcgcttccccacttctct

SEQ ID NO: 281322 - DNA, 20 bp, Artificial Sequence
  Description of Artificial Sequence: Synthetic oligonucleotide
  Target: ATXN1; (+) strand; PAM type: YTN; PAM sequence: CTC
tcgcttccccacttctctct

SEQ ID NO: 281323 - DNA, 20 bp, Artificial Sequence
  Description of Artificial Sequence: Synthetic oligonucleotide
  Target: ATXN1; (+) strand; PAM type: YTN; PAM sequence: CTC
gcttccccacttctctcttc

SEQ ID NO: 281324 - DNA, 20 bp, Artificial Sequence
  Description of Artificial Sequence: Synthetic oligonucleotide
  Target: ATXN1; (+) strand; PAM type: YTN; PAM sequence: CTT
ccccacttctctcttctgcc

SEQ ID NO: 281325 - DNA, 20 bp, Artificial Sequence
  Description of Artificial Sequence: Synthetic oligonucleotide
  Target: ATXN1; (+) strand; PAM type: YTN; PAM sequence: TTC
cccacttctctcttctgcca

SEQ ID NO: 281326 - DNA, 20 bp, Artificial Sequence
  Description of Artificial Sequence: Synthetic oligonucleotide
  Target: ATXN1; (+) strand; PAM type: YTN; PAM sequence: CTT
ctctcttctgccaggtgcag

SEQ ID NO: 281327 - DNA, 20 bp, Artificial Sequence
  Description of Artificial Sequence: Synthetic oligonucleotide
  Target: ATXN1; (+) strand; PAM type: YTN; PAM sequence: TTC
tctcttctgccaggtgcaga

SEQ ID NO: 281328 - DNA, 20 bp, Artificial Sequence
  Description of Artificial Sequence: Synthetic oligonucleotide
  Target: ATXN1; (+) strand; PAM type: YTN; PAM sequence: CTC
tcttctgccaggtgcagaag

SEQ ID NO: 281329 - DNA, 20 bp, Artificial Sequence
  Description of Artificial Sequence: Synthetic oligonucleotide
  Target: ATXN1; (+) strand; PAM type: YTN; PAM sequence: CTC
ttctgccaggtgcagaagat

SEQ ID NO: 281330 - DNA, 20 bp, Artificial Sequence
  Description of Artificial Sequence: Synthetic oligonucleotide
  Target: ATXN1; (+) strand; PAM type: YTN; PAM sequence: CTT
ctgccaggtgcagaagatcc

SEQ ID NO: 281331 - DNA, 20 bp, Artificial Sequence
  Description of Artificial Sequence: Synthetic oligonucleotide
  Target: ATXN1; (+) strand; PAM type: YTN; PAM sequence: TTC
tgccaggtgcagaagatcct

SEQ ID NO: 281332 - DNA, 20 bp, Artificial Sequence
  Description of Artificial Sequence: Synthetic oligonucleotide
  Target: ATXN1; (+) strand; PAM type: YTN; PAM sequence: CTG
ccaggtgcagaagatcctta

SEQ ID NO: 281333 - DNA, 20 bp, Artificial Sequence
  Description of Artificial Sequence: Synthetic oligonucleotide
  Target: ATXN1; (+) strand; PAM type: YTN; PAM sequence: CTT
agggtctcccaacactgagg

SEQ ID NO: 281334 - DNA, 20 bp, Artificial Sequence
  Description of Artificial Sequence: Synthetic oligonucleotide
  Target: ATXN1; (+) strand; PAM type: YTN; PAM sequence: TTA
gggtctcccaacactgaggg

SEQ ID NO: 281335 - DNA, 20 bp, Artificial Sequence
  Description of Artificial Sequence: Synthetic oligonucleotide
  Target: ATXN1; (+) strand; PAM type: YTN; PAM sequence: CTC
ccaacactgagggaatgtct

SEQ ID NO: 281336 - DNA, 20 bp, Artificial Sequence
  Description of Artificial Sequence: Synthetic oligonucleotide
  Target: ATXN1; (+) strand; PAM type: YTN; PAM sequence: CTG
agggaatgtctgagccttgc

SEQ ID NO: 281337 - DNA, 20 bp, Artificial Sequence
  Description of Artificial Sequence: Synthetic oligonucleotide
  Target: ATXN1; (+) strand; PAM type: YTN; PAM sequence: CTG
agccttgcgatacaaggacc

SEQ ID NO: 281338 - DNA, 20 bp, Artificial Sequence
  Description of Artificial Sequence: Synthetic oligonucleotide
  Target: ATXN1; (+) strand; PAM type: YTN; PAM sequence: CTT
gcgatacaaggaccctgggt

SEQ ID NO: 281339 - DNA, 20 bp, Artificial Sequence
  Description of Artificial Sequence: Synthetic oligonucleotide
  Target: ATXN1; (+) strand; PAM type: YTN; PAM sequence: TTG
cgatacaaggaccctgggtc

SEQ ID NO: 281340 - DNA, 20 bp, Artificial Sequence
  Description of Artificial Sequence: Synthetic oligonucleotide
  Target: ATXN1; (+) strand; PAM type: YTN; PAM sequence: CTG
ggtcagggaatcaccaccat

SEQ ID NO: 281341 - DNA, 20 bp, Artificial Sequence
  Description of Artificial Sequence: Synthetic oligonucleotide
  Target: ATXN1; (+) strand; PAM type: YTN; PAM sequence: CTC
tccaactgcagaacacccca

SEQ ID NO: 281342 - DNA, 20 bp, Artificial Sequence
  Description of Artificial Sequence: Synthetic oligonucleotide
  Target: ATXN1; (+) strand; PAM type: YTN; PAM sequence: CTC
caactgcagaacaccccaag

SEQ ID NO: 281343 - DNA, 20 bp, Artificial Sequence
  Description of Artificial Sequence: Synthetic oligonucleotide
  Target: ATXN1; (+) strand; PAM type: YTN; PAM sequence: CTG
cagaacaccccaagttatcc

SEQ ID NO: 281344 - DNA, 20 bp, Artificial Sequence
  Description of Artificial Sequence: Synthetic oligonucleotide
  Target: ATXN1; (+) strand; PAM type: YTN; PAM sequence: TTA
tccgtaacaccatcaaaaag

SEQ ID NO: 281345 - DNA, 20 bp, Artificial Sequence
  Description of Artificial Sequence: Synthetic oligonucleotide
  Target: ATXN1; (+) strand; PAM type: YTN; PAM sequence: CTT
ctactgtgttccaccctgaa

SEQ ID NO: 281346 - DNA, 20 bp, Artificial Sequence
  Description of Artificial Sequence: Synthetic oligonucleotide
  Target: ATXN1; (+) strand; PAM type: YTN; PAM sequence: TTC
tactgtgttccaccctgaag

SEQ ID NO: 281347 - DNA, 20 bp, Artificial Sequence
  Description of Artificial Sequence: Synthetic oligonucleotide
  Target: ATXN1; (+) strand; PAM type: YTN; PAM sequence: CTA
ctgtgttccaccctgaagag

SEQ ID NO: 281348 - DNA, 20 bp, Artificial Sequence
  Description of Artificial Sequence: Synthetic oligonucleotide
  Target: ATXN1; (+) strand; PAM type: YTN; PAM sequence: CTG
tgttccaccctgaagagttg

SEQ ID NO: 281349 - DNA, 20 bp, Artificial Sequence
  Description of Artificial Sequence: Synthetic oligonucleotide
  Target: ATXN1; (+) strand; PAM type: YTN; PAM sequence: TTC
caccctgaagagttggggtt

SEQ ID NO: 281350 - DNA, 20 bp, Artificial Sequence
  Description of Artificial Sequence: Synthetic oligonucleotide
  Target: ATXN1; (+) strand; PAM type: YTN; PAM sequence: CTG
aagagttggggttgcttgtt

SEQ ID NO: 281351 - DNA, 20 bp, Artificial Sequence
  Description of Artificial Sequence: Synthetic oligonucleotide
  Target: ATXN1; (+) strand; PAM type: YTN; PAM sequence: TTG
gggttgcttgttattgcaac

SEQ ID NO: 281352 - DNA, 20 bp, Artificial Sequence
  Description of Artificial Sequence: Synthetic oligonucleotide
  Target: ATXN1; (+) strand; PAM type: YTN; PAM sequence: TTG
cttgttattgcaacatcctt

SEQ ID NO: 281353 - DNA, 20 bp, Artificial Sequence
  Description of Artificial Sequence: Synthetic oligonucleotide
  Target: ATXN1; (+) strand; PAM type: YTN; PAM sequence: CTT
gttattgcaacatccttgcc

SEQ ID NO: 281354 - DNA, 20 bp, Artificial Sequence
  Description of Artificial Sequence: Synthetic oligonucleotide
  Target: ATXN1; (+) strand; PAM type: YTN; PAM sequence: TTG
ttattgcaacatccttgccc

SEQ ID NO: 281355 - DNA, 20 bp, Artificial Sequence
  Description of Artificial Sequence: Synthetic oligonucleotide
  Target: ATXN1; (+) strand; PAM type: YTN; PAM sequence: TTA
ttgcaacatccttgcccatt

SEQ ID NO: 281356 - DNA, 20 bp, Artificial Sequence
  Description of Artificial Sequence: Synthetic oligonucleotide
  Target: ATXN1; (+) strand; PAM type: YTN; PAM sequence: TTG
caacatccttgcccattgta

SEQ ID NO: 281357 - DNA, 20 bp, Artificial Sequence
  Description of Artificial Sequence: Synthetic oligonucleotide
  Target: ATXN1; (+) strand; PAM type: YTN; PAM sequence: CTT
gcccattgtaccatcatctc

SEQ ID NO: 281358 - DNA, 20 bp, Artificial Sequence
  Description of Artificial Sequence: Synthetic oligonucleotide
  Target: ATXN1; (+) strand; PAM type: YTN; PAM sequence: TTG
cccattgtaccatcatctct

SEQ ID NO: 281359 - DNA, 20 bp, Artificial Sequence
  Description of Artificial Sequence: Synthetic oligonucleotide
  Target: ATXN1; (+) strand; PAM type: YTN; PAM sequence: TTG
taccatcatctctttgttgc

SEQ ID NO: 281360 - DNA, 20 bp, Artificial Sequence
  Description of Artificial Sequence: Synthetic oligonucleotide
  Target: ATXN1; (+) strand; PAM type: YTN; PAM sequence: CTC
tttgttgcatctcaggaaat

SEQ ID NO: 281361 - DNA, 20 bp, Artificial Sequence
  Description of Artificial Sequence: Synthetic oligonucleotide
  Target: ATXN1; (+) strand; PAM type: YTN; PAM sequence: CTT
tgttgcatctcaggaaatgt

SEQ ID NO: 281362 - DNA, 20 bp, Artificial Sequence
  Description of Artificial Sequence: Synthetic oligonucleotide
  Target: ATXN1; (+) strand; PAM type: YTN; PAM sequence: TTT
gttgcatctcaggaaatgtc

SEQ ID NO: 281363 - DNA, 20 bp, Artificial Sequence
  Description of Artificial Sequence: Synthetic oligonucleotide
  Target: ATXN1; (+) strand; PAM type: YTN; PAM sequence: TTG
ttgcatctcaggaaatgtcc

SEQ ID NO: 281364 - DNA, 20 bp, Artificial Sequence
  Description of Artificial Sequence: Synthetic oligonucleotide
  Target: ATXN1; (+) strand; PAM type: YTN; PAM sequence: TTG
catctcaggaaatgtccttt

SEQ ID NO: 281365 - DNA, 20 bp, Artificial Sequence
  Description of Artificial Sequence: Synthetic oligonucleotide
  Target: ATXN1; (+) strand; PAM type: YTN; PAM sequence: CTC
aggaaatgtcctttacattc

SEQ ID NO: 281366 - DNA, 20 bp, Artificial Sequence
  Description of Artificial Sequence: Synthetic oligonucleotide
  Target: ATXN1; (+) strand; PAM type: YTN; PAM sequence: CTT
tacattcacctgccctggac

SEQ ID NO: 281367 - DNA, 20 bp, Artificial Sequence
  Description of Artificial Sequence: Synthetic oligonucleotide
  Target: ATXN1; (+) strand; PAM type: YTN; PAM sequence: TTT
acattcacctgccctggaca

SEQ ID NO: 281368 - DNA, 20 bp, Artificial Sequence
  Description of Artificial Sequence: Synthetic oligonucleotide
  Target: ATXN1; (+) strand; PAM type: YTN; PAM sequence: TTA
cattcacctgccctggacaa

SEQ ID NO: 281369 - DNA, 20 bp, Artificial Sequence
  Description of Artificial Sequence: Synthetic oligonucleotide
  Target: ATXN1; (+) strand; PAM type: YTN; PAM sequence: TTC
acctgccctggacaatccac

SEQ ID NO: 281370 - DNA, 20 bp, Artificial Sequence
  Description of Artificial Sequence: Synthetic oligonucleotide
  Target: ATXN1; (+) strand; PAM type: YTN; PAM sequence: CTG
ccctggacaatccactaggt

SEQ ID NO: 281371 - DNA, 20 bp, Artificial Sequence
  Description of Artificial Sequence: Synthetic oligonucleotide
  Target: ATXN1; (+) strand; PAM type: YTN; PAM sequence: CTG
gacaatccactaggtttgtt

SEQ ID NO: 281372 - DNA, 20 bp, Artificial Sequence
  Description of Artificial Sequence: Synthetic oligonucleotide
  Target: ATXN1; (+) strand; PAM type: YTN; PAM sequence: CTA
ggtttgtttgtcctcaaacg

SEQ ID NO: 281373 - DNA, 20 bp, Artificial Sequence
  Description of Artificial Sequence: Synthetic oligonucleotide
  Target: ATXN1; (+) strand; PAM type: YTN; PAM sequence: TTT
gtttgtcctcaaacgaaatg

SEQ ID NO: 281374 - DNA, 20 bp, Artificial Sequence
  Description of Artificial Sequence: Synthetic oligonucleotide
  Target: ATXN1; (+) strand; PAM type: YTN; PAM sequence: TTG
tttgtcctcaaacgaaatgg

SEQ ID NO: 281375 - DNA, 20 bp, Artificial Sequence
  Description of Artificial Sequence: Synthetic oligonucleotide
  Target: ATXN1; (+) strand; PAM type: YTN; PAM sequence: TTT
gtcctcaaacgaaatggcct

SEQ ID NO: 281376 - DNA, 20 bp, Artificial Sequence
  Description of Artificial Sequence: Synthetic oligonucleotide
  Target: ATXN1; (+) strand; PAM type: YTN; PAM sequence: TTG
tcctcaaacgaaatggcctc

SEQ ID NO: 281377 - DNA, 20 bp, Artificial Sequence
  Description of Artificial Sequence: Synthetic oligonucleotide
  Target: ATXN1; (+) strand; PAM type: YTN; PAM sequence: CTC
aaacgaaatggcctcacacc

SEQ ID NO: 281378 - DNA, 20 bp, Artificial Sequence
  Description of Artificial Sequence: Synthetic oligonucleotide
  Target: ATXN1; (+) strand; PAM type: YTN; PAM sequence: CTC
acaccgctgagattttataa

SEQ ID NO: 281379 - DNA, 20 bp, Artificial Sequence
  Description of Artificial Sequence: Synthetic oligonucleotide
  Target: ATXN1; (+) strand; PAM type: YTN; PAM sequence: CTG
agattttataatacttcaag

SEQ ID NO: 281380 - DNA, 20 bp, Artificial Sequence
  Description of Artificial Sequence: Synthetic oligonucleotide
  Target: ATXN1; (+) strand; PAM type: YTN; PAM sequence: TTT
tataatacttcaagttttta

SEQ ID NO: 281381 - DNA, 20 bp, Artificial Sequence
  Description of Artificial Sequence: Synthetic oligonucleotide
  Target: ATXN1; (+) strand; PAM type: YTN; PAM sequence: TTT
ataatacttcaagtttttat

SEQ ID NO: 281382 - DNA, 20 bp, Artificial Sequence
  Description of Artificial Sequence: Synthetic oligonucleotide
  Target: ATXN1; (+) strand; PAM type: YTN; PAM sequence: TTA
taatacttcaagtttttata

SEQ ID NO: 281383 - DNA, 20 bp, Artificial Sequence
  Description of Artificial Sequence: Synthetic oligonucleotide
  Target: ATXN1; (+) strand; PAM type: YTN; PAM sequence: CTT
caagtttttataggttttct

SEQ ID NO: 281384 - DNA, 20 bp, Artificial Sequence
  Description of Artificial Sequence: Synthetic oligonucleotide
  Target: ATXN1; (+) strand; PAM type: YTN; PAM sequence: TTC
aagtttttataggttttctc

SEQ ID NO: 281385 - DNA, 20 bp, Artificial Sequence
  Description of Artificial Sequence: Synthetic oligonucleotide
  Target: ATXN1; (+) strand; PAM type: YTN; PAM sequence: TTT
ttataggttttctccttcct

SEQ ID NO: 281386 - DNA, 20 bp, Artificial Sequence
  Description of Artificial Sequence: Synthetic oligonucleotide
  Target: ATXN1; (+) strand; PAM type: YTN; PAM sequence: TTT
tataggttttctccttcctt

SEQ ID NO: 281387 - DNA, 20 bp, Artificial Sequence
  Description of Artificial Sequence: Synthetic oligonucleotide
  Target: ATXN1; (+) strand; PAM type: YTN; PAM sequence: TTT
ataggttttctccttccttc

SEQ ID NO: 281388 - DNA, 20 bp, Artificial Sequence
  Description of Artificial Sequence: Synthetic oligonucleotide
  Target: ATXN1; (+) strand; PAM type: YTN; PAM sequence: TTA
taggttttctccttccttca

SEQ ID NO: 281389 - DNA, 20 bp, Artificial Sequence
  Description of Artificial Sequence: Synthetic oligonucleotide
  Target: ATXN1; (+) strand; PAM type: YTN; PAM sequence: TTT
tctccttccttcactgtggt

SEQ ID NO: 281390 - DNA, 20 bp, Artificial Sequence
  Description of Artificial Sequence: Synthetic oligonucleotide
  Target: ATXN1; (+) strand; PAM type: YTN; PAM sequence: TTT
ctccttccttcactgtggtt

SEQ ID NO: 281391 - DNA, 20 bp, Artificial Sequence
  Description of Artificial Sequence: Synthetic oligonucleotide
  Target: ATXN1; (+) strand; PAM type: YTN; PAM sequence: TTC
tccttccttcactgtggtta

SEQ ID NO: 281392 - DNA, 20 bp, Artificial Sequence
  Description of Artificial Sequence: Synthetic oligonucleotide
  Target: ATXN1; (+) strand; PAM type: YTN; PAM sequence: CTC
cttccttcactgtggttagt

SEQ ID NO: 281393 - DNA, 20 bp, Artificial Sequence
  Description of Artificial Sequence: Synthetic oligonucleotide
  Target: ATXN1; (+) strand; PAM type: YTN; PAM sequence: CTT
ccttcactgtggttagtaag

SEQ ID NO: 281394 - DNA, 20 bp, Artificial Sequence
  Description of Artificial Sequence: Synthetic oligonucleotide
  Target: ATXN1; (+) strand; PAM type: YTN; PAM sequence: TTC
cttcactgtggttagtaagt

SEQ ID NO: 281395 - DNA, 20 bp, Artificial Sequence
  Description of Artificial Sequence: Synthetic oligonucleotide
  Target: ATXN1; (+) strand; PAM type: YTN; PAM sequence: CTT
cactgtggttagtaagttta

SEQ ID NO: 281396 - DNA, 20 bp, Artificial Sequence
  Description of Artificial Sequence: Synthetic oligonucleotide
  Target: ATXN1; (+) strand; PAM type: YTN; PAM sequence: TTC
actgtggttagtaagtttaa

SEQ ID NO: 281397 - DNA, 20 bp, Artificial Sequence
  Description of Artificial Sequence: Synthetic oligonucleotide
  Target: ATXN1; (+) strand; PAM type: YTN; PAM sequence: CTG
tggttagtaagtttaaccca

SEQ ID NO: 281398 - DNA, 20 bp, Artificial Sequence
  Description of Artificial Sequence: Synthetic oligonucleotide
  Target: ATXN1; (+) strand; PAM type: YTN; PAM sequence: TTA
gtaagtttaacccaagaaag

SEQ ID NO: 281399 - DNA, 20 bp, Artificial Sequence
  Description of Artificial Sequence: Synthetic oligonucleotide
  Target: ATXN1; (+) strand; PAM type: YTN; PAM sequence: TTT
aacccaagaaagccctctta

SEQ ID NO: 281400 - DNA, 20 bp, Artificial Sequence
  Description of Artificial Sequence: Synthetic oligonucleotide
  Target: ATXN1; (+) strand; PAM type: YTN; PAM sequence: TTA
acccaagaaagccctcttat

SEQ ID NO: 281401 - DNA, 20 bp, Artificial Sequence
  Description of Artificial Sequence: Synthetic oligonucleotide
  Target: ATXN1; (+) strand; PAM type: YTN; PAM sequence: CTC
ttattccttctaatctattt

SEQ ID NO: 281402 - DNA, 20 bp, Artificial Sequence
  Description of Artificial Sequence: Synthetic oligonucleotide
  Target: ATXN1; (+) strand; PAM type: YTN; PAM sequence: CTT
attccttctaatctatttgg

SEQ ID NO: 281403 - DNA, 20 bp, Artificial Sequence
  Description of Artificial Sequence: Synthetic oligonucleotide
  Target: ATXN1; (+) strand; PAM type: YTN; PAM sequence: TTA
ttccttctaatctatttggg

SEQ ID NO: 281404 - DNA, 20 bp, Artificial Sequence
  Description of Artificial Sequence: Synthetic oligonucleotide
  Target: ATXN1; (+) strand; PAM type: YTN; PAM sequence: TTC
cttctaatctatttgggaaa

SEQ ID NO: 281405 - DNA, 20 bp, Artificial Sequence
  Description of Artificial Sequence: Synthetic oligonucleotide
  Target: ATXN1; (+) strand; PAM type: YTN; PAM sequence: CTT
ctaatctatttgggaaactg

SEQ ID NO: 281406 - DNA, 20 bp, Artificial Sequence
  Description of Artificial Sequence: Synthetic oligonucleotide
  Target: ATXN1; (+) strand; PAM type: YTN; PAM sequence: TTC
taatctatttgggaaactga

SEQ ID NO: 281407 - DNA, 20 bp, Artificial Sequence
  Description of Artificial Sequence: Synthetic oligonucleotide
  Target: ATXN1; (+) strand; PAM type: YTN; PAM sequence: CTA
atctatttgggaaactgaag

SEQ ID NO: 281408 - DNA, 20 bp, Artificial Sequence
  Description of Artificial Sequence: Synthetic oligonucleotide
  Target: ATXN1; (+) strand; PAM type: YTN; PAM sequence: CTA
tttgggaaactgaagaagtg

SEQ ID NO: 281409 - DNA, 20 bp, Artificial Sequence
  Description of Artificial Sequence: Synthetic oligonucleotide
  Target: ATXN1; (+) strand; PAM type: YTN; PAM sequence: TTT
gggaaactgaagaagtgaat

SEQ ID NO: 281410 - DNA, 20 bp, Artificial Sequence
  Description of Artificial Sequence: Synthetic oligonucleotide
  Target: ATXN1; (+) strand; PAM type: YTN; PAM sequence: TTG
ggaaactgaagaagtgaatg

SEQ ID NO: 281411 - DNA, 20 bp, Artificial Sequence
  Description of Artificial Sequence: Synthetic oligonucleotide
  Target: ATXN1; (+) strand; PAM type: YTN; PAM sequence: CTG
aagaagtgaatgtgttgaat

SEQ ID NO: 281412 - DNA, 20 bp, Artificial Sequence
  Description of Artificial Sequence: Synthetic oligonucleotide
  Target: ATXN1; (+) strand; PAM type: YTN; PAM sequence: TTG
aatcactaatcttactttga

SEQ ID NO: 281413 - DNA, 20 bp, Artificial Sequence
  Description of Artificial Sequence: Synthetic oligonucleotide
  Target: ATXN1; (+) strand; PAM type: YTN; PAM sequence: CTA
atcttactttgagtgtcctt

SEQ ID NO: 281414 - DNA, 20 bp, Artificial Sequence
  Description of Artificial Sequence: Synthetic oligonucleotide
  Target: ATXN1; (+) strand; PAM type: YTN; PAM sequence: CTT
actttgagtgtccttgtgag

SEQ ID NO: 281415 - DNA, 20 bp, Artificial Sequence
  Description of Artificial Sequence: Synthetic oligonucleotide
  Target: ATXN1; (+) strand; PAM type: YTN; PAM sequence: TTA
ctttgagtgtccttgtgagt

SEQ ID NO: 281416 - DNA, 20 bp, Artificial Sequence
  Description of Artificial Sequence: Synthetic oligonucleotide
  Target: ATXN1; (+) strand; PAM type: YTN; PAM sequence: CTT
tgagtgtccttgtgagtcaa

SEQ ID NO: 281417 - DNA, 20 bp, Artificial Sequence
  Description of Artificial Sequence: Synthetic oligonucleotide
  Target: ATXN1; (+) strand; PAM type: YTN; PAM sequence: TTT
gagtgtccttgtgagtcaac

SEQ ID NO: 281418 - DNA, 20 bp, Artificial Sequence
  Description of Artificial Sequence: Synthetic oligonucleotide
  Target: ATXN1; (+) strand; PAM type: YTN; PAM sequence: TTG
agtgtccttgtgagtcaaca

SEQ ID NO: 281419 - DNA, 20 bp, Artificial Sequence
  Description of Artificial Sequence: Synthetic oligonucleotide
  Target: ATXN1; (+) strand; PAM type: YTN; PAM sequence: CTT
gtgagtcaacagggctctgg

SEQ ID NO: 281420 - DNA, 20 bp, Artificial Sequence
  Description of Artificial Sequence: Synthetic oligonucleotide
  Target: ATXN1; (+) strand; PAM type: YTN; PAM sequence: TTG
tgagtcaacagggctctggg

SEQ ID NO: 281421 - DNA, 20 bp, Artificial Sequence
  Description of Artificial Sequence: Synthetic oligonucleotide
  Target: ATXN1; (+) strand; PAM type: YTN; PAM sequence: CTC
tgggttcaccagggcttcat

SEQ ID NO: 281422 - DNA, 20 bp, Artificial Sequence
  Description of Artificial Sequence: Synthetic oligonucleotide
  Target: ATXN1; (+) strand; PAM type: YTN; PAM sequence: CTG
ggttcaccagggcttcatct

SEQ ID NO: 281423 - DNA, 20 bp, Artificial Sequence
  Description of Artificial Sequence: Synthetic oligonucleotide
  Target: ATXN1; (+) strand; PAM type: YTN; PAM sequence: TTC
accagggcttcatctataag

SEQ ID NO: 281424 - DNA, 20 bp, Artificial Sequence
  Description of Artificial Sequence: Synthetic oligonucleotide
  Target: ATXN1; (+) strand; PAM type: YTN; PAM sequence: CTT
catctataagtataattcag

SEQ ID NO: 281425 - DNA, 20 bp, Artificial Sequence
  Description of Artificial Sequence: Synthetic oligonucleotide
  Target: ATXN1; (+) strand; PAM type: YTN; PAM sequence: TTC
atctataagtataattcaga

SEQ ID NO: 281426 - DNA, 20 bp, Artificial Sequence
  Description of Artificial Sequence: Synthetic oligonucleotide
  Target: ATXN1; (+) strand; PAM type: YTN; PAM sequence: CTA
taagtataattcagaatttt

SEQ ID NO: 281427 - DNA, 20 bp, Artificial Sequence
  Description of Artificial Sequence: Synthetic oligonucleotide
  Target: ATXN1; (+) strand; PAM type: YTN; PAM sequence: TTC
agaatttttttattggtcat

SEQ ID NO: 281428 - DNA, 20 bp, Artificial Sequence
  Description of Artificial Sequence: Synthetic oligonucleotide
  Target: ATXN1; (+) strand; PAM type: YTN; PAM sequence: TTT
ttttattggtcatttttctc

SEQ ID NO: 281429 - DNA, 20 bp, Artificial Sequence
  Description of Artificial Sequence: Synthetic oligonucleotide
  Target: ATXN1; (+) strand; PAM type: YTN; PAM sequence: TTT
tttattggtcatttttctcc

SEQ ID NO: 281430 - DNA, 20 bp, Artificial Sequence
  Description of Artificial Sequence: Synthetic oligonucleotide
  Target: ATXN1; (+) strand; PAM type: YTN; PAM sequence: TTT
ttattggtcatttttctcct

SEQ ID NO: 281431 - DNA, 20 bp, Artificial Sequence
  Description of Artificial Sequence: Synthetic oligonucleotide
  Target: ATXN1; (+) strand; PAM type: YTN; PAM sequence: TTT
tattggtcatttttctcctt

SEQ ID NO: 281432 - DNA, 20 bp, Artificial Sequence
  Description of Artificial Sequence: Synthetic oligonucleotide
  Target: ATXN1; (+) strand; PAM type: YTN; PAM sequence: TTT
attggtcatttttctccttc

SEQ ID NO: 281433 - DNA, 20 bp, Artificial Sequence
  Description of Artificial Sequence: Synthetic oligonucleotide
  Target: ATXN1; (+) strand; PAM type: YTN; PAM sequence: TTA
ttggtcatttttctccttcc

SEQ ID NO: 281434 - DNA, 20 bp, Artificial Sequence
  Description of Artificial Sequence: Synthetic oligonucleotide
  Target: ATXN1; (+) strand; PAM type: YTN; PAM sequence: TTG
gtcatttttctccttcccaa

SEQ ID NO: 281435 - DNA, 20 bp, Artificial Sequence
  Description of Artificial Sequence: Synthetic oligonucleotide
  Target: ATXN1; (+) strand; PAM type: YTN; PAM sequence: TTT
ttctccttcccaagaaggtt

SEQ ID NO: 281436 - DNA, 20 bp, Artificial Sequence
  Description of Artificial Sequence: Synthetic oligonucleotide
  Target: ATXN1; (+) strand; PAM type: YTN; PAM sequence: TTT
tctccttcccaagaaggttt

SEQ ID NO: 281437 - DNA, 20 bp, Artificial Sequence
  Description of Artificial Sequence: Synthetic oligonucleotide
  Target: ATXN1; (+) strand; PAM type: YTN; PAM sequence: TTT
ctccttcccaagaaggtttt

SEQ ID NO: 281438 - DNA, 20 bp, Artificial Sequence
  Description of Artificial Sequence: Synthetic oligonucleotide
  Target: ATXN1; (+) strand; PAM type: YTN; PAM sequence: TTC
tccttcccaagaaggttttt

SEQ ID NO: 281439 - DNA, 20 bp, Artificial Sequence
  Description of Artificial Sequence: Synthetic oligonucleotide
  Target: ATXN1; (+) strand; PAM type: YTN; PAM sequence: CTC
cttcccaagaaggtttttcc

SEQ ID NO: 281440 - DNA, 20 bp, Artificial Sequence
  Description of Artificial Sequence: Synthetic oligonucleotide
  Target: ATXN1; (+) strand; PAM type: YTN; PAM sequence: CTT
cccaagaaggtttttcctat

SEQ ID NO: 281441 - DNA, 20 bp, Artificial Sequence
  Description of Artificial Sequence: Synthetic oligonucleotide
  Target: ATXN1; (+) strand; PAM type: YTN; PAM sequence: TTC
ccaagaaggtttttcctatc

SEQ ID NO: 281442 - DNA, 20 bp, Artificial Sequence
  Description of Artificial Sequence: Synthetic oligonucleotide
  Target: ATXN1; (+) strand; PAM type: YTN; PAM sequence: TTT
ttcctatcatttccaggttt

SEQ ID NO: 281443 - DNA, 20 bp, Artificial Sequence
  Description of Artificial Sequence: Synthetic oligonucleotide
  Target: ATXN1; (+) strand; PAM type: YTN; PAM sequence: TTT
tcctatcatttccaggtttc

SEQ ID NO: 281444 - DNA, 20 bp, Artificial Sequence
  Description of Artificial Sequence: Synthetic oligonucleotide
  Target: ATXN1; (+) strand; PAM type: YTN; PAM sequence: TTT
cctatcatttccaggtttca

SEQ ID NO: 281445 - DNA, 20 bp, Artificial Sequence
  Description of Artificial Sequence: Synthetic oligonucleotide
  Target: ATXN1; (+) strand; PAM type: YTN; PAM sequence: TTC
ctatcatttccaggtttcaa

SEQ ID NO: 281446 - DNA, 20 bp, Artificial Sequence
  Description of Artificial Sequence: Synthetic oligonucleotide
  Target: ATXN1; (+) strand; PAM type: YTN; PAM sequence: CTA
tcatttccaggtttcaagta

SEQ ID NO: 281447 - DNA, 20 bp, Artificial Sequence
  Description of Artificial Sequence: Synthetic oligonucleotide
  Target: ATXN1; (+) strand; PAM type: YTN; PAM sequence: TTT
ccaggtttcaagtaggaccc

SEQ ID NO: 281448 - DNA, 20 bp, Artificial Sequence
  Description of Artificial Sequence: Synthetic oligonucleotide
  Target: ATXN1; (+) strand; PAM type: YTN; PAM sequence: TTC
caggtttcaagtaggaccca

SEQ ID NO: 281449 - DNA, 20 bp, Artificial Sequence
  Description of Artificial Sequence: Synthetic oligonucleotide
  Target: ATXN1; (+) strand; PAM type: YTN; PAM sequence: TTT
caagtaggacccacgtagat

SEQ ID NO: 281450 - DNA, 20 bp, Artificial Sequence
  Description of Artificial Sequence: Synthetic oligonucleotide
  Target: ATXN1; (+) strand; PAM type: YTN; PAM sequence: TTC
aagtaggacccacgtagatt

SEQ ID NO: 281451 - DNA, 20 bp, Artificial Sequence
  Description of Artificial Sequence: Synthetic oligonucleotide
  Target: ATXN1; (+) strand; PAM type: YTN; PAM sequence: TTA
gggtcacagaaatatgtatt

SEQ ID NO: 281452 - DNA, 20 bp, Artificial Sequence
  Description of Artificial Sequence: Synthetic oligonucleotide
  Target: ATXN1; (+) strand; PAM type: YTN; PAM sequence: TTC
tgcctaagataactaggatc

SEQ ID NO: 281453 - DNA, 20 bp, Artificial Sequence
  Description of Artificial Sequence: Synthetic oligonucleotide
  Target: ATXN1; (+) strand; PAM type: YTN; PAM sequence: CTG
cctaagataactaggatcat

SEQ ID NO: 281454 - DNA, 20 bp, Artificial Sequence
  Description of Artificial Sequence: Synthetic oligonucleotide
  Target: ATXN1; (+) strand; PAM type: YTN; PAM sequence: CTA
agataactaggatcatatca

SEQ ID NO: 281455 - DNA, 20 bp, Artificial Sequence
  Description of Artificial Sequence: Synthetic oligonucleotide
  Target: ATXN1; (+) strand; PAM type: YTN; PAM sequence: CTA
ggatcatatcacttttataa

SEQ ID NO: 281456 - DNA, 20 bp, Artificial Sequence
  Description of Artificial Sequence: Synthetic oligonucleotide
  Target: ATXN1; (+) strand; PAM type: YTN; PAM sequence: CTT
ttataactaaatccatggaa

SEQ ID NO: 281457 - DNA, 20 bp, Artificial Sequence
  Description of Artificial Sequence: Synthetic oligonucleotide
  Target: ATXN1; (+) strand; PAM type: YTN; PAM sequence: TTT
tataactaaatccatggaag

SEQ ID NO: 281458 - DNA, 20 bp, Artificial Sequence
  Description of Artificial Sequence: Synthetic oligonucleotide
  Target: ATXN1; (+) strand; PAM type: YTN; PAM sequence: TTT
ataactaaatccatggaagt

SEQ ID NO: 281459 - DNA, 20 bp, Artificial Sequence
  Description of Artificial Sequence: Synthetic oligonucleotide
  Target: ATXN1; (+) strand; PAM type: YTN; PAM sequence: TTA
taactaaatccatggaagtg

SEQ ID NO: 281460 - DNA, 20 bp, Artificial Sequence
  Description of Artificial Sequence: Synthetic oligonucleotide
  Target: ATXN1; (+) strand; PAM type: YTN; PAM sequence: CTA
aatccatggaagtggcacca

SEQ ID NO: 281461 - DNA, 20 bp, Artificial Sequence
  Description of Artificial Sequence: Synthetic oligonucleotide
  Target: ATXN1; (+) strand; PAM type: YTN; PAM sequence: CTT
tgttgaaaacagcttgctca

SEQ ID NO: 281462 - DNA, 20 bp, Artificial Sequence
  Description of Artificial Sequence: Synthetic oligonucleotide
  Target: ATXN1; (+) strand; PAM type: YTN; PAM sequence: TTT
gttgaaaacagcttgctcac

SEQ ID NO: 281463 - DNA, 20 bp, Artificial Sequence
  Description of Artificial Sequence: Synthetic oligonucleotide
  Target: ATXN1; (+) strand; PAM type: YTN; PAM sequence: TTG
ttgaaaacagcttgctcact

SEQ ID NO: 281464 - DNA, 20 bp, Artificial Sequence
  Description of Artificial Sequence: Synthetic oligonucleotide
  Target: ATXN1; (+) strand; PAM type: YTN; PAM sequence: TTG
aaaacagcttgctcacttca

SEQ ID NO: 281465 - DNA, 20 bp, Artificial Sequence
  Description of Artificial Sequence: Synthetic oligonucleotide
  Target: ATXN1; (+) strand; PAM type: YTN; PAM sequence: CTT
gctcacttcattcattcact

SEQ ID NO: 281466 - DNA, 20 bp, Artificial Sequence
  Description of Artificial Sequence: Synthetic oligonucleotide
  Target: ATXN1; (+) strand; PAM type: YTN; PAM sequence: TTG
ctcacttcattcattcacta

SEQ ID NO: 281467 - DNA, 20 bp, Artificial Sequence
  Description of Artificial Sequence: Synthetic oligonucleotide
  Target: ATXN1; (+) strand; PAM type: YTN; PAM sequence: CTC
acttcattcattcactattc

SEQ ID NO: 281468 - DNA, 20 bp, Artificial Sequence
  Description of Artificial Sequence: Synthetic oligonucleotide
  Target: ATXN1; (+) strand; PAM type: YTN; PAM sequence: CTT
cattcattcactattcattt

SEQ ID NO: 281469 - DNA, 20 bp, Artificial Sequence
  Description of Artificial Sequence: Synthetic oligonucleotide
  Target: ATXN1; (+) strand; PAM type: YTN; PAM sequence: TTC
attcattcactattcattta

SEQ ID NO: 281470 - DNA, 20 bp, Artificial Sequence
  Description of Artificial Sequence: Synthetic oligonucleotide
  Target: ATXN1; (+) strand; PAM type: YTN; PAM sequence: TTC
attcactattcatttattca

SEQ ID NO: 281471 - DNA, 20 bp, Artificial Sequence
  Description of Artificial Sequence: Synthetic oligonucleotide
  Target: ATXN1; (+) strand; PAM type: YTN; PAM sequence: TTC
actattcatttattcagttt

SEQ ID NO: 281472 - DNA, 20 bp, Artificial Sequence
  Description of Artificial Sequence: Synthetic oligonucleotide
  Target: ATXN1; (+) strand; PAM type: YTN; PAM sequence: CTA
ttcatttattcagtttacct

SEQ ID NO: 281473 - DNA, 20 bp, Artificial Sequence
  Description of Artificial Sequence: Synthetic oligonucleotide
  Target: ATXN1; (+) strand; PAM type: YTN; PAM sequence: TTC
atttattcagtttaccttta

SEQ ID NO: 281474 - DNA, 20 bp, Artificial Sequence
  Description of Artificial Sequence: Synthetic oligonucleotide
  Target: ATXN1; (+) strand; PAM type: YTN; PAM sequence: TTT
attcagtttacctttaatgg

SEQ ID NO: 281475 - DNA, 20 bp, Artificial Sequence
  Description of Artificial Sequence: Synthetic oligonucleotide
  Target: ATXN1; (+) strand; PAM type: YTN; PAM sequence: TTA
ttcagtttacctttaatgga

SEQ ID NO: 281476 - DNA, 20 bp, Artificial Sequence
  Description of Artificial Sequence: Synthetic oligonucleotide
  Target: ATXN1; (+) strand; PAM type: YTN; PAM sequence: TTC
agtttacctttaatggaaga

SEQ ID NO: 281477 - DNA, 20 bp, Artificial Sequence
  Description of Artificial Sequence: Synthetic oligonucleotide
  Target: ATXN1; (+) strand; PAM type: YTN; PAM sequence: TTT
acctttaatggaagagggga

SEQ ID NO: 281478 - DNA, 20 bp, Artificial Sequence
  Description of Artificial Sequence: Synthetic oligonucleotide
  Target: ATXN1; (+) strand; PAM type: YTN; PAM sequence: TTA
cctttaatggaagaggggag

SEQ ID NO: 281479 - DNA, 20 bp, Artificial Sequence
  Description of Artificial Sequence: Synthetic oligonucleotide
  Target: ATXN1; (+) strand; PAM type: YTN; PAM sequence: CTT
taatggaagaggggagaaga

SEQ ID NO: 281480 - DNA, 20 bp, Artificial Sequence
  Description of Artificial Sequence: Synthetic oligonucleotide
  Target: ATXN1; (+) strand; PAM type: YTN; PAM sequence: TTT
aatggaagaggggagaagag

SEQ ID NO: 281481 - DNA, 20 bp, Artificial Sequence
  Description of Artificial Sequence: Synthetic oligonucleotide
  Target: ATXN1; (+) strand; PAM type: YTN; PAM sequence: TTA
atggaagaggggagaagaga

SEQ ID NO: 281482 - DNA, 20 bp, Artificial Sequence
  Description of Artificial Sequence: Synthetic oligonucleotide
  Target: ATXN1; (+) strand; PAM type: YTN; PAM sequence: CTG
aagaaagacagatgaaagtg

SEQ ID NO: 281483 - DNA, 20 bp, Artificial Sequence
  Description of Artificial Sequence: Synthetic oligonucleotide
  Target: ATXN1; (+) strand; PAM type: YTN; PAM sequence: TTG
taaccattccccacgcctaa

SEQ ID NO: 281484 - DNA, 20 bp, Artificial Sequence
  Description of Artificial Sequence: Synthetic oligonucleotide
  Target: ATXN1; (+) strand; PAM type: YTN; PAM sequence: TTC
cccacgcctaactctctata

SEQ ID NO: 281485 - DNA, 20 bp, Artificial Sequence
  Description of Artificial Sequence: Synthetic oligonucleotide
  Target: ATXN1; (+) strand; PAM type: YTN; PAM sequence: CTA
actctctatatattcccctt

SEQ ID NO: 281486 - DNA, 20 bp, Artificial Sequence
  Description of Artificial Sequence: Synthetic oligonucleotide
  Target: ATXN1; (+) strand; PAM type: YTN; PAM sequence: CTC
tctatatattccccttattt

SEQ ID NO: 281487 - DNA, 20 bp, Artificial Sequence
  Description of Artificial Sequence: Synthetic oligonucleotide
  Target: ATXN1; (+) strand; PAM type: YTN; PAM sequence: CTC
tatatattccccttatttta

SEQ ID NO: 281488 - DNA, 20 bp, Artificial Sequence
  Description of Artificial Sequence: Synthetic oligonucleotide
  Target: ATXN1; (+) strand; PAM type: YTN; PAM sequence: CTA
tatattccccttattttatt

SEQ ID NO: 281489 - DNA, 20 bp, Artificial Sequence
  Description of Artificial Sequence: Synthetic oligonucleotide
  Target: ATXN1; (+) strand; PAM type: YTN; PAM sequence: TTC
cccttattttattcataagt

SEQ ID NO: 281490 - DNA, 20 bp, Artificial Sequence
  Description of Artificial Sequence: Synthetic oligonucleotide
  Target: ATXN1; (+) strand; PAM type: YTN; PAM sequence: CTT
attttattcataagttgtta

SEQ ID NO: 281491 - DNA, 20 bp, Artificial Sequence
  Description of Artificial Sequence: Synthetic oligonucleotide
  Target: ATXN1; (+) strand; PAM type: YTN; PAM sequence: TTA
ttttattcataagttgttag

SEQ ID NO: 281492 - DNA, 20 bp, Artificial Sequence
  Description of Artificial Sequence: Synthetic oligonucleotide
  Target: ATXN1; (+) strand; PAM type: YTN; PAM sequence: TTT
tattcataagttgttagagg

SEQ ID NO: 281493 - DNA, 20 bp, Artificial Sequence
  Description of Artificial Sequence: Synthetic oligonucleotide
  Target: ATXN1; (+) strand; PAM type: YTN; PAM sequence: TTT
attcataagttgttagaggg

SEQ ID NO: 281494 - DNA, 20 bp, Artificial Sequence
  Description of Artificial Sequence: Synthetic oligonucleotide
  Target: ATXN1; (+) strand; PAM type: YTN; PAM sequence: TTA
ttcataagttgttagagggt

SEQ ID NO: 281495 - DNA, 20 bp, Artificial Sequence
  Description of Artificial Sequence: Synthetic oligonucleotide
  Target: ATXN1; (+) strand; PAM type: YTN; PAM sequence: TTC
ataagttgttagagggtaca

SEQ ID NO: 281496 - DNA, 20 bp, Artificial Sequence
  Description of Artificial Sequence: Synthetic oligonucleotide
  Target: ATXN1; (+) strand; PAM type: YTN; PAM sequence: TTG
ttagagggtacaataaaaac

SEQ ID NO: 281497 - DNA, 20 bp, Artificial Sequence
  Description of Artificial Sequence: Synthetic oligonucleotide
  Target: ATXN1; (+) strand; PAM type: YTN; PAM sequence: TTA
gagggtacaataaaaactaa

SEQ ID NO: 281498 - DNA, 20 bp, Artificial Sequence
  Description of Artificial Sequence: Synthetic oligonucleotide
  Target: ATXN1; (+) strand; PAM type: YTN; PAM sequence: CTA
agttaagatgtaatttgaaa

SEQ ID NO: 281499 - DNA, 20 bp, Artificial Sequence
  Description of Artificial Sequence: Synthetic oligonucleotide
  Target: ATXN1; (+) strand; PAM type: YTN; PAM sequence: TTA
agatgtaatttgaaatggag

SEQ ID NO: 281500 - DNA, 20 bp, Artificial Sequence
  Description of Artificial Sequence: Synthetic oligonucleotide
  Target: ATXN1; (+) strand; PAM type: YTN; PAM sequence: TTT
gaaatggagtctgtctaatc

SEQ ID NO: 281501 - DNA, 20 bp, Artificial Sequence
  Description of Artificial Sequence: Synthetic oligonucleotide
  Target: ATXN1; (+) strand; PAM type: YTN; PAM sequence: TTG
aaatggagtctgtctaatcc

SEQ ID NO: 281502 - DNA, 20 bp, Artificial Sequence
  Description of Artificial Sequence: Synthetic oligonucleotide
  Target: ATXN1; (+) strand; PAM type: YTN; PAM sequence: CTG
tctaatccaaaaccctagct

SEQ ID NO: 281503 - DNA, 20 bp, Artificial Sequence
  Description of Artificial Sequence: Synthetic oligonucleotide
  Target: ATXN1; (+) strand; PAM type: YTN; PAM sequence: CTA
atccaaaaccctagctttct

SEQ ID NO: 281504 - DNA, 20 bp, Artificial Sequence
  Description of Artificial Sequence: Synthetic oligonucleotide
  Target: ATXN1; (+) strand; PAM type: YTN; PAM sequence: CTA
gctttctacccttgctcctt

SEQ ID NO: 281505 - DNA, 20 bp, Artificial Sequence
  Description of Artificial Sequence: Synthetic oligonucleotide
  Target: ATXN1; (+) strand; PAM type: YTN; PAM sequence: CTT
tctacccttgctccttgcac

SEQ ID NO: 281506 - DNA, 20 bp, Artificial Sequence
  Description of Artificial Sequence: Synthetic oligonucleotide
  Target: ATXN1; (+) strand; PAM type: YTN; PAM sequence: TTT
ctacccttgctccttgcaca

SEQ ID NO: 281507 - DNA, 20 bp, Artificial Sequence
  Description of Artificial Sequence: Synthetic oligonucleotide
  Target: ATXN1; (+) strand; PAM type: YTN; PAM sequence: TTC
tacccttgctccttgcacag

SEQ ID NO: 281508 - DNA, 20 bp, Artificial Sequence
  Description of Artificial Sequence: Synthetic oligonucleotide
  Target: ATXN1; (+) strand; PAM type: YTN; PAM sequence: CTA
cccttgctccttgcacagcg

SEQ ID NO: 281509 - DNA, 20 bp, Artificial Sequence
  Description of Artificial Sequence: Synthetic oligonucleotide
  Target: ATXN1; (+) strand; PAM type: YTN; PAM sequence: CTT
gctccttgcacagcgatttt

SEQ ID NO: 281510 - DNA, 20 bp, Artificial Sequence
  Description of Artificial Sequence: Synthetic oligonucleotide
  Target: ATXN1; (+) strand; PAM type: YTN; PAM sequence: TTG
ctccttgcacagcgattttc

SEQ ID NO: 281511 - DNA, 20 bp, Artificial Sequence
  Description of Artificial Sequence: Synthetic oligonucleotide
  Target: ATXN1; (+) strand; PAM type: YTN; PAM sequence: CTC
cttgcacagcgattttctgg

SEQ ID NO: 281512 - DNA, 20 bp, Artificial Sequence
  Description of Artificial Sequence: Synthetic oligonucleotide
  Target: ATXN1; (+) strand; PAM type: YTN; PAM sequence: CTT
gcacagcgattttctggagc

SEQ ID NO: 281513 - DNA, 20 bp, Artificial Sequence
  Description of Artificial Sequence: Synthetic oligonucleotide
  Target: ATXN1; (+) strand; PAM type: YTN; PAM sequence: TTG
cacagcgattttctggagct

SEQ ID NO: 281514 - DNA, 20 bp, Artificial Sequence
  Description of Artificial Sequence: Synthetic oligonucleotide
  Target: ATXN1; (+) strand; PAM type: YTN; PAM sequence: TTT
tctggagctgtccaccctca

SEQ ID NO: 281515 - DNA, 20 bp, Artificial Sequence
  Description of Artificial Sequence: Synthetic oligonucleotide
  Target: ATXN1; (+) strand; PAM type: YTN; PAM sequence: TTT
ctggagctgtccaccctcat

SEQ ID NO: 281516 - DNA, 20 bp, Artificial Sequence
  Description of Artificial Sequence: Synthetic oligonucleotide
  Target: ATXN1; (+) strand; PAM type: YTN; PAM sequence: TTC
tggagctgtccaccctcatc

SEQ ID NO: 281517 - DNA, 20 bp, Artificial Sequence
  Description of Artificial Sequence: Synthetic oligonucleotide
  Target: ATXN1; (+) strand; PAM type: YTN; PAM sequence: CTG
gagctgtccaccctcatcac

SEQ ID NO: 281518 - DNA, 20 bp, Artificial Sequence
  Description of Artificial Sequence: Synthetic oligonucleotide
  Target: ATXN1; (+) strand; PAM type: YTN; PAM sequence: CTG
tccaccctcatcactttgtt

SEQ ID NO: 281519 - DNA, 20 bp, Artificial Sequence
  Description of Artificial Sequence: Synthetic oligonucleotide
  Target: ATXN1; (+) strand; PAM type: YTN; PAM sequence: CTC
atcactttgttgcatctcta

SEQ ID NO: 281520 - DNA, 20 bp, Artificial Sequence
  Description of Artificial Sequence: Synthetic oligonucleotide
  Target: ATXN1; (+) strand; PAM type: YTN; PAM sequence: CTT
tgttgcatctctagaaagat

SEQ ID NO: 281521 - DNA, 20 bp, Artificial Sequence
  Description of Artificial Sequence: Synthetic oligonucleotide
  Target: ATXN1; (+) strand; PAM type: YTN; PAM sequence: TTT
gttgcatctctagaaagatc

SEQ ID NO: 281522 - DNA, 20 bp, Artificial Sequence
  Description of Artificial Sequence: Synthetic oligonucleotide
  Target: ATXN1; (+) strand; PAM type: YTN; PAM sequence: TTG
ttgcatctctagaaagatcc

SEQ ID NO: 281523 - DNA, 20 bp, Artificial Sequence
  Description of Artificial Sequence: Synthetic oligonucleotide
  Target: ATXN1; (+) strand; PAM type: YTN; PAM sequence: TTG
catctctagaaagatccagg

SEQ ID NO: 281524 - DNA, 20 bp, Artificial Sequence
  Description of Artificial Sequence: Synthetic oligonucleotide
  Target: ATXN1; (+) strand; PAM type: YTN; PAM sequence: CTC
tagaaagatccagggattaa

SEQ ID NO: 281525 - DNA, 20 bp, Artificial Sequence
  Description of Artificial Sequence: Synthetic oligonucleotide
  Target: ATXN1; (+) strand; PAM type: YTN; PAM sequence: CTA
gaaagatccagggattaaat

SEQ ID NO: 281526 - DNA, 20 bp, Artificial Sequence
  Description of Artificial Sequence: Synthetic oligonucleotide
  Target: ATXN1; (+) strand; PAM type: YTN; PAM sequence: TTA
aataattatgtgcttcctgt

SEQ ID NO: 281527 - DNA, 20 bp, Artificial Sequence
  Description of Artificial Sequence: Synthetic oligonucleotide
  Target: ATXN1; (+) strand; PAM type: YTN; PAM sequence: TTA
tgtgcttcctgtgtggtggc

SEQ ID NO: 281528 - DNA, 20 bp, Artificial Sequence
  Description of Artificial Sequence: Synthetic oligonucleotide
  Target: ATXN1; (+) strand; PAM type: YTN; PAM sequence: CTT
cctgtgtggtggcctaagaa

SEQ ID NO: 281529 - DNA, 20 bp, Artificial Sequence
  Description of Artificial Sequence: Synthetic oligonucleotide
  Target: ATXN1; (+) strand; PAM type: YTN; PAM sequence: TTC
ctgtgtggtggcctaagaat

SEQ ID NO: 281530 - DNA, 20 bp, Artificial Sequence
  Description of Artificial Sequence: Synthetic oligonucleotide
  Target: ATXN1; (+) strand; PAM type: YTN; PAM sequence: CTG
tgtggtggcctaagaattaa

SEQ ID NO: 281531 - DNA, 20 bp, Artificial Sequence
  Description of Artificial Sequence: Synthetic oligonucleotide
  Target: ATXN1; (+) strand; PAM type: YTN; PAM sequence: CTA
agaattaagagaagtgacct

SEQ ID NO: 281532 - DNA, 20 bp, Artificial Sequence
  Description of Artificial Sequence: Synthetic oligonucleotide
  Target: ATXN1; (+) strand; PAM type: YTN; PAM sequence: TTA
agagaagtgacctgtttgat

SEQ ID NO: 281533 - DNA, 20 bp, Artificial Sequence
  Description of Artificial Sequence: Synthetic oligonucleotide
  Target: ATXN1; (+) strand; PAM type: YTN; PAM sequence: CTG
tttgatgcctgtgtgcaccc

SEQ ID NO: 281534 - DNA, 20 bp, Artificial Sequence
  Description of Artificial Sequence: Synthetic oligonucleotide
  Target: ATXN1; (+) strand; PAM type: YTN; PAM sequence: TTT
gatgcctgtgtgcaccctct

SEQ ID NO: 281535 - DNA, 20 bp, Artificial Sequence
  Description of Artificial Sequence: Synthetic oligonucleotide
  Target: ATXN1; (+) strand; PAM type: YTN; PAM sequence: TTG
atgcctgtgtgcaccctctc

SEQ ID NO: 281536 - DNA, 20 bp, Artificial Sequence
  Description of Artificial Sequence: Synthetic oligonucleotide
  Target: ATXN1; (+) strand; PAM type: YTN; PAM sequence: CTG
tgtgcaccctctctttgaca

SEQ ID NO: 281537 - DNA, 20 bp, Artificial Sequence
  Description of Artificial Sequence: Synthetic oligonucleotide
  Target: ATXN1; (+) strand; PAM type: YTN; PAM sequence: CTC
tctttgacaaagcatggcct

SEQ ID NO: 281538 - DNA, 20 bp, Artificial Sequence
  Description of Artificial Sequence: Synthetic oligonucleotide
  Target: ATXN1; (+) strand; PAM type: YTN; PAM sequence: CTC
tttgacaaagcatggcctga

SEQ ID NO: 281539 - DNA, 20 bp, Artificial Sequence
  Description of Artificial Sequence: Synthetic oligonucleotide
  Target: ATXN1; (+) strand; PAM type: YTN; PAM sequence: CTT
tgacaaagcatggcctgatt

SEQ ID NO: 281540 - DNA, 20 bp, Artificial Sequence
  Description of Artificial Sequence: Synthetic oligonucleotide
  Target: ATXN1; (+) strand; PAM type: YTN; PAM sequence: TTT
gacaaagcatggcctgattt

SEQ ID NO: 281541 - DNA, 20 bp, Artificial Sequence
  Description of Artificial Sequence: Synthetic oligonucleotide
  Target: ATXN1; (+) strand; PAM type: YTN; PAM sequence: TTG
acaaagcatggcctgatttc

SEQ ID NO: 281542 - DNA, 20 bp, Artificial Sequence
  Description of Artificial Sequence: Synthetic oligonucleotide
  Target: ATXN1; (+) strand; PAM type: YTN; PAM sequence: CTG
atttcccaatccttatggag

SEQ ID NO: 281543 - DNA, 20 bp, Artificial Sequence
  Description of Artificial Sequence: Synthetic oligonucleotide
  Target: ATXN1; (+) strand; PAM type: YTN; PAM sequence: TTT
cccaatccttatggagctct

SEQ ID NO: 281544 - DNA, 20 bp, Artificial Sequence
  Description of Artificial Sequence: Synthetic oligonucleotide
  Target: ATXN1; (+) strand; PAM type: YTN; PAM sequence: TTC
ccaatccttatggagctctg

SEQ ID NO: 281545 - DNA, 20 bp, Artificial Sequence
  Description of Artificial Sequence: Synthetic oligonucleotide
  Target: ATXN1; (+) strand; PAM type: YTN; PAM sequence: CTT
atggagctctgttgagggtt

SEQ ID NO: 281546 - DNA, 20 bp, Artificial Sequence
  Description of Artificial Sequence: Synthetic oligonucleotide
  Target: ATXN1; (+) strand; PAM type: YTN; PAM sequence: TTA
tggagctctgttgagggtta

SEQ ID NO: 281547 - DNA, 20 bp, Artificial Sequence
  Description of Artificial Sequence: Synthetic oligonucleotide
  Target: ATXN1; (+) strand; PAM type: YTN; PAM sequence: CTC
tgttgagggttacacagcaa

SEQ ID NO: 281548 - DNA, 20 bp, Artificial Sequence
  Description of Artificial Sequence: Synthetic oligonucleotide
  Target: ATXN1; (+) strand; PAM type: YTN; PAM sequence: CTG
ttgagggttacacagcaagg

SEQ ID NO: 281549 - DNA, 20 bp, Artificial Sequence
  Description of Artificial Sequence: Synthetic oligonucleotide
  Target: ATXN1; (+) strand; PAM type: YTN; PAM sequence: TTG
agggttacacagcaaggatt

SEQ ID NO: 281550 - DNA, 20 bp, Artificial Sequence
  Description of Artificial Sequence: Synthetic oligonucleotide
  Target: ATXN1; (+) strand; PAM type: YTN; PAM sequence: TTA
cacagcaaggattctgcctg

SEQ ID NO: 281551 - DNA, 20 bp, Artificial Sequence
  Description of Artificial Sequence: Synthetic oligonucleotide
  Target: ATXN1; (+) strand; PAM type: YTN; PAM sequence: TTC
tgcctgcctttaccttgcaa

SEQ ID NO: 281552 - DNA, 20 bp, Artificial Sequence
  Description of Artificial Sequence: Synthetic oligonucleotide
  Target: ATXN1; (+) strand; PAM type: YTN; PAM sequence: CTG
cctgcctttaccttgcaatt

SEQ ID NO: 281553 - DNA, 20 bp, Artificial Sequence
  Description of Artificial Sequence: Synthetic oligonucleotide
  Target: ATXN1; (+) strand; PAM type: YTN; PAM sequence: CTG
cctttaccttgcaattgcta

SEQ ID NO: 281554 - DNA, 20 bp, Artificial Sequence
  Description of Artificial Sequence: Synthetic oligonucleotide
  Target: ATXN1; (+) strand; PAM type: YTN; PAM sequence: CTT
taccttgcaattgctatgag

SEQ ID NO: 281555 - DNA, 20 bp, Artificial Sequence
  Description of Artificial Sequence: Synthetic oligonucleotide
  Target: ATXN1; (+) strand; PAM type: YTN; PAM sequence: TTT
accttgcaattgctatgaga

SEQ ID NO: 281556 - DNA, 20 bp, Artificial Sequence
  Description of Artificial Sequence: Synthetic oligonucleotide
  Target: ATXN1; (+) strand; PAM type: YTN; PAM sequence: TTA
ccttgcaattgctatgagaa

SEQ ID NO: 281557 - DNA, 20 bp, Artificial Sequence
  Description of Artificial Sequence: Synthetic oligonucleotide
  Target: ATXN1; (+) strand; PAM type: YTN; PAM sequence: CTT
gcaattgctatgagaataaa

SEQ ID NO: 281558 - DNA, 20 bp, Artificial Sequence
  Description of Artificial Sequence: Synthetic oligonucleotide
  Target: ATXN1; (+) strand; PAM type: YTN; PAM sequence: TTG
caattgctatgagaataaat

SEQ ID NO: 281559 - DNA, 20 bp, Artificial Sequence
  Description of Artificial Sequence: Synthetic oligonucleotide
  Target: ATXN1; (+) strand; PAM type: YTN; PAM sequence: TTG
ctatgagaataaattcaaaa

SEQ ID NO: 281560 - DNA, 20 bp, Artificial Sequence
  Description of Artificial Sequence: Synthetic oligonucleotide
  Target: ATXN1; (+) strand; PAM type: YTN; PAM sequence: CTA
tgagaataaattcaaaatgg

SEQ ID NO: 281561 - DNA, 20 bp, Artificial Sequence
  Description of Artificial Sequence: Synthetic oligonucleotide
  Target: ATXN1; (+) strand; PAM type: YTN; PAM sequence: TTC
aaaatggttcccgagttcag

SEQ ID NO: 281562 - DNA, 20 bp, Artificial Sequence
  Description of Artificial Sequence: Synthetic oligonucleotide
  Target: ATXN1; (+) strand; PAM type: YTN; PAM sequence: TTC
ccgagttcagcatgtgactc

SEQ ID NO: 281563 - DNA, 20 bp, Artificial Sequence
  Description of Artificial Sequence: Synthetic oligonucleotide
  Target: ATXN1; (+) strand; PAM type: YTN; PAM sequence: TTC
agcatgtgactcccacttct

SEQ ID NO: 281564 - DNA, 20 bp, Artificial Sequence
  Description of Artificial Sequence: Synthetic oligonucleotide
  Target: ATXN1; (+) strand; PAM type: YTN; PAM sequence: CTC
ccacttctgctgctaaaaaa

SEQ ID NO: 281565 - DNA, 20 bp, Artificial Sequence
  Description of Artificial Sequence: Synthetic oligonucleotide
  Target: ATXN1; (+) strand; PAM type: YTN; PAM sequence: CTT
ctgctgctaaaaaaacaaga

SEQ ID NO: 281566 - DNA, 20 bp, Artificial Sequence
  Description of Artificial Sequence: Synthetic oligonucleotide
  Target: ATXN1; (+) strand; PAM type: YTN; PAM sequence: TTC
tgctgctaaaaaaacaagac

SEQ ID NO: 281567 - DNA, 20 bp, Artificial Sequence
  Description of Artificial Sequence: Synthetic oligonucleotide
  Target: ATXN1; (+) strand; PAM type: YTN; PAM sequence: CTG
ctgctaaaaaaacaagacag

SEQ ID NO: 281568 - DNA, 20 bp, Artificial Sequence
  Description of Artificial Sequence: Synthetic oligonucleotide
  Target: ATXN1; (+) strand; PAM type: YTN; PAM sequence: CTG
ctaaaaaaacaagacagcta

SEQ ID NO: 281569 - DNA, 20 bp, Artificial Sequence
  Description of Artificial Sequence: Synthetic oligonucleotide
  Target: ATXN1; (+) strand; PAM type: YTN; PAM sequence: CTA
aaaaaacaagacagctattg

SEQ ID NO: 281570 - DNA, 20 bp, Artificial Sequence
  Description of Artificial Sequence: Synthetic oligonucleotide
  Target: ATXN1; (+) strand; PAM type: YTN; PAM sequence: CTA
ttgtattgaatgcactctac

SEQ ID NO: 281571 - DNA, 20 bp, Artificial Sequence
  Description of Artificial Sequence: Synthetic oligonucleotide
  Target: ATXN1; (+) strand; PAM type: YTN; PAM sequence: TTG
tattgaatgcactctactca

SEQ ID NO: 281572 - DNA, 20 bp, Artificial Sequence
  Description of Artificial Sequence: Synthetic oligonucleotide
  Target: ATXN1; (+) strand; PAM type: YTN; PAM sequence: TTG
aatgcactctactcatcagg

SEQ ID NO: 281573 - DNA, 20 bp, Artificial Sequence
  Description of Artificial Sequence: Synthetic oligonucleotide
  Target: ATXN1; (+) strand; PAM type: YTN; PAM sequence: CTC
tactcatcaggcactctgag

SEQ ID NO: 281574 - DNA, 20 bp, Artificial Sequence
  Description of Artificial Sequence: Synthetic oligonucleotide
  Target: ATXN1; (+) strand; PAM type: YTN; PAM sequence: CTA
ctcatcaggcactctgagaa

SEQ ID NO: 281575 - DNA, 20 bp, Artificial Sequence
  Description of Artificial Sequence: Synthetic oligonucleotide
  Target: ATXN1; (+) strand; PAM type: YTN; PAM sequence: CTC
atcaggcactctgagaatga

SEQ ID NO: 281576 - DNA, 20 bp, Artificial Sequence
  Description of Artificial Sequence: Synthetic oligonucleotide
  Target: ATXN1; (+) strand; PAM type: YTN; PAM sequence: CTC
tgagaatgaaggtgacctgg

SEQ ID NO: 281577 - DNA, 20 bp, Artificial Sequence
  Description of Artificial Sequence: Synthetic oligonucleotide
  Target: ATXN1; (+) strand; PAM type: YTN; PAM sequence: CTG
agaatgaaggtgacctggct

SEQ ID NO: 281578 - DNA, 20 bp, Artificial Sequence
  Description of Artificial Sequence: Synthetic oligonucleotide
  Target: ATXN1; (+) strand; PAM type: YTN; PAM sequence: CTG
gctggtatatatgggtctgt

SEQ ID NO: 281579 - DNA, 20 bp, Artificial Sequence
  Description of Artificial Sequence: Synthetic oligonucleotide
  Target: ATXN1; (+) strand; PAM type: YTN; PAM sequence: CTG
gtatatatgggtctgtggaa

SEQ ID NO: 281580 - DNA, 20 bp, Artificial Sequence
  Description of Artificial Sequence: Synthetic oligonucleotide
  Target: ATXN1; (+) strand; PAM type: YTN; PAM sequence: CTG
tggaaagacaaagtattttt

SEQ ID NO: 281581 - DNA, 20 bp, Artificial Sequence
  Description of Artificial Sequence: Synthetic oligonucleotide
  Target: ATXN1; (+) strand; PAM type: YTN; PAM sequence: TTT
ttacatagaaccattgacta

SEQ ID NO: 281582 - DNA, 20 bp, Artificial Sequence
  Description of Artificial Sequence: Synthetic oligonucleotide
  Target: ATXN1; (+) strand; PAM type: YTN; PAM sequence: TTT
tacatagaaccattgactac

SEQ ID NO: 281583 - DNA, 20 bp, Artificial Sequence
  Description of Artificial Sequence: Synthetic oligonucleotide
  Target: ATXN1; (+) strand; PAM type: YTN; PAM sequence: TTT
acatagaaccattgactacc

SEQ ID NO: 281584 - DNA, 20 bp, Artificial Sequence
  Description of Artificial Sequence: Synthetic oligonucleotide
  Target: ATXN1; (+) strand; PAM type: YTN; PAM sequence: TTA
catagaaccattgactacca

SEQ ID NO: 281585 - DNA, 20 bp, Artificial Sequence
  Description of Artificial Sequence: Synthetic oligonucleotide
  Target: ATXN1; (+) strand; PAM type: YTN; PAM sequence: TTG
actaccattacaattttgaa

SEQ ID NO: 281586 - DNA, 20 bp, Artificial Sequence
  Description of Artificial Sequence: Synthetic oligonucleotide
  Target: ATXN1; (+) strand; PAM type: YTN; PAM sequence: CTA
ccattacaattttgaaatat

SEQ ID NO: 281587 - DNA, 20 bp, Artificial Sequence
  Description of Artificial Sequence: Synthetic oligonucleotide
  Target: ATXN1; (+) strand; PAM type: YTN; PAM sequence: TTA
caattttgaaatatgttccc

SEQ ID NO: 281588 - DNA, 20 bp, Artificial Sequence
  Description of Artificial Sequence: Synthetic oligonucleotide
  Target: ATXN1; (+) strand; PAM type: YTN; PAM sequence: TTT
tgaaatatgttccctataaa

SEQ ID NO: 281589 - DNA, 20 bp, Artificial Sequence
  Description of Artificial Sequence: Synthetic oligonucleotide
  Target: ATXN1; (+) strand; PAM type: YTN; PAM sequence: TTT
gaaatatgttccctataaaa

SEQ ID NO: 281590 - DNA, 20 bp, Artificial Sequence
  Description of Artificial Sequence: Synthetic oligonucleotide
  Target: ATXN1; (+) strand; PAM type: YTN; PAM sequence: TTG
aaatatgttccctataaaaa

SEQ ID NO: 281591 - DNA, 20 bp, Artificial Sequence
  Description of Artificial Sequence: Synthetic oligonucleotide
  Target: ATXN1; (+) strand; PAM type: YTN; PAM sequence: TTC
cctataaaaaaaatactgaa

SEQ ID NO: 281592 - DNA, 20 bp, Artificial Sequence
  Description of Artificial Sequence: Synthetic oligonucleotide
  Target: ATXN1; (+) strand; PAM type: YTN; PAM sequence: CTA
taaaaaaaatactgaagtca

SEQ ID NO: 281593 - DNA, 20 bp, Artificial Sequence
  Description of Artificial Sequence: Synthetic oligonucleotide
  Target: ATXN1; (+) strand; PAM type: YTN; PAM sequence: CTG
aagtcaatacattagtttaa

SEQ ID NO: 281594 - DNA, 20 bp, Artificial Sequence
  Description of Artificial Sequence: Synthetic oligonucleotide
  Target: ATXN1; (+) strand; PAM type: YTN; PAM sequence: TTA
gtttaaaaggacataaaaag

SEQ ID NO: 281595 - DNA, 20 bp, Artificial Sequence
  Description of Artificial Sequence: Synthetic oligonucleotide
  Target: ATXN1; (+) strand; PAM type: YTN; PAM sequence: TTT
aaaaggacataaaaagagtc

SEQ ID NO: 281596 - DNA, 20 bp, Artificial Sequence
  Description of Artificial Sequence: Synthetic oligonucleotide
  Target: ATXN1; (+) strand; PAM type: YTN; PAM sequence: TTA
aaaggacataaaaagagtct

SEQ ID NO: 281597 - DNA, 20 bp, Artificial Sequence
  Description of Artificial Sequence: Synthetic oligonucleotide
  Target: ATXN1; (+) strand; PAM type: YTN; PAM sequence: CTT
tattctgccaatgtgaacat

SEQ ID NO: 281598 - DNA, 20 bp, Artificial Sequence
  Description of Artificial Sequence: Synthetic oligonucleotide
  Target: ATXN1; (+) strand; PAM type: YTN; PAM sequence: TTT
attctgccaatgtgaacata

SEQ ID NO: 281599 - DNA, 20 bp, Artificial Sequence
  Description of Artificial Sequence: Synthetic oligonucleotide
  Target: ATXN1; (+) strand; PAM type: YTN; PAM sequence: TTA
ttctgccaatgtgaacatat

SEQ ID NO: 281600 - DNA, 20 bp, Artificial Sequence
  Description of Artificial Sequence: Synthetic oligonucleotide
  Target: ATXN1; (+) strand; PAM type: YTN; PAM sequence: TTC
tgccaatgtgaacatatgtg

SEQ ID NO: 281601 - DNA, 20 bp, Artificial Sequence
  Description of Artificial Sequence: Synthetic oligonucleotide
  Target: ATXN1; (+) strand; PAM type: YTN; PAM sequence: CTG
ccaatgtgaacatatgtgct

SEQ ID NO: 281602 - DNA, 20 bp, Artificial Sequence
  Description of Artificial Sequence: Synthetic oligonucleotide
  Target: ATXN1; (+) strand; PAM type: YTN; PAM sequence: CTT
ccacagcaagcccataaagg

SEQ ID NO: 281603 - DNA, 20 bp, Artificial Sequence
  Description of Artificial Sequence: Synthetic oligonucleotide
  Target: ATXN1; (+) strand; PAM type: YTN; PAM sequence: TTC
cacagcaagcccataaaggg

SEQ ID NO: 281604 - DNA, 20 bp, Artificial Sequence
  Description of Artificial Sequence: Synthetic oligonucleotide
  Target: ATXN1; (+) strand; PAM type: YTN; PAM sequence: CTA
gaggctacttcatggagtat

SEQ ID NO: 281605 - DNA, 20 bp, Artificial Sequence
  Description of Artificial Sequence: Synthetic oligonucleotide
  Target: ATXN1; (+) strand; PAM type: YTN; PAM sequence: CTA
cttcatggagtattctgcca

SEQ ID NO: 281606 - DNA, 20 bp, Artificial Sequence
  Description of Artificial Sequence: Synthetic oligonucleotide
  Target: ATXN1; (+) strand; PAM type: YTN; PAM sequence: CTT
catggagtattctgccattt

SEQ ID NO: 281607 - DNA, 20 bp, Artificial Sequence
  Description of Artificial Sequence: Synthetic oligonucleotide
  Target: ATXN1; (+) strand; PAM type: YTN; PAM sequence: TTC
atggagtattctgccatttc

SEQ ID NO: 281608 - DNA, 20 bp, Artificial Sequence
  Description of Artificial Sequence: Synthetic oligonucleotide
  Target: ATXN1; (+) strand; PAM type: YTN; PAM sequence: TTC
tgccatttccaatgtccgct

SEQ ID NO: 281609 - DNA, 20 bp, Artificial Sequence
  Description of Artificial Sequence: Synthetic oligonucleotide
  Target: ATXN1; (+) strand; PAM type: YTN; PAM sequence: CTG
ccatttccaatgtccgctct

SEQ ID NO: 281610 - DNA, 20 bp, Artificial Sequence
  Description of Artificial Sequence: Synthetic oligonucleotide
  Target: ATXN1; (+) strand; PAM type: YTN; PAM sequence: TTT
ccaatgtccgctctacaaaa

SEQ ID NO: 281611 - DNA, 20 bp, Artificial Sequence
  Description of Artificial Sequence: Synthetic oligonucleotide
  Target: ATXN1; (+) strand; PAM type: YTN; PAM sequence: TTC
caatgtccgctctacaaaag

SEQ ID NO: 281612 - DNA, 20 bp, Artificial Sequence
  Description of Artificial Sequence: Synthetic oligonucleotide
  Target: ATXN1; (+) strand; PAM type: YTN; PAM sequence: CTC
tacaaaagatgtcattcttt

SEQ ID NO: 281613 - DNA, 20 bp, Artificial Sequence
  Description of Artificial Sequence: Synthetic oligonucleotide
  Target: ATXN1; (+) strand; PAM type: YTN; PAM sequence: CTA
caaaagatgtcattctttta

SEQ ID NO: 281614 - DNA, 20 bp, Artificial Sequence
  Description of Artificial Sequence: Synthetic oligonucleotide
  Target: ATXN1; (+) strand; PAM type: YTN; PAM sequence: TTC
ttttatacattattttcttt

SEQ ID NO: 281615 - DNA, 20 bp, Artificial Sequence
  Description of Artificial Sequence: Synthetic oligonucleotide
  Target: ATXN1; (+) strand; PAM type: YTN; PAM sequence: CTT
ttatacattattttctttta

SEQ ID NO: 281616 - DNA, 20 bp, Artificial Sequence
  Description of Artificial Sequence: Synthetic oligonucleotide
  Target: ATXN1; (+) strand; PAM type: YTN; PAM sequence: TTT
tatacattattttcttttat

SEQ ID NO: 281617 - DNA, 20 bp, Artificial Sequence
  Description of Artificial Sequence: Synthetic oligonucleotide
  Target: ATXN1; (+) strand; PAM type: YTN; PAM sequence: TTT
atacattattttcttttatt

SEQ ID NO: 281618 - DNA, 20 bp, Artificial Sequence
  Description of Artificial Sequence: Synthetic oligonucleotide
  Target: ATXN1; (+) strand; PAM type: YTN; PAM sequence: TTA
tacattattttcttttattt

SEQ ID NO: 281619 - DNA, 20 bp, Artificial Sequence
  Description of Artificial Sequence: Synthetic oligonucleotide
  Target: ATXN1; (+) strand; PAM type: YTN; PAM sequence: TTA
ttttcttttattttattttt

SEQ ID NO: 281620 - DNA, 20 bp, Artificial Sequence
  Description of Artificial Sequence: Synthetic oligonucleotide
  Target: ATXN1; (+) strand; PAM type: YTN; PAM sequence: TTT
tcttttattttatttttcta

SEQ ID NO: 281621 - DNA, 20 bp, Artificial Sequence
  Description of Artificial Sequence: Synthetic oligonucleotide
  Target: ATXN1; (+) strand; PAM type: YTN; PAM sequence: TTT
cttttattttatttttctag

SEQ ID NO: 281622 - DNA, 20 bp, Artificial Sequence
  Description of Artificial Sequence: Synthetic oligonucleotide
  Target: ATXN1; (+) strand; PAM type: YTN; PAM sequence: TTC
ttttattttatttttctaga

SEQ ID NO: 281623 - DNA, 20 bp, Artificial Sequence
  Description of Artificial Sequence: Synthetic oligonucleotide
  Target: ATXN1; (+) strand; PAM type: YTN; PAM sequence: CTT
ttattttatttttctagaga

SEQ ID NO: 281624 - DNA, 20 bp, Artificial Sequence
  Description of Artificial Sequence: Synthetic oligonucleotide
  Target: ATXN1; (+) strand; PAM type: YTN; PAM sequence: TTT
tattttatttttctagagac

SEQ ID NO: 281625 - DNA, 20 bp, Artificial Sequence
  Description of Artificial Sequence: Synthetic oligonucleotide
  Target: ATXN1; (+) strand; PAM type: YTN; PAM sequence: TTT
attttatttttctagagaca

SEQ ID NO: 281626 - DNA, 20 bp, Artificial Sequence
  Description of Artificial Sequence: Synthetic oligonucleotide
  Target: ATXN1; (+) strand; PAM type: YTN; PAM sequence: TTA
ttttatttttctagagacag

SEQ ID NO: 281627 - DNA, 20 bp, Artificial Sequence
  Description of Artificial Sequence: Synthetic oligonucleotide
  Target: ATXN1; (+) strand; PAM type: YTN; PAM sequence: TTT
tatttttctagagacagggt

SEQ ID NO: 281628 - DNA, 20 bp, Artificial Sequence
  Description of Artificial Sequence: Synthetic oligonucleotide
  Target: ATXN1; (+) strand; PAM type: YTN; PAM sequence: TTT
atttttctagagacagggtc

SEQ ID NO: 281629 - DNA, 20 bp, Artificial Sequence
  Description of Artificial Sequence: Synthetic oligonucleotide
  Target: ATXN1; (+) strand; PAM type: YTN; PAM sequence: TTA
tttttctagagacagggtct

SEQ ID NO: 281630 - DNA, 20 bp, Artificial Sequence
  Description of Artificial Sequence: Synthetic oligonucleotide
  Target: ATXN1; (+) strand; PAM type: YTN; PAM sequence: TTT
ttctagagacagggtctcac

SEQ ID NO: 281631 - DNA, 20 bp, Artificial Sequence
  Description of Artificial Sequence: Synthetic oligonucleotide
  Target: ATXN1; (+) strand; PAM type: YTN; PAM sequence: TTT
tctagagacagggtctcact

SEQ ID NO: 281632 - DNA, 20 bp, Artificial Sequence
  Description of Artificial Sequence: Synthetic oligonucleotide
  Target: ATXN1; (+) strand; PAM type: YTN; PAM sequence: TTT
ctagagacagggtctcactt

SEQ ID NO: 281633 - DNA, 20 bp, Artificial Sequence
  Description of Artificial Sequence: Synthetic oligonucleotide
  Target: ATXN1; (+) strand; PAM type: YTN; PAM sequence: TTC
tagagacagggtctcacttt

SEQ ID NO: 281634 - DNA, 20 bp, Artificial Sequence
  Description of Artificial Sequence: Synthetic oligonucleotide
  Target: ATXN1; (+) strand; PAM type: YTN; PAM sequence: CTA
gagacagggtctcactttgc

SEQ ID NO: 281635 - DNA, 20 bp, Artificial Sequence
  Description of Artificial Sequence: Synthetic oligonucleotide
  Target: ATXN1; (+) strand; PAM type: YTN; PAM sequence: CTC
actttgccacccagactggt

SEQ ID NO: 281636 - DNA, 20 bp, Artificial Sequence
  Description of Artificial Sequence: Synthetic oligonucleotide
  Target: ATXN1; (+) strand; PAM type: YTN; PAM sequence: CTT
tgccacccagactggtgtgc

SEQ ID NO: 281637 - DNA, 20 bp, Artificial Sequence
  Description of Artificial Sequence: Synthetic oligonucleotide
  Target: ATXN1; (+) strand; PAM type: YTN; PAM sequence: TTT
gccacccagactggtgtgca

SEQ ID NO: 281638 - DNA, 20 bp, Artificial Sequence
  Description of Artificial Sequence: Synthetic oligonucleotide
  Target: ATXN1; (+) strand; PAM type: YTN; PAM sequence: TTG
ccacccagactggtgtgcag

SEQ ID NO: 281639 - DNA, 20 bp, Artificial Sequence
  Description of Artificial Sequence: Synthetic oligonucleotide
  Target: ATXN1; (+) strand; PAM type: YTN; PAM sequence: CTG
gtgtgcagtggtgcaatcat

SEQ ID NO: 281640 - DNA, 20 bp, Artificial Sequence
  Description of Artificial Sequence: Synthetic oligonucleotide
  Target: ATXN1; (+) strand; PAM type: YTN; PAM sequence: CTC
actgtaaccttgaactcctg

SEQ ID NO: 281641 - DNA, 20 bp, Artificial Sequence
  Description of Artificial Sequence: Synthetic oligonucleotide
  Target: ATXN1; (+) strand; PAM type: YTN; PAM sequence: CTG
taaccttgaactcctgggct

SEQ ID NO: 281642 - DNA, 20 bp, Artificial Sequence
  Description of Artificial Sequence: Synthetic oligonucleotide
  Target: ATXN1; (+) strand; PAM type: YTN; PAM sequence: CTT
gaactcctgggctcaagcaa

SEQ ID NO: 281643 - DNA, 20 bp, Artificial Sequence
  Description of Artificial Sequence: Synthetic oligonucleotide
  Target: ATXN1; (+) strand; PAM type: YTN; PAM sequence: TTG
aactcctgggctcaagcaat

SEQ ID NO: 281644 - DNA, 20 bp, Artificial Sequence
  Description of Artificial Sequence: Synthetic oligonucleotide
  Target: ATXN1; (+) strand; PAM type: YTN; PAM sequence: CTC
ctgggctcaagcaatcctcc

SEQ ID NO: 281645 - DNA, 20 bp, Artificial Sequence
  Description of Artificial Sequence: Synthetic oligonucleotide
  Target: ATXN1; (+) strand; PAM type: YTN; PAM sequence: CTG
ggctcaagcaatcctcccac

SEQ ID NO: 281646 - DNA, 20 bp, Artificial Sequence
  Description of Artificial Sequence: Synthetic oligonucleotide
  Target: ATXN1; (+) strand; PAM type: YTN; PAM sequence: CTC
aagcaatcctcccacctcag

SEQ ID NO: 281647 - DNA, 20 bp, Artificial Sequence
  Description of Artificial Sequence: Synthetic oligonucleotide
  Target: ATXN1; (+) strand; PAM type: YTN; PAM sequence: CTC
ccacctcagcctcctgagca

SEQ ID NO: 281648 - DNA, 20 bp, Artificial Sequence
  Description of Artificial Sequence: Synthetic oligonucleotide
  Target: ATXN1; (+) strand; PAM type: YTN; PAM sequence: CTC
agcctcctgagcagctagga

SEQ ID NO: 281649 - DNA, 20 bp, Artificial Sequence
  Description of Artificial Sequence: Synthetic oligonucleotide
  Target: ATXN1; (+) strand; PAM type: YTN; PAM sequence: CTC
ctgagcagctaggactacag

SEQ ID NO: 281650 - DNA, 20 bp, Artificial Sequence
  Description of Artificial Sequence: Synthetic oligonucleotide
  Target: ATXN1; (+) strand; PAM type: YTN; PAM sequence: CTG
agcagctaggactacagact

SEQ ID NO: 281651 - DNA, 20 bp, Artificial Sequence
  Description of Artificial Sequence: Synthetic oligonucleotide
  Target: ATXN1; (+) strand; PAM type: YTN; PAM sequence: CTA
ggactacagactcacaacat

SEQ ID NO: 281652 - DNA, 20 bp, Artificial Sequence
  Description of Artificial Sequence: Synthetic oligonucleotide
  Target: ATXN1; (+) strand; PAM type: YTN; PAM sequence: CTA
cagactcacaacattacact

SEQ ID NO: 281653 - DNA, 20 bp, Artificial Sequence
  Description of Artificial Sequence: Synthetic oligonucleotide
  Target: ATXN1; (+) strand; PAM type: YTN; PAM sequence: CTC
acaacattacactcagctaa

SEQ ID NO: 281654 - DNA, 20 bp, Artificial Sequence
  Description of Artificial Sequence: Synthetic oligonucleotide
  Target: ATXN1; (+) strand; PAM type: YTN; PAM sequence: TTA
cactcagctaattaaaaaaa

SEQ ID NO: 281655 - DNA, 20 bp, Artificial Sequence
  Description of Artificial Sequence: Synthetic oligonucleotide
  Target: ATXN1; (+) strand; PAM type: YTN; PAM sequence: CTC
agctaattaaaaaaaaaaaa

SEQ ID NO: 281656 - DNA, 20 bp, Artificial Sequence
  Description of Artificial Sequence: Synthetic oligonucleotide
  Target: ATXN1; (+) strand; PAM type: YTN; PAM sequence: CTA
attaaaaaaaaaaaacttaa

SEQ ID NO: 281657 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaaaaacttaaagag

SEQ ID NO: 281658 - DNA, 20 bp, Artificial Sequence
  Description of Artificial Sequence: Synthetic oligonucleotide
  Target: ATXN1; (+) strand; PAM type: YTN; PAM sequence: CTT
aaagagacaaagacttgttc

SEQ ID NO: 281659 - DNA, 20 bp, Artificial Sequence
  Description of Artificial Sequence: Synthetic oligonucleotide
  Target: ATXN1; (+) strand; PAM type: YTN; PAM sequence: TTA
aagagacaaagacttgttct

SEQ ID NO: 281660 - DNA, 20 bp, Artificial Sequence
  Description of Artificial Sequence: Synthetic oligonucleotide
  Target: ATXN1; (+) strand; PAM type: YTN; PAM sequence: CTT
gttctgtcacccaggctgga

SEQ ID NO: 281661 - DNA, 20 bp, Artificial Sequence
  Description of Artificial Sequence: Synthetic oligonucleotide
  Target: ATXN1; (+) strand; PAM type: YTN; PAM sequence: TTG
ttctgtcacccaggctggag

SEQ ID NO: 281662 - DNA, 20 bp, Artificial Sequence
  Description of Artificial Sequence: Synthetic oligonucleotide
  Target: ATXN1; (+) strand; PAM type: YTN; PAM sequence: TTC
tgtcacccaggctggagtgt

SEQ ID NO: 281663 - DNA, 20 bp, Artificial Sequence
  Description of Artificial Sequence: Synthetic oligonucleotide
  Target: ATXN1; (+) strand; PAM type: YTN; PAM sequence: CTG
tcacccaggctggagtgtag

SEQ ID NO: 281664 - DNA, 20 bp, Artificial Sequence
  Description of Artificial Sequence: Synthetic oligonucleotide
  Target: ATXN1; (+) strand; PAM type: YTN; PAM sequence: CTG
gagtgtagtggtgcgatcac

SEQ ID NO: 281665 - DNA, 20 bp, Artificial Sequence
  Description of Artificial Sequence: Synthetic oligonucleotide
  Target: ATXN1; (+) strand; PAM type: YTN; PAM sequence: CTC
actgcagcctcaaactccta

SEQ ID NO: 281666 - DNA, 20 bp, Artificial Sequence
  Description of Artificial Sequence: Synthetic oligonucleotide
  Target: ATXN1; (+) strand; PAM type: YTN; PAM sequence: CTG
cagcctcaaactcctagact

SEQ ID NO: 281667 - DNA, 20 bp, Artificial Sequence
  Description of Artificial Sequence: Synthetic oligonucleotide
  Target: ATXN1; (+) strand; PAM type: YTN; PAM sequence: CTC
aaactcctagactcaagtga

SEQ ID NO: 281668 - DNA, 20 bp, Artificial Sequence
  Description of Artificial Sequence: Synthetic oligonucleotide
  Target: ATXN1; (+) strand; PAM type: YTN; PAM sequence: CTC
ctagactcaagtgatcctcc

SEQ ID NO: 281669 - DNA, 20 bp, Artificial Sequence
  Description of Artificial Sequence: Synthetic oligonucleotide
  Target: ATXN1; (+) strand; PAM type: YTN; PAM sequence: CTA
gactcaagtgatcctcctac

SEQ ID NO: 281670 - DNA, 20 bp, Artificial Sequence
  Description of Artificial Sequence: Synthetic oligonucleotide
  Target: ATXN1; (+) strand; PAM type: YTN; PAM sequence: CTC
aagtgatcctcctacataag

SEQ ID NO: 281671 - DNA, 20 bp, Artificial Sequence
  Description of Artificial Sequence: Synthetic oligonucleotide
  Target: ATXN1; (+) strand; PAM type: YTN; PAM sequence: CTC
ctacataagcctcccaagta

SEQ ID NO: 281672 - DNA, 20 bp, Artificial Sequence
  Description of Artificial Sequence: Synthetic oligonucleotide
  Target: ATXN1; (+) strand; PAM type: YTN; PAM sequence: CTA
cataagcctcccaagtagct

SEQ ID NO: 281673 - DNA, 20 bp, Artificial Sequence
  Description of Artificial Sequence: Synthetic oligonucleotide
  Target: ATXN1; (+) strand; PAM type: YTN; PAM sequence: CTC
ccaagtagctaggactacag

SEQ ID NO: 281674 - DNA, 20 bp, Artificial Sequence
  Description of Artificial Sequence: Synthetic oligonucleotide
  Target: ATXN1; (+) strand; PAM type: YTN; PAM sequence: CTA
ggactacaggctcatgccac

SEQ ID NO: 281675 - DNA, 20 bp, Artificial Sequence
  Description of Artificial Sequence: Synthetic oligonucleotide
  Target: ATXN1; (+) strand; PAM type: YTN; PAM sequence: CTA
caggctcatgccaccatgct

SEQ ID NO: 281676 - DNA, 20 bp, Artificial Sequence
  Description of Artificial Sequence: Synthetic oligonucleotide
  Target: ATXN1; (+) strand; PAM type: YTN; PAM sequence: CTC
atgccaccatgctcagctaa

SEQ ID NO: 281677 - DNA, 20 bp, Artificial Sequence
  Description of Artificial Sequence: Synthetic oligonucleotide
  Target: ATXN1; (+) strand; PAM type: YTN; PAM sequence: CTC
agctaagttttaaatttttt

SEQ ID NO: 281678 - DNA, 20 bp, Artificial Sequence
  Description of Artificial Sequence: Synthetic oligonucleotide
  Target: ATXN1; (+) strand; PAM type: YTN; PAM sequence: CTA
agttttaaattttttttgta

SEQ ID NO: 281679 - DNA, 20 bp, Artificial Sequence
  Description of Artificial Sequence: Synthetic oligonucleotide
  Target: ATXN1; (+) strand; PAM type: YTN; PAM sequence: TTT
taaattttttttgtagagat

SEQ ID NO: 281680 - DNA, 20 bp, Artificial Sequence
  Description of Artificial Sequence: Synthetic oligonucleotide
  Target: ATXN1; (+) strand; PAM type: YTN; PAM sequence: TTT
aaattttttttgtagagata

SEQ ID NO: 281681 - DNA, 20 bp, Artificial Sequence
  Description of Artificial Sequence: Synthetic oligonucleotide
  Target: ATXN1; (+) strand; PAM type: YTN; PAM sequence: TTA
aattttttttgtagagatag

SEQ ID NO: 281682 - DNA, 20 bp, Artificial Sequence
  Description of Artificial Sequence: Synthetic oligonucleotide
  Target: ATXN1; (+) strand; PAM type: YTN; PAM sequence: TTT
tttttgtagagatagggtct

SEQ ID NO: 281683 - DNA, 20 bp, Artificial Sequence
  Description of Artificial Sequence: Synthetic oligonucleotide
  Target: ATXN1; (+) strand; PAM type: YTN; PAM sequence: TTT
ttttgtagagatagggtctc

SEQ ID NO: 281684 - DNA, 20 bp, Artificial Sequence
  Description of Artificial Sequence: Synthetic oligonucleotide
  Target: ATXN1; (+) strand; PAM type: YTN; PAM sequence: TTT
tttgtagagatagggtctca

SEQ ID NO: 281685 - DNA, 20 bp, Artificial Sequence
  Description of Artificial Sequence: Synthetic oligonucleotide
  Target: ATXN1; (+) strand; PAM type: YTN; PAM sequence: TTT
ttgtagagatagggtctcac

SEQ ID NO: 281686 - DNA, 20 bp, Artificial Sequence
  Description of Artificial Sequence: Synthetic oligonucleotide
  Target: ATXN1; (+) strand; PAM type: YTN; PAM sequence: TTT
tgtagagatagggtctcact

SEQ ID NO: 281687 - DNA, 20 bp, Artificial Sequence
  Description of Artificial Sequence: Synthetic oligonucleotide
  Target: ATXN1; (+) strand; PAM type: YTN; PAM sequence: TTT
gtagagatagggtctcacta

SEQ ID NO: 281688 - DNA, 20 bp, Artificial Sequence
  Description of Artificial Sequence: Synthetic oligonucleotide
  Target: ATXN1; (+) strand; PAM type: YTN; PAM sequence: TTG
tagagatagggtctcactac

SEQ ID NO: 281689 - DNA, 20 bp, Artificial Sequence
  Description of Artificial Sequence: Synthetic oligonucleotide
  Target: ATXN1; (+) strand; PAM type: YTN; PAM sequence: CTC
actacgctgtccaggctggt

SEQ ID NO: 281690 - DNA, 20 bp, Artificial Sequence
  Description of Artificial Sequence: Synthetic oligonucleotide
  Target: ATXN1; (+) strand; PAM type: YTN; PAM sequence: CTA
cgctgtccaggctggtctca

SEQ ID NO: 281691 - DNA, 20 bp, Artificial Sequence
  Description of Artificial Sequence: Synthetic oligonucleotide
  Target: ATXN1; (+) strand; PAM type: YTN; PAM sequence: CTG
tccaggctggtctcaaactc

SEQ ID NO: 281692 - DNA, 20 bp, Artificial Sequence
  Description of Artificial Sequence: Synthetic oligonucleotide
  Target: ATXN1; (+) strand; PAM type: YTN; PAM sequence: CTG
gtctcaaactcgtggcttca

SEQ ID NO: 281693 - DNA, 20 bp, Artificial Sequence
  Description of Artificial Sequence: Synthetic oligonucleotide
  Target: ATXN1; (+) strand; PAM type: YTN; PAM sequence: CTC
aaactcgtggcttcaagtga

SEQ ID NO: 281694 - DNA, 20 bp, Artificial Sequence
  Description of Artificial Sequence: Synthetic oligonucleotide
  Target: ATXN1; (+) strand; PAM type: YTN; PAM sequence: CTC
gtggcttcaagtgatccttc

SEQ ID NO: 281695 - DNA, 20 bp, Artificial Sequence
  Description of Artificial Sequence: Synthetic oligonucleotide
  Target: ATXN1; (+) strand; PAM type: YTN; PAM sequence: CTT
caagtgatccttccacctca

SEQ ID NO: 281696 - DNA, 20 bp, Artificial Sequence
  Description of Artificial Sequence: Synthetic oligonucleotide
  Target: ATXN1; (+) strand; PAM type: YTN; PAM sequence: TTC
aagtgatccttccacctcag

SEQ ID NO: 281697 - DNA, 20 bp, Artificial Sequence
  Description of Artificial Sequence: Synthetic oligonucleotide
  Target: ATXN1; (+) strand; PAM type: YTN; PAM sequence: CTT
ccacctcagccccccaaagt

SEQ ID NO: 281698 - DNA, 20 bp, Artificial Sequence
  Description of Artificial Sequence: Synthetic oligonucleotide
  Target: ATXN1; (+) strand; PAM type: YTN; PAM sequence: TTC
cacctcagccccccaaagtg

SEQ ID NO: 281699 - DNA, 20 bp, Artificial Sequence
  Description of Artificial Sequence: Synthetic oligonucleotide
  Target: ATXN1; (+) strand; PAM type: YTN; PAM sequence: CTC
agccccccaaagtgctggga

SEQ ID NO: 281700 - DNA, 20 bp, Artificial Sequence
  Description of Artificial Sequence: Synthetic oligonucleotide
  Target: ATXN1; (+) strand; PAM type: YTN; PAM sequence: CTG
ggattgcaggggtgagccat

SEQ ID NO: 281701 - DNA, 20 bp, Artificial Sequence
  Description of Artificial Sequence: Synthetic oligonucleotide
  Target: ATXN1; (+) strand; PAM type: YTN; PAM sequence: TTG
caggggtgagccatcacgtt

SEQ ID NO: 281702 - DNA, 20 bp, Artificial Sequence
  Description of Artificial Sequence: Synthetic oligonucleotide
  Target: ATXN1; (+) strand; PAM type: YTN; PAM sequence: TTC
agcctctttctaaattctac

SEQ ID NO: 281703 - DNA, 20 bp, Artificial Sequence
  Description of Artificial Sequence: Synthetic oligonucleotide
  Target: ATXN1; (+) strand; PAM type: YTN; PAM sequence: CTC
tttctaaattctacaaaaaa

SEQ ID NO: 281704 - DNA, 20 bp, Artificial Sequence
  Description of Artificial Sequence: Synthetic oligonucleotide
  Target: ATXN1; (+) strand; PAM type: YTN; PAM sequence: CTT
tctaaattctacaaaaaaac

SEQ ID NO: 281705 - DNA, 20 bp, Artificial Sequence
  Description of Artificial Sequence: Synthetic oligonucleotide
  Target: ATXN1; (+) strand; PAM type: YTN; PAM sequence: TTT
ctaaattctacaaaaaaaca

SEQ ID NO: 281706 - DNA, 20 bp, Artificial Sequence
  Description of Artificial Sequence: Synthetic oligonucleotide
  Target: ATXN1; (+) strand; PAM type: YTN; PAM sequence: TTC
taaattctacaaaaaaacat

SEQ ID NO: 281707 - DNA, 20 bp, Artificial Sequence
  Description of Artificial Sequence: Synthetic oligonucleotide
  Target: ATXN1; (+) strand; PAM type: YTN; PAM sequence: CTA
aattctacaaaaaaacatgc

SEQ ID NO: 281708 - DNA, 20 bp, Artificial Sequence
  Description of Artificial Sequence: Synthetic oligonucleotide
  Target: ATXN1; (+) strand; PAM type: YTN; PAM sequence: TTC
tacaaaaaaacatgcattca

SEQ ID NO: 281709 - DNA, 20 bp, Artificial Sequence
  Description of Artificial Sequence: Synthetic oligonucleotide
  Target: ATXN1; (+) strand; PAM type: YTN; PAM sequence: CTA
caaaaaaacatgcattcata

SEQ ID NO: 281710 - DNA, 20 bp, Artificial Sequence
  Description of Artificial Sequence: Synthetic oligonucleotide
  Target: ATXN1; (+) strand; PAM type: YTN; PAM sequence: TTC
atattatatcgtgcaatgct

SEQ ID NO: 281711 - DNA, 20 bp, Artificial Sequence
  Description of Artificial Sequence: Synthetic oligonucleotide
  Target: ATXN1; (+) strand; PAM type: YTN; PAM sequence: TTA
tatcgtgcaatgctatgtaa

SEQ ID NO: 281712 - DNA, 20 bp, Artificial Sequence
  Description of Artificial Sequence: Synthetic oligonucleotide
  Target: ATXN1; (+) strand; PAM type: YTN; PAM sequence: CTA
tgtaagtcatgttttagata

SEQ ID NO: 281713 - DNA, 20 bp, Artificial Sequence
  Description of Artificial Sequence: Synthetic oligonucleotide
  Target: ATXN1; (+) strand; PAM type: YTN; PAM sequence: TTT
tagatatgccatggccggtt

SEQ ID NO: 281714 - DNA, 20 bp, Artificial Sequence
  Description of Artificial Sequence: Synthetic oligonucleotide
  Target: ATXN1; (+) strand; PAM type: YTN; PAM sequence: TTT
agatatgccatggccggttc

SEQ ID NO: 281715 - DNA, 20 bp, Artificial Sequence
  Description of Artificial Sequence: Synthetic oligonucleotide
  Target: ATXN1; (+) strand; PAM type: YTN; PAM sequence: TTA
gatatgccatggccggttcc

SEQ ID NO: 281716 - DNA, 20 bp, Artificial Sequence
  Description of Artificial Sequence: Synthetic oligonucleotide
  Target: ATXN1; (+) strand; PAM type: YTN; PAM sequence: TTC
ctattccatggggagttctc

SEQ ID NO: 281717 - DNA, 20 bp, Artificial Sequence
  Description of Artificial Sequence: Synthetic oligonucleotide
  Target: ATXN1; (+) strand; PAM type: YTN; PAM sequence: CTA
ttccatggggagttctcagc

SEQ ID NO: 281718 - DNA, 20 bp, Artificial Sequence
  Description of Artificial Sequence: Synthetic oligonucleotide
  Target: ATXN1; (+) strand; PAM type: YTN; PAM sequence: TTC
catggggagttctcagcatc

SEQ ID NO: 281719 - DNA, 20 bp, Artificial Sequence
  Description of Artificial Sequence: Synthetic oligonucleotide
  Target: ATXN1; (+) strand; PAM type: YTN; PAM sequence: TTC
tcagcatcataaaggtattt

SEQ ID NO: 281720 - DNA, 20 bp, Artificial Sequence
  Description of Artificial Sequence: Synthetic oligonucleotide
  Target: ATXN1; (+) strand; PAM type: YTN; PAM sequence: CTC
agcatcataaaggtatttga

SEQ ID NO: 281721 - DNA, 20 bp, Artificial Sequence
  Description of Artificial Sequence: Synthetic oligonucleotide
  Target: ATXN1; (+) strand; PAM type: YTN; PAM sequence: TTT
gaagtttaagtctacatgtt

SEQ ID NO: 281722 - DNA, 20 bp, Artificial Sequence
  Description of Artificial Sequence: Synthetic oligonucleotide
  Target: ATXN1; (+) strand; PAM type: YTN; PAM sequence: TTG
aagtttaagtctacatgttg

SEQ ID NO: 281723 - DNA, 20 bp, Artificial Sequence
  Description of Artificial Sequence: Synthetic oligonucleotide
  Target: ATXN1; (+) strand; PAM type: YTN; PAM sequence: TTT
aagtctacatgttgtaaagg

SEQ ID NO: 281724 - DNA, 20 bp, Artificial Sequence
  Description of Artificial Sequence: Synthetic oligonucleotide
  Target: ATXN1; (+) strand; PAM type: YTN; PAM sequence: TTA
agtctacatgttgtaaaggt

SEQ ID NO: 281725 - DNA, 20 bp, Artificial Sequence
  Description of Artificial Sequence: Synthetic oligonucleotide
  Target: ATXN1; (+) strand; PAM type: YTN; PAM sequence: CTA
catgttgtaaaggtgatgct

SEQ ID NO: 281726 - DNA, 20 bp, Artificial Sequence
  Description of Artificial Sequence: Synthetic oligonucleotide
  Target: ATXN1; (+) strand; PAM type: YTN; PAM sequence: TTG
taaaggtgatgctcaatgct

SEQ ID NO: 281727 - DNA, 20 bp, Artificial Sequence
  Description of Artificial Sequence: Synthetic oligonucleotide
  Target: ATXN1; (+) strand; PAM type: YTN; PAM sequence: CTC
aatgctcaattctcagacta

SEQ ID NO: 281728 - DNA, 20 bp, Artificial Sequence
  Description of Artificial Sequence: Synthetic oligonucleotide
  Target: ATXN1; (+) strand; PAM type: YTN; PAM sequence: CTC
aattctcagactagaaccag

SEQ ID NO: 281729 - DNA, 20 bp, Artificial Sequence
  Description of Artificial Sequence: Synthetic oligonucleotide
  Target: ATXN1; (+) strand; PAM type: YTN; PAM sequence: TTC
tcagactagaaccagaactt

SEQ ID NO: 281730 - DNA, 20 bp, Artificial Sequence
  Description of Artificial Sequence: Synthetic oligonucleotide
  Target: ATXN1; (+) strand; PAM type: YTN; PAM sequence: CTC
agactagaaccagaacttcc

SEQ ID NO: 281731 - DNA, 20 bp, Artificial Sequence
  Description of Artificial Sequence: Synthetic oligonucleotide
  Target: ATXN1; (+) strand; PAM type: YTN; PAM sequence: CTA
gaaccagaacttccacaatt

SEQ ID NO: 281732 - DNA, 20 bp, Artificial Sequence
  Description of Artificial Sequence: Synthetic oligonucleotide
  Target: ATXN1; (+) strand; PAM type: YTN; PAM sequence: CTT
ccacaatttcatatttttaa

SEQ ID NO: 281733 - DNA, 20 bp, Artificial Sequence
  Description of Artificial Sequence: Synthetic oligonucleotide
  Target: ATXN1; (+) strand; PAM type: YTN; PAM sequence: TTC
cacaatttcatatttttaag

SEQ ID NO: 281734 - DNA, 20 bp, Artificial Sequence
  Description of Artificial Sequence: Synthetic oligonucleotide
  Target: ATXN1; (+) strand; PAM type: YTN; PAM sequence: TTT
catatttttaagaatatcaa

SEQ ID NO: 281735 - DNA, 20 bp, Artificial Sequence
  Description of Artificial Sequence: Synthetic oligonucleotide
  Target: ATXN1; (+) strand; PAM type: YTN; PAM sequence: TTC
atatttttaagaatatcaag

SEQ ID NO: 281736 - DNA, 20 bp, Artificial Sequence
  Description of Artificial Sequence: Synthetic oligonucleotide
  Target: ATXN1; (+) strand; PAM type: YTN; PAM sequence: TTT
ttaagaatatcaagcaactt

SEQ ID NO: 281737 - DNA, 20 bp, Artificial Sequence
  Description of Artificial Sequence: Synthetic oligonucleotide
  Target: ATXN1; (+) strand; PAM type: YTN; PAM sequence: TTT
taagaatatcaagcaacttc

SEQ ID NO: 281738 - DNA, 20 bp, Artificial Sequence
  Description of Artificial Sequence: Synthetic oligonucleotide
  Target: ATXN1; (+) strand; PAM type: YTN; PAM sequence: TTT
aagaatatcaagcaacttcc

SEQ ID NO: 281739 - DNA, 20 bp, Artificial Sequence
  Description of Artificial Sequence: Synthetic oligonucleotide
  Target: ATXN1; (+) strand; PAM type: YTN; PAM sequence: TTA
agaatatcaagcaacttcca

SEQ ID NO: 281740 - DNA, 20 bp, Artificial Sequence
  Description of Artificial Sequence: Synthetic oligonucleotide
  Target: ATXN1; (+) strand; PAM type: YTN; PAM sequence: CTT
ccacttacaattaactataa

SEQ ID NO: 281741 - DNA, 20 bp, Artificial Sequence
  Description of Artificial Sequence: Synthetic oligonucleotide
  Target: ATXN1; (+) strand; PAM type: YTN; PAM sequence: TTC
cacttacaattaactataaa

SEQ ID NO: 281742 - DNA, 20 bp, Artificial Sequence
  Description of Artificial Sequence: Synthetic oligonucleotide
  Target: ATXN1; (+) strand; PAM type: YTN; PAM sequence: CTT
acaattaactataaaaaggg

SEQ ID NO: 281743 - DNA, 20 bp, Artificial Sequence
  Description of Artificial Sequence: Synthetic oligonucleotide
  Target: ATXN1; (+) strand; PAM type: YTN; PAM sequence: TTA
caattaactataaaaagggt

SEQ ID NO: 281744 - DNA, 20 bp, Artificial Sequence
  Description of Artificial Sequence: Synthetic oligonucleotide
  Target: ATXN1; (+) strand; PAM type: YTN; PAM sequence: TTA
actataaaaagggttaattt

SEQ ID NO: 281745 - DNA, 20 bp, Artificial Sequence
  Description of Artificial Sequence: Synthetic oligonucleotide
  Target: ATXN1; (+) strand; PAM type: YTN; PAM sequence: CTA
taaaaagggttaattttctc

SEQ ID NO: 281746 - DNA, 20 bp, Artificial Sequence
  Description of Artificial Sequence: Synthetic oligonucleotide
  Target: ATXN1; (+) strand; PAM type: YTN; PAM sequence: TTA
attttctcctcagttgccta

SEQ ID NO: 281747 - DNA, 20 bp, Artificial Sequence
  Description of Artificial Sequence: Synthetic oligonucleotide
  Target: ATXN1; (+) strand; PAM type: YTN; PAM sequence: TTT
tctcctcagttgcctattgt

SEQ ID NO: 281748 - DNA, 20 bp, Artificial Sequence
  Description of Artificial Sequence: Synthetic oligonucleotide
  Target: ATXN1; (+) strand; PAM type: YTN; PAM sequence: TTT
ctcctcagttgcctattgtc

SEQ ID NO: 281749 - DNA, 20 bp, Artificial Sequence
  Description of Artificial Sequence: Synthetic oligonucleotide
  Target: ATXN1; (+) strand; PAM type: YTN; PAM sequence: TTC
tcctcagttgcctattgtca

SEQ ID NO: 281750 - DNA, 20 bp, Artificial Sequence
  Description of Artificial Sequence: Synthetic oligonucleotide
  Target: ATXN1; (+) strand; PAM type: YTN; PAM sequence: CTC
ctcagttgcctattgtcaat

SEQ ID NO: 281751 - DNA, 20 bp, Artificial Sequence
  Description of Artificial Sequence: Synthetic oligonucleotide
  Target: ATXN1; (+) strand; PAM type: YTN; PAM sequence: CTC
agttgcctattgtcaataaa

SEQ ID NO: 281752 - DNA, 20 bp, Artificial Sequence
  Description of Artificial Sequence: Synthetic oligonucleotide
  Target: ATXN1; (+) strand; PAM type: YTN; PAM sequence: TTG
cctattgtcaataaaatgtt

SEQ ID NO: 281753 - DNA, 20 bp, Artificial Sequence
  Description of Artificial Sequence: Synthetic oligonucleotide
  Target: ATXN1; (+) strand; PAM type: YTN; PAM sequence: CTA
ttgtcaataaaatgtttact

SEQ ID NO: 281754 - DNA, 20 bp, Artificial Sequence
  Description of Artificial Sequence: Synthetic oligonucleotide
  Target: ATXN1; (+) strand; PAM type: YTN; PAM sequence: TTG
tcaataaaatgtttacttgg

SEQ ID NO: 281755 - DNA, 20 bp, Artificial Sequence
  Description of Artificial Sequence: Synthetic oligonucleotide
  Target: ATXN1; (+) strand; PAM type: YTN; PAM sequence: TTT
acttggcctaatgaccgact

SEQ ID NO: 281756 - DNA, 20 bp, Artificial Sequence
  Description of Artificial Sequence: Synthetic oligonucleotide
  Target: ATXN1; (+) strand; PAM type: YTN; PAM sequence: TTA
cttggcctaatgaccgactg

SEQ ID NO: 281757 - DNA, 20 bp, Artificial Sequence
  Description of Artificial Sequence: Synthetic oligonucleotide
  Target: ATXN1; (+) strand; PAM type: YTN; PAM sequence: CTT
ggcctaatgaccgactgata

SEQ ID NO: 281758 - DNA, 20 bp, Artificial Sequence
  Description of Artificial Sequence: Synthetic oligonucleotide
  Target: ATXN1; (+) strand; PAM type: YTN; PAM sequence: TTG
gcctaatgaccgactgatac

SEQ ID NO: 281759 - DNA, 20 bp, Artificial Sequence
  Description of Artificial Sequence: Synthetic oligonucleotide
  Target: ATXN1; (+) strand; PAM type: YTN; PAM sequence: CTA
atgaccgactgataccaaaa

SEQ ID NO: 281760 - DNA, 20 bp, Artificial Sequence
  Description of Artificial Sequence: Synthetic oligonucleotide
  Target: ATXN1; (+) strand; PAM type: YTN; PAM sequence: CTG
ataccaaaaaaggtataagg

SEQ ID NO: 281761 - DNA, 20 bp, Artificial Sequence
  Description of Artificial Sequence: Synthetic oligonucleotide
  Target: ATXN1; (+) strand; PAM type: YTN; PAM sequence: CTC
aactgttaagaaacaatgat

SEQ ID NO: 281762 - DNA, 20 bp, Artificial Sequence
  Description of Artificial Sequence: Synthetic oligonucleotide
  Target: ATXN1; (+) strand; PAM type: YTN; PAM sequence: CTG
ttaagaaacaatgatgtata

SEQ ID NO: 281763 - DNA, 20 bp, Artificial Sequence
  Description of Artificial Sequence: Synthetic oligonucleotide
  Target: ATXN1; (+) strand; PAM type: YTN; PAM sequence: TTA
agaaacaatgatgtataatg

SEQ ID NO: 281764 - DNA, 20 bp, Artificial Sequence
  Description of Artificial Sequence: Synthetic oligonucleotide
  Target: ATXN1; (+) strand; PAM type: YTN; PAM sequence: TTG
actgagaaagggacggagat

SEQ ID NO: 281765 - DNA, 20 bp, Artificial Sequence
  Description of Artificial Sequence: Synthetic oligonucleotide
  Target: ATXN1; (+) strand; PAM type: YTN; PAM sequence: CTG
agaaagggacggagatcttc

SEQ ID NO: 281766 - DNA, 20 bp, Artificial Sequence
  Description of Artificial Sequence: Synthetic oligonucleotide
  Target: ATXN1; (+) strand; PAM type: YTN; PAM sequence: CTT
cgaagaccttcaaaacataa

SEQ ID NO: 281767 - DNA, 20 bp, Artificial Sequence
  Description of Artificial Sequence: Synthetic oligonucleotide
  Target: ATXN1; (+) strand; PAM type: YTN; PAM sequence: TTC
gaagaccttcaaaacataaa

SEQ ID NO: 281768 - DNA, 20 bp, Artificial Sequence
  Description of Artificial Sequence: Synthetic oligonucleotide
  Target: ATXN1; (+) strand; PAM type: YTN; PAM sequence: CTT
caaaacataaatctgattac

SEQ ID NO: 281769 - DNA, 20 bp, Artificial Sequence
  Description of Artificial Sequence: Synthetic oligonucleotide
  Target: ATXN1; (+) strand; PAM type: YTN; PAM sequence: TTC
aaaacataaatctgattact

SEQ ID NO: 281770 - DNA, 20 bp, Artificial Sequence
  Description of Artificial Sequence: Synthetic oligonucleotide
  Target: ATXN1; (+) strand; PAM type: YTN; PAM sequence: CTG
attactgccacccataatca

SEQ ID NO: 281771 - DNA, 20 bp, Artificial Sequence
  Description of Artificial Sequence: Synthetic oligonucleotide
  Target: ATXN1; (+) strand; PAM type: YTN; PAM sequence: TTA
ctgccacccataatcaaatg

SEQ ID NO: 281772 - DNA, 20 bp, Artificial Sequence
  Description of Artificial Sequence: Synthetic oligonucleotide
  Target: ATXN1; (+) strand; PAM type: YTN; PAM sequence: CTG
ccacccataatcaaatgtgt

SEQ ID NO: 281773 - DNA, 20 bp, Artificial Sequence
  Description of Artificial Sequence: Synthetic oligonucleotide
  Target: ATXN1; (+) strand; PAM type: YTN; PAM sequence: CTA
agtcttccacaggtgaatac

SEQ ID NO: 281774 - DNA, 20 bp, Artificial Sequence
  Description of Artificial Sequence: Synthetic oligonucleotide
  Target: ATXN1; (+) strand; PAM type: YTN; PAM sequence: CTT
ccacaggtgaatacacctac

SEQ ID NO: 281775 - DNA, 20 bp, Artificial Sequence
  Description of Artificial Sequence: Synthetic oligonucleotide
  Target: ATXN1; (+) strand; PAM type: YTN; PAM sequence: TTC
cacaggtgaatacacctacg

SEQ ID NO: 281776 - DNA, 20 bp, Artificial Sequence
  Description of Artificial Sequence: Synthetic oligonucleotide
  Target: ATXN1; (+) strand; PAM type: YTN; PAM sequence: CTA
cggttctgcccctgaaccgc

SEQ ID NO: 281777 - DNA, 20 bp, Artificial Sequence
  Description of Artificial Sequence: Synthetic oligonucleotide
  Target: ATXN1; (+) strand; PAM type: YTN; PAM sequence: TTC
tgcccctgaaccgcaaggcc

SEQ ID NO: 281778 - DNA, 20 bp, Artificial Sequence
  Description of Artificial Sequence: Synthetic oligonucleotide
  Target: ATXN1; (+) strand; PAM type: YTN; PAM sequence: CTG
cccctgaaccgcaaggccat

SEQ ID NO: 281779 - DNA, 20 bp, Artificial Sequence
  Description of Artificial Sequence: Synthetic oligonucleotide
  Target: ATXN1; (+) strand; PAM type: YTN; PAM sequence: CTG
aaccgcaaggccatacctcc

SEQ ID NO: 281780 - DNA, 20 bp, Artificial Sequence
  Description of Artificial Sequence: Synthetic oligonucleotide
  Target: ATXN1; (+) strand; PAM type: YTN; PAM sequence: CTC
cccaagactgactctgtgag

SEQ ID NO: 281781 - DNA, 20 bp, Artificial Sequence
  Description of Artificial Sequence: Synthetic oligonucleotide
  Target: ATXN1; (+) strand; PAM type: YTN; PAM sequence: CTG
actctgtgagggctaacagg

SEQ ID NO: 281782 - DNA, 20 bp, Artificial Sequence
  Description of Artificial Sequence: Synthetic oligonucleotide
  Target: ATXN1; (+) strand; PAM type: YTN; PAM sequence: CTC
tgtgagggctaacaggctat

SEQ ID NO: 281783 - DNA, 20 bp, Artificial Sequence
  Description of Artificial Sequence: Synthetic oligonucleotide
  Target: ATXN1; (+) strand; PAM type: YTN; PAM sequence: CTG
tgagggctaacaggctataa

SEQ ID NO: 281784 - DNA, 20 bp, Artificial Sequence
  Description of Artificial Sequence: Synthetic oligonucleotide
  Target: ATXN1; (+) strand; PAM type: YTN; PAM sequence: CTA
acaggctataattgctgaca

SEQ ID NO: 281785 - DNA, 20 bp, Artificial Sequence
  Description of Artificial Sequence: Synthetic oligonucleotide
  Target: ATXN1; (+) strand; PAM type: YTN; PAM sequence: CTA
taattgctgacagggaggtt

SEQ ID NO: 281786 - DNA, 20 bp, Artificial Sequence
  Description of Artificial Sequence: Synthetic oligonucleotide
  Target: ATXN1; (+) strand; PAM type: YTN; PAM sequence: TTG
ctgacagggaggttttcagc

SEQ ID NO: 281787 - DNA, 20 bp, Artificial Sequence
  Description of Artificial Sequence: Synthetic oligonucleotide
  Target: ATXN1; (+) strand; PAM type: YTN; PAM sequence: CTG
acagggaggttttcagcttg

SEQ ID NO: 281788 - DNA, 20 bp, Artificial Sequence
  Description of Artificial Sequence: Synthetic oligonucleotide
  Target: ATXN1; (+) strand; PAM type: YTN; PAM sequence: TTT
tcagcttgtcatagagataa

SEQ ID NO: 281789 - DNA, 20 bp, Artificial Sequence
  Description of Artificial Sequence: Synthetic oligonucleotide
  Target: ATXN1; (+) strand; PAM type: YTN; PAM sequence: TTT
cagcttgtcatagagataaa

SEQ ID NO: 281790 - DNA, 20 bp, Artificial Sequence
  Description of Artificial Sequence: Synthetic oligonucleotide
  Target: ATXN1; (+) strand; PAM type: YTN; PAM sequence: TTC
agcttgtcatagagataaaa

SEQ ID NO: 281791 - DNA, 20 bp, Artificial Sequence
  Description of Artificial Sequence: Synthetic oligonucleotide
  Target: ATXN1; (+) strand; PAM type: YTN; PAM sequence: CTT
gtcatagagataaaaaaata

SEQ ID NO: 281792 - DNA, 20 bp, Artificial Sequence
  Description of Artificial Sequence: Synthetic oligonucleotide
  Target: ATXN1; (+) strand; PAM type: YTN; PAM sequence: TTG
tcatagagataaaaaaatat

SEQ ID NO: 281793 - DNA, 20 bp, Artificial Sequence
  Description of Artificial Sequence: Synthetic oligonucleotide
  Target: ATXN1; (+) strand; PAM type: YTN; PAM sequence: TTA
ttcttgagtaataagtggaa

SEQ ID NO: 281794 - DNA, 20 bp, Artificial Sequence
  Description of Artificial Sequence: Synthetic oligonucleotide
  Target: ATXN1; (+) strand; PAM type: YTN; PAM sequence: TTC
ttgagtaataagtggaaatt

SEQ ID NO: 281795 - DNA, 20 bp, Artificial Sequence
  Description of Artificial Sequence: Synthetic oligonucleotide
  Target: ATXN1; (+) strand; PAM type: YTN; PAM sequence: CTT
gagtaataagtggaaattcg

SEQ ID NO: 281796 - DNA, 20 bp, Artificial Sequence
  Description of Artificial Sequence: Synthetic oligonucleotide
  Target: ATXN1; (+) strand; PAM type: YTN; PAM sequence: TTG
agtaataagtggaaattcgt

SEQ ID NO: 281797 - DNA, 20 bp, Artificial Sequence
  Description of Artificial Sequence: Synthetic oligonucleotide
  Target: ATXN1; (+) strand; PAM type: YTN; PAM sequence: TTC
gtgaaataagtgatgaaaac

SEQ ID NO: 281798 - DNA, 20 bp, Artificial Sequence
  Description of Artificial Sequence: Synthetic oligonucleotide
  Target: ATXN1; (+) strand; PAM type: YTN; PAM sequence: CTA
cagaaaccctttcctaccca

SEQ ID NO: 281799 - DNA, 20 bp, Artificial Sequence
  Description of Artificial Sequence: Synthetic oligonucleotide
  Target: ATXN1; (+) strand; PAM type: YTN; PAM sequence: CTT
tcctacccaacacagagtga

SEQ ID NO: 281800 - DNA, 20 bp, Artificial Sequence
  Description of Artificial Sequence: Synthetic oligonucleotide
  Target: ATXN1; (+) strand; PAM type: YTN; PAM sequence: TTT
cctacccaacacagagtgag

SEQ ID NO: 281801 - DNA, 20 bp, Artificial Sequence
  Description of Artificial Sequence: Synthetic oligonucleotide
  Target: ATXN1; (+) strand; PAM type: YTN; PAM sequence: TTC
ctacccaacacagagtgaga

SEQ ID NO: 281802 - DNA, 20 bp, Artificial Sequence
  Description of Artificial Sequence: Synthetic oligonucleotide
  Target: ATXN1; (+) strand; PAM type: YTN; PAM sequence: CTA
cccaacacagagtgagacac

SEQ ID NO: 281803 - DNA, 20 bp, Artificial Sequence
  Description of Artificial Sequence: Synthetic oligonucleotide
  Target: ATXN1; (+) strand; PAM type: YTN; PAM sequence: CTT
cagggtgtgctcactaggtg

SEQ ID NO: 281804 - DNA, 20 bp, Artificial Sequence
  Description of Artificial Sequence: Synthetic oligonucleotide
  Target: ATXN1; (+) strand; PAM type: YTN; PAM sequence: TTC
agggtgtgctcactaggtga

SEQ ID NO: 281805 - DNA, 20 bp, Artificial Sequence
  Description of Artificial Sequence: Synthetic oligonucleotide
  Target: ATXN1; (+) strand; PAM type: YTN; PAM sequence: CTC
actaggtgatattatctacg

SEQ ID NO: 281806 - DNA, 20 bp, Artificial Sequence
  Description of Artificial Sequence: Synthetic oligonucleotide
  Target: ATXN1; (+) strand; PAM type: YTN; PAM sequence: CTA
ggtgatattatctacgttga

SEQ ID NO: 281807 - DNA, 20 bp, Artificial Sequence
  Description of Artificial Sequence: Synthetic oligonucleotide
  Target: ATXN1; (+) strand; PAM type: YTN; PAM sequence: TTA
tctacgttgaaaagacatgg

SEQ ID NO: 281808 - DNA, 20 bp, Artificial Sequence
  Description of Artificial Sequence: Synthetic oligonucleotide
  Target: ATXN1; (+) strand; PAM type: YTN; PAM sequence: CTA
cgttgaaaagacatggtacc

SEQ ID NO: 281809 - DNA, 20 bp, Artificial Sequence
  Description of Artificial Sequence: Synthetic oligonucleotide
  Target: ATXN1; (+) strand; PAM type: YTN; PAM sequence: TTG
aaaagacatggtacctgaag

SEQ ID NO: 281810 - DNA, 20 bp, Artificial Sequence
  Description of Artificial Sequence: Synthetic oligonucleotide
  Target: ATXN1; (+) strand; PAM type: YTN; PAM sequence: CTG
aagatcaagagtttgaggtt

SEQ ID NO: 281811 - DNA, 20 bp, Artificial Sequence
  Description of Artificial Sequence: Synthetic oligonucleotide
  Target: ATXN1; (+) strand; PAM type: YTN; PAM sequence: TTT
gaggtttaagcatgcataca

SEQ ID NO: 281812 - DNA, 20 bp, Artificial Sequence
  Description of Artificial Sequence: Synthetic oligonucleotide
  Target: ATXN1; (+) strand; PAM type: YTN; PAM sequence: TTG
aggtttaagcatgcatacac

SEQ ID NO: 281813 - DNA, 20 bp, Artificial Sequence
  Description of Artificial Sequence: Synthetic oligonucleotide
  Target: ATXN1; (+) strand; PAM type: YTN; PAM sequence: TTT
aagcatgcatacactttttc

SEQ ID NO: 281814 - DNA, 20 bp, Artificial Sequence
  Description of Artificial Sequence: Synthetic oligonucleotide
  Target: ATXN1; (+) strand; PAM type: YTN; PAM sequence: TTA
agcatgcatacactttttct

SEQ ID NO: 281815 - DNA, 20 bp, Artificial Sequence
  Description of Artificial Sequence: Synthetic oligonucleotide
  Target: ATXN1; (+) strand; PAM type: YTN; PAM sequence: CTT
tttctgttttttcttctata

SEQ ID NO: 281816 - DNA, 20 bp, Artificial Sequence
  Description of Artificial Sequence: Synthetic oligonucleotide
  Target: ATXN1; (+) strand; PAM type: YTN; PAM sequence: TTT
ttctgttttttcttctataa

SEQ ID NO: 281817 - DNA, 20 bp, Artificial Sequence
  Description of Artificial Sequence: Synthetic oligonucleotide
  Target: ATXN1; (+) strand; PAM type: YTN; PAM sequence: TTT
tctgttttttcttctataaa

SEQ ID NO: 281818 - DNA, 20 bp, Artificial Sequence
  Description of Artificial Sequence: Synthetic oligonucleotide
  Target: ATXN1; (+) strand; PAM type: YTN; PAM sequence: TTT
ctgttttttcttctataaag

SEQ ID NO: 281819 - DNA, 20 bp, Artificial Sequence
  Description of Artificial Sequence: Synthetic oligonucleotide
  Target: ATXN1; (+) strand; PAM type: YTN; PAM sequence: TTC
tgttttttcttctataaagt

SEQ ID NO: 281820 - DNA, 20 bp, Artificial Sequence
  Description of Artificial Sequence: Synthetic oligonucleotide
  Target: ATXN1; (+) strand; PAM type: YTN; PAM sequence: CTG
ttttttcttctataaagttc

SEQ ID NO: 281821 - DNA, 20 bp, Artificial Sequence
  Description of Artificial Sequence: Synthetic oligonucleotide
  Target: ATXN1; (+) strand; PAM type: YTN; PAM sequence: TTT
tttcttctataaagttcagt

SEQ ID NO: 281822 - DNA, 20 bp, Artificial Sequence
  Description of Artificial Sequence: Synthetic oligonucleotide
  Target: ATXN1; (+) strand; PAM type: YTN; PAM sequence: TTT
ttcttctataaagttcagta

SEQ ID NO: 281823 - DNA, 20 bp, Artificial Sequence
  Description of Artificial Sequence: Synthetic oligonucleotide
  Target: ATXN1; (+) strand; PAM type: YTN; PAM sequence: TTT
tcttctataaagttcagtat

SEQ ID NO: 281824 - DNA, 20 bp, Artificial Sequence
  Description of Artificial Sequence: Synthetic oligonucleotide
  Target: ATXN1; (+) strand; PAM type: YTN; PAM sequence: TTT
cttctataaagttcagtata

SEQ ID NO: 281825 - DNA, 20 bp, Artificial Sequence
  Description of Artificial Sequence: Synthetic oligonucleotide
  Target: ATXN1; (+) strand; PAM type: YTN; PAM sequence: TTC
ttctataaagttcagtatac

SEQ ID NO: 281826 - DNA, 20 bp, Artificial Sequence
  Description of Artificial Sequence: Synthetic oligonucleotide
  Target: ATXN1; (+) strand; PAM type: YTN; PAM sequence: CTT
ctataaagttcagtatactt

SEQ ID NO: 281827 - DNA, 20 bp, Artificial Sequence
  Description of Artificial Sequence: Synthetic oligonucleotide
  Target: ATXN1; (+) strand; PAM type: YTN; PAM sequence: TTC
tataaagttcagtatacttt

SEQ ID NO: 281828 - DNA, 20 bp, Artificial Sequence
  Description of Artificial Sequence: Synthetic oligonucleotide
  Target: ATXN1; (+) strand; PAM type: YTN; PAM sequence: CTA
taaagttcagtatactttta

SEQ ID NO: 281829 - DNA, 20 bp, Artificial Sequence
  Description of Artificial Sequence: Synthetic oligonucleotide
  Target: ATXN1; (+) strand; PAM type: YTN; PAM sequence: TTC
agtatacttttatggcattt

SEQ ID NO: 281830 - DNA, 20 bp, Artificial Sequence
  Description of Artificial Sequence: Synthetic oligonucleotide
  Target: ATXN1; (+) strand; PAM type: YTN; PAM sequence: CTT
ttatggcattttaactttca

SEQ ID NO: 281831 - DNA, 20 bp, Artificial Sequence
  Description of Artificial Sequence: Synthetic oligonucleotide
  Target: ATXN1; (+) strand; PAM type: YTN; PAM sequence: TTT
tatggcattttaactttcag

SEQ ID NO: 281832 - DNA, 20 bp, Artificial Sequence
  Description of Artificial Sequence: Synthetic oligonucleotide
  Target: ATXN1; (+) strand; PAM type: YTN; PAM sequence: TTT
atggcattttaactttcagt

SEQ ID NO: 281833 - DNA, 20 bp, Artificial Sequence
  Description of Artificial Sequence: Synthetic oligonucleotide
  Target: ATXN1; (+) strand; PAM type: YTN; PAM sequence: TTA
tggcattttaactttcagtt

SEQ ID NO: 281834 - DNA, 20 bp, Artificial Sequence
  Description of Artificial Sequence: Synthetic oligonucleotide
  Target: ATXN1; (+) strand; PAM type: YTN; PAM sequence: TTT
taactttcagttttggtacc

SEQ ID NO: 281835 - DNA, 20 bp, Artificial Sequence
  Description of Artificial Sequence: Synthetic oligonucleotide
  Target: ATXN1; (+) strand; PAM type: YTN; PAM sequence: TTT
aactttcagttttggtacct

SEQ ID NO: 281836 - DNA, 20 bp, Artificial Sequence
  Description of Artificial Sequence: Synthetic oligonucleotide
  Target: ATXN1; (+) strand; PAM type: YTN; PAM sequence: TTA
actttcagttttggtacctt

SEQ ID NO: 281837 - DNA, 20 bp, Artificial Sequence
  Description of Artificial Sequence: Synthetic oligonucleotide
  Target: ATXN1; (+) strand; PAM type: YTN; PAM sequence: CTT
tcagttttggtaccttggga

SEQ ID NO: 281838 - DNA, 20 bp, Artificial Sequence
  Description of Artificial Sequence: Synthetic oligonucleotide
  Target: ATXN1; (+) strand; PAM type: YTN; PAM sequence: TTT
cagttttggtaccttgggaa

SEQ ID NO: 281839 - DNA, 20 bp, Artificial Sequence
  Description of Artificial Sequence: Synthetic oligonucleotide
  Target: ATXN1; (+) strand; PAM type: YTN; PAM sequence: TTC
agttttggtaccttgggaac

SEQ ID NO: 281840 - DNA, 20 bp, Artificial Sequence
  Description of Artificial Sequence: Synthetic oligonucleotide
  Target: ATXN1; (+) strand; PAM type: YTN; PAM sequence: TTT
tggtaccttgggaacacagc

SEQ ID NO: 281841 - DNA, 20 bp, Artificial Sequence
  Description of Artificial Sequence: Synthetic oligonucleotide
  Target: ATXN1; (+) strand; PAM type: YTN; PAM sequence: TTT
ggtaccttgggaacacagca

SEQ ID NO: 281842 - DNA, 20 bp, Artificial Sequence
  Description of Artificial Sequence: Synthetic oligonucleotide
  Target: ATXN1; (+) strand; PAM type: YTN; PAM sequence: TTG
gtaccttgggaacacagcat

SEQ ID NO: 281843 - DNA, 20 bp, Artificial Sequence
  Description of Artificial Sequence: Synthetic oligonucleotide
  Target: ATXN1; (+) strand; PAM type: YTN; PAM sequence: CTT
gggaacacagcatcctctat

SEQ ID NO: 281844 - DNA, 20 bp, Artificial Sequence
  Description of Artificial Sequence: Synthetic oligonucleotide
  Target: ATXN1; (+) strand; PAM type: YTN; PAM sequence: TTG
ggaacacagcatcctctatc

SEQ ID NO: 281845 - DNA, 20 bp, Artificial Sequence
  Description of Artificial Sequence: Synthetic oligonucleotide
  Target: ATXN1; (+) strand; PAM type: YTN; PAM sequence: CTC
tatcttggcagagttaagtg

SEQ ID NO: 281846 - DNA, 20 bp, Artificial Sequence
  Description of Artificial Sequence: Synthetic oligonucleotide
  Target: ATXN1; (+) strand; PAM type: YTN; PAM sequence: CTA
tcttggcagagttaagtggg

SEQ ID NO: 281847 - DNA, 20 bp, Artificial Sequence
  Description of Artificial Sequence: Synthetic oligonucleotide
  Target: ATXN1; (+) strand; PAM type: YTN; PAM sequence: CTT
ggcagagttaagtggggcat

SEQ ID NO: 281848 - DNA, 20 bp, Artificial Sequence
  Description of Artificial Sequence: Synthetic oligonucleotide
  Target: ATXN1; (+) strand; PAM type: YTN; PAM sequence: TTG
gcagagttaagtggggcatg

SEQ ID NO: 281849 - DNA, 20 bp, Artificial Sequence
  Description of Artificial Sequence: Synthetic oligonucleotide
  Target: ATXN1; (+) strand; PAM type: YTN; PAM sequence: TTA
agtggggcatgaatggcctt

SEQ ID NO: 281850 - DNA, 20 bp, Artificial Sequence
  Description of Artificial Sequence: Synthetic oligonucleotide
  Target: ATXN1; (+) strand; PAM type: YTN; PAM sequence: CTT
ttcctaagtagaatggtgat

SEQ ID NO: 281851 - DNA, 20 bp, Artificial Sequence
  Description of Artificial Sequence: Synthetic oligonucleotide
  Target: ATXN1; (+) strand; PAM type: YTN; PAM sequence: TTT
tcctaagtagaatggtgatt

SEQ ID NO: 281852 - DNA, 20 bp, Artificial Sequence
  Description of Artificial Sequence: Synthetic oligonucleotide
  Target: ATXN1; (+) strand; PAM type: YTN; PAM sequence: TTT
cctaagtagaatggtgattt

SEQ ID NO: 281853 - DNA, 20 bp, Artificial Sequence
  Description of Artificial Sequence: Synthetic oligonucleotide
  Target: ATXN1; (+) strand; PAM type: YTN; PAM sequence: TTC
ctaagtagaatggtgattta

SEQ ID NO: 281854 - DNA, 20 bp, Artificial Sequence
  Description of Artificial Sequence: Synthetic oligonucleotide
  Target: ATXN1; (+) strand; PAM type: YTN; PAM sequence: CTA
agtagaatggtgatttaaca

SEQ ID NO: 281855 - DNA, 20 bp, Artificial Sequence
  Description of Artificial Sequence: Synthetic oligonucleotide
  Target: ATXN1; (+) strand; PAM type: YTN; PAM sequence: TTT
aacagagtttttatgagtat

SEQ ID NO: 281856 - DNA, 20 bp, Artificial Sequence
  Description of Artificial Sequence: Synthetic oligonucleotide
  Target: ATXN1; (+) strand; PAM type: YTN; PAM sequence: TTA
acagagtttttatgagtatg

SEQ ID NO: 281857 - DNA, 20 bp, Artificial Sequence
  Description of Artificial Sequence: Synthetic oligonucleotide
  Target: ATXN1; (+) strand; PAM type: YTN; PAM sequence: TTT
ttatgagtatggtccaacag

SEQ ID NO: 281858 - DNA, 20 bp, Artificial Sequence
  Description of Artificial Sequence: Synthetic oligonucleotide
  Target: ATXN1; (+) strand; PAM type: YTN; PAM sequence: TTT
tatgagtatggtccaacagt

SEQ ID NO: 281859 - DNA, 20 bp, Artificial Sequence
  Description of Artificial Sequence: Synthetic oligonucleotide
  Target: ATXN1; (+) strand; PAM type: YTN; PAM sequence: TTT
atgagtatggtccaacagta

SEQ ID NO: 281860 - DNA, 20 bp, Artificial Sequence
  Description of Artificial Sequence: Synthetic oligonucleotide
  Target: ATXN1; (+) strand; PAM type: YTN; PAM sequence: TTA
tgagtatggtccaacagtag

SEQ ID NO: 281861 - DNA, 20 bp, Artificial Sequence
  Description of Artificial Sequence: Synthetic oligonucleotide
  Target: ATXN1; (+) strand; PAM type: YTN; PAM sequence: CTG
acatttttatcaagaggaca

SEQ ID NO: 281862 - DNA, 20 bp, Artificial Sequence
  Description of Artificial Sequence: Synthetic oligonucleotide
  Target: ATXN1; (+) strand; PAM type: YTN; PAM sequence: TTT
ttatcaagaggacagaagtg

SEQ ID NO: 281863 - DNA, 20 bp, Artificial Sequence
  Description of Artificial Sequence: Synthetic oligonucleotide
  Target: ATXN1; (+) strand; PAM type: YTN; PAM sequence: TTT
tatcaagaggacagaagtgt

SEQ ID NO: 281864 - DNA, 20 bp, Artificial Sequence
  Description of Artificial Sequence: Synthetic oligonucleotide
  Target: ATXN1; (+) strand; PAM type: YTN; PAM sequence: TTT
atcaagaggacagaagtgtc

SEQ ID NO: 281865 - DNA, 20 bp, Artificial Sequence
  Description of Artificial Sequence: Synthetic oligonucleotide
  Target: ATXN1; (+) strand; PAM type: YTN; PAM sequence: TTA
tcaagaggacagaagtgtca

SEQ ID NO: 281866 - DNA, 20 bp, Artificial Sequence
  Description of Artificial Sequence: Synthetic oligonucleotide
  Target: ATXN1; (+) strand; PAM type: YTN; PAM sequence: TTT
gaaagatcttctaacactgt

SEQ ID NO: 281867 - DNA, 20 bp, Artificial Sequence
  Description of Artificial Sequence: Synthetic oligonucleotide
  Target: ATXN1; (+) strand; PAM type: YTN; PAM sequence: TTG
aaagatcttctaacactgtt

SEQ ID NO: 281868 - DNA, 20 bp, Artificial Sequence
  Description of Artificial Sequence: Synthetic oligonucleotide
  Target: ATXN1; (+) strand; PAM type: YTN; PAM sequence: CTT
ctaacactgttcatggctac

SEQ ID NO: 281869 - DNA, 20 bp, Artificial Sequence
  Description of Artificial Sequence: Synthetic oligonucleotide
  Target: ATXN1; (+) strand; PAM type: YTN; PAM sequence: TTC
taacactgttcatggctact

SEQ ID NO: 281870 - DNA, 20 bp, Artificial Sequence
  Description of Artificial Sequence: Synthetic oligonucleotide
  Target: ATXN1; (+) strand; PAM type: YTN; PAM sequence: CTA
acactgttcatggctactgc

SEQ ID NO: 281871 - DNA, 20 bp, Artificial Sequence
  Description of Artificial Sequence: Synthetic oligonucleotide
  Target: ATXN1; (+) strand; PAM type: YTN; PAM sequence: CTG
ttcatggctactgctaggaa

SEQ ID NO: 281872 - DNA, 20 bp, Artificial Sequence
  Description of Artificial Sequence: Synthetic oligonucleotide
  Target: ATXN1; (+) strand; PAM type: YTN; PAM sequence: TTC
atggctactgctaggaacag

SEQ ID NO: 281873 - DNA, 20 bp, Artificial Sequence
  Description of Artificial Sequence: Synthetic oligonucleotide
  Target: ATXN1; (+) strand; PAM type: YTN; PAM sequence: CTA
ctgctaggaacagagtaggg

SEQ ID NO: 281874 - DNA, 20 bp, Artificial Sequence
  Description of Artificial Sequence: Synthetic oligonucleotide
  Target: ATXN1; (+) strand; PAM type: YTN; PAM sequence: CTG
ctaggaacagagtagggcaa

SEQ ID NO: 281875 - DNA, 20 bp, Artificial Sequence
  Description of Artificial Sequence: Synthetic oligonucleotide
  Target: ATXN1; (+) strand; PAM type: YTN; PAM sequence: CTA
ggaacagagtagggcaatct

SEQ ID NO: 281876 - DNA, 20 bp, Artificial Sequence
  Description of Artificial Sequence: Synthetic oligonucleotide
  Target: ATXN1; (+) strand; PAM type: YTN; PAM sequence: CTT
tcccttctttttatgtggag

SEQ ID NO: 281877 - DNA, 20 bp, Artificial Sequence
  Description of Artificial Sequence: Synthetic oligonucleotide
  Target: ATXN1; (+) strand; PAM type: YTN; PAM sequence: TTT
cccttctttttatgtggagg

SEQ ID NO: 281878 - DNA, 20 bp, Artificial Sequence
  Description of Artificial Sequence: Synthetic oligonucleotide
  Target: ATXN1; (+) strand; PAM type: YTN; PAM sequence: TTC
ccttctttttatgtggaggg

SEQ ID NO: 281879 - DNA, 20 bp, Artificial Sequence
  Description of Artificial Sequence: Synthetic oligonucleotide
  Target: ATXN1; (+) strand; PAM type: YTN; PAM sequence: CTT
ctttttatgtggagggcagg

SEQ ID NO: 281880 - DNA, 20 bp, Artificial Sequence
  Description of Artificial Sequence: Synthetic oligonucleotide
  Target: ATXN1; (+) strand; PAM type: YTN; PAM sequence: TTC
tttttatgtggagggcaggg

SEQ ID NO: 281881 - DNA, 20 bp, Artificial Sequence
  Description of Artificial Sequence: Synthetic oligonucleotide
  Target: ATXN1; (+) strand; PAM type: YTN; PAM sequence: CTT
tttatgtggagggcagggac

SEQ ID NO: 281882 - DNA, 20 bp, Artificial Sequence
  Description of Artificial Sequence: Synthetic oligonucleotide
  Target: ATXN1; (+) strand; PAM type: YTN; PAM sequence: TTT
ttatgtggagggcagggact

SEQ ID NO: 281883 - DNA, 20 bp, Artificial Sequence
  Description of Artificial Sequence: Synthetic oligonucleotide
  Target: ATXN1; (+) strand; PAM type: YTN; PAM sequence: TTT
tatgtggagggcagggactc

SEQ ID NO: 281884 - DNA, 20 bp, Artificial Sequence
  Description of Artificial Sequence: Synthetic oligonucleotide
  Target: ATXN1; (+) strand; PAM type: YTN; PAM sequence: TTT
atgtggagggcagggactcc

SEQ ID NO: 281885 - DNA, 20 bp, Artificial Sequence
  Description of Artificial Sequence: Synthetic oligonucleotide
  Target: ATXN1; (+) strand; PAM type: YTN; PAM sequence: TTA
tgtggagggcagggactcct

SEQ ID NO: 281886 - DNA, 20 bp, Artificial Sequence
  Description of Artificial Sequence: Synthetic oligonucleotide
  Target: ATXN1; (+) strand; PAM type: YTN; PAM sequence: CTC
cttaagtaggctgacctggc

SEQ ID NO: 281887 - DNA, 20 bp, Artificial Sequence
  Description of Artificial Sequence: Synthetic oligonucleotide
  Target: ATXN1; (+) strand; PAM type: YTN; PAM sequence: CTT
aagtaggctgacctggccat

SEQ ID NO: 281888 - DNA, 20 bp, Artificial Sequence
  Description of Artificial Sequence: Synthetic oligonucleotide
  Target: ATXN1; (+) strand; PAM type: YTN; PAM sequence: TTA
agtaggctgacctggccatt

SEQ ID NO: 281889 - DNA, 20 bp, Artificial Sequence
  Description of Artificial Sequence: Synthetic oligonucleotide
  Target: ATXN1; (+) strand; PAM type: YTN; PAM sequence: CTG
acctggccattcattcagtc

SEQ ID NO: 281890 - DNA, 20 bp, Artificial Sequence
  Description of Artificial Sequence: Synthetic oligonucleotide
  Target: ATXN1; (+) strand; PAM type: YTN; PAM sequence: CTG
gccattcattcagtctagcc

SEQ ID NO: 281891 - DNA, 20 bp, Artificial Sequence
  Description of Artificial Sequence: Synthetic oligonucleotide
  Target: ATXN1; (+) strand; PAM type: YTN; PAM sequence: TTC
attcagtctagcctaagcca

SEQ ID NO: 281892 - DNA, 20 bp, Artificial Sequence
  Description of Artificial Sequence: Synthetic oligonucleotide
  Target: ATXN1; (+) strand; PAM type: YTN; PAM sequence: TTC
agtctagcctaagccacagg

SEQ ID NO: 281893 - DNA, 20 bp, Artificial Sequence
  Description of Artificial Sequence: Synthetic oligonucleotide
  Target: ATXN1; (+) strand; PAM type: YTN; PAM sequence: CTA
gcctaagccacaggctttct

SEQ ID NO: 281894 - DNA, 20 bp, Artificial Sequence
  Description of Artificial Sequence: Synthetic oligonucleotide
  Target: ATXN1; (+) strand; PAM type: YTN; PAM sequence: CTA
agccacaggctttctggccc

SEQ ID NO: 281895 - DNA, 20 bp, Artificial Sequence
  Description of Artificial Sequence: Synthetic oligonucleotide
  Target: ATXN1; (+) strand; PAM type: YTN; PAM sequence: CTT
tctggcccacattccagcgt

SEQ ID NO: 281896 - DNA, 20 bp, Artificial Sequence
  Description of Artificial Sequence: Synthetic oligonucleotide
  Target: ATXN1; (+) strand; PAM type: YTN; PAM sequence: TTT
ctggcccacattccagcgta

SEQ ID NO: 281897 - DNA, 20 bp, Artificial Sequence
  Description of Artificial Sequence: Synthetic oligonucleotide
  Target: ATXN1; (+) strand; PAM type: YTN; PAM sequence: TTC
tggcccacattccagcgtaa

SEQ ID NO: 281898 - DNA, 20 bp, Artificial Sequence
  Description of Artificial Sequence: Synthetic oligonucleotide
  Target: ATXN1; (+) strand; PAM type: YTN; PAM sequence: CTG
gcccacattccagcgtaagc

SEQ ID NO: 281899 - DNA, 20 bp, Artificial Sequence
  Description of Artificial Sequence: Synthetic oligonucleotide
  Target: ATXN1; (+) strand; PAM type: YTN; PAM sequence: TTC
cagcgtaagcagatgctgtg

SEQ ID NO: 281900 - DNA, 20 bp, Artificial Sequence
  Description of Artificial Sequence: Synthetic oligonucleotide
  Target: ATXN1; (+) strand; PAM type: YTN; PAM sequence: CTG
tgttgacattctttttaatc

SEQ ID NO: 281901 - DNA, 20 bp, Artificial Sequence
  Description of Artificial Sequence: Synthetic oligonucleotide
  Target: ATXN1; (+) strand; PAM type: YTN; PAM sequence: TTG
acattctttttaatcctcct

SEQ ID NO: 281902 - DNA, 20 bp, Artificial Sequence
  Description of Artificial Sequence: Synthetic oligonucleotide
  Target: ATXN1; (+) strand; PAM type: YTN; PAM sequence: TTC
tttttaatcctccttcctca

SEQ ID NO: 281903 - DNA, 20 bp, Artificial Sequence
  Description of Artificial Sequence: Synthetic oligonucleotide
  Target: ATXN1; (+) strand; PAM type: YTN; PAM sequence: CTT
tttaatcctccttcctcacc

SEQ ID NO: 281904 - DNA, 20 bp, Artificial Sequence
  Description of Artificial Sequence: Synthetic oligonucleotide
  Target: ATXN1; (+) strand; PAM type: YTN; PAM sequence: TTT
ttaatcctccttcctcacct

SEQ ID NO: 281905 - DNA, 20 bp, Artificial Sequence
  Description of Artificial Sequence: Synthetic oligonucleotide
  Target: ATXN1; (+) strand; PAM type: YTN; PAM sequence: TTT
taatcctccttcctcaccta

SEQ ID NO: 281906 - DNA, 20 bp, Artificial Sequence
  Description of Artificial Sequence: Synthetic oligonucleotide
  Target: ATXN1; (+) strand; PAM type: YTN; PAM sequence: TTT
aatcctccttcctcacctag

SEQ ID NO: 281907 - DNA, 20 bp, Artificial Sequence
  Description of Artificial Sequence: Synthetic oligonucleotide
  Target: ATXN1; (+) strand; PAM type: YTN; PAM sequence: TTA
atcctccttcctcacctaga

SEQ ID NO: 281908 - DNA, 20 bp, Artificial Sequence
  Description of Artificial Sequence: Synthetic oligonucleotide
  Target: ATXN1; (+) strand; PAM type: YTN; PAM sequence: CTC
cttcctcacctagaatacat

SEQ ID NO: 281909 - DNA, 20 bp, Artificial Sequence
  Description of Artificial Sequence: Synthetic oligonucleotide
  Target: ATXN1; (+) strand; PAM type: YTN; PAM sequence: CTT
cctcacctagaatacattat

SEQ ID NO: 281910 - DNA, 20 bp, Artificial Sequence
  Description of Artificial Sequence: Synthetic oligonucleotide
  Target: ATXN1; (+) strand; PAM type: YTN; PAM sequence: TTC
ctcacctagaatacattatt

SEQ ID NO: 281911 - DNA, 20 bp, Artificial Sequence
  Description of Artificial Sequence: Synthetic oligonucleotide
  Target: ATXN1; (+) strand; PAM type: YTN; PAM sequence: CTC
acctagaatacattattcct

SEQ ID NO: 281912 - DNA, 20 bp, Artificial Sequence
  Description of Artificial Sequence: Synthetic oligonucleotide
  Target: ATXN1; (+) strand; PAM type: YTN; PAM sequence: CTA
gaatacattattcctcgatg

SEQ ID NO: 281913 - DNA, 20 bp, Artificial Sequence
  Description of Artificial Sequence: Synthetic oligonucleotide
  Target: ATXN1; (+) strand; PAM type: YTN; PAM sequence: TTA
ttcctcgatgtaggcatgca

SEQ ID NO: 281914 - DNA, 20 bp, Artificial Sequence
  Description of Artificial Sequence: Synthetic oligonucleotide
  Target: ATXN1; (+) strand; PAM type: YTN; PAM sequence: TTC
ctcgatgtaggcatgcaaat

SEQ ID NO: 281915 - DNA, 20 bp, Artificial Sequence
  Description of Artificial Sequence: Synthetic oligonucleotide
  Target: ATXN1; (+) strand; PAM type: YTN; PAM sequence: CTC
gatgtaggcatgcaaatatc

SEQ ID NO: 281916 - DNA, 20 bp, Artificial Sequence
  Description of Artificial Sequence: Synthetic oligonucleotide
  Target: ATXN1; (+) strand; PAM type: YTN; PAM sequence: CTG
ctgaatggattatttcagtt

SEQ ID NO: 281917 - DNA, 20 bp, Artificial Sequence
  Description of Artificial Sequence: Synthetic oligonucleotide
  Target: ATXN1; (+) strand; PAM type: YTN; PAM sequence: CTG
aatggattatttcagttatg

SEQ ID NO: 281918 - DNA, 20 bp, Artificial Sequence
  Description of Artificial Sequence: Synthetic oligonucleotide
  Target: ATXN1; (+) strand; PAM type: YTN; PAM sequence: TTA
tttcagttatggacaccaat

SEQ ID NO: 281919 - DNA, 20 bp, Artificial Sequence
  Description of Artificial Sequence: Synthetic oligonucleotide
  Target: ATXN1; (+) strand; PAM type: YTN; PAM sequence: TTT
cagttatggacaccaatagt

SEQ ID NO: 281920 - DNA, 20 bp, Artificial Sequence
  Description of Artificial Sequence: Synthetic oligonucleotide
  Target: ATXN1; (+) strand; PAM type: YTN; PAM sequence: TTC
agttatggacaccaatagta

SEQ ID NO: 281921 - DNA, 20 bp, Artificial Sequence
  Description of Artificial Sequence: Synthetic oligonucleotide
  Target: ATXN1; (+) strand; PAM type: YTN; PAM sequence: TTA
tggacaccaatagtacctgt

SEQ ID NO: 281922 - DNA, 20 bp, Artificial Sequence
  Description of Artificial Sequence: Synthetic oligonucleotide
  Target: ATXN1; (+) strand; PAM type: YTN; PAM sequence: CTG
tccagtaaatatgacccaga

SEQ ID NO: 281923 - DNA, 20 bp, Artificial Sequence
  Description of Artificial Sequence: Synthetic oligonucleotide
  Target: ATXN1; (+) strand; PAM type: YTN; PAM sequence: CTT
tgactccttcctctccattc

SEQ ID NO: 281924 - DNA, 20 bp, Artificial Sequence
  Description of Artificial Sequence: Synthetic oligonucleotide
  Target: ATXN1; (+) strand; PAM type: YTN; PAM sequence: TTT
gactccttcctctccattct

SEQ ID NO: 281925 - DNA, 20 bp, Artificial Sequence
  Description of Artificial Sequence: Synthetic oligonucleotide
  Target: ATXN1; (+) strand; PAM type: YTN; PAM sequence: TTG
actccttcctctccattctc

SEQ ID NO: 281926 - DNA, 20 bp, Artificial Sequence
  Description of Artificial Sequence: Synthetic oligonucleotide
  Target: ATXN1; (+) strand; PAM type: YTN; PAM sequence: CTC
cttcctctccattctccaaa

SEQ ID NO: 281927 - DNA, 20 bp, Artificial Sequence
  Description of Artificial Sequence: Synthetic oligonucleotide
  Target: ATXN1; (+) strand; PAM type: YTN; PAM sequence: CTT
cctctccattctccaaatcc

SEQ ID NO: 281928 - DNA, 20 bp, Artificial Sequence
  Description of Artificial Sequence: Synthetic oligonucleotide
  Target: ATXN1; (+) strand; PAM type: YTN; PAM sequence: TTC
ctctccattctccaaatcca

SEQ ID NO: 281929 - DNA, 20 bp, Artificial Sequence
  Description of Artificial Sequence: Synthetic oligonucleotide
  Target: ATXN1; (+) strand; PAM type: YTN; PAM sequence: CTC
tccattctccaaatccaaca

SEQ ID NO: 281930 - DNA, 20 bp, Artificial Sequence
  Description of Artificial Sequence: Synthetic oligonucleotide
  Target: ATXN1; (+) strand; PAM type: YTN; PAM sequence: CTC
cattctccaaatccaacaat

SEQ ID NO: 281931 - DNA, 20 bp, Artificial Sequence
  Description of Artificial Sequence: Synthetic oligonucleotide
  Target: ATXN1; (+) strand; PAM type: YTN; PAM sequence: TTC
tccaaatccaacaattacta

SEQ ID NO: 281932 - DNA, 20 bp, Artificial Sequence
  Description of Artificial Sequence: Synthetic oligonucleotide
  Target: ATXN1; (+) strand; PAM type: YTN; PAM sequence: CTC
caaatccaacaattactaag

SEQ ID NO: 281933 - DNA, 20 bp, Artificial Sequence
  Description of Artificial Sequence: Synthetic oligonucleotide
  Target: ATXN1; (+) strand; PAM type: YTN; PAM sequence: TTA
ctaagttatattattttatc

SEQ ID NO: 281934 - DNA, 20 bp, Artificial Sequence
  Description of Artificial Sequence: Synthetic oligonucleotide
  Target: ATXN1; (+) strand; PAM type: YTN; PAM sequence: CTA
agttatattattttatccct

SEQ ID NO: 281935 - DNA, 20 bp, Artificial Sequence
  Description of Artificial Sequence: Synthetic oligonucleotide
  Target: ATXN1; (+) strand; PAM type: YTN; PAM sequence: TTA
tattattttatcccttcaaa

SEQ ID NO: 281936 - DNA, 20 bp, Artificial Sequence
  Description of Artificial Sequence: Synthetic oligonucleotide
  Target: ATXN1; (+) strand; PAM type: YTN; PAM sequence: TTA
ttttatcccttcaaatacct

SEQ ID NO: 281937 - DNA, 20 bp, Artificial Sequence
  Description of Artificial Sequence: Synthetic oligonucleotide
  Target: ATXN1; (+) strand; PAM type: YTN; PAM sequence: TTT
tatcccttcaaatacctttg

SEQ ID NO: 281938 - DNA, 20 bp, Artificial Sequence
  Description of Artificial Sequence: Synthetic oligonucleotide
  Target: ATXN1; (+) strand; PAM type: YTN; PAM sequence: TTT
atcccttcaaatacctttga

SEQ ID NO: 281939 - DNA, 20 bp, Artificial Sequence
  Description of Artificial Sequence: Synthetic oligonucleotide
  Target: ATXN1; (+) strand; PAM type: YTN; PAM sequence: TTA
tcccttcaaatacctttgaa

SEQ ID NO: 281940 - DNA, 20 bp, Artificial Sequence
  Description of Artificial Sequence: Synthetic oligonucleotide
  Target: ATXN1; (+) strand; PAM type: YTN; PAM sequence: CTT
caaatacctttgaatatgtt

SEQ ID NO: 281941 - DNA, 20 bp, Artificial Sequence
  Description of Artificial Sequence: Synthetic oligonucleotide
  Target: ATXN1; (+) strand; PAM type: YTN; PAM sequence: TTC
aaatacctttgaatatgttg

SEQ ID NO: 281942 - DNA, 20 bp, Artificial Sequence
  Description of Artificial Sequence: Synthetic oligonucleotide
  Target: ATXN1; (+) strand; PAM type: YTN; PAM sequence: CTT
tgaatatgttgccccctttt

SEQ ID NO: 281943 - DNA, 20 bp, Artificial Sequence
  Description of Artificial Sequence: Synthetic oligonucleotide
  Target: ATXN1; (+) strand; PAM type: YTN; PAM sequence: TTT
gaatatgttgcccccttttc

SEQ ID NO: 281944 - DNA, 20 bp, Artificial Sequence
  Description of Artificial Sequence: Synthetic oligonucleotide
  Target: ATXN1; (+) strand; PAM type: YTN; PAM sequence: TTG
aatatgttgcccccttttcc

SEQ ID NO: 281945 - DNA, 20 bp, Artificial Sequence
  Description of Artificial Sequence: Synthetic oligonucleotide
  Target: ATXN1; (+) strand; PAM type: YTN; PAM sequence: TTG
cccccttttcctttcctgcc

SEQ ID NO: 281946 - DNA, 20 bp, Artificial Sequence
  Description of Artificial Sequence: Synthetic oligonucleotide
  Target: ATXN1; (+) strand; PAM type: YTN; PAM sequence: CTT
ttcctttcctgccatcctcc

SEQ ID NO: 281947 - DNA, 20 bp, Artificial Sequence
  Description of Artificial Sequence: Synthetic oligonucleotide
  Target: ATXN1; (+) strand; PAM type: YTN; PAM sequence: TTT
tcctttcctgccatcctccc

SEQ ID NO: 281948 - DNA, 20 bp, Artificial Sequence
  Description of Artificial Sequence: Synthetic oligonucleotide
  Target: ATXN1; (+) strand; PAM type: YTN; PAM sequence: TTT
cctttcctgccatcctccca

SEQ ID NO: 281949 - DNA, 20 bp, Artificial Sequence
  Description of Artificial Sequence: Synthetic oligonucleotide
  Target: ATXN1; (+) strand; PAM type: YTN; PAM sequence: TTC
ctttcctgccatcctcccaa

SEQ ID NO: 281950 - DNA, 20 bp, Artificial Sequence
  Description of Artificial Sequence: Synthetic oligonucleotide
  Target: ATXN1; (+) strand; PAM type: YTN; PAM sequence: CTT
tcctgccatcctcccaacac

SEQ ID NO: 281951 - DNA, 20 bp, Artificial Sequence
  Description of Artificial Sequence: Synthetic oligonucleotide
  Target: ATXN1; (+) strand; PAM type: YTN; PAM sequence: TTT
cctgccatcctcccaacacc

SEQ ID NO: 281952 - DNA, 20 bp, Artificial Sequence
  Description of Artificial Sequence: Synthetic oligonucleotide
  Target: ATXN1; (+) strand; PAM type: YTN; PAM sequence: TTC
ctgccatcctcccaacaccc

SEQ ID NO: 281953 - DNA, 20 bp, Artificial Sequence
  Description of Artificial Sequence: Synthetic oligonucleotide
  Target: ATXN1; (+) strand; PAM type: YTN; PAM sequence: CTG
ccatcctcccaacaccctca

SEQ ID NO: 281954 - DNA, 20 bp, Artificial Sequence
  Description of Artificial Sequence: Synthetic oligonucleotide
  Target: ATXN1; (+) strand; PAM type: YTN; PAM sequence: CTC
ccaacaccctcaaacgaata

SEQ ID NO: 281955 - DNA, 20 bp, Artificial Sequence
  Description of Artificial Sequence: Synthetic oligonucleotide
  Target: ATXN1; (+) strand; PAM type: YTN; PAM sequence: CTC
aaacgaataggctcccatta

SEQ ID NO: 281956 - DNA, 20 bp, Artificial Sequence
  Description of Artificial Sequence: Synthetic oligonucleotide
  Target: ATXN1; (+) strand; PAM type: YTN; PAM sequence: CTC
ccattacctatctttaattc

SEQ ID NO: 281957 - DNA, 20 bp, Artificial Sequence
  Description of Artificial Sequence: Synthetic oligonucleotide
  Target: ATXN1; (+) strand; PAM type: YTN; PAM sequence: TTA
cctatctttaattcctgact

SEQ ID NO: 281958 - DNA, 20 bp, Artificial Sequence
  Description of Artificial Sequence: Synthetic oligonucleotide
  Target: ATXN1; (+) strand; PAM type: YTN; PAM sequence: CTA
tctttaattcctgactcgcc

SEQ ID NO: 281959 - DNA, 20 bp, Artificial Sequence
  Description of Artificial Sequence: Synthetic oligonucleotide
  Target: ATXN1; (+) strand; PAM type: YTN; PAM sequence: CTT
taattcctgactcgcctgtc

SEQ ID NO: 281960 - DNA, 20 bp, Artificial Sequence
  Description of Artificial Sequence: Synthetic oligonucleotide
  Target: ATXN1; (+) strand; PAM type: YTN; PAM sequence: TTT
aattcctgactcgcctgtcc

SEQ ID NO: 281961 - DNA, 20 bp, Artificial Sequence
  Description of Artificial Sequence: Synthetic oligonucleotide
  Target: ATXN1; (+) strand; PAM type: YTN; PAM sequence: TTA
attcctgactcgcctgtccc

SEQ ID NO: 281962 - DNA, 20 bp, Artificial Sequence
  Description of Artificial Sequence: Synthetic oligonucleotide
  Target: ATXN1; (+) strand; PAM type: YTN; PAM sequence: TTC
ctgactcgcctgtcccctgt

SEQ ID NO: 281963 - DNA, 20 bp, Artificial Sequence
  Description of Artificial Sequence: Synthetic oligonucleotide
  Target: ATXN1; (+) strand; PAM type: YTN; PAM sequence: CTG
actcgcctgtcccctgtttc

SEQ ID NO: 281964 - DNA, 20 bp, Artificial Sequence
  Description of Artificial Sequence: Synthetic oligonucleotide
  Target: ATXN1; (+) strand; PAM type: YTN; PAM sequence: CTC
gcctgtcccctgtttctccc

SEQ ID NO: 281965 - DNA, 20 bp, Artificial Sequence
  Description of Artificial Sequence: Synthetic oligonucleotide
  Target: ATXN1; (+) strand; PAM type: YTN; PAM sequence: CTG
tcccctgtttctcccaactc

SEQ ID NO: 281966 - DNA, 20 bp, Artificial Sequence
  Description of Artificial Sequence: Synthetic oligonucleotide
  Target: ATXN1; (+) strand; PAM type: YTN; PAM sequence: CTG
tttctcccaactctggccac

SEQ ID NO: 281967 - DNA, 20 bp, Artificial Sequence
  Description of Artificial Sequence: Synthetic oligonucleotide
  Target: ATXN1; (+) strand; PAM type: YTN; PAM sequence: TTT
ctcccaactctggccaccct

SEQ ID NO: 281968 - DNA, 20 bp, Artificial Sequence
  Description of Artificial Sequence: Synthetic oligonucleotide
  Target: ATXN1; (+) strand; PAM type: YTN; PAM sequence: TTC
tcccaactctggccacccta

SEQ ID NO: 281969 - DNA, 20 bp, Artificial Sequence
  Description of Artificial Sequence: Synthetic oligonucleotide
  Target: ATXN1; (+) strand; PAM type: YTN; PAM sequence: CTC
ccaactctggccaccctaca

SEQ ID NO: 281970 - DNA, 20 bp, Artificial Sequence
  Description of Artificial Sequence: Synthetic oligonucleotide
  Target: ATXN1; (+) strand; PAM type: YTN; PAM sequence: CTC
tggccaccctacatacattg

SEQ ID NO: 281971 - DNA, 20 bp, Artificial Sequence
  Description of Artificial Sequence: Synthetic oligonucleotide
  Target: ATXN1; (+) strand; PAM type: YTN; PAM sequence: CTG
gccaccctacatacattgtc

SEQ ID NO: 281972 - DNA, 20 bp, Artificial Sequence
  Description of Artificial Sequence: Synthetic oligonucleotide
  Target: ATXN1; (+) strand; PAM type: YTN; PAM sequence: CTA
catacattgtcaccggtttc

SEQ ID NO: 281973 - DNA, 20 bp, Artificial Sequence
  Description of Artificial Sequence: Synthetic oligonucleotide
  Target: ATXN1; (+) strand; PAM type: YTN; PAM sequence: TTG
tcaccggtttcagatatata

SEQ ID NO: 281974 - DNA, 20 bp, Artificial Sequence
  Description of Artificial Sequence: Synthetic oligonucleotide
  Target: ATXN1; (+) strand; PAM type: YTN; PAM sequence: TTT
cagatatatacacacaaact

SEQ ID NO: 281975 - DNA, 20 bp, Artificial Sequence
  Description of Artificial Sequence: Synthetic oligonucleotide
  Target: ATXN1; (+) strand; PAM type: YTN; PAM sequence: TTC
agatatatacacacaaactc

SEQ ID NO: 281976 - DNA, 20 bp, Artificial Sequence
  Description of Artificial Sequence: Synthetic oligonucleotide
  Target: ATXN1; (+) strand; PAM type: YTN; PAM sequence: CTC
actgagccccttccataaac

SEQ ID NO: 281977 - DNA, 20 bp, Artificial Sequence
  Description of Artificial Sequence: Synthetic oligonucleotide
  Target: ATXN1; (+) strand; PAM type: YTN; PAM sequence: CTG
agccccttccataaacaaga

SEQ ID NO: 281978 - DNA, 20 bp, Artificial Sequence
  Description of Artificial Sequence: Synthetic oligonucleotide
  Target: ATXN1; (+) strand; PAM type: YTN; PAM sequence: CTT
ccataaacaagaactgggaa

SEQ ID NO: 281979 - DNA, 20 bp, Artificial Sequence
  Description of Artificial Sequence: Synthetic oligonucleotide
  Target: ATXN1; (+) strand; PAM type: YTN; PAM sequence: TTC
cataaacaagaactgggaac

SEQ ID NO: 281980 - DNA, 20 bp, Artificial Sequence
  Description of Artificial Sequence: Synthetic oligonucleotide
  Target: ATXN1; (+) strand; PAM type: YTN; PAM sequence: CTG
ggaactctgtgtcacctcct

SEQ ID NO: 281981 - DNA, 20 bp, Artificial Sequence
  Description of Artificial Sequence: Synthetic oligonucleotide
  Target: ATXN1; (+) strand; PAM type: YTN; PAM sequence: CTC
tgtgtcacctcctgcattaa

SEQ ID NO: 281982 - DNA, 20 bp, Artificial Sequence
  Description of Artificial Sequence: Synthetic oligonucleotide
  Target: ATXN1; (+) strand; PAM type: YTN; PAM sequence: CTG
tgtcacctcctgcattaact

SEQ ID NO: 281983 - DNA, 20 bp, Artificial Sequence
  Description of Artificial Sequence: Synthetic oligonucleotide
  Target: ATXN1; (+) strand; PAM type: YTN; PAM sequence: CTC
ctgcattaacttcacattcc

SEQ ID NO: 281984 - DNA, 20 bp, Artificial Sequence
  Description of Artificial Sequence: Synthetic oligonucleotide
  Target: ATXN1; (+) strand; PAM type: YTN; PAM sequence: CTG
cattaacttcacattcctcc

SEQ ID NO: 281985 - DNA, 20 bp, Artificial Sequence
  Description of Artificial Sequence: Synthetic oligonucleotide
  Target: ATXN1; (+) strand; PAM type: YTN; PAM sequence: TTA
acttcacattcctccgccag

SEQ ID NO: 281986 - DNA, 20 bp, Artificial Sequence
  Description of Artificial Sequence: Synthetic oligonucleotide
  Target: ATXN1; (+) strand; PAM type: YTN; PAM sequence: CTT
cacattcctccgccaggtct

SEQ ID NO: 281987 - DNA, 20 bp, Artificial Sequence
  Description of Artificial Sequence: Synthetic oligonucleotide
  Target: ATXN1; (+) strand; PAM type: YTN; PAM sequence: TTC
acattcctccgccaggtctt

SEQ ID NO: 281988 - DNA, 20 bp, Artificial Sequence
  Description of Artificial Sequence: Synthetic oligonucleotide
  Target: ATXN1; (+) strand; PAM type: YTN; PAM sequence: TTC
ctccgccaggtcttagtgat

SEQ ID NO: 281989 - DNA, 20 bp, Artificial Sequence
  Description of Artificial Sequence: Synthetic oligonucleotide
  Target: ATXN1; (+) strand; PAM type: YTN; PAM sequence: CTC
cgccaggtcttagtgatcct

SEQ ID NO: 281990 - DNA, 20 bp, Artificial Sequence
  Description of Artificial Sequence: Synthetic oligonucleotide
  Target: ATXN1; (+) strand; PAM type: YTN; PAM sequence: CTT
agtgatcctttagctctgtt

SEQ ID NO: 281991 - DNA, 20 bp, Artificial Sequence
  Description of Artificial Sequence: Synthetic oligonucleotide
  Target: ATXN1; (+) strand; PAM type: YTN; PAM sequence: TTA
gtgatcctttagctctgtta

SEQ ID NO: 281992 - DNA, 20 bp, Artificial Sequence
  Description of Artificial Sequence: Synthetic oligonucleotide
  Target: ATXN1; (+) strand; PAM type: YTN; PAM sequence: CTT
tagctctgttatccccacag

SEQ ID NO: 281993 - DNA, 20 bp, Artificial Sequence
  Description of Artificial Sequence: Synthetic oligonucleotide
  Target: ATXN1; (+) strand; PAM type: YTN; PAM sequence: TTT
agctctgttatccccacagc

SEQ ID NO: 281994 - DNA, 20 bp, Artificial Sequence
  Description of Artificial Sequence: Synthetic oligonucleotide
  Target: ATXN1; (+) strand; PAM type: YTN; PAM sequence: TTA
gctctgttatccccacagct

SEQ ID NO: 281995 - DNA, 20 bp, Artificial Sequence
  Description of Artificial Sequence: Synthetic oligonucleotide
  Target: ATXN1; (+) strand; PAM type: YTN; PAM sequence: CTC
tgttatccccacagctgtca

SEQ ID NO: 281996 - DNA, 20 bp, Artificial Sequence
  Description of Artificial Sequence: Synthetic oligonucleotide
  Target: ATXN1; (+) strand; PAM type: YTN; PAM sequence: CTG
ttatccccacagctgtcaaa

SEQ ID NO: 281997 - DNA, 20 bp, Artificial Sequence
  Description of Artificial Sequence: Synthetic oligonucleotide
  Target: ATXN1; (+) strand; PAM type: YTN; PAM sequence: TTA
tccccacagctgtcaaattc

SEQ ID NO: 281998 - DNA, 20 bp, Artificial Sequence
  Description of Artificial Sequence: Synthetic oligonucleotide
  Target: ATXN1; (+) strand; PAM type: YTN; PAM sequence: CTG
tcaaattctctttcatacca

SEQ ID NO: 281999 - DNA, 20 bp, Artificial Sequence
  Description of Artificial Sequence: Synthetic oligonucleotide
  Target: ATXN1; (+) strand; PAM type: YTN; PAM sequence: TTC
tctttcataccaatctccag

SEQ ID NO: 282000 - DNA, 20 bp, Artificial Sequence
  Description of Artificial Sequence: Synthetic oligonucleotide
  Target: ATXN1; (+) strand; PAM type: YTN; PAM sequence: CTC
tttcataccaatctccagca

SEQ ID NO: 282001 - DNA, 20 bp, Artificial Sequence
  Description of Artificial Sequence: Synthetic oligonucleotide
  Target: ATXN1; (+) strand; PAM type: YTN; PAM sequence: CTT
tcataccaatctccagcaat

SEQ ID NO: 282002 - DNA, 20 bp, Artificial Sequence
  Description of Artificial Sequence: Synthetic oligonucleotide
  Target: ATXN1; (+) strand; PAM type: YTN; PAM sequence: TTT
cataccaatctccagcaatg

SEQ ID NO: 282003 - DNA, 20 bp, Artificial Sequence
  Description of Artificial Sequence: Synthetic oligonucleotide
  Target: ATXN1; (+) strand; PAM type: YTN; PAM sequence: TTC
ataccaatctccagcaatgc

SEQ ID NO: 282004 - DNA, 20 bp, Artificial Sequence
  Description of Artificial Sequence: Synthetic oligonucleotide
  Target: ATXN1; (+) strand; PAM type: YTN; PAM sequence: CTC
cagcaatgcacatataactc

SEQ ID NO: 282005 - DNA, 20 bp, Artificial Sequence
  Description of Artificial Sequence: Synthetic oligonucleotide
  Target: ATXN1; (+) strand; PAM type: YTN; PAM sequence: CTC
cgctggcccctccaacatat

SEQ ID NO: 282006 - DNA, 20 bp, Artificial Sequence
  Description of Artificial Sequence: Synthetic oligonucleotide
  Target: ATXN1; (+) strand; PAM type: YTN; PAM sequence: CTG
gcccctccaacatatcccat

SEQ ID NO: 282007 - DNA, 20 bp, Artificial Sequence
  Description of Artificial Sequence: Synthetic oligonucleotide
  Target: ATXN1; (+) strand; PAM type: YTN; PAM sequence: CTC
caacatatcccatgcaggcc

SEQ ID NO: 282008 - DNA, 20 bp, Artificial Sequence
  Description of Artificial Sequence: Synthetic oligonucleotide
  Target: ATXN1; (+) strand; PAM type: YTN; PAM sequence: CTG
tgtcccttcctcatgctttt

SEQ ID NO: 282009 - DNA, 20 bp, Artificial Sequence
  Description of Artificial Sequence: Synthetic oligonucleotide
  Target: ATXN1; (+) strand; PAM type: YTN; PAM sequence: CTT
cctcatgcttttgtccctgc

SEQ ID NO: 282010 - DNA, 20 bp, Artificial Sequence
  Description of Artificial Sequence: Synthetic oligonucleotide
  Target: ATXN1; (+) strand; PAM type: YTN; PAM sequence: TTC
ctcatgcttttgtccctgct

SEQ ID NO: 282011 - DNA, 20 bp, Artificial Sequence
  Description of Artificial Sequence: Synthetic oligonucleotide
  Target: ATXN1; (+) strand; PAM type: YTN; PAM sequence: CTC
atgcttttgtccctgctgcc

SEQ ID NO: 282012 - DNA, 20 bp, Artificial Sequence
  Description of Artificial Sequence: Synthetic oligonucleotide
  Target: ATXN1; (+) strand; PAM type: YTN; PAM sequence: CTT
ttgtccctgctgccactgtg

SEQ ID NO: 282013 - DNA, 20 bp, Artificial Sequence
  Description of Artificial Sequence: Synthetic oligonucleotide
  Target: ATXN1; (+) strand; PAM type: YTN; PAM sequence: TTT
tgtccctgctgccactgtgc

SEQ ID NO: 282014 - DNA, 20 bp, Artificial Sequence
  Description of Artificial Sequence: Synthetic oligonucleotide
  Target: ATXN1; (+) strand; PAM type: YTN; PAM sequence: TTT
gtccctgctgccactgtgcc

SEQ ID NO: 282015 - DNA, 20 bp, Artificial Sequence
  Description of Artificial Sequence: Synthetic oligonucleotide
  Target: ATXN1; (+) strand; PAM type: YTN; PAM sequence: TTG
tccctgctgccactgtgcct

SEQ ID NO: 282016 - DNA, 20 bp, Artificial Sequence
  Description of Artificial Sequence: Synthetic oligonucleotide
  Target: ATXN1; (+) strand; PAM type: YTN; PAM sequence: CTG
ctgccactgtgcctacaatg

SEQ ID NO: 282017 - DNA, 20 bp, Artificial Sequence
  Description of Artificial Sequence: Synthetic oligonucleotide
  Target: ATXN1; (+) strand; PAM type: YTN; PAM sequence: CTG
ccactgtgcctacaatgacc

SEQ ID NO: 282018 - DNA, 20 bp, Artificial Sequence
  Description of Artificial Sequence: Synthetic oligonucleotide
  Target: ATXN1; (+) strand; PAM type: YTN; PAM sequence: CTG
tgcctacaatgacccctcag

SEQ ID NO: 282019 - DNA, 20 bp, Artificial Sequence
  Description of Artificial Sequence: Synthetic oligonucleotide
  Target: ATXN1; (+) strand; PAM type: YTN; PAM sequence: CTA
caatgacccctcagtttcct

SEQ ID NO: 282020 - DNA, 20 bp, Artificial Sequence
  Description of Artificial Sequence: Synthetic oligonucleotide
  Target: ATXN1; (+) strand; PAM type: YTN; PAM sequence: CTC
agtttcctccacccatcatc

SEQ ID NO: 282021 - DNA, 20 bp, Artificial Sequence
  Description of Artificial Sequence: Synthetic oligonucleotide
  Target: ATXN1; (+) strand; PAM type: YTN; PAM sequence: TTT
cctccacccatcatcactac

SEQ ID NO: 282022 - DNA, 20 bp, Artificial Sequence
  Description of Artificial Sequence: Synthetic oligonucleotide
  Target: ATXN1; (+) strand; PAM type: YTN; PAM sequence: TTC
ctccacccatcatcactaca

SEQ ID NO: 282023 - DNA, 20 bp, Artificial Sequence
  Description of Artificial Sequence: Synthetic oligonucleotide
  Target: ATXN1; (+) strand; PAM type: YTN; PAM sequence: CTC
cacccatcatcactacacat

SEQ ID NO: 282024 - DNA, 20 bp, Artificial Sequence
  Description of Artificial Sequence: Synthetic oligonucleotide
  Target: ATXN1; (+) strand; PAM type: YTN; PAM sequence: CTA
cacatcctgttaaggtccct

SEQ ID NO: 282025 - DNA, 20 bp, Artificial Sequence
  Description of Artificial Sequence: Synthetic oligonucleotide
  Target: ATXN1; (+) strand; PAM type: YTN; PAM sequence: CTG
ttaaggtccctgtcaggctt

SEQ ID NO: 282026 - DNA, 20 bp, Artificial Sequence
  Description of Artificial Sequence: Synthetic oligonucleotide
  Target: ATXN1; (+) strand; PAM type: YTN; PAM sequence: TTA
aggtccctgtcaggctttgc

SEQ ID NO: 282027 - DNA, 20 bp, Artificial Sequence
  Description of Artificial Sequence: Synthetic oligonucleotide
  Target: ATXN1; (+) strand; PAM type: YTN; PAM sequence: CTG
tcaggctttgcttctcatag

SEQ ID NO: 282028 - DNA, 20 bp, Artificial Sequence
  Description of Artificial Sequence: Synthetic oligonucleotide
  Target: ATXN1; (+) strand; PAM type: YTN; PAM sequence: CTT
tgcttctcataggaagctct

SEQ ID NO: 282029 - DNA, 20 bp, Artificial Sequence
  Description of Artificial Sequence: Synthetic oligonucleotide
  Target: ATXN1; (+) strand; PAM type: YTN; PAM sequence: TTT
gcttctcataggaagctctt

SEQ ID NO: 282030 - DNA, 20 bp, Artificial Sequence
  Description of Artificial Sequence: Synthetic oligonucleotide
  Target: ATXN1; (+) strand; PAM type: YTN; PAM sequence: TTG
cttctcataggaagctcttc

SEQ ID NO: 282031 - DNA, 20 bp, Artificial Sequence
  Description of Artificial Sequence: Synthetic oligonucleotide
  Target: ATXN1; (+) strand; PAM type: YTN; PAM sequence: CTT
ctcataggaagctcttcctg

SEQ ID NO: 282032 - DNA, 20 bp, Artificial Sequence
  Description of Artificial Sequence: Synthetic oligonucleotide
  Target: ATXN1; (+) strand; PAM type: YTN; PAM sequence: TTC
tcataggaagctcttcctga

SEQ ID NO: 282033 - DNA, 20 bp, Artificial Sequence
  Description of Artificial Sequence: Synthetic oligonucleotide
  Target: ATXN1; (+) strand; PAM type: YTN; PAM sequence: CTC
ataggaagctcttcctgaag

SEQ ID NO: 282034 - DNA, 20 bp, Artificial Sequence
  Description of Artificial Sequence: Synthetic oligonucleotide
  Target: ATXN1; (+) strand; PAM type: YTN; PAM sequence: CTC
ttcctgaagactccaatccc

SEQ ID NO: 282035 - DNA, 20 bp, Artificial Sequence
  Description of Artificial Sequence: Synthetic oligonucleotide
  Target: ATXN1; (+) strand; PAM type: YTN; PAM sequence: CTT
cctgaagactccaatcccca

SEQ ID NO: 282036 - DNA, 20 bp, Artificial Sequence
  Description of Artificial Sequence: Synthetic oligonucleotide
  Target: ATXN1; (+) strand; PAM type: YTN; PAM sequence: TTC
ctgaagactccaatccccag

SEQ ID NO: 282037 - DNA, 20 bp, Artificial Sequence
  Description of Artificial Sequence: Synthetic oligonucleotide
  Target: ATXN1; (+) strand; PAM type: YTN; PAM sequence: CTG
aagactccaatccccagcca

SEQ ID NO: 282038 - DNA, 20 bp, Artificial Sequence
  Description of Artificial Sequence: Synthetic oligonucleotide
  Target: ATXN1; (+) strand; PAM type: YTN; PAM sequence: CTC
caatccccagccatttctca

SEQ ID NO: 282039 - DNA, 20 bp, Artificial Sequence
  Description of Artificial Sequence: Synthetic oligonucleotide
  Target: ATXN1; (+) strand; PAM type: YTN; PAM sequence: TTT
ctcattcctcttctgaacct

SEQ ID NO: 282040 - DNA, 20 bp, Artificial Sequence
  Description of Artificial Sequence: Synthetic oligonucleotide
  Target: ATXN1; (+) strand; PAM type: YTN; PAM sequence: TTC
tcattcctcttctgaacctg

SEQ ID NO: 282041 - DNA, 20 bp, Artificial Sequence
  Description of Artificial Sequence: Synthetic oligonucleotide
  Target: ATXN1; (+) strand; PAM type: YTN; PAM sequence: CTC
attcctcttctgaacctgac

SEQ ID NO: 282042 - DNA, 20 bp, Artificial Sequence
  Description of Artificial Sequence: Synthetic oligonucleotide
  Target: ATXN1; (+) strand; PAM type: YTN; PAM sequence: TTC
ctcttctgaacctgacactg

SEQ ID NO: 282043 - DNA, 20 bp, Artificial Sequence
  Description of Artificial Sequence: Synthetic oligonucleotide
  Target: ATXN1; (+) strand; PAM type: YTN; PAM sequence: CTC
ttctgaacctgacactggca

SEQ ID NO: 282044 - DNA, 20 bp, Artificial Sequence
  Description of Artificial Sequence: Synthetic oligonucleotide
  Target: ATXN1; (+) strand; PAM type: YTN; PAM sequence: CTT
ctgaacctgacactggcacc

SEQ ID NO: 282045 - DNA, 20 bp, Artificial Sequence
  Description of Artificial Sequence: Synthetic oligonucleotide
  Target: ATXN1; (+) strand; PAM type: YTN; PAM sequence: TTC
tgaacctgacactggcaccc

SEQ ID NO: 282046 - DNA, 20 bp, Artificial Sequence
  Description of Artificial Sequence: Synthetic oligonucleotide
  Target: ATXN1; (+) strand; PAM type: YTN; PAM sequence: CTG
aacctgacactggcacccca

SEQ ID NO: 282047 - DNA, 20 bp, Artificial Sequence
  Description of Artificial Sequence: Synthetic oligonucleotide
  Target: ATXN1; (+) strand; PAM type: YTN; PAM sequence: CTG
acactggcaccccattacaa

SEQ ID NO: 282048 - DNA, 20 bp, Artificial Sequence
  Description of Artificial Sequence: Synthetic oligonucleotide
  Target: ATXN1; (+) strand; PAM type: YTN; PAM sequence: CTG
gcaccccattacaaattctc

SEQ ID NO: 282049 - DNA, 20 bp, Artificial Sequence
  Description of Artificial Sequence: Synthetic oligonucleotide
  Target: ATXN1; (+) strand; PAM type: YTN; PAM sequence: TTA
caaattctcagttgtctgtt

SEQ ID NO: 282050 - DNA, 20 bp, Artificial Sequence
  Description of Artificial Sequence: Synthetic oligonucleotide
  Target: ATXN1; (+) strand; PAM type: YTN; PAM sequence: TTC
tcagttgtctgttgtcatgg

SEQ ID NO: 282051 - DNA, 20 bp, Artificial Sequence
  Description of Artificial Sequence: Synthetic oligonucleotide
  Target: ATXN1; (+) strand; PAM type: YTN; PAM sequence: CTC
agttgtctgttgtcatggat

SEQ ID NO: 282052 - DNA, 20 bp, Artificial Sequence
  Description of Artificial Sequence: Synthetic oligonucleotide
  Target: ATXN1; (+) strand; PAM type: YTN; PAM sequence: TTG
tctgttgtcatggattgctc

SEQ ID NO: 282053 - DNA, 20 bp, Artificial Sequence
  Description of Artificial Sequence: Synthetic oligonucleotide
  Target: ATXN1; (+) strand; PAM type: YTN; PAM sequence: CTG
ttgtcatggattgctctata

SEQ ID NO: 282054 - DNA, 20 bp, Artificial Sequence
  Description of Artificial Sequence: Synthetic oligonucleotide
  Target: ATXN1; (+) strand; PAM type: YTN; PAM sequence: TTG
tcatggattgctctataatt

SEQ ID NO: 282055 - DNA, 20 bp, Artificial Sequence
  Description of Artificial Sequence: Synthetic oligonucleotide
  Target: ATXN1; (+) strand; PAM type: YTN; PAM sequence: TTG
ctctataattgcttcctgtg

SEQ ID NO: 282056 - DNA, 20 bp, Artificial Sequence
  Description of Artificial Sequence: Synthetic oligonucleotide
  Target: ATXN1; (+) strand; PAM type: YTN; PAM sequence: CTC
tataattgcttcctgtggat

SEQ ID NO: 282057 - DNA, 20 bp, Artificial Sequence
  Description of Artificial Sequence: Synthetic oligonucleotide
  Target: ATXN1; (+) strand; PAM type: YTN; PAM sequence: CTA
taattgcttcctgtggattg

SEQ ID NO: 282058 - DNA, 20 bp, Artificial Sequence
  Description of Artificial Sequence: Synthetic oligonucleotide
  Target: ATXN1; (+) strand; PAM type: YTN; PAM sequence: TTG
cttcctgtggattggtattg

SEQ ID NO: 282059 - DNA, 20 bp, Artificial Sequence
  Description of Artificial Sequence: Synthetic oligonucleotide
  Target: ATXN1; (+) strand; PAM type: YTN; PAM sequence: CTT
cctgtggattggtattgtgc

SEQ ID NO: 282060 - DNA, 20 bp, Artificial Sequence
  Description of Artificial Sequence: Synthetic oligonucleotide
  Target: ATXN1; (+) strand; PAM type: YTN; PAM sequence: TTC
ctgtggattggtattgtgcc

SEQ ID NO: 282061 - DNA, 20 bp, Artificial Sequence
  Description of Artificial Sequence: Synthetic oligonucleotide
  Target: ATXN1; (+) strand; PAM type: YTN; PAM sequence: CTG
tggattggtattgtgccctg

SEQ ID NO: 282062 - DNA, 20 bp, Artificial Sequence
  Description of Artificial Sequence: Synthetic oligonucleotide
  Target: ATXN1; (+) strand; PAM type: YTN; PAM sequence: TTG
gtattgtgccctgaactaga

SEQ ID NO: 282063 - DNA, 20 bp, Artificial Sequence
  Description of Artificial Sequence: Synthetic oligonucleotide
  Target: ATXN1; (+) strand; PAM type: YTN; PAM sequence: TTG
tgccctgaactagatttttt

SEQ ID NO: 282064 - DNA, 20 bp, Artificial Sequence
  Description of Artificial Sequence: Synthetic oligonucleotide
  Target: ATXN1; (+) strand; PAM type: YTN; PAM sequence: CTG
aactagattttttgttttgt

SEQ ID NO: 282065 - DNA, 20 bp, Artificial Sequence
  Description of Artificial Sequence: Synthetic oligonucleotide
  Target: ATXN1; (+) strand; PAM type: YTN; PAM sequence: CTA
gattttttgttttgttttgt

SEQ ID NO: 282066 - DNA, 20 bp, Artificial Sequence
  Description of Artificial Sequence: Synthetic oligonucleotide
  Target: ATXN1; (+) strand; PAM type: YTN; PAM sequence: TTT
tttgttttgttttgtttttt

SEQ ID NO: 282067 - DNA, 20 bp, Artificial Sequence
  Description of Artificial Sequence: Synthetic oligonucleotide
  Target: ATXN1; (+) strand; PAM type: YTN; PAM sequence: TTT
ttgttttgttttgttttttg

SEQ ID NO: 282068 - DNA, 20 bp, Artificial Sequence
  Description of Artificial Sequence: Synthetic oligonucleotide
  Target: ATXN1; (+) strand; PAM type: YTN; PAM sequence: TTT
tgttttgttttgttttttga

SEQ ID NO: 282069 - DNA, 20 bp, Artificial Sequence
  Description of Artificial Sequence: Synthetic oligonucleotide
  Target: ATXN1; (+) strand; PAM type: YTN; PAM sequence: TTT
gttttgttttgttttttgat

SEQ ID NO: 282070 - DNA, 20 bp, Artificial Sequence
  Description of Artificial Sequence: Synthetic oligonucleotide
  Target: ATXN1; (+) strand; PAM type: YTN; PAM sequence: TTG
ttttgttttgttttttgatg

SEQ ID NO: 282071 - DNA, 20 bp, Artificial Sequence
  Description of Artificial Sequence: Synthetic oligonucleotide
  Target: ATXN1; (+) strand; PAM type: YTN; PAM sequence: TTT
tgttttgttttttgatggag

SEQ ID NO: 282072 - DNA, 20 bp, Artificial Sequence
  Description of Artificial Sequence: Synthetic oligonucleotide
  Target: ATXN1; (+) strand; PAM type: YTN; PAM sequence: TTT
gttttgttttttgatggagt

SEQ ID NO: 282073 - DNA, 20 bp, Artificial Sequence
  Description of Artificial Sequence: Synthetic oligonucleotide
  Target: ATXN1; (+) strand; PAM type: YTN; PAM sequence: TTG
ttttgttttttgatggagtc

SEQ ID NO: 282074 - DNA, 20 bp, Artificial Sequence
  Description of Artificial Sequence: Synthetic oligonucleotide
  Target: ATXN1; (+) strand; PAM type: YTN; PAM sequence: TTT
tgttttttgatggagtctca

SEQ ID NO: 282075 - DNA, 20 bp, Artificial Sequence
  Description of Artificial Sequence: Synthetic oligonucleotide
  Target: ATXN1; (+) strand; PAM type: YTN; PAM sequence: TTT
gttttttgatggagtctcac

SEQ ID NO: 282076 - DNA, 20 bp, Artificial Sequence
  Description of Artificial Sequence: Synthetic oligonucleotide
  Target: ATXN1; (+) strand; PAM type: YTN; PAM sequence: TTG
ttttttgatggagtctcact

SEQ ID NO: 282077 - DNA, 20 bp, Artificial Sequence
  Description of Artificial Sequence: Synthetic oligonucleotide
  Target: ATXN1; (+) strand; PAM type: YTN; PAM sequence: TTT
tttgatggagtctcactctg

SEQ ID NO: 282078 - DNA, 20 bp, Artificial Sequence
  Description of Artificial Sequence: Synthetic oligonucleotide
  Target: ATXN1; (+) strand; PAM type: YTN; PAM sequence: TTT
ttgatggagtctcactctgt

SEQ ID NO: 282079 - DNA, 20 bp, Artificial Sequence
  Description of Artificial Sequence: Synthetic oligonucleotide
  Target: ATXN1; (+) strand; PAM type: YTN; PAM sequence: TTT
tgatggagtctcactctgtc

SEQ ID NO: 282080 - DNA, 20 bp, Artificial Sequence
  Description of Artificial Sequence: Synthetic oligonucleotide
  Target: ATXN1; (+) strand; PAM type: YTN; PAM sequence: TTT
gatggagtctcactctgtca

SEQ ID NO: 282081 - DNA, 20 bp, Artificial Sequence
  Description of Artificial Sequence: Synthetic oligonucleotide
  Target: ATXN1; (+) strand; PAM type: YTN; PAM sequence: TTG
atggagtctcactctgtcac

SEQ ID NO: 282082 - DNA, 20 bp, Artificial Sequence
  Description of Artificial Sequence: Synthetic oligonucleotide
  Target: ATXN1; (+) strand; PAM type: YTN; PAM sequence: CTC
actctgtcacccaggctgga

SEQ ID NO: 282083 - DNA, 20 bp, Artificial Sequence
  Description of Artificial Sequence: Synthetic oligonucleotide
  Target: ATXN1; (+) strand; PAM type: YTN; PAM sequence: CTC
tgtcacccaggctggagtgc

SEQ ID NO: 282084 - DNA, 20 bp, Artificial Sequence
  Description of Artificial Sequence: Synthetic oligonucleotide
  Target: ATXN1; (+) strand; PAM type: YTN; PAM sequence: CTG
tcacccaggctggagtgcag

SEQ ID NO: 282085 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggccggatctc

SEQ ID NO: 282086 - DNA, 20 bp, Artificial Sequence
  Description of Artificial Sequence: Synthetic oligonucleotide
  Target: ATXN1; (+) strand; PAM type: YTN; PAM sequence: CTC
agctcactgcaacctctgcc

SEQ ID NO: 282087 - DNA, 20 bp, Artificial Sequence
  Description of Artificial Sequence: Synthetic oligonucleotide
  Target: ATXN1; (+) strand; PAM type: YTN; PAM sequence: CTC
actgcaacctctgccttcca

SEQ ID NO: 282088 - DNA, 20 bp, Artificial Sequence
  Description of Artificial Sequence: Synthetic oligonucleotide
  Target: ATXN1; (+) strand; PAM type: YTN; PAM sequence: CTG
caacctctgccttccaggtt

SEQ ID NO: 282089 - DNA, 20 bp, Artificial Sequence
  Description of Artificial Sequence: Synthetic oligonucleotide
  Target: ATXN1; (+) strand; PAM type: YTN; PAM sequence: CTC
tgccttccaggttcaagcaa

SEQ ID NO: 282090 - DNA, 20 bp, Artificial Sequence
  Description of Artificial Sequence: Synthetic oligonucleotide
  Target: ATXN1; (+) strand; PAM type: YTN; PAM sequence: CTG
ccttccaggttcaagcaatt

SEQ ID NO: 282091 - DNA, 20 bp, Artificial Sequence
  Description of Artificial Sequence: Synthetic oligonucleotide
  Target: ATXN1; (+) strand; PAM type: YTN; PAM sequence: CTT
ccaggttcaagcaattctct

SEQ ID NO: 282092 - DNA, 20 bp, Artificial Sequence
  Description of Artificial Sequence: Synthetic oligonucleotide
  Target: ATXN1; (+) strand; PAM type: YTN; PAM sequence: TTC
caggttcaagcaattctctt

SEQ ID NO: 282093 - DNA, 20 bp, Artificial Sequence
  Description of Artificial Sequence: Synthetic oligonucleotide
  Target: ATXN1; (+) strand; PAM type: YTN; PAM sequence: TTC
aagcaattctcttgcctcag

SEQ ID NO: 282094 - DNA, 20 bp, Artificial Sequence
  Description of Artificial Sequence: Synthetic oligonucleotide
  Target: ATXN1; (+) strand; PAM type: YTN; PAM sequence: TTC
tcttgcctcagcctcccaag

SEQ ID NO: 282095 - DNA, 20 bp, Artificial Sequence
  Description of Artificial Sequence: Synthetic oligonucleotide
  Target: ATXN1; (+) strand; PAM type: YTN; PAM sequence: CTC
ttgcctcagcctcccaagta

SEQ ID NO: 282096 - DNA, 20 bp, Artificial Sequence
  Description of Artificial Sequence: Synthetic oligonucleotide
  Target: ATXN1; (+) strand; PAM type: YTN; PAM sequence: CTT
gcctcagcctcccaagtagc

SEQ ID NO: 282097 - DNA, 20 bp, Artificial Sequence
  Description of Artificial Sequence: Synthetic oligonucleotide
  Target: ATXN1; (+) strand; PAM type: YTN; PAM sequence: TTG
cctcagcctcccaagtagct

SEQ ID NO: 282098 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagtagctggga

SEQ ID NO: 282099 - DNA, 20 bp, Artificial Sequence
  Description of Artificial Sequence: Synthetic oligonucleotide
  Target: ATXN1; (+) strand; PAM type: YTN; PAM sequence: CTC
ccaagtagctgggattacag

SEQ ID NO: 282100 - DNA, 20 bp, Artificial Sequence
  Description of Artificial Sequence: Synthetic oligonucleotide
  Target: ATXN1; (+) strand; PAM type: YTN; PAM sequence: CTG
ggattacaggtacacaccac

SEQ ID NO: 282101 - DNA, 20 bp, Artificial Sequence
  Description of Artificial Sequence: Synthetic oligonucleotide
  Target: ATXN1; (+) strand; PAM type: YTN; PAM sequence: TTA
caggtacacaccaccatgcc

SEQ ID NO: 282102 - DNA, 20 bp, Artificial Sequence
  Description of Artificial Sequence: Synthetic oligonucleotide
  Target: ATXN1; (+) strand; PAM type: YTN; PAM sequence: CTA
gctaatttttgtattattta

SEQ ID NO: 282103 - DNA, 20 bp, Artificial Sequence
  Description of Artificial Sequence: Synthetic oligonucleotide
  Target: ATXN1; (+) strand; PAM type: YTN; PAM sequence: CTA
atttttgtattatttattta

SEQ ID NO: 282104 - DNA, 20 bp, Artificial Sequence
  Description of Artificial Sequence: Synthetic oligonucleotide
  Target: ATXN1; (+) strand; PAM type: YTN; PAM sequence: TTT
ttgtattatttatttattta

SEQ ID NO: 282105 - DNA, 20 bp, Artificial Sequence
  Description of Artificial Sequence: Synthetic oligonucleotide
  Target: ATXN1; (+) strand; PAM type: YTN; PAM sequence: TTT
tgtattatttatttatttat

SEQ ID NO: 282106 - DNA, 20 bp, Artificial Sequence
  Description of Artificial Sequence: Synthetic oligonucleotide
  Target: ATXN1; (+) strand; PAM type: YTN; PAM sequence: TTT
gtattatttatttatttatt

SEQ ID NO: 282107 - DNA, 20 bp, Artificial Sequence
  Description of Artificial Sequence: Synthetic oligonucleotide
  Target: ATXN1; (+) strand; PAM type: YTN; PAM sequence: TTG
tattatttatttatttattt

SEQ ID NO: 282108 - DNA, 20 bp, Artificial Sequence
  Description of Artificial Sequence: Synthetic oligonucleotide
  Target: ATXN1; (+) strand; PAM type: YTN; PAM sequence: TTA
tttatttatttatttatttg

SEQ ID NO: 282109 - DNA, 20 bp, Artificial Sequence
  Description of Artificial Sequence: Synthetic oligonucleotide
  Target: ATXN1; (+) strand; PAM type: YTN; PAM sequence: TTT
atttatttatttatttgaga

SEQ ID NO: 282110 - DNA, 20 bp, Artificial Sequence
  Description of Artificial Sequence: Synthetic oligonucleotide
  Target: ATXN1; (+) strand; PAM type: YTN; PAM sequence: TTA
tttatttatttatttgagac

SEQ ID NO: 282111 - DNA, 20 bp, Artificial Sequence
  Description of Artificial Sequence: Synthetic oligonucleotide
  Target: ATXN1; (+) strand; PAM type: YTN; PAM sequence: TTT
atttatttatttgagacgga

SEQ ID NO: 282112 - DNA, 20 bp, Artificial Sequence
  Description of Artificial Sequence: Synthetic oligonucleotide
  Target: ATXN1; (+) strand; PAM type: YTN; PAM sequence: TTA
tttatttatttgagacggag

SEQ ID NO: 282113 - DNA, 20 bp, Artificial Sequence
  Description of Artificial Sequence: Synthetic oligonucleotide
  Target: ATXN1; (+) strand; PAM type: YTN; PAM sequence: TTT
atttatttgagacggagtct

SEQ ID NO: 282114 - DNA, 20 bp, Artificial Sequence
  Description of Artificial Sequence: Synthetic oligonucleotide
  Target: ATXN1; (+) strand; PAM type: YTN; PAM sequence: TTA
tttatttgagacggagtctc

SEQ ID NO: 282115 - DNA, 20 bp, Artificial Sequence
  Description of Artificial Sequence: Synthetic oligonucleotide
  Target: ATXN1; (+) strand; PAM type: YTN; PAM sequence: TTT
atttgagacggagtctcgct

SEQ ID NO: 282116 - DNA, 20 bp, Artificial Sequence
  Description of Artificial Sequence: Synthetic oligonucleotide
  Target: ATXN1; (+) strand; PAM type: YTN; PAM sequence: TTA
tttgagacggagtctcgctc

SEQ ID NO: 282117 - DNA, 20 bp, Artificial Sequence
  Description of Artificial Sequence: Synthetic oligonucleotide
  Target: ATXN1; (+) strand; PAM type: YTN; PAM sequence: TTT
gagacggagtctcgctctgt

SEQ ID NO: 282118 - DNA, 20 bp, Artificial Sequence
  Description of Artificial Sequence: Synthetic oligonucleotide
  Target: ATXN1; (+) strand; PAM type: YTN; PAM sequence: TTG
agacggagtctcgctctgtc

SEQ ID NO: 282119 - DNA, 20 bp, Artificial Sequence
  Description of Artificial Sequence: Synthetic oligonucleotide
  Target: ATXN1; (+) strand; PAM type: YTN; PAM sequence: CTC
gctctgtcgcccaggctggc

SEQ ID NO: 282120 - DNA, 20 bp, Artificial Sequence
  Description of Artificial Sequence: Synthetic oligonucleotide
  Target: ATXN1; (+) strand; PAM type: YTN; PAM sequence: CTC
tgtcgcccaggctggcatgc

SEQ ID NO: 282121 - DNA, 20 bp, Artificial Sequence
  Description of Artificial Sequence: Synthetic oligonucleotide
  Target: ATXN1; (+) strand; PAM type: YTN; PAM sequence: CTG
tcgcccaggctggcatgcag

SEQ ID NO: 282122 - DNA, 20 bp, Artificial Sequence
  Description of Artificial Sequence: Synthetic oligonucleotide
  Target: ATXN1; (+) strand; PAM type: YTN; PAM sequence: CTG
gcatgcagtggcgcgatctc

SEQ ID NO: 282123 - DNA, 20 bp, Artificial Sequence
  Description of Artificial Sequence: Synthetic oligonucleotide
  Target: ATXN1; (+) strand; PAM type: YTN; PAM sequence: CTC
ggctcactgcaacctctgcc

SEQ ID NO: 282124 - DNA, 20 bp, Artificial Sequence
  Description of Artificial Sequence: Synthetic oligonucleotide
  Target: ATXN1; (+) strand; PAM type: YTN; PAM sequence: CTC
actgcaacctctgcctccgg

SEQ ID NO: 282125 - DNA, 20 bp, Artificial Sequence
  Description of Artificial Sequence: Synthetic oligonucleotide
  Target: ATXN1; (+) strand; PAM type: YTN; PAM sequence: CTG
caacctctgcctccggggtt

SEQ ID NO: 282126 - DNA, 20 bp, Artificial Sequence
  Description of Artificial Sequence: Synthetic oligonucleotide
  Target: ATXN1; (+) strand; PAM type: YTN; PAM sequence: CTC
tgcctccggggttcaagtgc

SEQ ID NO: 282127 - DNA, 20 bp, Artificial Sequence
  Description of Artificial Sequence: Synthetic oligonucleotide
  Target: ATXN1; (+) strand; PAM type: YTN; PAM sequence: CTG
cctccggggttcaagtgctt

SEQ ID NO: 282128 - DNA, 20 bp, Artificial Sequence
  Description of Artificial Sequence: Synthetic oligonucleotide
  Target: ATXN1; (+) strand; PAM type: YTN; PAM sequence: CTC
cggggttcaagtgcttctcc

SEQ ID NO: 282129 - DNA, 20 bp, Artificial Sequence
  Description of Artificial Sequence: Synthetic oligonucleotide
  Target: ATXN1; (+) strand; PAM type: YTN; PAM sequence: TTC
aagtgcttctcctgcctcag

SEQ ID NO: 282130 - DNA, 20 bp, Artificial Sequence
  Description of Artificial Sequence: Synthetic oligonucleotide
  Target: ATXN1; (+) strand; PAM type: YTN; PAM sequence: CTT
ctcctgcctcagcctcttga

SEQ ID NO: 282131 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcttgag

SEQ ID NO: 282132 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcttgagta

SEQ ID NO: 282133 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcttgagtagct

SEQ ID NO: 282134 - DNA, 20 bp, Artificial Sequence
  Description of Artificial Sequence: Synthetic oligonucleotide
  Target: ATXN1; (+) strand; PAM type: YTN; PAM sequence: CTC
agcctcttgagtagctggga

SEQ ID NO: 282135 - DNA, 20 bp, Artificial Sequence
  Description of Artificial Sequence: Synthetic oligonucleotide
  Target: ATXN1; (+) strand; PAM type: YTN; PAM sequence: CTC
ttgagtagctgggattacag

SEQ ID NO: 282136 - DNA, 20 bp, Artificial Sequence
  Description of Artificial Sequence: Synthetic oligonucleotide
  Target: ATXN1; (+) strand; PAM type: YTN; PAM sequence: CTT
gagtagctgggattacaggc

SEQ ID NO: 282137 - DNA, 20 bp, Artificial Sequence
  Description of Artificial Sequence: Synthetic oligonucleotide
  Target: ATXN1; (+) strand; PAM type: YTN; PAM sequence: TTG
agtagctgggattacaggca

SEQ ID NO: 282138 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcatgcgccac

SEQ ID NO: 282139 - DNA, 20 bp, Artificial Sequence
  Description of Artificial Sequence: Synthetic oligonucleotide
  Target: ATXN1; (+) strand; PAM type: YTN; PAM sequence: TTA
caggcatgcgccaccatgcc

SEQ ID NO: 282140 - DNA, 20 bp, Artificial Sequence
  Description of Artificial Sequence: Synthetic oligonucleotide
  Target: ATXN1; (+) strand; PAM type: YTN; PAM sequence: CTA
attttatttgtatttttagt

SEQ ID NO: 282141 - DNA, 20 bp, Artificial Sequence
  Description of Artificial Sequence: Synthetic oligonucleotide
  Target: ATXN1; (+) strand; PAM type: YTN; PAM sequence: TTT
tatttgtatttttagtagaa

SEQ ID NO: 282142 - DNA, 20 bp, Artificial Sequence
  Description of Artificial Sequence: Synthetic oligonucleotide
  Target: ATXN1; (+) strand; PAM type: YTN; PAM sequence: TTT
atttgtatttttagtagaaa

SEQ ID NO: 282143 - DNA, 20 bp, Artificial Sequence
  Description of Artificial Sequence: Synthetic oligonucleotide
  Target: ATXN1; (+) strand; PAM type: YTN; PAM sequence: TTA
tttgtatttttagtagaaac

SEQ ID NO: 282144 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagaaacggg

SEQ ID NO: 282145 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagaaacgggg

SEQ ID NO: 282146 - DNA, 20 bp, Artificial Sequence
  Description of Artificial Sequence: Synthetic oligonucleotide
  Target: ATXN1; (+) strand; PAM type: YTN; PAM sequence: TTT
ttagtagaaacggggtttct

SEQ ID NO: 282147 - DNA, 20 bp, Artificial Sequence
  Description of Artificial Sequence: Synthetic oligonucleotide
  Target: ATXN1; (+) strand; PAM type: YTN; PAM sequence: TTT
tagtagaaacggggtttctc

SEQ ID NO: 282148 - DNA, 20 bp, Artificial Sequence
  Description of Artificial Sequence: Synthetic oligonucleotide
  Target: ATXN1; (+) strand; PAM type: YTN; PAM sequence: TTT
agtagaaacggggtttctcc

SEQ ID NO: 282149 - DNA, 20 bp, Artificial Sequence
  Description of Artificial Sequence: Synthetic oligonucleotide
  Target: ATXN1; (+) strand; PAM type: YTN; PAM sequence: TTA
gtagaaacggggtttctcca

SEQ ID NO: 282150 - DNA, 20 bp, Artificial Sequence
  Description of Artificial Sequence: Synthetic oligonucleotide
  Target: ATXN1; (+) strand; PAM type: YTN; PAM sequence: TTT
ctccatgttgctcagggtgg

SEQ ID NO: 282151 - DNA, 20 bp, Artificial Sequence
  Description of Artificial Sequence: Synthetic oligonucleotide
  Target: ATXN1; (+) strand; PAM type: YTN; PAM sequence: TTC
tccatgttgctcagggtggt

SEQ ID NO: 282152 - DNA, 20 bp, Artificial Sequence
  Description of Artificial Sequence: Synthetic oligonucleotide
  Target: ATXN1; (+) strand; PAM type: YTN; PAM sequence: CTC
catgttgctcagggtggtct

SEQ ID NO: 282153 - DNA, 20 bp, Artificial Sequence
  Description of Artificial Sequence: Synthetic oligonucleotide
  Target: ATXN1; (+) strand; PAM type: YTN; PAM sequence: TTG
ctcagggtggtctcgaactc

SEQ ID NO: 282154 - DNA, 20 bp, Artificial Sequence
  Description of Artificial Sequence: Synthetic oligonucleotide
  Target: ATXN1; (+) strand; PAM type: YTN; PAM sequence: CTC
agggtggtctcgaactcccg

SEQ ID NO: 282155 - DNA, 20 bp, Artificial Sequence
  Description of Artificial Sequence: Synthetic oligonucleotide
  Target: ATXN1; (+) strand; PAM type: YTN; PAM sequence: CTC
gaactcccgacctcaggtga

SEQ ID NO: 282156 - DNA, 20 bp, Artificial Sequence
  Description of Artificial Sequence: Synthetic oligonucleotide
  Target: ATXN1; (+) strand; PAM type: YTN; PAM sequence: CTC
ccgacctcaggtgatccgcc

SEQ ID NO: 282157 - DNA, 20 bp, Artificial Sequence
  Description of Artificial Sequence: Synthetic oligonucleotide
  Target: ATXN1; (+) strand; PAM type: YTN; PAM sequence: CTC
aggtgatccgcccgcctcgg

SEQ ID NO: 282158 - DNA, 20 bp, Artificial Sequence
  Description of Artificial Sequence: Synthetic oligonucleotide
  Target: ATXN1; (+) strand; PAM type: YTN; PAM sequence: CTC
ggcctcccaaagtgttggga

SEQ ID NO: 282159 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgttgggattacag

SEQ ID NO: 282160 - DNA, 20 bp, Artificial Sequence
  Description of Artificial Sequence: Synthetic oligonucleotide
  Target: ATXN1; (+) strand; PAM type: YTN; PAM sequence: TTG
ggattacaggcatgagccac

SEQ ID NO: 282161 - DNA, 20 bp, Artificial Sequence
  Description of Artificial Sequence: Synthetic oligonucleotide
  Target: ATXN1; (+) strand; PAM type: YTN; PAM sequence: TTA
caggcatgagccaccgcacc

SEQ ID NO: 282162 - DNA, 20 bp, Artificial Sequence
  Description of Artificial Sequence: Synthetic oligonucleotide
  Target: ATXN1; (+) strand; PAM type: YTN; PAM sequence: CTA
atttttgtattttcagtaga

SEQ ID NO: 282163 - DNA, 20 bp, Artificial Sequence
  Description of Artificial Sequence: Synthetic oligonucleotide
  Target: ATXN1; (+) strand; PAM type: YTN; PAM sequence: TTT
ttgtattttcagtagagatg

SEQ ID NO: 282164 - DNA, 20 bp, Artificial Sequence
  Description of Artificial Sequence: Synthetic oligonucleotide
  Target: ATXN1; (+) strand; PAM type: YTN; PAM sequence: TTT
tgtattttcagtagagatgg

SEQ ID NO: 282165 - DNA, 20 bp, Artificial Sequence
  Description of Artificial Sequence: Synthetic oligonucleotide
  Target: ATXN1; (+) strand; PAM type: YTN; PAM sequence: TTT
gtattttcagtagagatggg

SEQ ID NO: 282166 - DNA, 20 bp, Artificial Sequence
  Description of Artificial Sequence: Synthetic oligonucleotide
  Target: ATXN1; (+) strand; PAM type: YTN; PAM sequence: TTG
tattttcagtagagatgggg

SEQ ID NO: 282167 - DNA, 20 bp, Artificial Sequence
  Description of Artificial Sequence: Synthetic oligonucleotide
  Target: ATXN1; (+) strand; PAM type: YTN; PAM sequence: TTT
tcagtagagatggggtttca

SEQ ID NO: 282168 - DNA, 20 bp, Artificial Sequence
  Description of Artificial Sequence: Synthetic oligonucleotide
  Target: ATXN1; (+) strand; PAM type: YTN; PAM sequence: TTT
cagtagagatggggtttcac

SEQ ID NO: 282169 - DNA, 20 bp, Artificial Sequence
  Description of Artificial Sequence: Synthetic oligonucleotide
  Target: ATXN1; (+) strand; PAM type: YTN; PAM sequence: TTC
agtagagatggggtttcacc

SEQ ID NO: 282170 - DNA, 20 bp, Artificial Sequence
  Description of Artificial Sequence: Synthetic oligonucleotide
  Target: ATXN1; (+) strand; PAM type: YTN; PAM sequence: TTT
caccatgttggccagtctgg

SEQ ID NO: 282171 - DNA, 20 bp, Artificial Sequence
  Description of Artificial Sequence: Synthetic oligonucleotide
  Target: ATXN1; (+) strand; PAM type: YTN; PAM sequence: TTC
accatgttggccagtctggt

SEQ ID NO: 282172 - DNA, 20 bp, Artificial Sequence
  Description of Artificial Sequence: Synthetic oligonucleotide
  Target: ATXN1; (+) strand; PAM type: YTN; PAM sequence: TTG
gccagtctggtctcgatctc

SEQ ID NO: 282173 - DNA, 20 bp, Artificial Sequence
  Description of Artificial Sequence: Synthetic oligonucleotide
  Target: ATXN1; (+) strand; PAM type: YTN; PAM sequence: CTG
gtctcgatctcctgacctca

SEQ ID NO: 282174 - DNA, 20 bp, Artificial Sequence
  Description of Artificial Sequence: Synthetic oligonucleotide
  Target: ATXN1; (+) strand; PAM type: YTN; PAM sequence: CTC
gatctcctgacctcaagtga

SEQ ID NO: 282175 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaagtgatctgcc

SEQ ID NO: 282176 - DNA, 20 bp, Artificial Sequence
  Description of Artificial Sequence: Synthetic oligonucleotide
  Target: ATXN1; (+) strand; PAM type: YTN; PAM sequence: CTG
acctcaagtgatctgcccac

SEQ ID NO: 282177 - DNA, 20 bp, Artificial Sequence
  Description of Artificial Sequence: Synthetic oligonucleotide
  Target: ATXN1; (+) strand; PAM type: YTN; PAM sequence: CTC
aagtgatctgcccacctcgg

SEQ ID NO: 282178 - DNA, 20 bp, Artificial Sequence
  Description of Artificial Sequence: Synthetic oligonucleotide
  Target: ATXN1; (+) strand; PAM type: YTN; PAM sequence: CTG
cccacctcggcctacctaag

SEQ ID NO: 282179 - DNA, 20 bp, Artificial Sequence
  Description of Artificial Sequence: Synthetic oligonucleotide
  Target: ATXN1; (+) strand; PAM type: YTN; PAM sequence: CTC
ggcctacctaagtgtcaact

SEQ ID NO: 282180 - DNA, 20 bp, Artificial Sequence
  Description of Artificial Sequence: Synthetic oligonucleotide
  Target: ATXN1; (+) strand; PAM type: YTN; PAM sequence: CTA
cctaagtgtcaactaggttt

SEQ ID NO: 282181 - DNA, 20 bp, Artificial Sequence
  Description of Artificial Sequence: Synthetic oligonucleotide
  Target: ATXN1; (+) strand; PAM type: YTN; PAM sequence: CTA
agtgtcaactaggttttttt

SEQ ID NO: 282182 - DNA, 20 bp, Artificial Sequence
  Description of Artificial Sequence: Synthetic oligonucleotide
  Target: ATXN1; (+) strand; PAM type: YTN; PAM sequence: CTA
ggtttttttgaagataattt

SEQ ID NO: 282183 - DNA, 20 bp, Artificial Sequence
  Description of Artificial Sequence: Synthetic oligonucleotide
  Target: ATXN1; (+) strand; PAM type: YTN; PAM sequence: TTT
ttttgaagataattttagat

SEQ ID NO: 282184 - DNA, 20 bp, Artificial Sequence
  Description of Artificial Sequence: Synthetic oligonucleotide
  Target: ATXN1; (+) strand; PAM type: YTN; PAM sequence: TTT
tttgaagataattttagatt

SEQ ID NO: 282185 - DNA, 20 bp, Artificial Sequence
  Description of Artificial Sequence: Synthetic oligonucleotide
  Target: ATXN1; (+) strand; PAM type: YTN; PAM sequence: TTT
ttgaagataattttagattt

SEQ ID NO: 282186 - DNA, 20 bp, Artificial Sequence
  Description of Artificial Sequence: Synthetic oligonucleotide
  Target: ATXN1; (+) strand; PAM type: YTN; PAM sequence: TTT
tgaagataattttagattta

SEQ ID NO: 282187 - DNA, 20 bp, Artificial Sequence
  Description of Artificial Sequence: Synthetic oligonucleotide
  Target: ATXN1; (+) strand; PAM type: YTN; PAM sequence: TTT
gaagataattttagatttac

SEQ ID NO: 282188 - DNA, 20 bp, Artificial Sequence
  Description of Artificial Sequence: Synthetic oligonucleotide
  Target: ATXN1; (+) strand; PAM type: YTN; PAM sequence: TTG
aagataattttagatttaca

SEQ ID NO: 282189 - DNA, 20 bp, Artificial Sequence
  Description of Artificial Sequence: Synthetic oligonucleotide
  Target: ATXN1; (+) strand; PAM type: YTN; PAM sequence: TTT
tagatttacagaaagcggca

SEQ ID NO: 282190 - DNA, 20 bp, Artificial Sequence
  Description of Artificial Sequence: Synthetic oligonucleotide
  Target: ATXN1; (+) strand; PAM type: YTN; PAM sequence: TTT
agatttacagaaagcggcaa

SEQ ID NO: 282191 - DNA, 20 bp, Artificial Sequence
  Description of Artificial Sequence: Synthetic oligonucleotide
  Target: ATXN1; (+) strand; PAM type: YTN; PAM sequence: TTA
gatttacagaaagcggcaaa

SEQ ID NO: 282192 - DNA, 20 bp, Artificial Sequence
  Description of Artificial Sequence: Synthetic oligonucleotide
  Target: ATXN1; (+) strand; PAM type: YTN; PAM sequence: TTT
acagaaagcggcaaaaatag

SEQ ID NO: 282193 - DNA, 20 bp, Artificial Sequence
  Description of Artificial Sequence: Synthetic oligonucleotide
  Target: ATXN1; (+) strand; PAM type: YTN; PAM sequence: TTA
cagaaagcggcaaaaatagt

SEQ ID NO: 282194 - DNA, 20 bp, Artificial Sequence
  Description of Artificial Sequence: Synthetic oligonucleotide
  Target: ATXN1; (+) strand; PAM type: YTN; PAM sequence: CTC
ccttgtaccttccacccagt

SEQ ID NO: 282195 - DNA, 20 bp, Artificial Sequence
  Description of Artificial Sequence: Synthetic oligonucleotide
  Target: ATXN1; (+) strand; PAM type: YTN; PAM sequence: CTT
gtaccttccacccagtttcc

SEQ ID NO: 282196 - DNA, 20 bp, Artificial Sequence
  Description of Artificial Sequence: Synthetic oligonucleotide
  Target: ATXN1; (+) strand; PAM type: YTN; PAM sequence: TTG
taccttccacccagtttccc

SEQ ID NO: 282197 - DNA, 20 bp, Artificial Sequence
  Description of Artificial Sequence: Synthetic oligonucleotide
  Target: ATXN1; (+) strand; PAM type: YTN; PAM sequence: CTT
ccacccagtttccccctata

SEQ ID NO: 282198 - DNA, 20 bp, Artificial Sequence
  Description of Artificial Sequence: Synthetic oligonucleotide
  Target: ATXN1; (+) strand; PAM type: YTN; PAM sequence: TTC
cacccagtttccccctatat

SEQ ID NO: 282199 - DNA, 20 bp, Artificial Sequence
  Description of Artificial Sequence: Synthetic oligonucleotide
  Target: ATXN1; (+) strand; PAM type: YTN; PAM sequence: TTT
ccccctatattaacagctta

SEQ ID NO: 282200 - DNA, 20 bp, Artificial Sequence
  Description of Artificial Sequence: Synthetic oligonucleotide
  Target: ATXN1; (+) strand; PAM type: YTN; PAM sequence: TTC
cccctatattaacagcttac

SEQ ID NO: 282201 - DNA, 20 bp, Artificial Sequence
  Description of Artificial Sequence: Synthetic oligonucleotide
  Target: ATXN1; (+) strand; PAM type: YTN; PAM sequence: CTA
tattaacagcttacaaagcc

SEQ ID NO: 282202 - DNA, 20 bp, Artificial Sequence
  Description of Artificial Sequence: Synthetic oligonucleotide
  Target: ATXN1; (+) strand; PAM type: YTN; PAM sequence: TTA
acagcttacaaagccataga

SEQ ID NO: 282203 - DNA, 20 bp, Artificial Sequence
  Description of Artificial Sequence: Synthetic oligonucleotide
  Target: ATXN1; (+) strand; PAM type: YTN; PAM sequence: CTT
acaaagccatagaaccacga

SEQ ID NO: 282204 - DNA, 20 bp, Artificial Sequence
  Description of Artificial Sequence: Synthetic oligonucleotide
  Target: ATXN1; (+) strand; PAM type: YTN; PAM sequence: TTA
caaagccatagaaccacgat

SEQ ID NO: 282205 - DNA, 20 bp, Artificial Sequence
  Description of Artificial Sequence: Synthetic oligonucleotide
  Target: ATXN1; (+) strand; PAM type: YTN; PAM sequence: CTA
gaaagttaacctgggtcacg

SEQ ID NO: 282206 - DNA, 20 bp, Artificial Sequence
  Description of Artificial Sequence: Synthetic oligonucleotide
  Target: ATXN1; (+) strand; PAM type: YTN; PAM sequence: TTA
acctgggtcacgactactca

SEQ ID NO: 282207 - DNA, 20 bp, Artificial Sequence
  Description of Artificial Sequence: Synthetic oligonucleotide
  Target: ATXN1; (+) strand; PAM type: YTN; PAM sequence: CTG
ggtcacgactactcaacaaa

SEQ ID NO: 282208 - DNA, 20 bp, Artificial Sequence
  Description of Artificial Sequence: Synthetic oligonucleotide
  Target: ATXN1; (+) strand; PAM type: YTN; PAM sequence: CTA
ctcaacaaaccgtagggtgt

SEQ ID NO: 282209 - DNA, 20 bp, Artificial Sequence
  Description of Artificial Sequence: Synthetic oligonucleotide
  Target: ATXN1; (+) strand; PAM type: YTN; PAM sequence: CTC
aacaaaccgtagggtgtatt

SEQ ID NO: 282210 - DNA, 20 bp, Artificial Sequence
  Description of Artificial Sequence: Synthetic oligonucleotide
  Target: ATXN1; (+) strand; PAM type: YTN; PAM sequence: TTA
ggatttcaccagtttttgca

SEQ ID NO: 282211 - DNA, 20 bp, Artificial Sequence
  Description of Artificial Sequence: Synthetic oligonucleotide
  Target: ATXN1; (+) strand; PAM type: YTN; PAM sequence: TTT
caccagtttttgcaccaaac

SEQ ID NO: 282212 - DNA, 20 bp, Artificial Sequence
  Description of Artificial Sequence: Synthetic oligonucleotide
  Target: ATXN1; (+) strand; PAM type: YTN; PAM sequence: TTC
accagtttttgcaccaaaca

SEQ ID NO: 282213 - DNA, 20 bp, Artificial Sequence
  Description of Artificial Sequence: Synthetic oligonucleotide
  Target: ATXN1; (+) strand; PAM type: YTN; PAM sequence: TTT
ttgcaccaaacaggcttttt

SEQ ID NO: 282214 - DNA, 20 bp, Artificial Sequence
  Description of Artificial Sequence: Synthetic oligonucleotide
  Target: ATXN1; (+) strand; PAM type: YTN; PAM sequence: TTT
tgcaccaaacaggctttttt

SEQ ID NO: 282215 - DNA, 20 bp, Artificial Sequence
  Description of Artificial Sequence: Synthetic oligonucleotide
  Target: ATXN1; (+) strand; PAM type: YTN; PAM sequence: TTT
gcaccaaacaggcttttttt

SEQ ID NO: 282216 - DNA, 20 bp, Artificial Sequence
  Description of Artificial Sequence: Synthetic oligonucleotide
  Target: ATXN1; (+) strand; PAM type: YTN; PAM sequence: TTG
caccaaacaggctttttttt

SEQ ID NO: 282217 - DNA, 20 bp, Artificial Sequence
  Description of Artificial Sequence: Synthetic oligonucleotide
  Target: ATXN1; (+) strand; PAM type: YTN; PAM sequence: CTT
tttttttttttttcctgttt

SEQ ID NO: 282218 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttcctgtttc

SEQ ID NO: 282219 - DNA, 20 bp, Artificial Sequence
  Description of Artificial Sequence: Synthetic oligonucleotide
  Target: ATXN1; (+) strand; PAM type: YTN; PAM sequence: TTT
tttttttttttcctgtttca

SEQ ID NO: 282220 - DNA, 20 bp, Artificial Sequence
  Description of Artificial Sequence: Synthetic oligonucleotide
  Target: ATXN1; (+) strand; PAM type: YTN; PAM sequence: TTT
ttttttttttcctgtttcag

SEQ ID NO: 282221 - DNA, 20 bp, Artificial Sequence
  Description of Artificial Sequence: Synthetic oligonucleotide
  Target: ATXN1; (+) strand; PAM type: YTN; PAM sequence: TTT
tttttttttcctgtttcagg

SEQ ID NO: 282222 - DNA, 20 bp, Artificial Sequence
  Description of Artificial Sequence: Synthetic oligonucleotide
  Target: ATXN1; (+) strand; PAM type: YTN; PAM sequence: TTT
ttttttttcctgtttcagga

SEQ ID NO: 282223 - DNA, 20 bp, Artificial Sequence
  Description of Artificial Sequence: Synthetic oligonucleotide
  Target: ATXN1; (+) strand; PAM type: YTN; PAM sequence: TTT
tttttttcctgtttcaggat

SEQ ID NO: 282224 - DNA, 20 bp, Artificial Sequence
  Description of Artificial Sequence: Synthetic oligonucleotide
  Target: ATXN1; (+) strand; PAM type: YTN; PAM sequence: TTT
ttttttcctgtttcaggatc

SEQ ID NO: 282225 - DNA, 20 bp, Artificial Sequence
  Description of Artificial Sequence: Synthetic oligonucleotide
  Target: ATXN1; (+) strand; PAM type: YTN; PAM sequence: TTT
tttttcctgtttcaggatca

SEQ ID NO: 282226 - DNA, 20 bp, Artificial Sequence
  Description of Artificial Sequence: Synthetic oligonucleotide
  Target: ATXN1; (+) strand; PAM type: YTN; PAM sequence: TTT
ttttcctgtttcaggatcat

SEQ ID NO: 282227 - DNA, 20 bp, Artificial Sequence
  Description of Artificial Sequence: Synthetic oligonucleotide
  Target: ATXN1; (+) strand; PAM type: YTN; PAM sequence: TTT
tttcctgtttcaggatcata

SEQ ID NO: 282228 - DNA, 20 bp, Artificial Sequence
  Description of Artificial Sequence: Synthetic oligonucleotide
  Target: ATXN1; (+) strand; PAM type: YTN; PAM sequence: TTT
ttcctgtttcaggatcatac

SEQ ID NO: 282229 - DNA, 20 bp, Artificial Sequence
  Description of Artificial Sequence: Synthetic oligonucleotide
  Target: ATXN1; (+) strand; PAM type: YTN; PAM sequence: TTT
tcctgtttcaggatcatact

SEQ ID NO: 282230 - DNA, 20 bp, Artificial Sequence
  Description of Artificial Sequence: Synthetic oligonucleotide
  Target: ATXN1; (+) strand; PAM type: YTN; PAM sequence: TTT
cctgtttcaggatcatactt

SEQ ID NO: 282231 - DNA, 20 bp, Artificial Sequence
  Description of Artificial Sequence: Synthetic oligonucleotide
  Target: ATXN1; (+) strand; PAM type: YTN; PAM sequence: TTC
ctgtttcaggatcatactta

SEQ ID NO: 282232 - DNA, 20 bp, Artificial Sequence
  Description of Artificial Sequence: Synthetic oligonucleotide
  Target: ATXN1; (+) strand; PAM type: YTN; PAM sequence: CTG
tttcaggatcatacttagaa

SEQ ID NO: 282233 - DNA, 20 bp, Artificial Sequence
  Description of Artificial Sequence: Synthetic oligonucleotide
  Target: ATXN1; (+) strand; PAM type: YTN; PAM sequence: TTT
caggatcatacttagaattt

SEQ ID NO: 282234 - DNA, 20 bp, Artificial Sequence
  Description of Artificial Sequence: Synthetic oligonucleotide
  Target: ATXN1; (+) strand; PAM type: YTN; PAM sequence: TTC
aggatcatacttagaatttt

SEQ ID NO: 282235 - DNA, 20 bp, Artificial Sequence
  Description of Artificial Sequence: Synthetic oligonucleotide
  Target: ATXN1; (+) strand; PAM type: YTN; PAM sequence: CTT
agaattttatgtggtcatat

SEQ ID NO: 282236 - DNA, 20 bp, Artificial Sequence
  Description of Artificial Sequence: Synthetic oligonucleotide
  Target: ATXN1; (+) strand; PAM type: YTN; PAM sequence: TTA
gaattttatgtggtcatatt

SEQ ID NO: 282237 - DNA, 20 bp, Artificial Sequence
  Description of Artificial Sequence: Synthetic oligonucleotide
  Target: ATXN1; (+) strand; PAM type: YTN; PAM sequence: TTT
tatgtggtcatatttcttag

SEQ ID NO: 282238 - DNA, 20 bp, Artificial Sequence
  Description of Artificial Sequence: Synthetic oligonucleotide
  Target: ATXN1; (+) strand; PAM type: YTN; PAM sequence: TTT
atgtggtcatatttcttagt

SEQ ID NO: 282239 - DNA, 20 bp, Artificial Sequence
  Description of Artificial Sequence: Synthetic oligonucleotide
  Target: ATXN1; (+) strand; PAM type: YTN; PAM sequence: TTA
tgtggtcatatttcttagtt

SEQ ID NO: 282240 - DNA, 20 bp, Artificial Sequence
  Description of Artificial Sequence: Synthetic oligonucleotide
  Target: ATXN1; (+) strand; PAM type: YTN; PAM sequence: TTT
cttagtttctgctaatctgt

SEQ ID NO: 282241 - DNA, 20 bp, Artificial Sequence
  Description of Artificial Sequence: Synthetic oligonucleotide
  Target: ATXN1; (+) strand; PAM type: YTN; PAM sequence: TTC
ttagtttctgctaatctgtg

SEQ ID NO: 282242 - DNA, 20 bp, Artificial Sequence
  Description of Artificial Sequence: Synthetic oligonucleotide
  Target: ATXN1; (+) strand; PAM type: YTN; PAM sequence: CTT
agtttctgctaatctgtgac

SEQ ID NO: 282243 - DNA, 20 bp, Artificial Sequence
  Description of Artificial Sequence: Synthetic oligonucleotide
  Target: ATXN1; (+) strand; PAM type: YTN; PAM sequence: TTA
gtttctgctaatctgtgaca

SEQ ID NO: 282244 - DNA, 20 bp, Artificial Sequence
  Description of Artificial Sequence: Synthetic oligonucleotide
  Target: ATXN1; (+) strand; PAM type: YTN; PAM sequence: TTT
ctgctaatctgtgacagttc

SEQ ID NO: 282245 - DNA, 20 bp, Artificial Sequence
  Description of Artificial Sequence: Synthetic oligonucleotide
  Target: ATXN1; (+) strand; PAM type: YTN; PAM sequence: TTC
tgctaatctgtgacagttcc

SEQ ID NO: 282246 - DNA, 20 bp, Artificial Sequence
  Description of Artificial Sequence: Synthetic oligonucleotide
  Target: ATXN1; (+) strand; PAM type: YTN; PAM sequence: CTG
ctaatctgtgacagttcctg

SEQ ID NO: 282247 - DNA, 20 bp, Artificial Sequence
  Description of Artificial Sequence: Synthetic oligonucleotide
  Target: ATXN1; (+) strand; PAM type: YTN; PAM sequence: CTA
atctgtgacagttcctgaat

SEQ ID NO: 282248 - DNA, 20 bp, Artificial Sequence
  Description of Artificial Sequence: Synthetic oligonucleotide
  Target: ATXN1; (+) strand; PAM type: YTN; PAM sequence: CTG
tgacagttcctgaatccttc

SEQ ID NO: 282249 - DNA, 20 bp, Artificial Sequence
  Description of Artificial Sequence: Synthetic oligonucleotide
  Target: ATXN1; (+) strand; PAM type: YTN; PAM sequence: TTC
ctgaatccttccttatcctt

SEQ ID NO: 282250 - DNA, 20 bp, Artificial Sequence
  Description of Artificial Sequence: Synthetic oligonucleotide
  Target: ATXN1; (+) strand; PAM type: YTN; PAM sequence: CTG
aatccttccttatccttaaa

SEQ ID NO: 282251 - DNA, 20 bp, Artificial Sequence
  Description of Artificial Sequence: Synthetic oligonucleotide
  Target: ATXN1; (+) strand; PAM type: YTN; PAM sequence: CTT
ccttatccttaaagaccttg

SEQ ID NO: 282252 - DNA, 20 bp, Artificial Sequence
  Description of Artificial Sequence: Synthetic oligonucleotide
  Target: ATXN1; (+) strand; PAM type: YTN; PAM sequence: TTC
cttatccttaaagaccttga

SEQ ID NO: 282253 - DNA, 20 bp, Artificial Sequence
  Description of Artificial Sequence: Synthetic oligonucleotide
  Target: ATXN1; (+) strand; PAM type: YTN; PAM sequence: CTT
atccttaaagaccttgacaa

SEQ ID NO: 282254 - DNA, 20 bp, Artificial Sequence
  Description of Artificial Sequence: Synthetic oligonucleotide
  Target: ATXN1; (+) strand; PAM type: YTN; PAM sequence: TTA
tccttaaagaccttgacaat

SEQ ID NO: 282255 - DNA, 20 bp, Artificial Sequence
  Description of Artificial Sequence: Synthetic oligonucleotide
  Target: ATXN1; (+) strand; PAM type: YTN; PAM sequence: CTT
aaagaccttgacaattttaa

SEQ ID NO: 282256 - DNA, 20 bp, Artificial Sequence
  Description of Artificial Sequence: Synthetic oligonucleotide
  Target: ATXN1; (+) strand; PAM type: YTN; PAM sequence: TTA
aagaccttgacaattttaag

SEQ ID NO: 282257 - DNA, 20 bp, Artificial Sequence
  Description of Artificial Sequence: Synthetic oligonucleotide
  Target: ATXN1; (+) strand; PAM type: YTN; PAM sequence: CTT
gacaattttaaggggagggg

SEQ ID NO: 282258 - DNA, 20 bp, Artificial Sequence
  Description of Artificial Sequence: Synthetic oligonucleotide
  Target: ATXN1; (+) strand; PAM type: YTN; PAM sequence: TTG
acaattttaaggggaggggt

SEQ ID NO: 282259 - DNA, 20 bp, Artificial Sequence
  Description of Artificial Sequence: Synthetic oligonucleotide
  Target: ATXN1; (+) strand; PAM type: YTN; PAM sequence: TTT
taaggggaggggtcagttat

SEQ ID NO: 282260 - DNA, 20 bp, Artificial Sequence
  Description of Artificial Sequence: Synthetic oligonucleotide
  Target: ATXN1; (+) strand; PAM type: YTN; PAM sequence: TTT
aaggggaggggtcagttatt

SEQ ID NO: 282261 - DNA, 20 bp, Artificial Sequence
  Description of Artificial Sequence: Synthetic oligonucleotide
  Target: ATXN1; (+) strand; PAM type: YTN; PAM sequence: TTA
aggggaggggtcagttattt

SEQ ID NO: 282262 - DNA, 20 bp, Artificial Sequence
  Description of Artificial Sequence: Synthetic oligonucleotide
  Target: ATXN1; (+) strand; PAM type: YTN; PAM sequence: TTA
ttttttcgaatgtccttcca

SEQ ID NO: 282263 - DNA, 20 bp, Artificial Sequence
  Description of Artificial Sequence: Synthetic oligonucleotide
  Target: ATXN1; (+) strand; PAM type: YTN; PAM sequence: TTT
tttcgaatgtccttccattt

SEQ ID NO: 282264 - DNA, 20 bp, Artificial Sequence
  Description of Artificial Sequence: Synthetic oligonucleotide
  Target: ATXN1; (+) strand; PAM type: YTN; PAM sequence: TTT
ttcgaatgtccttccatttg

SEQ ID NO: 282265 - DNA, 20 bp, Artificial Sequence
  Description of Artificial Sequence: Synthetic oligonucleotide
  Target: ATXN1; (+) strand; PAM type: YTN; PAM sequence: TTT
tcgaatgtccttccatttga

SEQ ID NO: 282266 - DNA, 20 bp, Artificial Sequence
  Description of Artificial Sequence: Synthetic oligonucleotide
  Target: ATXN1; (+) strand; PAM type: YTN; PAM sequence: TTT
cgaatgtccttccatttgag

SEQ ID NO: 282267 - DNA, 20 bp, Artificial Sequence
  Description of Artificial Sequence: Synthetic oligonucleotide
  Target: ATXN1; (+) strand; PAM type: YTN; PAM sequence: TTC
gaatgtccttccatttgagt

SEQ ID NO: 282268 - DNA, 20 bp, Artificial Sequence
  Description of Artificial Sequence: Synthetic oligonucleotide
  Target: ATXN1; (+) strand; PAM type: YTN; PAM sequence: CTT
ccatttgagtttgctatttt

SEQ ID NO: 282269 - DNA, 20 bp, Artificial Sequence
  Description of Artificial Sequence: Synthetic oligonucleotide
  Target: ATXN1; (+) strand; PAM type: YTN; PAM sequence: TTC
catttgagtttgctattttt

SEQ ID NO: 282270 - DNA, 20 bp, Artificial Sequence
  Description of Artificial Sequence: Synthetic oligonucleotide
  Target: ATXN1; (+) strand; PAM type: YTN; PAM sequence: TTT
gagtttgctatttttttctt

SEQ ID NO: 282271 - DNA, 20 bp, Artificial Sequence
  Description of Artificial Sequence: Synthetic oligonucleotide
  Target: ATXN1; (+) strand; PAM type: YTN; PAM sequence: TTG
agtttgctatttttttcttg

SEQ ID NO: 282272 - DNA, 20 bp, Artificial Sequence
  Description of Artificial Sequence: Synthetic oligonucleotide
  Target: ATXN1; (+) strand; PAM type: YTN; PAM sequence: TTT
gctatttttttcttgattag

SEQ ID NO: 282273 - DNA, 20 bp, Artificial Sequence
  Description of Artificial Sequence: Synthetic oligonucleotide
  Target: ATXN1; (+) strand; PAM type: YTN; PAM sequence: TTG
ctatttttttcttgattaga

SEQ ID NO: 282274 - DNA, 20 bp, Artificial Sequence
  Description of Artificial Sequence: Synthetic oligonucleotide
  Target: ATXN1; (+) strand; PAM type: YTN; PAM sequence: CTA
tttttttcttgattagagtg

SEQ ID NO: 282275 - DNA, 20 bp, Artificial Sequence
  Description of Artificial Sequence: Synthetic oligonucleotide
  Target: ATXN1; (+) strand; PAM type: YTN; PAM sequence: TTT
ttttcttgattagagtgaga

SEQ ID NO: 282276 - DNA, 20 bp, Artificial Sequence
  Description of Artificial Sequence: Synthetic oligonucleotide
  Target: ATXN1; (+) strand; PAM type: YTN; PAM sequence: TTT
tttcttgattagagtgagat

SEQ ID NO: 282277 - DNA, 20 bp, Artificial Sequence
  Description of Artificial Sequence: Synthetic oligonucleotide
  Target: ATXN1; (+) strand; PAM type: YTN; PAM sequence: TTT
ttcttgattagagtgagatt

SEQ ID NO: 282278 - DNA, 20 bp, Artificial Sequence
  Description of Artificial Sequence: Synthetic oligonucleotide
  Target: ATXN1; (+) strand; PAM type: YTN; PAM sequence: TTT
tcttgattagagtgagatta

SEQ ID NO: 282279 - DNA, 20 bp, Artificial Sequence
  Description of Artificial Sequence: Synthetic oligonucleotide
  Target: ATXN1; (+) strand; PAM type: YTN; PAM sequence: TTT
cttgattagagtgagattat

SEQ ID NO: 282280 - DNA, 20 bp, Artificial Sequence
  Description of Artificial Sequence: Synthetic oligonucleotide
  Target: ATXN1; (+) strand; PAM type: YTN; PAM sequence: TTC
ttgattagagtgagattatg

SEQ ID NO: 282281 - DNA, 20 bp, Artificial Sequence
  Description of Artificial Sequence: Synthetic oligonucleotide
  Target: ATXN1; (+) strand; PAM type: YTN; PAM sequence: CTT
gattagagtgagattatgcc

SEQ ID NO: 282282 - DNA, 20 bp, Artificial Sequence
  Description of Artificial Sequence: Synthetic oligonucleotide
  Target: ATXN1; (+) strand; PAM type: YTN; PAM sequence: TTG
attagagtgagattatgcct

SEQ ID NO: 282283 - DNA, 20 bp, Artificial Sequence
  Description of Artificial Sequence: Synthetic oligonucleotide
  Target: ATXN1; (+) strand; PAM type: YTN; PAM sequence: TTA
gagtgagattatgccttttc

SEQ ID NO: 282284 - DNA, 20 bp, Artificial Sequence
  Description of Artificial Sequence: Synthetic oligonucleotide
  Target: ATXN1; (+) strand; PAM type: YTN; PAM sequence: TTA
tgccttttcagggaggatat

SEQ ID NO: 282285 - DNA, 20 bp, Artificial Sequence
  Description of Artificial Sequence: Synthetic oligonucleotide
  Target: ATXN1; (+) strand; PAM type: YTN; PAM sequence: CTT
ttcagggaggatatcagaga

SEQ ID NO: 282286 - DNA, 20 bp, Artificial Sequence
  Description of Artificial Sequence: Synthetic oligonucleotide
  Target: ATXN1; (+) strand; PAM type: YTN; PAM sequence: TTT
tcagggaggatatcagagat

SEQ ID NO: 282287 - DNA, 20 bp, Artificial Sequence
  Description of Artificial Sequence: Synthetic oligonucleotide
  Target: ATXN1; (+) strand; PAM type: YTN; PAM sequence: TTT
cagggaggatatcagagatg

SEQ ID NO: 282288 - DNA, 20 bp, Artificial Sequence
  Description of Artificial Sequence: Synthetic oligonucleotide
  Target: ATXN1; (+) strand; PAM type: YTN; PAM sequence: TTC
agggaggatatcagagatga

SEQ ID NO: 282289 - DNA, 20 bp, Artificial Sequence
  Description of Artificial Sequence: Synthetic oligonucleotide
  Target: ATXN1; (+) strand; PAM type: YTN; PAM sequence: CTT
ctcagtgggacacacgatgt

SEQ ID NO: 282290 - DNA, 20 bp, Artificial Sequence
  Description of Artificial Sequence: Synthetic oligonucleotide
  Target: ATXN1; (+) strand; PAM type: YTN; PAM sequence: TTC
tcagtgggacacacgatgtc

SEQ ID NO: 282291 - DNA, 20 bp, Artificial Sequence
  Description of Artificial Sequence: Synthetic oligonucleotide
  Target: ATXN1; (+) strand; PAM type: YTN; PAM sequence: CTC
agtgggacacacgatgtcaa

SEQ ID NO: 282292 - DNA, 20 bp, Artificial Sequence
  Description of Artificial Sequence: Synthetic oligonucleotide
  Target: ATXN1; (+) strand; PAM type: YTN; PAM sequence: CTG
gtgacattaaccttgatcac

SEQ ID NO: 282293 - DNA, 20 bp, Artificial Sequence
  Description of Artificial Sequence: Synthetic oligonucleotide
  Target: ATXN1; (+) strand; PAM type: YTN; PAM sequence: TTA
accttgatcactcagttaag

SEQ ID NO: 282294 - DNA, 20 bp, Artificial Sequence
  Description of Artificial Sequence: Synthetic oligonucleotide
  Target: ATXN1; (+) strand; PAM type: YTN; PAM sequence: CTT
gatcactcagttaaggtgat

SEQ ID NO: 282295 - DNA, 20 bp, Artificial Sequence
  Description of Artificial Sequence: Synthetic oligonucleotide
  Target: ATXN1; (+) strand; PAM type: YTN; PAM sequence: TTG
atcactcagttaaggtgatg

SEQ ID NO: 282296 - DNA, 20 bp, Artificial Sequence
  Description of Artificial Sequence: Synthetic oligonucleotide
  Target: ATXN1; (+) strand; PAM type: YTN; PAM sequence: CTC
agttaaggtgatgtctgcca

SEQ ID NO: 282297 - DNA, 20 bp, Artificial Sequence
  Description of Artificial Sequence: Synthetic oligonucleotide
  Target: ATXN1; (+) strand; PAM type: YTN; PAM sequence: TTA
aggtgatgtctgccaggatt

SEQ ID NO: 282298 - DNA, 20 bp, Artificial Sequence
  Description of Artificial Sequence: Synthetic oligonucleotide
  Target: ATXN1; (+) strand; PAM type: YTN; PAM sequence: CTG
ccaggattcttcaccgtaaa

SEQ ID NO: 282299 - DNA, 20 bp, Artificial Sequence
  Description of Artificial Sequence: Synthetic oligonucleotide
  Target: ATXN1; (+) strand; PAM type: YTN; PAM sequence: TTC
ttcaccgtaaacttttattt

SEQ ID NO: 282300 - DNA, 20 bp, Artificial Sequence
  Description of Artificial Sequence: Synthetic oligonucleotide
  Target: ATXN1; (+) strand; PAM type: YTN; PAM sequence: CTT
caccgtaaacttttattttt

SEQ ID NO: 282301 - DNA, 20 bp, Artificial Sequence
  Description of Artificial Sequence: Synthetic oligonucleotide
  Target: ATXN1; (+) strand; PAM type: YTN; PAM sequence: TTC
accgtaaacttttatttttc

SEQ ID NO: 282302 - DNA, 20 bp, Artificial Sequence
  Description of Artificial Sequence: Synthetic oligonucleotide
  Target: ATXN1; (+) strand; PAM type: YTN; PAM sequence: CTT
ttatttttctccttgtaatt

SEQ ID NO: 282303 - DNA, 20 bp, Artificial Sequence
  Description of Artificial Sequence: Synthetic oligonucleotide
  Target: ATXN1; (+) strand; PAM type: YTN; PAM sequence: TTT
tatttttctccttgtaatta

SEQ ID NO: 282304 - DNA, 20 bp, Artificial Sequence
  Description of Artificial Sequence: Synthetic oligonucleotide
  Target: ATXN1; (+) strand; PAM type: YTN; PAM sequence: TTT
atttttctccttgtaattac

SEQ ID NO: 282305 - DNA, 20 bp, Artificial Sequence
  Description of Artificial Sequence: Synthetic oligonucleotide
  Target: ATXN1; (+) strand; PAM type: YTN; PAM sequence: TTA
tttttctccttgtaattact

SEQ ID NO: 282306 - DNA, 20 bp, Artificial Sequence
  Description of Artificial Sequence: Synthetic oligonucleotide
  Target: ATXN1; (+) strand; PAM type: YTN; PAM sequence: TTT
ttctccttgtaattactaaa

SEQ ID NO: 282307 - DNA, 20 bp, Artificial Sequence
  Description of Artificial Sequence: Synthetic oligonucleotide
  Target: ATXN1; (+) strand; PAM type: YTN; PAM sequence: TTT
tctccttgtaattactaaat

SEQ ID NO: 282308 - DNA, 20 bp, Artificial Sequence
  Description of Artificial Sequence: Synthetic oligonucleotide
  Target: ATXN1; (+) strand; PAM type: YTN; PAM sequence: TTT
ctccttgtaattactaaatg

SEQ ID NO: 282309 - DNA, 20 bp, Artificial Sequence
  Description of Artificial Sequence: Synthetic oligonucleotide
  Target: ATXN1; (+) strand; PAM type: YTN; PAM sequence: TTC
tccttgtaattactaaatgt

SEQ ID NO: 282310 - DNA, 20 bp, Artificial Sequence
  Description of Artificial Sequence: Synthetic oligonucleotide
  Target: ATXN1; (+) strand; PAM type: YTN; PAM sequence: CTC
cttgtaattactaaatgttt

SEQ ID NO: 282311 - DNA, 20 bp, Artificial Sequence
  Description of Artificial Sequence: Synthetic oligonucleotide
  Target: ATXN1; (+) strand; PAM type: YTN; PAM sequence: CTT
gtaattactaaatgtttggg

SEQ ID NO: 282312 - DNA, 20 bp, Artificial Sequence
  Description of Artificial Sequence: Synthetic oligonucleotide
  Target: ATXN1; (+) strand; PAM type: YTN; PAM sequence: TTG
taattactaaatgtttgggg

SEQ ID NO: 282313 - DNA, 20 bp, Artificial Sequence
  Description of Artificial Sequence: Synthetic oligonucleotide
  Target: ATXN1; (+) strand; PAM type: YTN; PAM sequence: TTA
ctaaatgtttggggtaggga

SEQ ID NO: 282314 - DNA, 20 bp, Artificial Sequence
  Description of Artificial Sequence: Synthetic oligonucleotide
  Target: ATXN1; (+) strand; PAM type: YTN; PAM sequence: CTA
aatgtttggggtagggatat

SEQ ID NO: 282315 - DNA, 20 bp, Artificial Sequence
  Description of Artificial Sequence: Synthetic oligonucleotide
  Target: ATXN1; (+) strand; PAM type: YTN; PAM sequence: TTT
ggggtagggatattttaaaa

SEQ ID NO: 282316 - DNA, 20 bp, Artificial Sequence
  Description of Artificial Sequence: Synthetic oligonucleotide
  Target: ATXN1; (+) strand; PAM type: YTN; PAM sequence: TTG
gggtagggatattttaaaat

SEQ ID NO: 282317 - DNA, 20 bp, Artificial Sequence
  Description of Artificial Sequence: Synthetic oligonucleotide
  Target: ATXN1; (+) strand; PAM type: YTN; PAM sequence: TTT
taaaattctacgaatttcct

SEQ ID NO: 282318 - DNA, 20 bp, Artificial Sequence
  Description of Artificial Sequence: Synthetic oligonucleotide
  Target: ATXN1; (+) strand; PAM type: YTN; PAM sequence: TTT
aaaattctacgaatttcctg

SEQ ID NO: 282319 - DNA, 20 bp, Artificial Sequence
  Description of Artificial Sequence: Synthetic oligonucleotide
  Target: ATXN1; (+) strand; PAM type: YTN; PAM sequence: TTA
aaattctacgaatttcctgt

SEQ ID NO: 282320 - DNA, 20 bp, Artificial Sequence
  Description of Artificial Sequence: Synthetic oligonucleotide
  Target: ATXN1; (+) strand; PAM type: YTN; PAM sequence: TTC
tacgaatttcctgtttctgc

SEQ ID NO: 282321 - DNA, 20 bp, Artificial Sequence
  Description of Artificial Sequence: Synthetic oligonucleotide
  Target: ATXN1; (+) strand; PAM type: YTN; PAM sequence: CTA
cgaatttcctgtttctgcat

SEQ ID NO: 282322 - DNA, 20 bp, Artificial Sequence
  Description of Artificial Sequence: Synthetic oligonucleotide
  Target: ATXN1; (+) strand; PAM type: YTN; PAM sequence: TTT
cctgtttctgcatatacttt

SEQ ID NO: 282323 - DNA, 20 bp, Artificial Sequence
  Description of Artificial Sequence: Synthetic oligonucleotide
  Target: ATXN1; (+) strand; PAM type: YTN; PAM sequence: TTC
ctgtttctgcatatactttt

SEQ ID NO: 282324 - DNA, 20 bp, Artificial Sequence
  Description of Artificial Sequence: Synthetic oligonucleotide
  Target: ATXN1; (+) strand; PAM type: YTN; PAM sequence: CTG
tttctgcatatacttttgcc

SEQ ID NO: 282325 - DNA, 20 bp, Artificial Sequence
  Description of Artificial Sequence: Synthetic oligonucleotide
  Target: ATXN1; (+) strand; PAM type: YTN; PAM sequence: TTT
ctgcatatacttttgcccgc

SEQ ID NO: 282326 - DNA, 20 bp, Artificial Sequence
  Description of Artificial Sequence: Synthetic oligonucleotide
  Target: ATXN1; (+) strand; PAM type: YTN; PAM sequence: TTC
tgcatatacttttgcccgct

SEQ ID NO: 282327 - DNA, 20 bp, Artificial Sequence
  Description of Artificial Sequence: Synthetic oligonucleotide
  Target: ATXN1; (+) strand; PAM type: YTN; PAM sequence: CTG
catatacttttgcccgctca

SEQ ID NO: 282328 - DNA, 20 bp, Artificial Sequence
  Description of Artificial Sequence: Synthetic oligonucleotide
  Target: ATXN1; (+) strand; PAM type: YTN; PAM sequence: CTT
ttgcccgctcattctaatcc

SEQ ID NO: 282329 - DNA, 20 bp, Artificial Sequence
  Description of Artificial Sequence: Synthetic oligonucleotide
  Target: ATXN1; (+) strand; PAM type: YTN; PAM sequence: TTT
tgcccgctcattctaatcca

SEQ ID NO: 282330 - DNA, 20 bp, Artificial Sequence
  Description of Artificial Sequence: Synthetic oligonucleotide
  Target: ATXN1; (+) strand; PAM type: YTN; PAM sequence: TTT
gcccgctcattctaatccat

SEQ ID NO: 282331 - DNA, 20 bp, Artificial Sequence
  Description of Artificial Sequence: Synthetic oligonucleotide
  Target: ATXN1; (+) strand; PAM type: YTN; PAM sequence: TTG
cccgctcattctaatccatc

SEQ ID NO: 282332 - DNA, 20 bp, Artificial Sequence
  Description of Artificial Sequence: Synthetic oligonucleotide
  Target: ATXN1; (+) strand; PAM type: YTN; PAM sequence: CTC
attctaatccatctaatcca

SEQ ID NO: 282333 - DNA, 20 bp, Artificial Sequence
  Description of Artificial Sequence: Synthetic oligonucleotide
  Target: ATXN1; (+) strand; PAM type: YTN; PAM sequence: TTC
taatccatctaatccacatc

SEQ ID NO: 282334 - DNA, 20 bp, Artificial Sequence
  Description of Artificial Sequence: Synthetic oligonucleotide
  Target: ATXN1; (+) strand; PAM type: YTN; PAM sequence: CTA
atccatctaatccacatctg

SEQ ID NO: 282335 - DNA, 20 bp, Artificial Sequence
  Description of Artificial Sequence: Synthetic oligonucleotide
  Target: ATXN1; (+) strand; PAM type: YTN; PAM sequence: CTA
atccacatctgcccatctaa

SEQ ID NO: 282336 - DNA, 20 bp, Artificial Sequence
  Description of Artificial Sequence: Synthetic oligonucleotide
  Target: ATXN1; (+) strand; PAM type: YTN; PAM sequence: CTG
cccatctaatgcatccatcg

SEQ ID NO: 282337 - DNA, 20 bp, Artificial Sequence
  Description of Artificial Sequence: Synthetic oligonucleotide
  Target: ATXN1; (+) strand; PAM type: YTN; PAM sequence: CTA
atgcatccatcggtgggact

SEQ ID NO: 282338 - DNA, 20 bp, Artificial Sequence
  Description of Artificial Sequence: Synthetic oligonucleotide
  Target: ATXN1; (+) strand; PAM type: YTN; PAM sequence: CTT
tctcgtggcaattcttacta

SEQ ID NO: 282339 - DNA, 20 bp, Artificial Sequence
  Description of Artificial Sequence: Synthetic oligonucleotide
  Target: ATXN1; (+) strand; PAM type: YTN; PAM sequence: TTT
ctcgtggcaattcttactat

SEQ ID NO: 282340 - DNA, 20 bp, Artificial Sequence
  Description of Artificial Sequence: Synthetic oligonucleotide
  Target: ATXN1; (+) strand; PAM type: YTN; PAM sequence: TTC
tcgtggcaattcttactatg

SEQ ID NO: 282341 - DNA, 20 bp, Artificial Sequence
  Description of Artificial Sequence: Synthetic oligonucleotide
  Target: ATXN1; (+) strand; PAM type: YTN; PAM sequence: CTC
gtggcaattcttactatgag

SEQ ID NO: 282342 - DNA, 20 bp, Artificial Sequence
  Description of Artificial Sequence: Synthetic oligonucleotide
  Target: ATXN1; (+) strand; PAM type: YTN; PAM sequence: TTC
ttactatgagttctaatgat

SEQ ID NO: 282343 - DNA, 20 bp, Artificial Sequence
  Description of Artificial Sequence: Synthetic oligonucleotide
  Target: ATXN1; (+) strand; PAM type: YTN; PAM sequence: CTT
actatgagttctaatgatgt

SEQ ID NO: 282344 - DNA, 20 bp, Artificial Sequence
  Description of Artificial Sequence: Synthetic oligonucleotide
  Target: ATXN1; (+) strand; PAM type: YTN; PAM sequence: TTA
ctatgagttctaatgatgtt

SEQ ID NO: 282345 - DNA, 20 bp, Artificial Sequence
  Description of Artificial Sequence: Synthetic oligonucleotide
  Target: ATXN1; (+) strand; PAM type: YTN; PAM sequence: CTA
tgagttctaatgatgttttc

SEQ ID NO: 282346 - DNA, 20 bp, Artificial Sequence
  Description of Artificial Sequence: Synthetic oligonucleotide
  Target: ATXN1; (+) strand; PAM type: YTN; PAM sequence: TTC
taatgatgttttcatactgc

SEQ ID NO: 282347 - DNA, 20 bp, Artificial Sequence
  Description of Artificial Sequence: Synthetic oligonucleotide
  Target: ATXN1; (+) strand; PAM type: YTN; PAM sequence: CTA
atgatgttttcatactgctt

SEQ ID NO: 282348 - DNA, 20 bp, Artificial Sequence
  Description of Artificial Sequence: Synthetic oligonucleotide
  Target: ATXN1; (+) strand; PAM type: YTN; PAM sequence: TTT
tcatactgcttccttcctcg

SEQ ID NO: 282349 - DNA, 20 bp, Artificial Sequence
  Description of Artificial Sequence: Synthetic oligonucleotide
  Target: ATXN1; (+) strand; PAM type: YTN; PAM sequence: TTT
catactgcttccttcctcgt

SEQ ID NO: 282350 - DNA, 20 bp, Artificial Sequence
  Description of Artificial Sequence: Synthetic oligonucleotide
  Target: ATXN1; (+) strand; PAM type: YTN; PAM sequence: TTC
atactgcttccttcctcgtt

SEQ ID NO: 282351 - DNA, 20 bp, Artificial Sequence
  Description of Artificial Sequence: Synthetic oligonucleotide
  Target: ATXN1; (+) strand; PAM type: YTN; PAM sequence: CTG
cttccttcctcgtttgttta

SEQ ID NO: 282352 - DNA, 20 bp, Artificial Sequence
  Description of Artificial Sequence: Synthetic oligonucleotide
  Target: ATXN1; (+) strand; PAM type: YTN; PAM sequence: CTT
ccttcctcgtttgtttatta

SEQ ID NO: 282353 - DNA, 20 bp, Artificial Sequence
  Description of Artificial Sequence: Synthetic oligonucleotide
  Target: ATXN1; (+) strand; PAM type: YTN; PAM sequence: TTC
cttcctcgtttgtttattaa

SEQ ID NO: 282354 - DNA, 20 bp, Artificial Sequence
  Description of Artificial Sequence: Synthetic oligonucleotide
  Target: ATXN1; (+) strand; PAM type: YTN; PAM sequence: CTT
cctcgtttgtttattaactg

SEQ ID NO: 282355 - DNA, 20 bp, Artificial Sequence
  Description of Artificial Sequence: Synthetic oligonucleotide
  Target: ATXN1; (+) strand; PAM type: YTN; PAM sequence: TTC
ctcgtttgtttattaactga

SEQ ID NO: 282356 - DNA, 20 bp, Artificial Sequence
  Description of Artificial Sequence: Synthetic oligonucleotide
  Target: ATXN1; (+) strand; PAM type: YTN; PAM sequence: CTC
gtttgtttattaactgaaat

SEQ ID NO: 282357 - DNA, 20 bp, Artificial Sequence
  Description of Artificial Sequence: Synthetic oligonucleotide
  Target: ATXN1; (+) strand; PAM type: YTN; PAM sequence: TTT
gtttattaactgaaattctg

SEQ ID NO: 282358 - DNA, 20 bp, Artificial Sequence
  Description of Artificial Sequence: Synthetic oligonucleotide
  Target: ATXN1; (+) strand; PAM type: YTN; PAM sequence: TTG
tttattaactgaaattctgc

SEQ ID NO: 282359 - DNA, 20 bp, Artificial Sequence
  Description of Artificial Sequence: Synthetic oligonucleotide
  Target: ATXN1; (+) strand; PAM type: YTN; PAM sequence: TTT
attaactgaaattctgctgc

SEQ ID NO: 282360 - DNA, 20 bp, Artificial Sequence
  Description of Artificial Sequence: Synthetic oligonucleotide
  Target: ATXN1; (+) strand; PAM type: YTN; PAM sequence: TTA
ttaactgaaattctgctgca

SEQ ID NO: 282361 - DNA, 20 bp, Artificial Sequence
  Description of Artificial Sequence: Synthetic oligonucleotide
  Target: ATXN1; (+) strand; PAM type: YTN; PAM sequence: TTA
actgaaattctgctgcaggg

SEQ ID NO: 282362 - DNA, 20 bp, Artificial Sequence
  Description of Artificial Sequence: Synthetic oligonucleotide
  Target: ATXN1; (+) strand; PAM type: YTN; PAM sequence: CTG
aaattctgctgcagggaaga

SEQ ID NO: 282363 - DNA, 20 bp, Artificial Sequence
  Description of Artificial Sequence: Synthetic oligonucleotide
  Target: ATXN1; (+) strand; PAM type: YTN; PAM sequence: TTC
tgctgcagggaagagtcatt

SEQ ID NO: 282364 - DNA, 20 bp, Artificial Sequence
  Description of Artificial Sequence: Synthetic oligonucleotide
  Target: ATXN1; (+) strand; PAM type: YTN; PAM sequence: CTG
ctgcagggaagagtcattcc

SEQ ID NO: 282365 - DNA, 20 bp, Artificial Sequence
  Description of Artificial Sequence: Synthetic oligonucleotide
  Target: ATXN1; (+) strand; PAM type: YTN; PAM sequence: CTG
cagggaagagtcattccttt

SEQ ID NO: 282366 - DNA, 20 bp, Artificial Sequence
  Description of Artificial Sequence: Synthetic oligonucleotide
  Target: ATXN1; (+) strand; PAM type: YTN; PAM sequence: TTC
cttttcccttatttatttat

SEQ ID NO: 282367 - DNA, 20 bp, Artificial Sequence
  Description of Artificial Sequence: Synthetic oligonucleotide
  Target: ATXN1; (+) strand; PAM type: YTN; PAM sequence: CTT
ttcccttatttatttattca

SEQ ID NO: 282368 - DNA, 20 bp, Artificial Sequence
  Description of Artificial Sequence: Synthetic oligonucleotide
  Target: ATXN1; (+) strand; PAM type: YTN; PAM sequence: TTT
tcccttatttatttattcat

SEQ ID NO: 282369 - DNA, 20 bp, Artificial Sequence
  Description of Artificial Sequence: Synthetic oligonucleotide
  Target: ATXN1; (+) strand; PAM type: YTN; PAM sequence: TTT
cccttatttatttattcatt

SEQ ID NO: 282370 - DNA, 20 bp, Artificial Sequence
  Description of Artificial Sequence: Synthetic oligonucleotide
  Target: ATXN1; (+) strand; PAM type: YTN; PAM sequence: TTC
ccttatttatttattcattg

SEQ ID NO: 282371 - DNA, 20 bp, Artificial Sequence
  Description of Artificial Sequence: Synthetic oligonucleotide
  Target: ATXN1; (+) strand; PAM type: YTN; PAM sequence: CTT
atttatttattcattggact

SEQ ID NO: 282372 - DNA, 20 bp, Artificial Sequence
  Description of Artificial Sequence: Synthetic oligonucleotide
  Target: ATXN1; (+) strand; PAM type: YTN; PAM sequence: TTA
tttatttattcattggactc

SEQ ID NO: 282373 - DNA, 20 bp, Artificial Sequence
  Description of Artificial Sequence: Synthetic oligonucleotide
  Target: ATXN1; (+) strand; PAM type: YTN; PAM sequence: TTT
atttattcattggactcgtt

SEQ ID NO: 282374 - DNA, 20 bp, Artificial Sequence
  Description of Artificial Sequence: Synthetic oligonucleotide
  Target: ATXN1; (+) strand; PAM type: YTN; PAM sequence: TTA
tttattcattggactcgttg

SEQ ID NO: 282375 - DNA, 20 bp, Artificial Sequence
  Description of Artificial Sequence: Synthetic oligonucleotide
  Target: ATXN1; (+) strand; PAM type: YTN; PAM sequence: TTT
attcattggactcgttggat

SEQ ID NO: 282376 - DNA, 20 bp, Artificial Sequence
  Description of Artificial Sequence: Synthetic oligonucleotide
  Target: ATXN1; (+) strand; PAM type: YTN; PAM sequence: TTA
ttcattggactcgttggata

SEQ ID NO: 282377 - DNA, 20 bp, Artificial Sequence
  Description of Artificial Sequence: Synthetic oligonucleotide
  Target: ATXN1; (+) strand; PAM type: YTN; PAM sequence: TTC
attggactcgttggatattt

SEQ ID NO: 282378 - DNA, 20 bp, Artificial Sequence
  Description of Artificial Sequence: Synthetic oligonucleotide
  Target: ATXN1; (+) strand; PAM type: YTN; PAM sequence: TTG
gactcgttggatattttatt

SEQ ID NO: 282379 - DNA, 20 bp, Artificial Sequence
  Description of Artificial Sequence: Synthetic oligonucleotide
  Target: ATXN1; (+) strand; PAM type: YTN; PAM sequence: CTC
gttggatattttattctttg

SEQ ID NO: 282380 - DNA, 20 bp, Artificial Sequence
  Description of Artificial Sequence: Synthetic oligonucleotide
  Target: ATXN1; (+) strand; PAM type: YTN; PAM sequence: TTG
gatattttattctttgggtt

SEQ ID NO: 282381 - DNA, 20 bp, Artificial Sequence
  Description of Artificial Sequence: Synthetic oligonucleotide
  Target: ATXN1; (+) strand; PAM type: YTN; PAM sequence: TTT
tattctttgggttataatcc

SEQ ID NO: 282382 - DNA, 20 bp, Artificial Sequence
  Description of Artificial Sequence: Synthetic oligonucleotide
  Target: ATXN1; (+) strand; PAM type: YTN; PAM sequence: TTT
attctttgggttataatcca

SEQ ID NO: 282383 - DNA, 20 bp, Artificial Sequence
  Description of Artificial Sequence: Synthetic oligonucleotide
  Target: ATXN1; (+) strand; PAM type: YTN; PAM sequence: TTA
ttctttgggttataatccag

SEQ ID NO: 282384 - DNA, 20 bp, Artificial Sequence
  Description of Artificial Sequence: Synthetic oligonucleotide
  Target: ATXN1; (+) strand; PAM type: YTN; PAM sequence: TTC
tttgggttataatccagcat

SEQ ID NO: 282385 - DNA, 20 bp, Artificial Sequence
  Description of Artificial Sequence: Synthetic oligonucleotide
  Target: ATXN1; (+) strand; PAM type: YTN; PAM sequence: CTT
tgggttataatccagcattt

SEQ ID NO: 282386 - DNA, 20 bp, Artificial Sequence
  Description of Artificial Sequence: Synthetic oligonucleotide
  Target: ATXN1; (+) strand; PAM type: YTN; PAM sequence: TTT
gggttataatccagcattta

SEQ ID NO: 282387 - DNA, 20 bp, Artificial Sequence
  Description of Artificial Sequence: Synthetic oligonucleotide
  Target: ATXN1; (+) strand; PAM type: YTN; PAM sequence: TTG
ggttataatccagcatttat

SEQ ID NO: 282388 - DNA, 20 bp, Artificial Sequence
  Description of Artificial Sequence: Synthetic oligonucleotide
  Target: ATXN1; (+) strand; PAM type: YTN; PAM sequence: TTA
taatccagcatttatttcct

SEQ ID NO: 282389 - DNA, 20 bp, Artificial Sequence
  Description of Artificial Sequence: Synthetic oligonucleotide
  Target: ATXN1; (+) strand; PAM type: YTN; PAM sequence: TTT
atttccttacccagttattc

SEQ ID NO: 282390 - DNA, 20 bp, Artificial Sequence
  Description of Artificial Sequence: Synthetic oligonucleotide
  Target: ATXN1; (+) strand; PAM type: YTN; PAM sequence: TTA
tttccttacccagttattct

SEQ ID NO: 282391 - DNA, 20 bp, Artificial Sequence
  Description of Artificial Sequence: Synthetic oligonucleotide
  Target: ATXN1; (+) strand; PAM type: YTN; PAM sequence: TTT
ccttacccagttattctaag

SEQ ID NO: 282392 - DNA, 20 bp, Artificial Sequence
  Description of Artificial Sequence: Synthetic oligonucleotide
  Target: ATXN1; (+) strand; PAM type: YTN; PAM sequence: TTC
cttacccagttattctaagc

SEQ ID NO: 282393 - DNA, 20 bp, Artificial Sequence
  Description of Artificial Sequence: Synthetic oligonucleotide
  Target: ATXN1; (+) strand; PAM type: YTN; PAM sequence: CTT
acccagttattctaagctgt

SEQ ID NO: 282394 - DNA, 20 bp, Artificial Sequence
  Description of Artificial Sequence: Synthetic oligonucleotide
  Target: ATXN1; (+) strand; PAM type: YTN; PAM sequence: TTA
cccagttattctaagctgta

SEQ ID NO: 282395 - DNA, 20 bp, Artificial Sequence
  Description of Artificial Sequence: Synthetic oligonucleotide
  Target: ATXN1; (+) strand; PAM type: YTN; PAM sequence: TTA
ttctaagctgtagctagata

SEQ ID NO: 282396 - DNA, 20 bp, Artificial Sequence
  Description of Artificial Sequence: Synthetic oligonucleotide
  Target: ATXN1; (+) strand; PAM type: YTN; PAM sequence: TTC
taagctgtagctagatattc

SEQ ID NO: 282397 - DNA, 20 bp, Artificial Sequence
  Description of Artificial Sequence: Synthetic oligonucleotide
  Target: ATXN1; (+) strand; PAM type: YTN; PAM sequence: CTA
agctgtagctagatattcta

SEQ ID NO: 282398 - DNA, 20 bp, Artificial Sequence
  Description of Artificial Sequence: Synthetic oligonucleotide
  Target: ATXN1; (+) strand; PAM type: YTN; PAM sequence: CTG
tagctagatattctaccatt

SEQ ID NO: 282399 - DNA, 20 bp, Artificial Sequence
  Description of Artificial Sequence: Synthetic oligonucleotide
  Target: ATXN1; (+) strand; PAM type: YTN; PAM sequence: CTA
gatattctaccatttcagag

SEQ ID NO: 282400 - DNA, 20 bp, Artificial Sequence
  Description of Artificial Sequence: Synthetic oligonucleotide
  Target: ATXN1; (+) strand; PAM type: YTN; PAM sequence: TTC
taccatttcagagcagacac

SEQ ID NO: 282401 - DNA, 20 bp, Artificial Sequence
  Description of Artificial Sequence: Synthetic oligonucleotide
  Target: ATXN1; (+) strand; PAM type: YTN; PAM sequence: CTA
ccatttcagagcagacacag

SEQ ID NO: 282402 - DNA, 20 bp, Artificial Sequence
  Description of Artificial Sequence: Synthetic oligonucleotide
  Target: ATXN1; (+) strand; PAM type: YTN; PAM sequence: TTT
cagagcagacacagccacat

SEQ ID NO: 282403 - DNA, 20 bp, Artificial Sequence
  Description of Artificial Sequence: Synthetic oligonucleotide
  Target: ATXN1; (+) strand; PAM type: YTN; PAM sequence: TTC
agagcagacacagccacatt

SEQ ID NO: 282404 - DNA, 20 bp, Artificial Sequence
  Description of Artificial Sequence: Synthetic oligonucleotide
  Target: ATXN1; (+) strand; PAM type: YTN; PAM sequence: TTG
tgtcctgtgttacaggttgt

SEQ ID NO: 282405 - DNA, 20 bp, Artificial Sequence
  Description of Artificial Sequence: Synthetic oligonucleotide
  Target: ATXN1; (+) strand; PAM type: YTN; PAM sequence: CTG
tgttacaggttgtccctcat

SEQ ID NO: 282406 - DNA, 20 bp, Artificial Sequence
  Description of Artificial Sequence: Synthetic oligonucleotide
  Target: ATXN1; (+) strand; PAM type: YTN; PAM sequence: TTA
caggttgtccctcatgtctt

SEQ ID NO: 282407 - DNA, 20 bp, Artificial Sequence
  Description of Artificial Sequence: Synthetic oligonucleotide
  Target: ATXN1; (+) strand; PAM type: YTN; PAM sequence: TTG
tccctcatgtcttaagacaa

SEQ ID NO: 282408 - DNA, 20 bp, Artificial Sequence
  Description of Artificial Sequence: Synthetic oligonucleotide
  Target: ATXN1; (+) strand; PAM type: YTN; PAM sequence: CTC
atgtcttaagacaagaacag

SEQ ID NO: 282409 - DNA, 20 bp, Artificial Sequence
  Description of Artificial Sequence: Synthetic oligonucleotide
  Target: ATXN1; (+) strand; PAM type: YTN; PAM sequence: CTT
aagacaagaacaggcacaca

SEQ ID NO: 282410 - DNA, 20 bp, Artificial Sequence
  Description of Artificial Sequence: Synthetic oligonucleotide
  Target: ATXN1; (+) strand; PAM type: YTN; PAM sequence: TTA
agacaagaacaggcacacag

SEQ ID NO: 282411 - DNA, 20 bp, Artificial Sequence
  Description of Artificial Sequence: Synthetic oligonucleotide
  Target: ATXN1; (+) strand; PAM type: YTN; PAM sequence: TTC
agctcatctgttcattcatt

SEQ ID NO: 282412 - DNA, 20 bp, Artificial Sequence
  Description of Artificial Sequence: Synthetic oligonucleotide
  Target: ATXN1; (+) strand; PAM type: YTN; PAM sequence: CTC
atctgttcattcatttgaca

SEQ ID NO: 282413 - DNA, 20 bp, Artificial Sequence
  Description of Artificial Sequence: Synthetic oligonucleotide
  Target: ATXN1; (+) strand; PAM type: YTN; PAM sequence: CTG
ttcattcatttgacaggtta

SEQ ID NO: 282414 - DNA, 20 bp, Artificial Sequence
  Description of Artificial Sequence: Synthetic oligonucleotide
  Target: ATXN1; (+) strand; PAM type: YTN; PAM sequence: TTC
attcatttgacaggttatct

SEQ ID NO: 282415 - DNA, 20 bp, Artificial Sequence
  Description of Artificial Sequence: Synthetic oligonucleotide
  Target: ATXN1; (+) strand; PAM type: YTN; PAM sequence: TTC
atttgacaggttatcttgag

SEQ ID NO: 282416 - DNA, 20 bp, Artificial Sequence
  Description of Artificial Sequence: Synthetic oligonucleotide
  Target: ATXN1; (+) strand; PAM type: YTN; PAM sequence: TTT
gacaggttatcttgagggcc

SEQ ID NO: 282417 - DNA, 20 bp, Artificial Sequence
  Description of Artificial Sequence: Synthetic oligonucleotide
  Target: ATXN1; (+) strand; PAM type: YTN; PAM sequence: TTG
acaggttatcttgagggcct

SEQ ID NO: 282418 - DNA, 20 bp, Artificial Sequence
  Description of Artificial Sequence: Synthetic oligonucleotide
  Target: ATXN1; (+) strand; PAM type: YTN; PAM sequence: TTA
tcttgagggccttgtgttag

SEQ ID NO: 282419 - DNA, 20 bp, Artificial Sequence
  Description of Artificial Sequence: Synthetic oligonucleotide
  Target: ATXN1; (+) strand; PAM type: YTN; PAM sequence: CTT
gagggccttgtgttaggtgt

SEQ ID NO: 282420 - DNA, 20 bp, Artificial Sequence
  Description of Artificial Sequence: Synthetic oligonucleotide
  Target: ATXN1; (+) strand; PAM type: YTN; PAM sequence: TTG
agggccttgtgttaggtgtt

SEQ ID NO: 282421 - DNA, 20 bp, Artificial Sequence
  Description of Artificial Sequence: Synthetic oligonucleotide
  Target: ATXN1; (+) strand; PAM type: YTN; PAM sequence: CTT
gtgttaggtgttagagttac

SEQ ID NO: 282422 - DNA, 20 bp, Artificial Sequence
  Description of Artificial Sequence: Synthetic oligonucleotide
  Target: ATXN1; (+) strand; PAM type: YTN; PAM sequence: TTG
tgttaggtgttagagttaca

SEQ ID NO: 282423 - DNA, 20 bp, Artificial Sequence
  Description of Artificial Sequence: Synthetic oligonucleotide
  Target: ATXN1; (+) strand; PAM type: YTN; PAM sequence: TTA
ggtgttagagttacaagaaa

SEQ ID NO: 282424 - DNA, 20 bp, Artificial Sequence
  Description of Artificial Sequence: Synthetic oligonucleotide
  Target: ATXN1; (+) strand; PAM type: YTN; PAM sequence: TTA
gagttacaagaaataaaaca

SEQ ID NO: 282425 - DNA, 20 bp, Artificial Sequence
  Description of Artificial Sequence: Synthetic oligonucleotide
  Target: ATXN1; (+) strand; PAM type: YTN; PAM sequence: TTA
caagaaataaaacaattcct

SEQ ID NO: 282426 - DNA, 20 bp, Artificial Sequence
  Description of Artificial Sequence: Synthetic oligonucleotide
  Target: ATXN1; (+) strand; PAM type: YTN; PAM sequence: TTC
ctctgtccgagtggtttaca

SEQ ID NO: 282427 - DNA, 20 bp, Artificial Sequence
  Description of Artificial Sequence: Synthetic oligonucleotide
  Target: ATXN1; (+) strand; PAM type: YTN; PAM sequence: CTC
tgtccgagtggtttacagcc

SEQ ID NO: 282428 - DNA, 20 bp, Artificial Sequence
  Description of Artificial Sequence: Synthetic oligonucleotide
  Target: ATXN1; (+) strand; PAM type: YTN; PAM sequence: CTG
tccgagtggtttacagccta

SEQ ID NO: 282429 - DNA, 20 bp, Artificial Sequence
  Description of Artificial Sequence: Synthetic oligonucleotide
  Target: ATXN1; (+) strand; PAM type: YTN; PAM sequence: TTT
acagcctagttagaagagac

SEQ ID NO: 282430 - DNA, 20 bp, Artificial Sequence
  Description of Artificial Sequence: Synthetic oligonucleotide
  Target: ATXN1; (+) strand; PAM type: YTN; PAM sequence: TTA
cagcctagttagaagagacc

SEQ ID NO: 282431 - DNA, 20 bp, Artificial Sequence
  Description of Artificial Sequence: Synthetic oligonucleotide
  Target: ATXN1; (+) strand; PAM type: YTN; PAM sequence: CTA
gttagaagagacctacaggc

SEQ ID NO: 282432 - DNA, 20 bp, Artificial Sequence
  Description of Artificial Sequence: Synthetic oligonucleotide
  Target: ATXN1; (+) strand; PAM type: YTN; PAM sequence: TTA
gaagagacctacaggcacat

SEQ ID NO: 282433 - DNA, 20 bp, Artificial Sequence
  Description of Artificial Sequence: Synthetic oligonucleotide
  Target: ATXN1; (+) strand; PAM type: YTN; PAM sequence: CTA
caggcacatttgcaagtcct

SEQ ID NO: 282434 - DNA, 20 bp, Artificial Sequence
  Description of Artificial Sequence: Synthetic oligonucleotide
  Target: ATXN1; (+) strand; PAM type: YTN; PAM sequence: TTT
gcaagtccttattaaaagta

SEQ ID NO: 282435 - DNA, 20 bp, Artificial Sequence
  Description of Artificial Sequence: Synthetic oligonucleotide
  Target: ATXN1; (+) strand; PAM type: YTN; PAM sequence: TTG
caagtccttattaaaagtat

SEQ ID NO: 282436 - DNA, 20 bp, Artificial Sequence
  Description of Artificial Sequence: Synthetic oligonucleotide
  Target: ATXN1; (+) strand; PAM type: YTN; PAM sequence: CTT
attaaaagtattaggcaagt

SEQ ID NO: 282437 - DNA, 20 bp, Artificial Sequence
  Description of Artificial Sequence: Synthetic oligonucleotide
  Target: ATXN1; (+) strand; PAM type: YTN; PAM sequence: TTA
ttaaaagtattaggcaagta

SEQ ID NO: 282438 - DNA, 20 bp, Artificial Sequence
  Description of Artificial Sequence: Synthetic oligonucleotide
  Target: ATXN1; (+) strand; PAM type: YTN; PAM sequence: TTA
aaagtattaggcaagtacag

SEQ ID NO: 282439 - DNA, 20 bp, Artificial Sequence
  Description of Artificial Sequence: Synthetic oligonucleotide
  Target: ATXN1; (+) strand; PAM type: YTN; PAM sequence: TTA
ggcaagtacagcaatggccc

SEQ ID NO: 282440 - DNA, 20 bp, Artificial Sequence
  Description of Artificial Sequence: Synthetic oligonucleotide
  Target: ATXN1; (+) strand; PAM type: YTN; PAM sequence: CTC
tacctggagaaaaaggggtg

SEQ ID NO: 282441 - DNA, 20 bp, Artificial Sequence
  Description of Artificial Sequence: Synthetic oligonucleotide
  Target: ATXN1; (+) strand; PAM type: YTN; PAM sequence: CTA
cctggagaaaaaggggtgtg

SEQ ID NO: 282442 - DNA, 20 bp, Artificial Sequence
  Description of Artificial Sequence: Synthetic oligonucleotide
  Target: ATXN1; (+) strand; PAM type: YTN; PAM sequence: CTG
gagaaaaaggggtgtggcaa

SEQ ID NO: 282443 - DNA, 20 bp, Artificial Sequence
  Description of Artificial Sequence: Synthetic oligonucleotide
  Target: ATXN1; (+) strand; PAM type: YTN; PAM sequence: TTG
gtaggcaggaaagacttcct

SEQ ID NO: 282444 - DNA, 20 bp, Artificial Sequence
  Description of Artificial Sequence: Synthetic oligonucleotide
  Target: ATXN1; (+) strand; PAM type: YTN; PAM sequence: CTT
ccttaagaccaagcagcatc

SEQ ID NO: 282445 - DNA, 20 bp, Artificial Sequence
  Description of Artificial Sequence: Synthetic oligonucleotide
  Target: ATXN1; (+) strand; PAM type: YTN; PAM sequence: TTC
cttaagaccaagcagcatcc

SEQ ID NO: 282446 - DNA, 20 bp, Artificial Sequence
  Description of Artificial Sequence: Synthetic oligonucleotide
  Target: ATXN1; (+) strand; PAM type: YTN; PAM sequence: CTT
aagaccaagcagcatcctgc

SEQ ID NO: 282447 - DNA, 20 bp, Artificial Sequence
  Description of Artificial Sequence: Synthetic oligonucleotide
  Target: ATXN1; (+) strand; PAM type: YTN; PAM sequence: TTA
agaccaagcagcatcctgct

SEQ ID NO: 282448 - DNA, 20 bp, Artificial Sequence
  Description of Artificial Sequence: Synthetic oligonucleotide
  Target: ATXN1; (+) strand; PAM type: YTN; PAM sequence: CTG
cttcccttctattgtactgc

SEQ ID NO: 282449 - DNA, 20 bp, Artificial Sequence
  Description of Artificial Sequence: Synthetic oligonucleotide
  Target: ATXN1; (+) strand; PAM type: YTN; PAM sequence: CTT
cccttctattgtactgcttg

SEQ ID NO: 282450 - DNA, 20 bp, Artificial Sequence
  Description of Artificial Sequence: Synthetic oligonucleotide
  Target: ATXN1; (+) strand; PAM type: YTN; PAM sequence: TTC
ccttctattgtactgcttgc

SEQ ID NO: 282451 - DNA, 20 bp, Artificial Sequence
  Description of Artificial Sequence: Synthetic oligonucleotide
  Target: ATXN1; (+) strand; PAM type: YTN; PAM sequence: CTT
ctattgtactgcttgctcta

SEQ ID NO: 282452 - DNA, 20 bp, Artificial Sequence
  Description of Artificial Sequence: Synthetic oligonucleotide
  Target: ATXN1; (+) strand; PAM type: YTN; PAM sequence: TTC
tattgtactgcttgctctat

SEQ ID NO: 282453 - DNA, 20 bp, Artificial Sequence
  Description of Artificial Sequence: Synthetic oligonucleotide
  Target: ATXN1; (+) strand; PAM type: YTN; PAM sequence: CTA
ttgtactgcttgctctataa

SEQ ID NO: 282454 - DNA, 20 bp, Artificial Sequence
  Description of Artificial Sequence: Synthetic oligonucleotide
  Target: ATXN1; (+) strand; PAM type: YTN; PAM sequence: TTG
tactgcttgctctataaaaa

SEQ ID NO: 282455 - DNA, 20 bp, Artificial Sequence
  Description of Artificial Sequence: Synthetic oligonucleotide
  Target: ATXN1; (+) strand; PAM type: YTN; PAM sequence: CTG
cttgctctataaaaatcaat

SEQ ID NO: 282456 - DNA, 20 bp, Artificial Sequence
  Description of Artificial Sequence: Synthetic oligonucleotide
  Target: ATXN1; (+) strand; PAM type: YTN; PAM sequence: CTT
gctctataaaaatcaatggg

SEQ ID NO: 282457 - DNA, 20 bp, Artificial Sequence
  Description of Artificial Sequence: Synthetic oligonucleotide
  Target: ATXN1; (+) strand; PAM type: YTN; PAM sequence: TTG
ctctataaaaatcaatgggc

SEQ ID NO: 282458 - DNA, 20 bp, Artificial Sequence
  Description of Artificial Sequence: Synthetic oligonucleotide
  Target: ATXN1; (+) strand; PAM type: YTN; PAM sequence: CTC
tataaaaatcaatgggcata

SEQ ID NO: 282459 - DNA, 20 bp, Artificial Sequence
  Description of Artificial Sequence: Synthetic oligonucleotide
  Target: ATXN1; (+) strand; PAM type: YTN; PAM sequence: CTA
taaaaatcaatgggcatata

SEQ ID NO: 282460 - DNA, 20 bp, Artificial Sequence
  Description of Artificial Sequence: Synthetic oligonucleotide
  Target: ATXN1; (+) strand; PAM type: YTN; PAM sequence: TTT
ctagagacacacgccatcac

SEQ ID NO: 282461 - DNA, 20 bp, Artificial Sequence
  Description of Artificial Sequence: Synthetic oligonucleotide
  Target: ATXN1; (+) strand; PAM type: YTN; PAM sequence: TTC
tagagacacacgccatcaca

SEQ ID NO: 282462 - DNA, 20 bp, Artificial Sequence
  Description of Artificial Sequence: Synthetic oligonucleotide
  Target: ATXN1; (+) strand; PAM type: YTN; PAM sequence: CTA
gagacacacgccatcacaca

SEQ ID NO: 282463 - DNA, 20 bp, Artificial Sequence
  Description of Artificial Sequence: Synthetic oligonucleotide
  Target: ATXN1; (+) strand; PAM type: YTN; PAM sequence: TTA
gcaggtactccaagcccctg

SEQ ID NO: 282464 - DNA, 20 bp, Artificial Sequence
  Description of Artificial Sequence: Synthetic oligonucleotide
  Target: ATXN1; (+) strand; PAM type: YTN; PAM sequence: CTC
caagcccctgaatcttctaa

SEQ ID NO: 282465 - DNA, 20 bp, Artificial Sequence
  Description of Artificial Sequence: Synthetic oligonucleotide
  Target: ATXN1; (+) strand; PAM type: YTN; PAM sequence: CTG
aatcttctaaactaattccc

SEQ ID NO: 282466 - DNA, 20 bp, Artificial Sequence
  Description of Artificial Sequence: Synthetic oligonucleotide
  Target: ATXN1; (+) strand; PAM type: YTN; PAM sequence: CTT
ctaaactaattccccacatc

SEQ ID NO: 282467 - DNA, 20 bp, Artificial Sequence
  Description of Artificial Sequence: Synthetic oligonucleotide
  Target: ATXN1; (+) strand; PAM type: YTN; PAM sequence: TTC
taaactaattccccacatca

SEQ ID NO: 282468 - DNA, 20 bp, Artificial Sequence
  Description of Artificial Sequence: Synthetic oligonucleotide
  Target: ATXN1; (+) strand; PAM type: YTN; PAM sequence: CTA
aactaattccccacatcaaa

SEQ ID NO: 282469 - DNA, 20 bp, Artificial Sequence
  Description of Artificial Sequence: Synthetic oligonucleotide
  Target: ATXN1; (+) strand; PAM type: YTN; PAM sequence: CTA
attccccacatcaaacctca

SEQ ID NO: 282470 - DNA, 20 bp, Artificial Sequence
  Description of Artificial Sequence: Synthetic oligonucleotide
  Target: ATXN1; (+) strand; PAM type: YTN; PAM sequence: TTC
cccacatcaaacctcaaggg

SEQ ID NO: 282471 - DNA, 20 bp, Artificial Sequence
  Description of Artificial Sequence: Synthetic oligonucleotide
  Target: ATXN1; (+) strand; PAM type: YTN; PAM sequence: CTC
aagggcacactatttaggaa

SEQ ID NO: 282472 - DNA, 20 bp, Artificial Sequence
  Description of Artificial Sequence: Synthetic oligonucleotide
  Target: ATXN1; (+) strand; PAM type: YTN; PAM sequence: CTA
tttaggaagatttaatgcaa

SEQ ID NO: 282473 - DNA, 20 bp, Artificial Sequence
  Description of Artificial Sequence: Synthetic oligonucleotide
  Target: ATXN1; (+) strand; PAM type: YTN; PAM sequence: TTT
aggaagatttaatgcaataa

SEQ ID NO: 282474 - DNA, 20 bp, Artificial Sequence
  Description of Artificial Sequence: Synthetic oligonucleotide
  Target: ATXN1; (+) strand; PAM type: YTN; PAM sequence: TTA
ggaagatttaatgcaataaa

SEQ ID NO: 282475 - DNA, 20 bp, Artificial Sequence
  Description of Artificial Sequence: Synthetic oligonucleotide
  Target: ATXN1; (+) strand; PAM type: YTN; PAM sequence: TTT
aatgcaataaactcagactc

SEQ ID NO: 282476 - DNA, 20 bp, Artificial Sequence
  Description of Artificial Sequence: Synthetic oligonucleotide
  Target: ATXN1; (+) strand; PAM type: YTN; PAM sequence: TTA
atgcaataaactcagactct

SEQ ID NO: 282477 - DNA, 20 bp, Artificial Sequence
  Description of Artificial Sequence: Synthetic oligonucleotide
  Target: ATXN1; (+) strand; PAM type: YTN; PAM sequence: CTC
agactctttatatagtgact

SEQ ID NO: 282478 - DNA, 20 bp, Artificial Sequence
  Description of Artificial Sequence: Synthetic oligonucleotide
  Target: ATXN1; (+) strand; PAM type: YTN; PAM sequence: CTC
tttatatagtgactatgtgc

SEQ ID NO: 282479 - DNA, 20 bp, Artificial Sequence
  Description of Artificial Sequence: Synthetic oligonucleotide
  Target: ATXN1; (+) strand; PAM type: YTN; PAM sequence: CTT
tatatagtgactatgtgctt

SEQ ID NO: 282480 - DNA, 20 bp, Artificial Sequence
  Description of Artificial Sequence: Synthetic oligonucleotide
  Target: ATXN1; (+) strand; PAM type: YTN; PAM sequence: TTT
atatagtgactatgtgcttt

SEQ ID NO: 282481 - DNA, 20 bp, Artificial Sequence
  Description of Artificial Sequence: Synthetic oligonucleotide
  Target: ATXN1; (+) strand; PAM type: YTN; PAM sequence: TTA
tatagtgactatgtgctttt

SEQ ID NO: 282482 - DNA, 20 bp, Artificial Sequence
  Description of Artificial Sequence: Synthetic oligonucleotide
  Target: ATXN1; (+) strand; PAM type: YTN; PAM sequence: CTA
tgtgcttttctaggaaaatt

SEQ ID NO: 282483 - DNA, 20 bp, Artificial Sequence
  Description of Artificial Sequence: Synthetic oligonucleotide
  Target: ATXN1; (+) strand; PAM type: YTN; PAM sequence: CTT
ttctaggaaaattggaaaca

SEQ ID NO: 282484 - DNA, 20 bp, Artificial Sequence
  Description of Artificial Sequence: Synthetic oligonucleotide
  Target: ATXN1; (+) strand; PAM type: YTN; PAM sequence: TTT
tctaggaaaattggaaacag

SEQ ID NO: 282485 - DNA, 20 bp, Artificial Sequence
  Description of Artificial Sequence: Synthetic oligonucleotide
  Target: ATXN1; (+) strand; PAM type: YTN; PAM sequence: TTT
ctaggaaaattggaaacagc

SEQ ID NO: 282486 - DNA, 20 bp, Artificial Sequence
  Description of Artificial Sequence: Synthetic oligonucleotide
  Target: ATXN1; (+) strand; PAM type: YTN; PAM sequence: TTC
taggaaaattggaaacagct

SEQ ID NO: 282487 - DNA, 20 bp, Artificial Sequence
  Description of Artificial Sequence: Synthetic oligonucleotide
  Target: ATXN1; (+) strand; PAM type: YTN; PAM sequence: CTA
ggaaaattggaaacagctaa

SEQ ID NO: 282488 - DNA, 20 bp, Artificial Sequence
  Description of Artificial Sequence: Synthetic oligonucleotide
  Target: ATXN1; (+) strand; PAM type: YTN; PAM sequence: TTG
gaaacagctaaggtaaaaaa

SEQ ID NO: 282489 - DNA, 20 bp, Artificial Sequence
  Description of Artificial Sequence: Synthetic oligonucleotide
  Target: ATXN1; (+) strand; PAM type: YTN; PAM sequence: CTA
aggtaaaaaaaaaaaaatct

SEQ ID NO: 282490 - DNA, 20 bp, Artificial Sequence
  Description of Artificial Sequence: Synthetic oligonucleotide
  Target: ATXN1; (+) strand; PAM type: YTN; PAM sequence: CTG
aaaagtcatttgtcttaatc

SEQ ID NO: 282491 - DNA, 20 bp, Artificial Sequence
  Description of Artificial Sequence: Synthetic oligonucleotide
  Target: ATXN1; (+) strand; PAM type: YTN; PAM sequence: TTT
gtcttaatccagtcttcaaa

SEQ ID NO: 282492 - DNA, 20 bp, Artificial Sequence
  Description of Artificial Sequence: Synthetic oligonucleotide
  Target: ATXN1; (+) strand; PAM type: YTN; PAM sequence: TTG
tcttaatccagtcttcaaat

SEQ ID NO: 282493 - DNA, 20 bp, Artificial Sequence
  Description of Artificial Sequence: Synthetic oligonucleotide
  Target: ATXN1; (+) strand; PAM type: YTN; PAM sequence: CTT
aatccagtcttcaaatccaa

SEQ ID NO: 282494 - DNA, 20 bp, Artificial Sequence
  Description of Artificial Sequence: Synthetic oligonucleotide
  Target: ATXN1; (+) strand; PAM type: YTN; PAM sequence: TTA
atccagtcttcaaatccaat

SEQ ID NO: 282495 - DNA, 20 bp, Artificial Sequence
  Description of Artificial Sequence: Synthetic oligonucleotide
  Target: ATXN1; (+) strand; PAM type: YTN; PAM sequence: CTT
caaatccaatttcatcgttt

SEQ ID NO: 282496 - DNA, 20 bp, Artificial Sequence
  Description of Artificial Sequence: Synthetic oligonucleotide
  Target: ATXN1; (+) strand; PAM type: YTN; PAM sequence: TTC
aaatccaatttcatcgtttt

SEQ ID NO: 282497 - DNA, 20 bp, Artificial Sequence
  Description of Artificial Sequence: Synthetic oligonucleotide
  Target: ATXN1; (+) strand; PAM type: YTN; PAM sequence: TTT
catcgtttttattccttcac

SEQ ID NO: 282498 - DNA, 20 bp, Artificial Sequence
  Description of Artificial Sequence: Synthetic oligonucleotide
  Target: ATXN1; (+) strand; PAM type: YTN; PAM sequence: TTC
atcgtttttattccttcaca

SEQ ID NO: 282499 - DNA, 20 bp, Artificial Sequence
  Description of Artificial Sequence: Synthetic oligonucleotide
  Target: ATXN1; (+) strand; PAM type: YTN; PAM sequence: TTT
ttattccttcacagggaata

SEQ ID NO: 282500 - DNA, 20 bp, Artificial Sequence
  Description of Artificial Sequence: Synthetic oligonucleotide
  Target: ATXN1; (+) strand; PAM type: YTN; PAM sequence: TTT
tattccttcacagggaataa

SEQ ID NO: 282501 - DNA, 20 bp, Artificial Sequence
  Description of Artificial Sequence: Synthetic oligonucleotide
  Target: ATXN1; (+) strand; PAM type: YTN; PAM sequence: TTT
attccttcacagggaataat

SEQ ID NO: 282502 - DNA, 20 bp, Artificial Sequence
  Description of Artificial Sequence: Synthetic oligonucleotide
  Target: ATXN1; (+) strand; PAM type: YTN; PAM sequence: TTA
ttccttcacagggaataatg

SEQ ID NO: 282503 - DNA, 20 bp, Artificial Sequence
  Description of Artificial Sequence: Synthetic oligonucleotide
  Target: ATXN1; (+) strand; PAM type: YTN; PAM sequence: TTC
cttcacagggaataatgaag

SEQ ID NO: 282504 - DNA, 20 bp, Artificial Sequence
  Description of Artificial Sequence: Synthetic oligonucleotide
  Target: ATXN1; (+) strand; PAM type: YTN; PAM sequence: CTT
cacagggaataatgaagagc

SEQ ID NO: 282505 - DNA, 20 bp, Artificial Sequence
  Description of Artificial Sequence: Synthetic oligonucleotide
  Target: ATXN1; (+) strand; PAM type: YTN; PAM sequence: TTC
acagggaataatgaagagca

SEQ ID NO: 282506 - DNA, 20 bp, Artificial Sequence
  Description of Artificial Sequence: Synthetic oligonucleotide
  Target: ATXN1; (+) strand; PAM type: YTN; PAM sequence: CTC
cctaagtctctttacttaat

SEQ ID NO: 282507 - DNA, 20 bp, Artificial Sequence
  Description of Artificial Sequence: Synthetic oligonucleotide
  Target: ATXN1; (+) strand; PAM type: YTN; PAM sequence: CTA
agtctctttacttaattcaa

SEQ ID NO: 282508 - DNA, 20 bp, Artificial Sequence
  Description of Artificial Sequence: Synthetic oligonucleotide
  Target: ATXN1; (+) strand; PAM type: YTN; PAM sequence: CTC
tttacttaattcaattttct

SEQ ID NO: 282509 - DNA, 20 bp, Artificial Sequence
  Description of Artificial Sequence: Synthetic oligonucleotide
  Target: ATXN1; (+) strand; PAM type: YTN; PAM sequence: CTT
tacttaattcaattttcttg

SEQ ID NO: 282510 - DNA, 20 bp, Artificial Sequence
  Description of Artificial Sequence: Synthetic oligonucleotide
  Target: ATXN1; (+) strand; PAM type: YTN; PAM sequence: TTT
acttaattcaattttcttgt

SEQ ID NO: 282511 - DNA, 20 bp, Artificial Sequence
  Description of Artificial Sequence: Synthetic oligonucleotide
  Target: ATXN1; (+) strand; PAM type: YTN; PAM sequence: TTA
cttaattcaattttcttgta

SEQ ID NO: 282512 - DNA, 20 bp, Artificial Sequence
  Description of Artificial Sequence: Synthetic oligonucleotide
  Target: ATXN1; (+) strand; PAM type: YTN; PAM sequence: CTT
aattcaattttcttgtactg

SEQ ID NO: 282513 - DNA, 20 bp, Artificial Sequence
  Description of Artificial Sequence: Synthetic oligonucleotide
  Target: ATXN1; (+) strand; PAM type: YTN; PAM sequence: TTA
attcaattttcttgtactgc

SEQ ID NO: 282514 - DNA, 20 bp, Artificial Sequence
  Description of Artificial Sequence: Synthetic oligonucleotide
  Target: ATXN1; (+) strand; PAM type: YTN; PAM sequence: TTC
aattttcttgtactgctctt

SEQ ID NO: 282515 - DNA, 20 bp, Artificial Sequence
  Description of Artificial Sequence: Synthetic oligonucleotide
  Target: ATXN1; (+) strand; PAM type: YTN; PAM sequence: TTT
tcttgtactgctcttacagt

SEQ ID NO: 282516 - DNA, 20 bp, Artificial Sequence
  Description of Artificial Sequence: Synthetic oligonucleotide
  Target: ATXN1; (+) strand; PAM type: YTN; PAM sequence: TTT
cttgtactgctcttacagta

SEQ ID NO: 282517 - DNA, 20 bp, Artificial Sequence
  Description of Artificial Sequence: Synthetic oligonucleotide
  Target: ATXN1; (+) strand; PAM type: YTN; PAM sequence: TTC
ttgtactgctcttacagtat

SEQ ID NO: 282518 - DNA, 20 bp, Artificial Sequence
  Description of Artificial Sequence: Synthetic oligonucleotide
  Target: ATXN1; (+) strand; PAM type: YTN; PAM sequence: CTT
gtactgctcttacagtattt

SEQ ID NO: 282519 - DNA, 20 bp, Artificial Sequence
  Description of Artificial Sequence: Synthetic oligonucleotide
  Target: ATXN1; (+) strand; PAM type: YTN; PAM sequence: TTG
tactgctcttacagtatttt

SEQ ID NO: 282520 - DNA, 20 bp, Artificial Sequence
  Description of Artificial Sequence: Synthetic oligonucleotide
  Target: ATXN1; (+) strand; PAM type: YTN; PAM sequence: CTG
ctcttacagtattttccaaa

SEQ ID NO: 282521 - DNA, 20 bp, Artificial Sequence
  Description of Artificial Sequence: Synthetic oligonucleotide
  Target: ATXN1; (+) strand; PAM type: YTN; PAM sequence: CTC
ttacagtattttccaaacaa

SEQ ID NO: 282522 - DNA, 20 bp, Artificial Sequence
  Description of Artificial Sequence: Synthetic oligonucleotide
  Target: ATXN1; (+) strand; PAM type: YTN; PAM sequence: CTT
acagtattttccaaacaaag

SEQ ID NO: 282523 - DNA, 20 bp, Artificial Sequence
  Description of Artificial Sequence: Synthetic oligonucleotide
  Target: ATXN1; (+) strand; PAM type: YTN; PAM sequence: TTA
cagtattttccaaacaaagc

SEQ ID NO: 282524 - DNA, 20 bp, Artificial Sequence
  Description of Artificial Sequence: Synthetic oligonucleotide
  Target: ATXN1; (+) strand; PAM type: YTN; PAM sequence: TTT
tccaaacaaagctgttcttt

SEQ ID NO: 282525 - DNA, 20 bp, Artificial Sequence
  Description of Artificial Sequence: Synthetic oligonucleotide
  Target: ATXN1; (+) strand; PAM type: YTN; PAM sequence: TTT
ccaaacaaagctgttctttt

SEQ ID NO: 282526 - DNA, 20 bp, Artificial Sequence
  Description of Artificial Sequence: Synthetic oligonucleotide
  Target: ATXN1; (+) strand; PAM type: YTN; PAM sequence: TTC
caaacaaagctgttcttttc

SEQ ID NO: 282527 - DNA, 20 bp, Artificial Sequence
  Description of Artificial Sequence: Synthetic oligonucleotide
  Target: ATXN1; (+) strand; PAM type: YTN; PAM sequence: CTG
ttcttttctacatatgatag

SEQ ID NO: 282528 - DNA, 20 bp, Artificial Sequence
  Description of Artificial Sequence: Synthetic oligonucleotide
  Target: ATXN1; (+) strand; PAM type: YTN; PAM sequence: TTC
ttttctacatatgatagttc

SEQ ID NO: 282529 - DNA, 20 bp, Artificial Sequence
  Description of Artificial Sequence: Synthetic oligonucleotide
  Target: ATXN1; (+) strand; PAM type: YTN; PAM sequence: CTT
ttctacatatgatagttcag

SEQ ID NO: 282530 - DNA, 20 bp, Artificial Sequence
  Description of Artificial Sequence: Synthetic oligonucleotide
  Target: ATXN1; (+) strand; PAM type: YTN; PAM sequence: TTT
tctacatatgatagttcagc

SEQ ID NO: 282531 - DNA, 20 bp, Artificial Sequence
  Description of Artificial Sequence: Synthetic oligonucleotide
  Target: ATXN1; (+) strand; PAM type: YTN; PAM sequence: TTT
ctacatatgatagttcagcc

SEQ ID NO: 282532 - DNA, 20 bp, Artificial Sequence
  Description of Artificial Sequence: Synthetic oligonucleotide
  Target: ATXN1; (+) strand; PAM type: YTN; PAM sequence: TTC
tacatatgatagttcagccc

SEQ ID NO: 282533 - DNA, 20 bp, Artificial Sequence
  Description of Artificial Sequence: Synthetic oligonucleotide
  Target: ATXN1; (+) strand; PAM type: YTN; PAM sequence: CTA
catatgatagttcagcccag

SEQ ID NO: 282534 - DNA, 20 bp, Artificial Sequence
  Description of Artificial Sequence: Synthetic oligonucleotide
  Target: ATXN1; (+) strand; PAM type: YTN; PAM sequence: TTC
agcccagcaaatgtcctcag

SEQ ID NO: 282535 - DNA, 20 bp, Artificial Sequence
  Description of Artificial Sequence: Synthetic oligonucleotide
  Target: ATXN1; (+) strand; PAM type: YTN; PAM sequence: CTC
aggaataataaacaaacagt

SEQ ID NO: 282536 - DNA, 20 bp, Artificial Sequence
  Description of Artificial Sequence: Synthetic oligonucleotide
  Target: ATXN1; (+) strand; PAM type: YTN; PAM sequence: TTT
tctgccacaaattacactct

SEQ ID NO: 282537 - DNA, 20 bp, Artificial Sequence
  Description of Artificial Sequence: Synthetic oligonucleotide
  Target: ATXN1; (+) strand; PAM type: YTN; PAM sequence: TTT
ctgccacaaattacactctg

SEQ ID NO: 282538 - DNA, 20 bp, Artificial Sequence
  Description of Artificial Sequence: Synthetic oligonucleotide
  Target: ATXN1; (+) strand; PAM type: YTN; PAM sequence: TTC
tgccacaaattacactctgc

SEQ ID NO: 282539 - DNA, 20 bp, Artificial Sequence
  Description of Artificial Sequence: Synthetic oligonucleotide
  Target: ATXN1; (+) strand; PAM type: YTN; PAM sequence: CTG
ccacaaattacactctgcaa

SEQ ID NO: 282540 - DNA, 20 bp, Artificial Sequence
  Description of Artificial Sequence: Synthetic oligonucleotide
  Target: ATXN1; (+) strand; PAM type: YTN; PAM sequence: TTA
cactctgcaacattcttcat

SEQ ID NO: 282541 - DNA, 20 bp, Artificial Sequence
  Description of Artificial Sequence: Synthetic oligonucleotide
  Target: ATXN1; (+) strand; PAM type: YTN; PAM sequence: CTC
tgcaacattcttcatccaaa

SEQ ID NO: 282542 - DNA, 20 bp, Artificial Sequence
  Description of Artificial Sequence: Synthetic oligonucleotide
  Target: ATXN1; (+) strand; PAM type: YTN; PAM sequence: CTG
caacattcttcatccaaagc

SEQ ID NO: 282543 - DNA, 20 bp, Artificial Sequence
  Description of Artificial Sequence: Synthetic oligonucleotide
  Target: ATXN1; (+) strand; PAM type: YTN; PAM sequence: TTC
ttcatccaaagcattttcaa

SEQ ID NO: 282544 - DNA, 20 bp, Artificial Sequence
  Description of Artificial Sequence: Synthetic oligonucleotide
  Target: ATXN1; (+) strand; PAM type: YTN; PAM sequence: CTT
catccaaagcattttcaatt

SEQ ID NO: 282545 - DNA, 20 bp, Artificial Sequence
  Description of Artificial Sequence: Synthetic oligonucleotide
  Target: ATXN1; (+) strand; PAM type: YTN; PAM sequence: TTC
atccaaagcattttcaattc

SEQ ID NO: 282546 - DNA, 20 bp, Artificial Sequence
  Description of Artificial Sequence: Synthetic oligonucleotide
  Target: ATXN1; (+) strand; PAM type: YTN; PAM sequence: TTT
tcaattccaagcaagcaaag

SEQ ID NO: 282547 - DNA, 20 bp, Artificial Sequence
  Description of Artificial Sequence: Synthetic oligonucleotide
  Target: ATXN1; (+) strand; PAM type: YTN; PAM sequence: TTT
caattccaagcaagcaaaga

SEQ ID NO: 282548 - DNA, 20 bp, Artificial Sequence
  Description of Artificial Sequence: Synthetic oligonucleotide
  Target: ATXN1; (+) strand; PAM type: YTN; PAM sequence: TTC
aattccaagcaagcaaagac

SEQ ID NO: 282549 - DNA, 20 bp, Artificial Sequence
  Description of Artificial Sequence: Synthetic oligonucleotide
  Target: ATXN1; (+) strand; PAM type: YTN; PAM sequence: TTC
caagcaagcaaagacacaag

SEQ ID NO: 282550 - DNA, 20 bp, Artificial Sequence
  Description of Artificial Sequence: Synthetic oligonucleotide
  Target: ATXN1; (+) strand; PAM type: YTN; PAM sequence: CTG
ccttattacaagaactgcac

SEQ ID NO: 282551 - DNA, 20 bp, Artificial Sequence
  Description of Artificial Sequence: Synthetic oligonucleotide
  Target: ATXN1; (+) strand; PAM type: YTN; PAM sequence: CTT
attacaagaactgcacacaa

SEQ ID NO: 282552 - DNA, 20 bp, Artificial Sequence
  Description of Artificial Sequence: Synthetic oligonucleotide
  Target: ATXN1; (+) strand; PAM type: YTN; PAM sequence: TTA
ttacaagaactgcacacaat

SEQ ID NO: 282553 - DNA, 20 bp, Artificial Sequence
  Description of Artificial Sequence: Synthetic oligonucleotide
  Target: ATXN1; (+) strand; PAM type: YTN; PAM sequence: TTA
caagaactgcacacaataga

SEQ ID NO: 282554 - DNA, 20 bp, Artificial Sequence
  Description of Artificial Sequence: Synthetic oligonucleotide
  Target: ATXN1; (+) strand; PAM type: YTN; PAM sequence: CTG
cacacaatagagaatctgta

SEQ ID NO: 282555 - DNA, 20 bp, Artificial Sequence
  Description of Artificial Sequence: Synthetic oligonucleotide
  Target: ATXN1; (+) strand; PAM type: YTN; PAM sequence: CTG
tattcagacacttattgaca

SEQ ID NO: 282556 - DNA, 20 bp, Artificial Sequence
  Description of Artificial Sequence: Synthetic oligonucleotide
  Target: ATXN1; (+) strand; PAM type: YTN; PAM sequence: TTC
agacacttattgacacttaa

SEQ ID NO: 282557 - DNA, 20 bp, Artificial Sequence
  Description of Artificial Sequence: Synthetic oligonucleotide
  Target: ATXN1; (+) strand; PAM type: YTN; PAM sequence: CTT
attgacacttaaacctgtta

SEQ ID NO: 282558 - DNA, 20 bp, Artificial Sequence
  Description of Artificial Sequence: Synthetic oligonucleotide
  Target: ATXN1; (+) strand; PAM type: YTN; PAM sequence: TTA
ttgacacttaaacctgttaa

SEQ ID NO: 282559 - DNA, 20 bp, Artificial Sequence
  Description of Artificial Sequence: Synthetic oligonucleotide
  Target: ATXN1; (+) strand; PAM type: YTN; PAM sequence: TTG
acacttaaacctgttaatat

SEQ ID NO: 282560 - DNA, 20 bp, Artificial Sequence
  Description of Artificial Sequence: Synthetic oligonucleotide
  Target: ATXN1; (+) strand; PAM type: YTN; PAM sequence: CTT
aaacctgttaatatgtaact

SEQ ID NO: 282561 - DNA, 20 bp, Artificial Sequence
  Description of Artificial Sequence: Synthetic oligonucleotide
  Target: ATXN1; (+) strand; PAM type: YTN; PAM sequence: TTA
aacctgttaatatgtaactc

SEQ ID NO: 282562 - DNA, 20 bp, Artificial Sequence
  Description of Artificial Sequence: Synthetic oligonucleotide
  Target: ATXN1; (+) strand; PAM type: YTN; PAM sequence: CTG
ttaatatgtaactcctacta

SEQ ID NO: 282563 - DNA, 20 bp, Artificial Sequence
  Description of Artificial Sequence: Synthetic oligonucleotide
  Target: ATXN1; (+) strand; PAM type: YTN; PAM sequence: TTA
atatgtaactcctactattg

SEQ ID NO: 282564 - DNA, 20 bp, Artificial Sequence
  Description of Artificial Sequence: Synthetic oligonucleotide
  Target: ATXN1; (+) strand; PAM type: YTN; PAM sequence: CTC
ctactattgttctaaaggat

SEQ ID NO: 282565 - DNA, 20 bp, Artificial Sequence
  Description of Artificial Sequence: Synthetic oligonucleotide
  Target: ATXN1; (+) strand; PAM type: YTN; PAM sequence: CTA
ctattgttctaaaggatgaa

SEQ ID NO: 282566 - DNA, 20 bp, Artificial Sequence
  Description of Artificial Sequence: Synthetic oligonucleotide
  Target: ATXN1; (+) strand; PAM type: YTN; PAM sequence: CTA
ttgttctaaaggatgaataa

SEQ ID NO: 282567 - DNA, 20 bp, Artificial Sequence
  Description of Artificial Sequence: Synthetic oligonucleotide
  Target: ATXN1; (+) strand; PAM type: YTN; PAM sequence: TTG
ttctaaaggatgaataagca

SEQ ID NO: 282568 - DNA, 20 bp, Artificial Sequence
  Description of Artificial Sequence: Synthetic oligonucleotide
  Target: ATXN1; (+) strand; PAM type: YTN; PAM sequence: TTC
taaaggatgaataagcaaat

SEQ ID NO: 282569 - DNA, 20 bp, Artificial Sequence
  Description of Artificial Sequence: Synthetic oligonucleotide
  Target: ATXN1; (+) strand; PAM type: YTN; PAM sequence: CTA
aaggatgaataagcaaattc

SEQ ID NO: 282570 - DNA, 20 bp, Artificial Sequence
  Description of Artificial Sequence: Synthetic oligonucleotide
  Target: ATXN1; (+) strand; PAM type: YTN; PAM sequence: TTC
tcctgcacatataatgttac

SEQ ID NO: 282571 - DNA, 20 bp, Artificial Sequence
  Description of Artificial Sequence: Synthetic oligonucleotide
  Target: ATXN1; (+) strand; PAM type: YTN; PAM sequence: CTC
ctgcacatataatgttacat

SEQ ID NO: 282572 - DNA, 20 bp, Artificial Sequence
  Description of Artificial Sequence: Synthetic oligonucleotide
  Target: ATXN1; (+) strand; PAM type: YTN; PAM sequence: CTG
cacatataatgttacatcat

SEQ ID NO: 282573 - DNA, 20 bp, Artificial Sequence
  Description of Artificial Sequence: Synthetic oligonucleotide
  Target: ATXN1; (+) strand; PAM type: YTN; PAM sequence: TTA
catcatgcactttaattaca

SEQ ID NO: 282574 - DNA, 20 bp, Artificial Sequence
  Description of Artificial Sequence: Synthetic oligonucleotide
  Target: ATXN1; (+) strand; PAM type: YTN; PAM sequence: CTT
taattacaatagtaaatact

SEQ ID NO: 282575 - DNA, 20 bp, Artificial Sequence
  Description of Artificial Sequence: Synthetic oligonucleotide
  Target: ATXN1; (+) strand; PAM type: YTN; PAM sequence: TTT
aattacaatagtaaatactg

SEQ ID NO: 282576 - DNA, 20 bp, Artificial Sequence
  Description of Artificial Sequence: Synthetic oligonucleotide
  Target: ATXN1; (+) strand; PAM type: YTN; PAM sequence: TTA
attacaatagtaaatactgc

SEQ ID NO: 282577 - DNA, 20 bp, Artificial Sequence
  Description of Artificial Sequence: Synthetic oligonucleotide
  Target: ATXN1; (+) strand; PAM type: YTN; PAM sequence: TTA
caatagtaaatactgccgaa

SEQ ID NO: 282578 - DNA, 20 bp, Artificial Sequence
  Description of Artificial Sequence: Synthetic oligonucleotide
  Target: ATXN1; (+) strand; PAM type: YTN; PAM sequence: CTG
ccgaaaggaattttactttc

SEQ ID NO: 282579 - DNA, 20 bp, Artificial Sequence
  Description of Artificial Sequence: Synthetic oligonucleotide
  Target: ATXN1; (+) strand; PAM type: YTN; PAM sequence: TTT
tactttcactgtttcatatc

SEQ ID NO: 282580 - DNA, 20 bp, Artificial Sequence
  Description of Artificial Sequence: Synthetic oligonucleotide
  Target: ATXN1; (+) strand; PAM type: YTN; PAM sequence: TTT
actttcactgtttcatatca

SEQ ID NO: 282581 - DNA, 20 bp, Artificial Sequence
  Description of Artificial Sequence: Synthetic oligonucleotide
  Target: ATXN1; (+) strand; PAM type: YTN; PAM sequence: TTA
ctttcactgtttcatatcac

SEQ ID NO: 282582 - DNA, 20 bp, Artificial Sequence
  Description of Artificial Sequence: Synthetic oligonucleotide
  Target: ATXN1; (+) strand; PAM type: YTN; PAM sequence: CTT
tcactgtttcatatcacctt

SEQ ID NO: 282583 - DNA, 20 bp, Artificial Sequence
  Description of Artificial Sequence: Synthetic oligonucleotide
  Target: ATXN1; (+) strand; PAM type: YTN; PAM sequence: TTT
cactgtttcatatcaccttt

SEQ ID NO: 282584 - DNA, 20 bp, Artificial Sequence
  Description of Artificial Sequence: Synthetic oligonucleotide
  Target: ATXN1; (+) strand; PAM type: YTN; PAM sequence: TTC
actgtttcatatcacctttt

SEQ ID NO: 282585 - DNA, 20 bp, Artificial Sequence
  Description of Artificial Sequence: Synthetic oligonucleotide
  Target: ATXN1; (+) strand; PAM type: YTN; PAM sequence: CTG
tttcatatcaccttttctaa

SEQ ID NO: 282586 - DNA, 20 bp, Artificial Sequence
  Description of Artificial Sequence: Synthetic oligonucleotide
  Target: ATXN1; (+) strand; PAM type: YTN; PAM sequence: TTT
catatcaccttttctaatta

SEQ ID NO: 282587 - DNA, 20 bp, Artificial Sequence
  Description of Artificial Sequence: Synthetic oligonucleotide
  Target: ATXN1; (+) strand; PAM type: YTN; PAM sequence: TTC
atatcaccttttctaattaa

SEQ ID NO: 282588 - DNA, 20 bp, Artificial Sequence
  Description of Artificial Sequence: Synthetic oligonucleotide
  Target: ATXN1; (+) strand; PAM type: YTN; PAM sequence: CTT
ttctaattaatgtcaatgtg

SEQ ID NO: 282589 - DNA, 20 bp, Artificial Sequence
  Description of Artificial Sequence: Synthetic oligonucleotide
  Target: ATXN1; (+) strand; PAM type: YTN; PAM sequence: TTT
tctaattaatgtcaatgtgt

SEQ ID NO: 282590 - DNA, 20 bp, Artificial Sequence
  Description of Artificial Sequence: Synthetic oligonucleotide
  Target: ATXN1; (+) strand; PAM type: YTN; PAM sequence: TTT
ctaattaatgtcaatgtgtc

SEQ ID NO: 282591 - DNA, 20 bp, Artificial Sequence
  Description of Artificial Sequence: Synthetic oligonucleotide
  Target: ATXN1; (+) strand; PAM type: YTN; PAM sequence: TTC
taattaatgtcaatgtgtct

SEQ ID NO: 282592 - DNA, 20 bp, Artificial Sequence
  Description of Artificial Sequence: Synthetic oligonucleotide
  Target: ATXN1; (+) strand; PAM type: YTN; PAM sequence: CTA
attaatgtcaatgtgtcttt

SEQ ID NO: 282593 - DNA, 20 bp, Artificial Sequence
  Description of Artificial Sequence: Synthetic oligonucleotide
  Target: ATXN1; (+) strand; PAM type: YTN; PAM sequence: TTA
atgtcaatgtgtcttttcca

SEQ ID NO: 282594 - DNA, 20 bp, Artificial Sequence
  Description of Artificial Sequence: Synthetic oligonucleotide
  Target: ATXN1; (+) strand; PAM type: YTN; PAM sequence: CTT
ttccatgtaagagagcatac

SEQ ID NO: 282595 - DNA, 20 bp, Artificial Sequence
  Description of Artificial Sequence: Synthetic oligonucleotide
  Target: ATXN1; (+) strand; PAM type: YTN; PAM sequence: TTT
tccatgtaagagagcataca

SEQ ID NO: 282596 - DNA, 20 bp, Artificial Sequence
  Description of Artificial Sequence: Synthetic oligonucleotide
  Target: ATXN1; (+) strand; PAM type: YTN; PAM sequence: TTT
ccatgtaagagagcatacag

SEQ ID NO: 282597 - DNA, 20 bp, Artificial Sequence
  Description of Artificial Sequence: Synthetic oligonucleotide
  Target: ATXN1; (+) strand; PAM type: YTN; PAM sequence: TTC
catgtaagagagcatacagc

SEQ ID NO: 282598 - DNA, 20 bp, Artificial Sequence
  Description of Artificial Sequence: Synthetic oligonucleotide
  Target: ATXN1; (+) strand; PAM type: YTN; PAM sequence: TTG
tgtctttgtgtatctgccca

SEQ ID NO: 282599 - DNA, 20 bp, Artificial Sequence
  Description of Artificial Sequence: Synthetic oligonucleotide
  Target: ATXN1; (+) strand; PAM type: YTN; PAM sequence: CTT
tgtgtatctgcccaaatgta

SEQ ID NO: 282600 - DNA, 20 bp, Artificial Sequence
  Description of Artificial Sequence: Synthetic oligonucleotide
  Target: ATXN1; (+) strand; PAM type: YTN; PAM sequence: TTT
gtgtatctgcccaaatgtac

SEQ ID NO: 282601 - DNA, 20 bp, Artificial Sequence
  Description of Artificial Sequence: Synthetic oligonucleotide
  Target: ATXN1; (+) strand; PAM type: YTN; PAM sequence: TTG
tgtatctgcccaaatgtaca

SEQ ID NO: 282602 - DNA, 20 bp, Artificial Sequence
  Description of Artificial Sequence: Synthetic oligonucleotide
  Target: ATXN1; (+) strand; PAM type: YTN; PAM sequence: CTG
cccaaatgtacacatattca

SEQ ID NO: 282603 - DNA, 20 bp, Artificial Sequence
  Description of Artificial Sequence: Synthetic oligonucleotide
  Target: ATXN1; (+) strand; PAM type: YTN; PAM sequence: TTC
atgaatgcacatacaaataa

SEQ ID NO: 282604 - DNA, 20 bp, Artificial Sequence
  Description of Artificial Sequence: Synthetic oligonucleotide
  Target: ATXN1; (+) strand; PAM type: YTN; PAM sequence: CTC
ttatgcacacagagtaaccc

SEQ ID NO: 282605 - DNA, 20 bp, Artificial Sequence
  Description of Artificial Sequence: Synthetic oligonucleotide
  Target: ATXN1; (+) strand; PAM type: YTN; PAM sequence: CTT
atgcacacagagtaaccccc

SEQ ID NO: 282606 - DNA, 20 bp, Artificial Sequence
  Description of Artificial Sequence: Synthetic oligonucleotide
  Target: ATXN1; (+) strand; PAM type: YTN; PAM sequence: TTA
tgcacacagagtaaccccca

SEQ ID NO: 282607 - DNA, 20 bp, Artificial Sequence
  Description of Artificial Sequence: Synthetic oligonucleotide
  Target: ATXN1; (+) strand; PAM type: YTN; PAM sequence: TTA
gcatgcatttataaatacag

SEQ ID NO: 282608 - DNA, 20 bp, Artificial Sequence
  Description of Artificial Sequence: Synthetic oligonucleotide
  Target: ATXN1; (+) strand; PAM type: YTN; PAM sequence: TTT
ataaatacagctggccccac

SEQ ID NO: 282609 - DNA, 20 bp, Artificial Sequence
  Description of Artificial Sequence: Synthetic oligonucleotide
  Target: ATXN1; (+) strand; PAM type: YTN; PAM sequence: TTA
taaatacagctggccccacc

SEQ ID NO: 282610 - DNA, 20 bp, Artificial Sequence
  Description of Artificial Sequence: Synthetic oligonucleotide
  Target: ATXN1; (+) strand; PAM type: YTN; PAM sequence: CTG
gccccaccccgagcatgcat

SEQ ID NO: 282611 - DNA, 20 bp, Artificial Sequence
  Description of Artificial Sequence: Synthetic oligonucleotide
  Target: ATXN1; (+) strand; PAM type: YTN; PAM sequence: TTG
acttccttttgcttttatag

SEQ ID NO: 282612 - DNA, 20 bp, Artificial Sequence
  Description of Artificial Sequence: Synthetic oligonucleotide
  Target: ATXN1; (+) strand; PAM type: YTN; PAM sequence: CTT
ccttttgcttttataggaga

SEQ ID NO: 282613 - DNA, 20 bp, Artificial Sequence
  Description of Artificial Sequence: Synthetic oligonucleotide
  Target: ATXN1; (+) strand; PAM type: YTN; PAM sequence: TTC
cttttgcttttataggagat

SEQ ID NO: 282614 - DNA, 20 bp, Artificial Sequence
  Description of Artificial Sequence: Synthetic oligonucleotide
  Target: ATXN1; (+) strand; PAM type: YTN; PAM sequence: CTT
ttgcttttataggagattga

SEQ ID NO: 282615 - DNA, 20 bp, Artificial Sequence
  Description of Artificial Sequence: Synthetic oligonucleotide
  Target: ATXN1; (+) strand; PAM type: YTN; PAM sequence: TTT
tgcttttataggagattgac

SEQ ID NO: 282616 - DNA, 20 bp, Artificial Sequence
  Description of Artificial Sequence: Synthetic oligonucleotide
  Target: ATXN1; (+) strand; PAM type: YTN; PAM sequence: TTT
gcttttataggagattgaca

SEQ ID NO: 282617 - DNA, 20 bp, Artificial Sequence
  Description of Artificial Sequence: Synthetic oligonucleotide
  Target: ATXN1; (+) strand; PAM type: YTN; PAM sequence: TTG
cttttataggagattgacat

SEQ ID NO: 282618 - DNA, 20 bp, Artificial Sequence
  Description of Artificial Sequence: Synthetic oligonucleotide
  Target: ATXN1; (+) strand; PAM type: YTN; PAM sequence: CTT
ttataggagattgacataaa

SEQ ID NO: 282619 - DNA, 20 bp, Artificial Sequence
  Description of Artificial Sequence: Synthetic oligonucleotide
  Target: ATXN1; (+) strand; PAM type: YTN; PAM sequence: TTT
tataggagattgacataaaa

SEQ ID NO: 282620 - DNA, 20 bp, Artificial Sequence
  Description of Artificial Sequence: Synthetic oligonucleotide
  Target: ATXN1; (+) strand; PAM type: YTN; PAM sequence: TTT
ataggagattgacataaaaa

SEQ ID NO: 282621 - DNA, 20 bp, Artificial Sequence
  Description of Artificial Sequence: Synthetic oligonucleotide
  Target: ATXN1; (+) strand; PAM type: YTN; PAM sequence: TTA
taggagattgacataaaaag

SEQ ID NO: 282622 - DNA, 20 bp, Artificial Sequence
  Description of Artificial Sequence: Synthetic oligonucleotide
  Target: ATXN1; (+) strand; PAM type: YTN; PAM sequence: TTG
acataaaaagctaaaaaaag

SEQ ID NO: 282623 - DNA, 20 bp, Artificial Sequence
  Description of Artificial Sequence: Synthetic oligonucleotide
  Target: ATXN1; (+) strand; PAM type: YTN; PAM sequence: CTA
aaaaaagacaagtagacact

SEQ ID NO: 282624 - DNA, 20 bp, Artificial Sequence
  Description of Artificial Sequence: Synthetic oligonucleotide
  Target: ATXN1; (+) strand; PAM type: YTN; PAM sequence: CTT
catggagcctgtgattaaga

SEQ ID NO: 282625 - DNA, 20 bp, Artificial Sequence
  Description of Artificial Sequence: Synthetic oligonucleotide
  Target: ATXN1; (+) strand; PAM type: YTN; PAM sequence: TTC
atggagcctgtgattaagag

SEQ ID NO: 282626 - DNA, 20 bp, Artificial Sequence
  Description of Artificial Sequence: Synthetic oligonucleotide
  Target: ATXN1; (+) strand; PAM type: YTN; PAM sequence: CTG
tgattaagagagaagctaat

SEQ ID NO: 282627 - DNA, 20 bp, Artificial Sequence
  Description of Artificial Sequence: Synthetic oligonucleotide
  Target: ATXN1; (+) strand; PAM type: YTN; PAM sequence: TTA
agagagaagctaatgagaca

SEQ ID NO: 282628 - DNA, 20 bp, Artificial Sequence
  Description of Artificial Sequence: Synthetic oligonucleotide
  Target: ATXN1; (+) strand; PAM type: YTN; PAM sequence: CTA
atgagacagatgggctgatg

SEQ ID NO: 282629 - DNA, 20 bp, Artificial Sequence
  Description of Artificial Sequence: Synthetic oligonucleotide
  Target: ATXN1; (+) strand; PAM type: YTN; PAM sequence: CTG
atgcataaagggaacttcag

SEQ ID NO: 282630 - DNA, 20 bp, Artificial Sequence
  Description of Artificial Sequence: Synthetic oligonucleotide
  Target: ATXN1; (+) strand; PAM type: YTN; PAM sequence: CTT
cagcacaccagcccacactc

SEQ ID NO: 282631 - DNA, 20 bp, Artificial Sequence
  Description of Artificial Sequence: Synthetic oligonucleotide
  Target: ATXN1; (+) strand; PAM type: YTN; PAM sequence: TTC
agcacaccagcccacactca

SEQ ID NO: 282632 - DNA, 20 bp, Artificial Sequence
  Description of Artificial Sequence: Synthetic oligonucleotide
  Target: ATXN1; (+) strand; PAM type: YTN; PAM sequence: CTC
agtaaagatttaccgtgctt

SEQ ID NO: 282633 - DNA, 20 bp, Artificial Sequence
  Description of Artificial Sequence: Synthetic oligonucleotide
  Target: ATXN1; (+) strand; PAM type: YTN; PAM sequence: TTT
accgtgcttcactgtctccg

SEQ ID NO: 282634 - DNA, 20 bp, Artificial Sequence
  Description of Artificial Sequence: Synthetic oligonucleotide
  Target: ATXN1; (+) strand; PAM type: YTN; PAM sequence: TTA
ccgtgcttcactgtctccgt

SEQ ID NO: 282635 - DNA, 20 bp, Artificial Sequence
  Description of Artificial Sequence: Synthetic oligonucleotide
  Target: ATXN1; (+) strand; PAM type: YTN; PAM sequence: CTT
cactgtctccgtttcagtct

SEQ ID NO: 282636 - DNA, 20 bp, Artificial Sequence
  Description of Artificial Sequence: Synthetic oligonucleotide
  Target: ATXN1; (+) strand; PAM type: YTN; PAM sequence: TTC
actgtctccgtttcagtctt

SEQ ID NO: 282637 - DNA, 20 bp, Artificial Sequence
  Description of Artificial Sequence: Synthetic oligonucleotide
  Target: ATXN1; (+) strand; PAM type: YTN; PAM sequence: CTG
tctccgtttcagtcttcatc

SEQ ID NO: 282638 - DNA, 20 bp, Artificial Sequence
  Description of Artificial Sequence: Synthetic oligonucleotide
  Target: ATXN1; (+) strand; PAM type: YTN; PAM sequence: CTC
cgtttcagtcttcatcatgt

SEQ ID NO: 282639 - DNA, 20 bp, Artificial Sequence
  Description of Artificial Sequence: Synthetic oligonucleotide
  Target: ATXN1; (+) strand; PAM type: YTN; PAM sequence: TTT
cagtcttcatcatgtggcat

SEQ ID NO: 282640 - DNA, 20 bp, Artificial Sequence
  Description of Artificial Sequence: Synthetic oligonucleotide
  Target: ATXN1; (+) strand; PAM type: YTN; PAM sequence: TTC
agtcttcatcatgtggcatg

SEQ ID NO: 282641 - DNA, 20 bp, Artificial Sequence
  Description of Artificial Sequence: Synthetic oligonucleotide
  Target: ATXN1; (+) strand; PAM type: YTN; PAM sequence: CTT
catcatgtggcatgctactt

SEQ ID NO: 282642 - DNA, 20 bp, Artificial Sequence
  Description of Artificial Sequence: Synthetic oligonucleotide
  Target: ATXN1; (+) strand; PAM type: YTN; PAM sequence: TTC
atcatgtggcatgctactta

SEQ ID NO: 282643 - DNA, 20 bp, Artificial Sequence
  Description of Artificial Sequence: Synthetic oligonucleotide
  Target: ATXN1; (+) strand; PAM type: YTN; PAM sequence: CTA
cttacattactcttgtcccc

SEQ ID NO: 282644 - DNA, 20 bp, Artificial Sequence
  Description of Artificial Sequence: Synthetic oligonucleotide
  Target: ATXN1; (+) strand; PAM type: YTN; PAM sequence: CTT
acattactcttgtccccaga

SEQ ID NO: 282645 - DNA, 20 bp, Artificial Sequence
  Description of Artificial Sequence: Synthetic oligonucleotide
  Target: ATXN1; (+) strand; PAM type: YTN; PAM sequence: TTA
cattactcttgtccccagac

SEQ ID NO: 282646 - DNA, 20 bp, Artificial Sequence
  Description of Artificial Sequence: Synthetic oligonucleotide
  Target: ATXN1; (+) strand; PAM type: YTN; PAM sequence: TTA
ctcttgtccccagaccacag

SEQ ID NO: 282647 - DNA, 20 bp, Artificial Sequence
  Description of Artificial Sequence: Synthetic oligonucleotide
  Target: ATXN1; (+) strand; PAM type: YTN; PAM sequence: CTC
ttgtccccagaccacagaca

SEQ ID NO: 282648 - DNA, 20 bp, Artificial Sequence
  Description of Artificial Sequence: Synthetic oligonucleotide
  Target: ATXN1; (+) strand; PAM type: YTN; PAM sequence: CTT
gtccccagaccacagacaca

SEQ ID NO: 282649 - DNA, 20 bp, Artificial Sequence
  Description of Artificial Sequence: Synthetic oligonucleotide
  Target: ATXN1; (+) strand; PAM type: YTN; PAM sequence: TTG
tccccagaccacagacacac

SEQ ID NO: 282650 - DNA, 20 bp, Artificial Sequence
  Description of Artificial Sequence: Synthetic oligonucleotide
  Target: ATXN1; (+) strand; PAM type: YTN; PAM sequence: CTT
ttctctgcccagacctccct

SEQ ID NO: 282651 - DNA, 20 bp, Artificial Sequence
  Description of Artificial Sequence: Synthetic oligonucleotide
  Target: ATXN1; (+) strand; PAM type: YTN; PAM sequence: TTT
tctctgcccagacctcccta

SEQ ID NO: 282652 - DNA, 20 bp, Artificial Sequence
  Description of Artificial Sequence: Synthetic oligonucleotide
  Target: ATXN1; (+) strand; PAM type: YTN; PAM sequence: TTT
ctctgcccagacctccctaa

SEQ ID NO: 282653 - DNA, 20 bp, Artificial Sequence
  Description of Artificial Sequence: Synthetic oligonucleotide
  Target: ATXN1; (+) strand; PAM type: YTN; PAM sequence: TTC
tctgcccagacctccctaaa

SEQ ID NO: 282654 - DNA, 20 bp, Artificial Sequence
  Description of Artificial Sequence: Synthetic oligonucleotide
  Target: ATXN1; (+) strand; PAM type: YTN; PAM sequence: CTC
tgcccagacctccctaaatt

SEQ ID NO: 282655 - DNA, 20 bp, Artificial Sequence
  Description of Artificial Sequence: Synthetic oligonucleotide
  Target: ATXN1; (+) strand; PAM type: YTN; PAM sequence: CTG
cccagacctccctaaattag

SEQ ID NO: 282656 - DNA, 20 bp, Artificial Sequence
  Description of Artificial Sequence: Synthetic oligonucleotide
  Target: ATXN1; (+) strand; PAM type: YTN; PAM sequence: CTC
cctaaattaggattatcaaa

SEQ ID NO: 282657 - DNA, 20 bp, Artificial Sequence
  Description of Artificial Sequence: Synthetic oligonucleotide
  Target: ATXN1; (+) strand; PAM type: YTN; PAM sequence: CTA
aattaggattatcaaatgac

SEQ ID NO: 282658 - DNA, 20 bp, Artificial Sequence
  Description of Artificial Sequence: Synthetic oligonucleotide
  Target: ATXN1; (+) strand; PAM type: YTN; PAM sequence: TTA
ggattatcaaatgacacaag

SEQ ID NO: 282659 - DNA, 20 bp, Artificial Sequence
  Description of Artificial Sequence: Synthetic oligonucleotide
  Target: ATXN1; (+) strand; PAM type: YTN; PAM sequence: TTA
tcaaatgacacaagatagca

SEQ ID NO: 282660 - DNA, 20 bp, Artificial Sequence
  Description of Artificial Sequence: Synthetic oligonucleotide
  Target: ATXN1; (+) strand; PAM type: YTN; PAM sequence: CTT
ctgctttaatgttgttattc

SEQ ID NO: 282661 - DNA, 20 bp, Artificial Sequence
  Description of Artificial Sequence: Synthetic oligonucleotide
  Target: ATXN1; (+) strand; PAM type: YTN; PAM sequence: TTC
tgctttaatgttgttattca

SEQ ID NO: 282662 - DNA, 20 bp, Artificial Sequence
  Description of Artificial Sequence: Synthetic oligonucleotide
  Target: ATXN1; (+) strand; PAM type: YTN; PAM sequence: CTG
ctttaatgttgttattcaag

SEQ ID NO: 282663 - DNA, 20 bp, Artificial Sequence
  Description of Artificial Sequence: Synthetic oligonucleotide
  Target: ATXN1; (+) strand; PAM type: YTN; PAM sequence: CTT
taatgttgttattcaaggtt

SEQ ID NO: 282664 - DNA, 20 bp, Artificial Sequence
  Description of Artificial Sequence: Synthetic oligonucleotide
  Target: ATXN1; (+) strand; PAM type: YTN; PAM sequence: TTT
aatgttgttattcaaggttt

SEQ ID NO: 282665 - DNA, 20 bp, Artificial Sequence
  Description of Artificial Sequence: Synthetic oligonucleotide
  Target: ATXN1; (+) strand; PAM type: YTN; PAM sequence: TTA
atgttgttattcaaggttta

SEQ ID NO: 282666 - DNA, 20 bp, Artificial Sequence
  Description of Artificial Sequence: Synthetic oligonucleotide
  Target: ATXN1; (+) strand; PAM type: YTN; PAM sequence: TTG
ttattcaaggtttactcaca

SEQ ID NO: 282667 - DNA, 20 bp, Artificial Sequence
  Description of Artificial Sequence: Synthetic oligonucleotide
  Target: ATXN1; (+) strand; PAM type: YTN; PAM sequence: TTA
ttcaaggtttactcacaggc

SEQ ID NO: 282668 - DNA, 20 bp, Artificial Sequence
  Description of Artificial Sequence: Synthetic oligonucleotide
  Target: ATXN1; (+) strand; PAM type: YTN; PAM sequence: TTC
aaggtttactcacaggcaat

SEQ ID NO: 282669 - DNA, 20 bp, Artificial Sequence
  Description of Artificial Sequence: Synthetic oligonucleotide
  Target: ATXN1; (+) strand; PAM type: YTN; PAM sequence: TTT
actcacaggcaatatttact

SEQ ID NO: 282670 - DNA, 20 bp, Artificial Sequence
  Description of Artificial Sequence: Synthetic oligonucleotide
  Target: ATXN1; (+) strand; PAM type: YTN; PAM sequence: TTA
ctcacaggcaatatttacta

SEQ ID NO: 282671 - DNA, 20 bp, Artificial Sequence
  Description of Artificial Sequence: Synthetic oligonucleotide
  Target: ATXN1; (+) strand; PAM type: YTN; PAM sequence: CTC
acaggcaatatttactataa

SEQ ID NO: 282672 - DNA, 20 bp, Artificial Sequence
  Description of Artificial Sequence: Synthetic oligonucleotide
  Target: ATXN1; (+) strand; PAM type: YTN; PAM sequence: TTT
actataaaatcttgtggttt

SEQ ID NO: 282673 - DNA, 20 bp, Artificial Sequence
  Description of Artificial Sequence: Synthetic oligonucleotide
  Target: ATXN1; (+) strand; PAM type: YTN; PAM sequence: TTA
ctataaaatcttgtggtttg

SEQ ID NO: 282674 - DNA, 20 bp, Artificial Sequence
  Description of Artificial Sequence: Synthetic oligonucleotide
  Target: ATXN1; (+) strand; PAM type: YTN; PAM sequence: CTA
taaaatcttgtggtttggcc

SEQ ID NO: 282675 - DNA, 20 bp, Artificial Sequence
  Description of Artificial Sequence: Synthetic oligonucleotide
  Target: ATXN1; (+) strand; PAM type: YTN; PAM sequence: CTT
gtggtttggccgggcacggt

SEQ ID NO: 282676 - DNA, 20 bp, Artificial Sequence
  Description of Artificial Sequence: Synthetic oligonucleotide
  Target: ATXN1; (+) strand; PAM type: YTN; PAM sequence: TTG
tggtttggccgggcacggtg

SEQ ID NO: 282677 - DNA, 20 bp, Artificial Sequence
  Description of Artificial Sequence: Synthetic oligonucleotide
  Target: ATXN1; (+) strand; PAM type: YTN; PAM sequence: TTT
ggccgggcacggtggctcat

SEQ ID NO: 282678 - DNA, 20 bp, Artificial Sequence
  Description of Artificial Sequence: Synthetic oligonucleotide
  Target: ATXN1; (+) strand; PAM type: YTN; PAM sequence: TTG
gccgggcacggtggctcatg

SEQ ID NO: 282679 - DNA, 20 bp, Artificial Sequence
  Description of Artificial Sequence: Synthetic oligonucleotide
  Target: ATXN1; (+) strand; PAM type: YTN; PAM sequence: CTC
atgcctgcaatcccagccct

SEQ ID NO: 282680 - DNA, 20 bp, Artificial Sequence
  Description of Artificial Sequence: Synthetic oligonucleotide
  Target: ATXN1; (+) strand; PAM type: YTN; PAM sequence: CTG
caatcccagccctttgggag

SEQ ID NO: 282681 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggagggtgg

SEQ ID NO: 282682 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggagggtgga

SEQ ID NO: 282683 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggagggtggat

SEQ ID NO: 282684 - DNA, 20 bp, Artificial Sequence
  Description of Artificial Sequence: Synthetic oligonucleotide
  Target: ATXN1; (+) strand; PAM type: YTN; PAM sequence: CTG
aggccaggagttcgagacca

SEQ ID NO: 282685 - DNA, 20 bp, Artificial Sequence
  Description of Artificial Sequence: Synthetic oligonucleotide
  Target: ATXN1; (+) strand; PAM type: YTN; PAM sequence: TTC
gagaccagcctagccaacat

SEQ ID NO: 282686 - DNA, 20 bp, Artificial Sequence
  Description of Artificial Sequence: Synthetic oligonucleotide
  Target: ATXN1; (+) strand; PAM type: YTN; PAM sequence: CTA
gccaacatagtgaaacccca

SEQ ID NO: 282687 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 282688 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 282689 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagccag

SEQ ID NO: 282690 - DNA, 20 bp, Artificial Sequence
  Description of Artificial Sequence: Synthetic oligonucleotide
  Target: ATXN1; (+) strand; PAM type: YTN; PAM sequence: TTA
gccaggtgcagtggcgcaca

SEQ ID NO: 282691 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctacttgggaa

SEQ ID NO: 282692 - DNA, 20 bp, Artificial Sequence
  Description of Artificial Sequence: Synthetic oligonucleotide
  Target: ATXN1; (+) strand; PAM type: YTN; PAM sequence: CTA
cttgggaagctgaggcaaaa

SEQ ID NO: 282693 - DNA, 20 bp, Artificial Sequence
  Description of Artificial Sequence: Synthetic oligonucleotide
  Target: ATXN1; (+) strand; PAM type: YTN; PAM sequence: CTT
gggaagctgaggcaaaagga

SEQ ID NO: 282694 - DNA, 20 bp, Artificial Sequence
  Description of Artificial Sequence: Synthetic oligonucleotide
  Target: ATXN1; (+) strand; PAM type: YTN; PAM sequence: TTG
ggaagctgaggcaaaaggat

SEQ ID NO: 282695 - DNA, 20 bp, Artificial Sequence
  Description of Artificial Sequence: Synthetic oligonucleotide
  Target: ATXN1; (+) strand; PAM type: YTN; PAM sequence: CTG
aggcaaaaggattgcttgaa

SEQ ID NO: 282696 - DNA, 20 bp, Artificial Sequence
  Description of Artificial Sequence: Synthetic oligonucleotide
  Target: ATXN1; (+) strand; PAM type: YTN; PAM sequence: TTG
cttgaacctgggaggcagag

SEQ ID NO: 282697 - DNA, 20 bp, Artificial Sequence
  Description of Artificial Sequence: Synthetic oligonucleotide
  Target: ATXN1; (+) strand; PAM type: YTN; PAM sequence: CTT
gaacctgggaggcagaggtt

SEQ ID NO: 282698 - DNA, 20 bp, Artificial Sequence
  Description of Artificial Sequence: Synthetic oligonucleotide
  Target: ATXN1; (+) strand; PAM type: YTN; PAM sequence: TTG
aacctgggaggcagaggttg

SEQ ID NO: 282699 - DNA, 20 bp, Artificial Sequence
  Description of Artificial Sequence: Synthetic oligonucleotide
  Target: ATXN1; (+) strand; PAM type: YTN; PAM sequence: CTG
ggaggcagaggttgcagtga

SEQ ID NO: 282700 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagatcgtgcc

SEQ ID NO: 282701 - DNA, 20 bp, Artificial Sequence
  Description of Artificial Sequence: Synthetic oligonucleotide
  Target: ATXN1; (+) strand; PAM type: YTN; PAM sequence: TTG
cactccagcttgggcaacag

SEQ ID NO: 282702 - DNA, 20 bp, Artificial Sequence
  Description of Artificial Sequence: Synthetic oligonucleotide
  Target: ATXN1; (+) strand; PAM type: YTN; PAM sequence: CTC
cagcttgggcaacagagcaa

SEQ ID NO: 282703 - DNA, 20 bp, Artificial Sequence
  Description of Artificial Sequence: Synthetic oligonucleotide
  Target: ATXN1; (+) strand; PAM type: YTN; PAM sequence: CTT
gggcaacagagcaagactct

SEQ ID NO: 282704 - DNA, 20 bp, Artificial Sequence
  Description of Artificial Sequence: Synthetic oligonucleotide
  Target: ATXN1; (+) strand; PAM type: YTN; PAM sequence: TTG
ggcaacagagcaagactctg

SEQ ID NO: 282705 - DNA, 20 bp, Artificial Sequence
  Description of Artificial Sequence: Synthetic oligonucleotide
  Target: ATXN1; (+) strand; PAM type: YTN; PAM sequence: CTC
tgtctcaaaaaaaaaaaaaa

SEQ ID NO: 282706 - DNA, 20 bp, Artificial Sequence
  Description of Artificial Sequence: Synthetic oligonucleotide
  Target: ATXN1; (+) strand; PAM type: YTN; PAM sequence: CTG
tctcaaaaaaaaaaaaaaaa

SEQ ID NO: 282707 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaaagg

SEQ ID NO: 282708 - DNA, 20 bp, Artificial Sequence
  Description of Artificial Sequence: Synthetic oligonucleotide
  Target: ATXN1; (+) strand; PAM type: YTN; PAM sequence: TTT
accgcttaacagagagtgga

SEQ ID NO: 282709 - DNA, 20 bp, Artificial Sequence
  Description of Artificial Sequence: Synthetic oligonucleotide
  Target: ATXN1; (+) strand; PAM type: YTN; PAM sequence: TTA
ccgcttaacagagagtggac

SEQ ID NO: 282710 - DNA, 20 bp, Artificial Sequence
  Description of Artificial Sequence: Synthetic oligonucleotide
  Target: ATXN1; (+) strand; PAM type: YTN; PAM sequence: CTT
aacagagagtggacaattct

SEQ ID NO: 282711 - DNA, 20 bp, Artificial Sequence
  Description of Artificial Sequence: Synthetic oligonucleotide
  Target: ATXN1; (+) strand; PAM type: YTN; PAM sequence: TTA
acagagagtggacaattctg

SEQ ID NO: 282712 - DNA, 20 bp, Artificial Sequence
  Description of Artificial Sequence: Synthetic oligonucleotide
  Target: ATXN1; (+) strand; PAM type: YTN; PAM sequence: TTC
tgttacagggcttaccagaa

SEQ ID NO: 282713 - DNA, 20 bp, Artificial Sequence
  Description of Artificial Sequence: Synthetic oligonucleotide
  Target: ATXN1; (+) strand; PAM type: YTN; PAM sequence: CTG
ttacagggcttaccagaata

SEQ ID NO: 282714 - DNA, 20 bp, Artificial Sequence
  Description of Artificial Sequence: Synthetic oligonucleotide
  Target: ATXN1; (+) strand; PAM type: YTN; PAM sequence: TTA
cagggcttaccagaatattt

SEQ ID NO: 282715 - DNA, 20 bp, Artificial Sequence
  Description of Artificial Sequence: Synthetic oligonucleotide
  Target: ATXN1; (+) strand; PAM type: YTN; PAM sequence: CTT
accagaatatttttggaaaa

SEQ ID NO: 282716 - DNA, 20 bp, Artificial Sequence
  Description of Artificial Sequence: Synthetic oligonucleotide
  Target: ATXN1; (+) strand; PAM type: YTN; PAM sequence: TTA
ccagaatatttttggaaaaa

SEQ ID NO: 282717 - DNA, 20 bp, Artificial Sequence
  Description of Artificial Sequence: Synthetic oligonucleotide
  Target: ATXN1; (+) strand; PAM type: YTN; PAM sequence: TTT
ttggaaaaattctgtaaaca

SEQ ID NO: 282718 - DNA, 20 bp, Artificial Sequence
  Description of Artificial Sequence: Synthetic oligonucleotide
  Target: ATXN1; (+) strand; PAM type: YTN; PAM sequence: TTT
tggaaaaattctgtaaacat

SEQ ID NO: 282719 - DNA, 20 bp, Artificial Sequence
  Description of Artificial Sequence: Synthetic oligonucleotide
  Target: ATXN1; (+) strand; PAM type: YTN; PAM sequence: TTT
ggaaaaattctgtaaacata

SEQ ID NO: 282720 - DNA, 20 bp, Artificial Sequence
  Description of Artificial Sequence: Synthetic oligonucleotide
  Target: ATXN1; (+) strand; PAM type: YTN; PAM sequence: TTG
gaaaaattctgtaaacatag

SEQ ID NO: 282721 - DNA, 20 bp, Artificial Sequence
  Description of Artificial Sequence: Synthetic oligonucleotide
  Target: ATXN1; (+) strand; PAM type: YTN; PAM sequence: TTC
tgtaaacatagaagaatttc

SEQ ID NO: 282722 - DNA, 20 bp, Artificial Sequence
  Description of Artificial Sequence: Synthetic oligonucleotide
  Target: ATXN1; (+) strand; PAM type: YTN; PAM sequence: CTG
taaacatagaagaatttctg

SEQ ID NO: 282723 - DNA, 20 bp, Artificial Sequence
  Description of Artificial Sequence: Synthetic oligonucleotide
  Target: ATXN1; (+) strand; PAM type: YTN; PAM sequence: TTT
ctgagccagaaaaatgagaa

SEQ ID NO: 282724 - DNA, 20 bp, Artificial Sequence
  Description of Artificial Sequence: Synthetic oligonucleotide
  Target: ATXN1; (+) strand; PAM type: YTN; PAM sequence: TTC
tgagccagaaaaatgagaag

SEQ ID NO: 282725 - DNA, 20 bp, Artificial Sequence
  Description of Artificial Sequence: Synthetic oligonucleotide
  Target: ATXN1; (+) strand; PAM type: YTN; PAM sequence: CTG
agccagaaaaatgagaagca

SEQ ID NO: 282726 - DNA, 20 bp, Artificial Sequence
  Description of Artificial Sequence: Synthetic oligonucleotide
  Target: ATXN1; (+) strand; PAM type: YTN; PAM sequence: TTC
atatgaatttttaaattttt

SEQ ID NO: 282727 - DNA, 20 bp, Artificial Sequence
  Description of Artificial Sequence: Synthetic oligonucleotide
  Target: ATXN1; (+) strand; PAM type: YTN; PAM sequence: TTT
ttaaatttttatacaataga

SEQ ID NO: 282728 - DNA, 20 bp, Artificial Sequence
  Description of Artificial Sequence: Synthetic oligonucleotide
  Target: ATXN1; (+) strand; PAM type: YTN; PAM sequence: TTT
taaatttttatacaatagat

SEQ ID NO: 282729 - DNA, 20 bp, Artificial Sequence
  Description of Artificial Sequence: Synthetic oligonucleotide
  Target: ATXN1; (+) strand; PAM type: YTN; PAM sequence: TTT
aaatttttatacaatagatt

SEQ ID NO: 282730 - DNA, 20 bp, Artificial Sequence
  Description of Artificial Sequence: Synthetic oligonucleotide
  Target: ATXN1; (+) strand; PAM type: YTN; PAM sequence: TTA
aatttttatacaatagattt

SEQ ID NO: 282731 - DNA, 20 bp, Artificial Sequence
  Description of Artificial Sequence: Synthetic oligonucleotide
  Target: ATXN1; (+) strand; PAM type: YTN; PAM sequence: TTT
ttatacaatagattttgcct

SEQ ID NO: 282732 - DNA, 20 bp, Artificial Sequence
  Description of Artificial Sequence: Synthetic oligonucleotide
  Target: ATXN1; (+) strand; PAM type: YTN; PAM sequence: TTT
tatacaatagattttgcctc

SEQ ID NO: 282733 - DNA, 20 bp, Artificial Sequence
  Description of Artificial Sequence: Synthetic oligonucleotide
  Target: ATXN1; (+) strand; PAM type: YTN; PAM sequence: TTT
atacaatagattttgcctct

SEQ ID NO: 282734 - DNA, 20 bp, Artificial Sequence
  Description of Artificial Sequence: Synthetic oligonucleotide
  Target: ATXN1; (+) strand; PAM type: YTN; PAM sequence: TTA
tacaatagattttgcctctg

SEQ ID NO: 282735 - DNA, 20 bp, Artificial Sequence
  Description of Artificial Sequence: Synthetic oligonucleotide
  Target: ATXN1; (+) strand; PAM type: YTN; PAM sequence: TTT
tgcctctgatatgactgctt

SEQ ID NO: 282736 - DNA, 20 bp, Artificial Sequence
  Description of Artificial Sequence: Synthetic oligonucleotide
  Target: ATXN1; (+) strand; PAM type: YTN; PAM sequence: TTT
gcctctgatatgactgcttc

SEQ ID NO: 282737 - DNA, 20 bp, Artificial Sequence
  Description of Artificial Sequence: Synthetic oligonucleotide
  Target: ATXN1; (+) strand; PAM type: YTN; PAM sequence: TTG
cctctgatatgactgcttct

SEQ ID NO: 282738 - DNA, 20 bp, Artificial Sequence
  Description of Artificial Sequence: Synthetic oligonucleotide
  Target: ATXN1; (+) strand; PAM type: YTN; PAM sequence: CTC
tgatatgactgcttctctaa

SEQ ID NO: 282739 - DNA, 20 bp, Artificial Sequence
  Description of Artificial Sequence: Synthetic oligonucleotide
  Target: ATXN1; (+) strand; PAM type: YTN; PAM sequence: CTG
atatgactgcttctctaagc

SEQ ID NO: 282740 - DNA, 20 bp, Artificial Sequence
  Description of Artificial Sequence: Synthetic oligonucleotide
  Target: ATXN1; (+) strand; PAM type: YTN; PAM sequence: CTG
cttctctaagctatttccac

SEQ ID NO: 282741 - DNA, 20 bp, Artificial Sequence
  Description of Artificial Sequence: Synthetic oligonucleotide
  Target: ATXN1; (+) strand; PAM type: YTN; PAM sequence: CTT
ctctaagctatttccacatg

SEQ ID NO: 282742 - DNA, 20 bp, Artificial Sequence
  Description of Artificial Sequence: Synthetic oligonucleotide
  Target: ATXN1; (+) strand; PAM type: YTN; PAM sequence: TTC
tctaagctatttccacatgt

SEQ ID NO: 282743 - DNA, 20 bp, Artificial Sequence
  Description of Artificial Sequence: Synthetic oligonucleotide
  Target: ATXN1; (+) strand; PAM type: YTN; PAM sequence: CTC
taagctatttccacatgtga

SEQ ID NO: 282744 - DNA, 20 bp, Artificial Sequence
  Description of Artificial Sequence: Synthetic oligonucleotide
  Target: ATXN1; (+) strand; PAM type: YTN; PAM sequence: CTA
agctatttccacatgtgatt

SEQ ID NO: 282745 - DNA, 20 bp, Artificial Sequence
  Description of Artificial Sequence: Synthetic oligonucleotide
  Target: ATXN1; (+) strand; PAM type: YTN; PAM sequence: CTA
tttccacatgtgattactgt

SEQ ID NO: 282746 - DNA, 20 bp, Artificial Sequence
  Description of Artificial Sequence: Synthetic oligonucleotide
  Target: ATXN1; (+) strand; PAM type: YTN; PAM sequence: TTT
ccacatgtgattactgtctc

SEQ ID NO: 282747 - DNA, 20 bp, Artificial Sequence
  Description of Artificial Sequence: Synthetic oligonucleotide
  Target: ATXN1; (+) strand; PAM type: YTN; PAM sequence: TTC
cacatgtgattactgtctct

SEQ ID NO: 282748 - DNA, 20 bp, Artificial Sequence
  Description of Artificial Sequence: Synthetic oligonucleotide
  Target: ATXN1; (+) strand; PAM type: YTN; PAM sequence: TTA
ctgtctctgagagctcactc

SEQ ID NO: 282749 - DNA, 20 bp, Artificial Sequence
  Description of Artificial Sequence: Synthetic oligonucleotide
  Target: ATXN1; (+) strand; PAM type: YTN; PAM sequence: CTG
tctctgagagctcactccat

SEQ ID NO: 282750 - DNA, 20 bp, Artificial Sequence
  Description of Artificial Sequence: Synthetic oligonucleotide
  Target: ATXN1; (+) strand; PAM type: YTN; PAM sequence: CTC
tgagagctcactccatgcca

SEQ ID NO: 282751 - DNA, 20 bp, Artificial Sequence
  Description of Artificial Sequence: Synthetic oligonucleotide
  Target: ATXN1; (+) strand; PAM type: YTN; PAM sequence: CTG
agagctcactccatgccata

SEQ ID NO: 282752 - DNA, 20 bp, Artificial Sequence
  Description of Artificial Sequence: Synthetic oligonucleotide
  Target: ATXN1; (+) strand; PAM type: YTN; PAM sequence: CTC
actccatgccataagaaatt

SEQ ID NO: 282753 - DNA, 20 bp, Artificial Sequence
  Description of Artificial Sequence: Synthetic oligonucleotide
  Target: ATXN1; (+) strand; PAM type: YTN; PAM sequence: CTC
catgccataagaaattgcag

SEQ ID NO: 282754 - DNA, 20 bp, Artificial Sequence
  Description of Artificial Sequence: Synthetic oligonucleotide
  Target: ATXN1; (+) strand; PAM type: YTN; PAM sequence: TTG
cagagttatagaaatagcat

SEQ ID NO: 282755 - DNA, 20 bp, Artificial Sequence
  Description of Artificial Sequence: Synthetic oligonucleotide
  Target: ATXN1; (+) strand; PAM type: YTN; PAM sequence: TTA
tagaaatagcatatgtagag

SEQ ID NO: 282756 - DNA, 20 bp, Artificial Sequence
  Description of Artificial Sequence: Synthetic oligonucleotide
  Target: ATXN1; (+) strand; PAM type: YTN; PAM sequence: CTC
tacaatttacaaaacatttt

SEQ ID NO: 282757 - DNA, 20 bp, Artificial Sequence
  Description of Artificial Sequence: Synthetic oligonucleotide
  Target: ATXN1; (+) strand; PAM type: YTN; PAM sequence: CTA
caatttacaaaacattttca

SEQ ID NO: 282758 - DNA, 20 bp, Artificial Sequence
  Description of Artificial Sequence: Synthetic oligonucleotide
  Target: ATXN1; (+) strand; PAM type: YTN; PAM sequence: TTT
acaaaacattttcaatgcat

SEQ ID NO: 282759 - DNA, 20 bp, Artificial Sequence
  Description of Artificial Sequence: Synthetic oligonucleotide
  Target: ATXN1; (+) strand; PAM type: YTN; PAM sequence: TTA
caaaacattttcaatgcatt

SEQ ID NO: 282760 - DNA, 20 bp, Artificial Sequence
  Description of Artificial Sequence: Synthetic oligonucleotide
  Target: ATXN1; (+) strand; PAM type: YTN; PAM sequence: TTT
tcaatgcattatctcatttg

SEQ ID NO: 282761 - DNA, 20 bp, Artificial Sequence
  Description of Artificial Sequence: Synthetic oligonucleotide
  Target: ATXN1; (+) strand; PAM type: YTN; PAM sequence: TTT
caatgcattatctcatttga

SEQ ID NO: 282762 - DNA, 20 bp, Artificial Sequence
  Description of Artificial Sequence: Synthetic oligonucleotide
  Target: ATXN1; (+) strand; PAM type: YTN; PAM sequence: TTC
aatgcattatctcatttgat

SEQ ID NO: 282763 - DNA, 20 bp, Artificial Sequence
  Description of Artificial Sequence: Synthetic oligonucleotide
  Target: ATXN1; (+) strand; PAM type: YTN; PAM sequence: TTA
tctcatttgatcatcacaat

SEQ ID NO: 282764 - DNA, 20 bp, Artificial Sequence
  Description of Artificial Sequence: Synthetic oligonucleotide
  Target: ATXN1; (+) strand; PAM type: YTN; PAM sequence: CTC
atttgatcatcacaataccc

SEQ ID NO: 282765 - DNA, 20 bp, Artificial Sequence
  Description of Artificial Sequence: Synthetic oligonucleotide
  Target: ATXN1; (+) strand; PAM type: YTN; PAM sequence: TTT
gatcatcacaatacccctgt

SEQ ID NO: 282766 - DNA, 20 bp, Artificial Sequence
  Description of Artificial Sequence: Synthetic oligonucleotide
  Target: ATXN1; (+) strand; PAM type: YTN; PAM sequence: TTG
atcatcacaatacccctgtg

SEQ ID NO: 282767 - DNA, 20 bp, Artificial Sequence
  Description of Artificial Sequence: Synthetic oligonucleotide
  Target: ATXN1; (+) strand; PAM type: YTN; PAM sequence: CTG
tgagacagatattataatta

SEQ ID NO: 282768 - DNA, 20 bp, Artificial Sequence
  Description of Artificial Sequence: Synthetic oligonucleotide
  Target: ATXN1; (+) strand; PAM type: YTN; PAM sequence: TTA
taattatttctattttatag

SEQ ID NO: 282769 - DNA, 20 bp, Artificial Sequence
  Description of Artificial Sequence: Synthetic oligonucleotide
  Target: ATXN1; (+) strand; PAM type: YTN; PAM sequence: TTA
tttctattttatagagatgc

SEQ ID NO: 282770 - DNA, 20 bp, Artificial Sequence
  Description of Artificial Sequence: Synthetic oligonucleotide
  Target: ATXN1; (+) strand; PAM type: YTN; PAM sequence: TTT
ctattttatagagatgcgga

SEQ ID NO: 282771 - DNA, 20 bp, Artificial Sequence
  Description of Artificial Sequence: Synthetic oligonucleotide
  Target: ATXN1; (+) strand; PAM type: YTN; PAM sequence: TTC
tattttatagagatgcggaa

SEQ ID NO: 282772 - DNA, 20 bp, Artificial Sequence
  Description of Artificial Sequence: Synthetic oligonucleotide
  Target: ATXN1; (+) strand; PAM type: YTN; PAM sequence: CTA
ttttatagagatgcggaaaa

SEQ ID NO: 282773 - DNA, 20 bp, Artificial Sequence
  Description of Artificial Sequence: Synthetic oligonucleotide
  Target: ATXN1; (+) strand; PAM type: YTN; PAM sequence: TTT
tatagagatgcggaaaaaac

SEQ ID NO: 282774 - DNA, 20 bp, Artificial Sequence
  Description of Artificial Sequence: Synthetic oligonucleotide
  Target: ATXN1; (+) strand; PAM type: YTN; PAM sequence: TTT
atagagatgcggaaaaaacc

SEQ ID NO: 282775 - DNA, 20 bp, Artificial Sequence
  Description of Artificial Sequence: Synthetic oligonucleotide
  Target: ATXN1; (+) strand; PAM type: YTN; PAM sequence: TTA
tagagatgcggaaaaaaccc

SEQ ID NO: 282776 - DNA, 20 bp, Artificial Sequence
  Description of Artificial Sequence: Synthetic oligonucleotide
  Target: ATXN1; (+) strand; PAM type: YTN; PAM sequence: CTC
agattttgagtgatttccct

SEQ ID NO: 282777 - DNA, 20 bp, Artificial Sequence
  Description of Artificial Sequence: Synthetic oligonucleotide
  Target: ATXN1; (+) strand; PAM type: YTN; PAM sequence: TTT
tgagtgatttccctaaggtc

SEQ ID NO: 282778 - DNA, 20 bp, Artificial Sequence
  Description of Artificial Sequence: Synthetic oligonucleotide
  Target: ATXN1; (+) strand; PAM type: YTN; PAM sequence: TTT
gagtgatttccctaaggtca

SEQ ID NO: 282779 - DNA, 20 bp, Artificial Sequence
  Description of Artificial Sequence: Synthetic oligonucleotide
  Target: ATXN1; (+) strand; PAM type: YTN; PAM sequence: TTG
agtgatttccctaaggtcac

SEQ ID NO: 282780 - DNA, 20 bp, Artificial Sequence
  Description of Artificial Sequence: Synthetic oligonucleotide
  Target: ATXN1; (+) strand; PAM type: YTN; PAM sequence: TTT
ccctaaggtcacaaagctga

SEQ ID NO: 282781 - DNA, 20 bp, Artificial Sequence
  Description of Artificial Sequence: Synthetic oligonucleotide
  Target: ATXN1; (+) strand; PAM type: YTN; PAM sequence: TTC
cctaaggtcacaaagctgat

SEQ ID NO: 282782 - DNA, 20 bp, Artificial Sequence
  Description of Artificial Sequence: Synthetic oligonucleotide
  Target: ATXN1; (+) strand; PAM type: YTN; PAM sequence: CTA
aggtcacaaagctgataagt

SEQ ID NO: 282783 - DNA, 20 bp, Artificial Sequence
  Description of Artificial Sequence: Synthetic oligonucleotide
  Target: ATXN1; (+) strand; PAM type: YTN; PAM sequence: CTG
ataagttgcagaactgagat

SEQ ID NO: 282784 - DNA, 20 bp, Artificial Sequence
  Description of Artificial Sequence: Synthetic oligonucleotide
  Target: ATXN1; (+) strand; PAM type: YTN; PAM sequence: TTG
cagaactgagattcaaaact

SEQ ID NO: 282785 - DNA, 20 bp, Artificial Sequence
  Description of Artificial Sequence: Synthetic oligonucleotide
  Target: ATXN1; (+) strand; PAM type: YTN; PAM sequence: CTG
agattcaaaactagaatttc

SEQ ID NO: 282786 - DNA, 20 bp, Artificial Sequence
  Description of Artificial Sequence: Synthetic oligonucleotide
  Target: ATXN1; (+) strand; PAM type: YTN; PAM sequence: TTC
aaaactagaatttctgatat

SEQ ID NO: 282787 - DNA, 20 bp, Artificial Sequence
  Description of Artificial Sequence: Synthetic oligonucleotide
  Target: ATXN1; (+) strand; PAM type: YTN; PAM sequence: CTA
gaatttctgatattgtattt

SEQ ID NO: 282788 - DNA, 20 bp, Artificial Sequence
  Description of Artificial Sequence: Synthetic oligonucleotide
  Target: ATXN1; (+) strand; PAM type: YTN; PAM sequence: TTT
ctgatattgtatttcatttt

SEQ ID NO: 282789 - DNA, 20 bp, Artificial Sequence
  Description of Artificial Sequence: Synthetic oligonucleotide
  Target: ATXN1; (+) strand; PAM type: YTN; PAM sequence: TTC
tgatattgtatttcattttc

SEQ ID NO: 282790 - DNA, 20 bp, Artificial Sequence
  Description of Artificial Sequence: Synthetic oligonucleotide
  Target: ATXN1; (+) strand; PAM type: YTN; PAM sequence: CTG
atattgtatttcattttctc

SEQ ID NO: 282791 - DNA, 20 bp, Artificial Sequence
  Description of Artificial Sequence: Synthetic oligonucleotide
  Target: ATXN1; (+) strand; PAM type: YTN; PAM sequence: TTG
tatttcattttctcccacta

SEQ ID NO: 282792 - DNA, 20 bp, Artificial Sequence
  Description of Artificial Sequence: Synthetic oligonucleotide
  Target: ATXN1; (+) strand; PAM type: YTN; PAM sequence: TTT
cattttctcccactacatta

SEQ ID NO: 282793 - DNA, 20 bp, Artificial Sequence
  Description of Artificial Sequence: Synthetic oligonucleotide
  Target: ATXN1; (+) strand; PAM type: YTN; PAM sequence: TTC
attttctcccactacattaa

SEQ ID NO: 282794 - DNA, 20 bp, Artificial Sequence
  Description of Artificial Sequence: Synthetic oligonucleotide
  Target: ATXN1; (+) strand; PAM type: YTN; PAM sequence: TTT
tctcccactacattaatttt

SEQ ID NO: 282795 - DNA, 20 bp, Artificial Sequence
  Description of Artificial Sequence: Synthetic oligonucleotide
  Target: ATXN1; (+) strand; PAM type: YTN; PAM sequence: TTT
ctcccactacattaatttta

SEQ ID NO: 282796 - DNA, 20 bp, Artificial Sequence
  Description of Artificial Sequence: Synthetic oligonucleotide
  Target: ATXN1; (+) strand; PAM type: YTN; PAM sequence: TTC
tcccactacattaattttat

SEQ ID NO: 282797 - DNA, 20 bp, Artificial Sequence
  Description of Artificial Sequence: Synthetic oligonucleotide
  Target: ATXN1; (+) strand; PAM type: YTN; PAM sequence: CTC
ccactacattaattttatta

SEQ ID NO: 282798 - DNA, 20 bp, Artificial Sequence
  Description of Artificial Sequence: Synthetic oligonucleotide
  Target: ATXN1; (+) strand; PAM type: YTN; PAM sequence: CTA
cattaattttattacatttt

SEQ ID NO: 282799 - DNA, 20 bp, Artificial Sequence
  Description of Artificial Sequence: Synthetic oligonucleotide
  Target: ATXN1; (+) strand; PAM type: YTN; PAM sequence: TTA
attttattacatttttcttg

SEQ ID NO: 282800 - DNA, 20 bp, Artificial Sequence
  Description of Artificial Sequence: Synthetic oligonucleotide
  Target: ATXN1; (+) strand; PAM type: YTN; PAM sequence: TTT
tattacatttttcttgaatt

SEQ ID NO: 282801 - DNA, 20 bp, Artificial Sequence
  Description of Artificial Sequence: Synthetic oligonucleotide
  Target: ATXN1; (+) strand; PAM type: YTN; PAM sequence: TTT
attacatttttcttgaattc

SEQ ID NO: 282802 - DNA, 20 bp, Artificial Sequence
  Description of Artificial Sequence: Synthetic oligonucleotide
  Target: ATXN1; (+) strand; PAM type: YTN; PAM sequence: TTA
ttacatttttcttgaattca

SEQ ID NO: 282803 - DNA, 20 bp, Artificial Sequence
  Description of Artificial Sequence: Synthetic oligonucleotide
  Target: ATXN1; (+) strand; PAM type: YTN; PAM sequence: TTA
catttttcttgaattcattt

SEQ ID NO: 282804 - DNA, 20 bp, Artificial Sequence
  Description of Artificial Sequence: Synthetic oligonucleotide
  Target: ATXN1; (+) strand; PAM type: YTN; PAM sequence: TTT
ttcttgaattcatttttggt

SEQ ID NO: 282805 - DNA, 20 bp, Artificial Sequence
  Description of Artificial Sequence: Synthetic oligonucleotide
  Target: ATXN1; (+) strand; PAM type: YTN; PAM sequence: TTT
tcttgaattcatttttggtt

SEQ ID NO: 282806 - DNA, 20 bp, Artificial Sequence
  Description of Artificial Sequence: Synthetic oligonucleotide
  Target: ATXN1; (+) strand; PAM type: YTN; PAM sequence: TTT
cttgaattcatttttggttc

SEQ ID NO: 282807 - DNA, 20 bp, Artificial Sequence
  Description of Artificial Sequence: Synthetic oligonucleotide
  Target: ATXN1; (+) strand; PAM type: YTN; PAM sequence: TTC
ttgaattcatttttggttct

SEQ ID NO: 282808 - DNA, 20 bp, Artificial Sequence
  Description of Artificial Sequence: Synthetic oligonucleotide
  Target: ATXN1; (+) strand; PAM type: YTN; PAM sequence: CTT
gaattcatttttggttctat

SEQ ID NO: 282809 - DNA, 20 bp, Artificial Sequence
  Description of Artificial Sequence: Synthetic oligonucleotide
  Target: ATXN1; (+) strand; PAM type: YTN; PAM sequence: TTG
aattcatttttggttctatt

SEQ ID NO: 282810 - DNA, 20 bp, Artificial Sequence
  Description of Artificial Sequence: Synthetic oligonucleotide
  Target: ATXN1; (+) strand; PAM type: YTN; PAM sequence: TTC
atttttggttctattttata

SEQ ID NO: 282811 - DNA, 20 bp, Artificial Sequence
  Description of Artificial Sequence: Synthetic oligonucleotide
  Target: ATXN1; (+) strand; PAM type: YTN; PAM sequence: TTT
ttggttctattttataatag

SEQ ID NO: 282812 - DNA, 20 bp, Artificial Sequence
  Description of Artificial Sequence: Synthetic oligonucleotide
  Target: ATXN1; (+) strand; PAM type: YTN; PAM sequence: TTT
tggttctattttataatagt

SEQ ID NO: 282813 - DNA, 20 bp, Artificial Sequence
  Description of Artificial Sequence: Synthetic oligonucleotide
  Target: ATXN1; (+) strand; PAM type: YTN; PAM sequence: TTT
ggttctattttataatagta

SEQ ID NO: 282814 - DNA, 20 bp, Artificial Sequence
  Description of Artificial Sequence: Synthetic oligonucleotide
  Target: ATXN1; (+) strand; PAM type: YTN; PAM sequence: TTG
gttctattttataatagtag

SEQ ID NO: 282815 - DNA, 20 bp, Artificial Sequence
  Description of Artificial Sequence: Synthetic oligonucleotide
  Target: ATXN1; (+) strand; PAM type: YTN; PAM sequence: TTC
tattttataatagtagactc

SEQ ID NO: 282816 - DNA, 20 bp, Artificial Sequence
  Description of Artificial Sequence: Synthetic oligonucleotide
  Target: ATXN1; (+) strand; PAM type: YTN; PAM sequence: CTA
ttttataatagtagactcta

SEQ ID NO: 282817 - DNA, 20 bp, Artificial Sequence
  Description of Artificial Sequence: Synthetic oligonucleotide
  Target: ATXN1; (+) strand; PAM type: YTN; PAM sequence: TTT
tataatagtagactctataa

SEQ ID NO: 282818 - DNA, 20 bp, Artificial Sequence
  Description of Artificial Sequence: Synthetic oligonucleotide
  Target: ATXN1; (+) strand; PAM type: YTN; PAM sequence: TTT
ataatagtagactctataaa

SEQ ID NO: 282819 - DNA, 20 bp, Artificial Sequence
  Description of Artificial Sequence: Synthetic oligonucleotide
  Target: ATXN1; (+) strand; PAM type: YTN; PAM sequence: TTA
taatagtagactctataaat

SEQ ID NO: 282820 - DNA, 20 bp, Artificial Sequence
  Description of Artificial Sequence: Synthetic oligonucleotide
  Target: ATXN1; (+) strand; PAM type: YTN; PAM sequence: CTC
tataaattctgctcattaca

SEQ ID NO: 282821 - DNA, 20 bp, Artificial Sequence
  Description of Artificial Sequence: Synthetic oligonucleotide
  Target: ATXN1; (+) strand; PAM type: YTN; PAM sequence: CTA
taaattctgctcattacata

SEQ ID NO: 282822 - DNA, 20 bp, Artificial Sequence
  Description of Artificial Sequence: Synthetic oligonucleotide
  Target: ATXN1; (+) strand; PAM type: YTN; PAM sequence: TTC
tgctcattacataaacattt

SEQ ID NO: 282823 - DNA, 20 bp, Artificial Sequence
  Description of Artificial Sequence: Synthetic oligonucleotide
  Target: ATXN1; (+) strand; PAM type: YTN; PAM sequence: CTG
ctcattacataaacatttta

SEQ ID NO: 282824 - DNA, 20 bp, Artificial Sequence
  Description of Artificial Sequence: Synthetic oligonucleotide
  Target: ATXN1; (+) strand; PAM type: YTN; PAM sequence: CTC
attacataaacattttatgt

SEQ ID NO: 282825 - DNA, 20 bp, Artificial Sequence
  Description of Artificial Sequence: Synthetic oligonucleotide
  Target: ATXN1; (+) strand; PAM type: YTN; PAM sequence: TTA
cataaacattttatgtgctt

SEQ ID NO: 282826 - DNA, 20 bp, Artificial Sequence
  Description of Artificial Sequence: Synthetic oligonucleotide
  Target: ATXN1; (+) strand; PAM type: YTN; PAM sequence: TTT
tatgtgcttctaaatgaaac

SEQ ID NO: 282827 - DNA, 20 bp, Artificial Sequence
  Description of Artificial Sequence: Synthetic oligonucleotide
  Target: ATXN1; (+) strand; PAM type: YTN; PAM sequence: TTT
atgtgcttctaaatgaaact

SEQ ID NO: 282828 - DNA, 20 bp, Artificial Sequence
  Description of Artificial Sequence: Synthetic oligonucleotide
  Target: ATXN1; (+) strand; PAM type: YTN; PAM sequence: TTA
tgtgcttctaaatgaaactg

SEQ ID NO: 282829 - DNA, 20 bp, Artificial Sequence
  Description of Artificial Sequence: Synthetic oligonucleotide
  Target: ATXN1; (+) strand; PAM type: YTN; PAM sequence: CTT
ctaaatgaaactgactcttt

SEQ ID NO: 282830 - DNA, 20 bp, Artificial Sequence
  Description of Artificial Sequence: Synthetic oligonucleotide
  Target: ATXN1; (+) strand; PAM type: YTN; PAM sequence: TTC
taaatgaaactgactcttta

SEQ ID NO: 282831 - DNA, 20 bp, Artificial Sequence
  Description of Artificial Sequence: Synthetic oligonucleotide
  Target: ATXN1; (+) strand; PAM type: YTN; PAM sequence: CTA
aatgaaactgactctttaat

SEQ ID NO: 282832 - DNA, 20 bp, Artificial Sequence
  Description of Artificial Sequence: Synthetic oligonucleotide
  Target: ATXN1; (+) strand; PAM type: YTN; PAM sequence: CTG
actctttaatctctaaattt

SEQ ID NO: 282833 - DNA, 20 bp, Artificial Sequence
  Description of Artificial Sequence: Synthetic oligonucleotide
  Target: ATXN1; (+) strand; PAM type: YTN; PAM sequence: CTC
tttaatctctaaattttttg

SEQ ID NO: 282834 - DNA, 20 bp, Artificial Sequence
  Description of Artificial Sequence: Synthetic oligonucleotide
  Target: ATXN1; (+) strand; PAM type: YTN; PAM sequence: CTT
taatctctaaattttttggt

SEQ ID NO: 282835 - DNA, 20 bp, Artificial Sequence
  Description of Artificial Sequence: Synthetic oligonucleotide
  Target: ATXN1; (+) strand; PAM type: YTN; PAM sequence: TTT
aatctctaaattttttggta

SEQ ID NO: 282836 - DNA, 20 bp, Artificial Sequence
  Description of Artificial Sequence: Synthetic oligonucleotide
  Target: ATXN1; (+) strand; PAM type: YTN; PAM sequence: TTA
atctctaaattttttggtaa

SEQ ID NO: 282837 - DNA, 20 bp, Artificial Sequence
  Description of Artificial Sequence: Synthetic oligonucleotide
  Target: ATXN1; (+) strand; PAM type: YTN; PAM sequence: CTC
taaattttttggtaacgttc

SEQ ID NO: 282838 - DNA, 20 bp, Artificial Sequence
  Description of Artificial Sequence: Synthetic oligonucleotide
  Target: ATXN1; (+) strand; PAM type: YTN; PAM sequence: CTA
aattttttggtaacgttcta

SEQ ID NO: 282839 - DNA, 20 bp, Artificial Sequence
  Description of Artificial Sequence: Synthetic oligonucleotide
  Target: ATXN1; (+) strand; PAM type: YTN; PAM sequence: TTT
tttggtaacgttctattttc

SEQ ID NO: 282840 - DNA, 20 bp, Artificial Sequence
  Description of Artificial Sequence: Synthetic oligonucleotide
  Target: ATXN1; (+) strand; PAM type: YTN; PAM sequence: TTT
ttggtaacgttctattttct

SEQ ID NO: 282841 - DNA, 20 bp, Artificial Sequence
  Description of Artificial Sequence: Synthetic oligonucleotide
  Target: ATXN1; (+) strand; PAM type: YTN; PAM sequence: TTT
tggtaacgttctattttctg

SEQ ID NO: 282842 - DNA, 20 bp, Artificial Sequence
  Description of Artificial Sequence: Synthetic oligonucleotide
  Target: ATXN1; (+) strand; PAM type: YTN; PAM sequence: TTT
ggtaacgttctattttctgg

SEQ ID NO: 282843 - DNA, 20 bp, Artificial Sequence
  Description of Artificial Sequence: Synthetic oligonucleotide
  Target: ATXN1; (+) strand; PAM type: YTN; PAM sequence: TTG
gtaacgttctattttctggt

SEQ ID NO: 282844 - DNA, 20 bp, Artificial Sequence
  Description of Artificial Sequence: Synthetic oligonucleotide
  Target: ATXN1; (+) strand; PAM type: YTN; PAM sequence: TTC
tattttctggttaaactaaa

SEQ ID NO: 282845 - DNA, 20 bp, Artificial Sequence
  Description of Artificial Sequence: Synthetic oligonucleotide
  Target: ATXN1; (+) strand; PAM type: YTN; PAM sequence: CTA
ttttctggttaaactaaaat

SEQ ID NO: 282846 - DNA, 20 bp, Artificial Sequence
  Description of Artificial Sequence: Synthetic oligonucleotide
  Target: ATXN1; (+) strand; PAM type: YTN; PAM sequence: TTT
tctggttaaactaaaatgcc

SEQ ID NO: 282847 - DNA, 20 bp, Artificial Sequence
  Description of Artificial Sequence: Synthetic oligonucleotide
  Target: ATXN1; (+) strand; PAM type: YTN; PAM sequence: TTT
ctggttaaactaaaatgccc

SEQ ID NO: 282848 - DNA, 20 bp, Artificial Sequence
  Description of Artificial Sequence: Synthetic oligonucleotide
  Target: ATXN1; (+) strand; PAM type: YTN; PAM sequence: TTC
tggttaaactaaaatgccca

SEQ ID NO: 282849 - DNA, 20 bp, Artificial Sequence
  Description of Artificial Sequence: Synthetic oligonucleotide
  Target: ATXN1; (+) strand; PAM type: YTN; PAM sequence: CTG
gttaaactaaaatgcccagg

SEQ ID NO: 282850 - DNA, 20 bp, Artificial Sequence
  Description of Artificial Sequence: Synthetic oligonucleotide
  Target: ATXN1; (+) strand; PAM type: YTN; PAM sequence: TTA
aactaaaatgcccaggttcc

SEQ ID NO: 282851 - DNA, 20 bp, Artificial Sequence
  Description of Artificial Sequence: Synthetic oligonucleotide
  Target: ATXN1; (+) strand; PAM type: YTN; PAM sequence: CTA
aaatgcccaggttcccttat

SEQ ID NO: 282852 - DNA, 20 bp, Artificial Sequence
  Description of Artificial Sequence: Synthetic oligonucleotide
  Target: ATXN1; (+) strand; PAM type: YTN; PAM sequence: TTC
ccttatcatctgctttcttt

SEQ ID NO: 282853 - DNA, 20 bp, Artificial Sequence
  Description of Artificial Sequence: Synthetic oligonucleotide
  Target: ATXN1; (+) strand; PAM type: YTN; PAM sequence: CTT
atcatctgctttctttattc

SEQ ID NO: 282854 - DNA, 20 bp, Artificial Sequence
  Description of Artificial Sequence: Synthetic oligonucleotide
  Target: ATXN1; (+) strand; PAM type: YTN; PAM sequence: TTA
tcatctgctttctttattcc

SEQ ID NO: 282855 - DNA, 20 bp, Artificial Sequence
  Description of Artificial Sequence: Synthetic oligonucleotide
  Target: ATXN1; (+) strand; PAM type: YTN; PAM sequence: CTG
ctttctttattccctggaat

SEQ ID NO: 282856 - DNA, 20 bp, Artificial Sequence
  Description of Artificial Sequence: Synthetic oligonucleotide
  Target: ATXN1; (+) strand; PAM type: YTN; PAM sequence: CTT
tctttattccctggaatctt

SEQ ID NO: 282857 - DNA, 20 bp, Artificial Sequence
  Description of Artificial Sequence: Synthetic oligonucleotide
  Target: ATXN1; (+) strand; PAM type: YTN; PAM sequence: TTT
ctttattccctggaatcttc

SEQ ID NO: 282858 - DNA, 20 bp, Artificial Sequence
  Description of Artificial Sequence: Synthetic oligonucleotide
  Target: ATXN1; (+) strand; PAM type: YTN; PAM sequence: TTC
tttattccctggaatcttcc

SEQ ID NO: 282859 - DNA, 20 bp, Artificial Sequence
  Description of Artificial Sequence: Synthetic oligonucleotide
  Target: ATXN1; (+) strand; PAM type: YTN; PAM sequence: CTT
tattccctggaatcttcctt

SEQ ID NO: 282860 - DNA, 20 bp, Artificial Sequence
  Description of Artificial Sequence: Synthetic oligonucleotide
  Target: ATXN1; (+) strand; PAM type: YTN; PAM sequence: TTT
attccctggaatcttccttt

SEQ ID NO: 282861 - DNA, 20 bp, Artificial Sequence
  Description of Artificial Sequence: Synthetic oligonucleotide
  Target: ATXN1; (+) strand; PAM type: YTN; PAM sequence: TTA
ttccctggaatcttcctttt

SEQ ID NO: 282862 - DNA, 20 bp, Artificial Sequence
  Description of Artificial Sequence: Synthetic oligonucleotide
  Target: ATXN1; (+) strand; PAM type: YTN; PAM sequence: TTC
cctggaatcttccttttgag

SEQ ID NO: 282863 - DNA, 20 bp, Artificial Sequence
  Description of Artificial Sequence: Synthetic oligonucleotide
  Target: ATXN1; (+) strand; PAM type: YTN; PAM sequence: CTG
gaatcttccttttgagagat

SEQ ID NO: 282864 - DNA, 20 bp, Artificial Sequence
  Description of Artificial Sequence: Synthetic oligonucleotide
  Target: ATXN1; (+) strand; PAM type: YTN; PAM sequence: CTT
ccttttgagagatatgatgt

SEQ ID NO: 282865 - DNA, 20 bp, Artificial Sequence
  Description of Artificial Sequence: Synthetic oligonucleotide
  Target: ATXN1; (+) strand; PAM type: YTN; PAM sequence: TTC
cttttgagagatatgatgtt

SEQ ID NO: 282866 - DNA, 20 bp, Artificial Sequence
  Description of Artificial Sequence: Synthetic oligonucleotide
  Target: ATXN1; (+) strand; PAM type: YTN; PAM sequence: CTT
ttgagagatatgatgttcca

SEQ ID NO: 282867 - DNA, 20 bp, Artificial Sequence
  Description of Artificial Sequence: Synthetic oligonucleotide
  Target: ATXN1; (+) strand; PAM type: YTN; PAM sequence: TTT
tgagagatatgatgttccat

SEQ ID NO: 282868 - DNA, 20 bp, Artificial Sequence
  Description of Artificial Sequence: Synthetic oligonucleotide
  Target: ATXN1; (+) strand; PAM type: YTN; PAM sequence: TTT
gagagatatgatgttccatt

SEQ ID NO: 282869 - DNA, 20 bp, Artificial Sequence
  Description of Artificial Sequence: Synthetic oligonucleotide
  Target: ATXN1; (+) strand; PAM type: YTN; PAM sequence: TTG
agagatatgatgttccatta

SEQ ID NO: 282870 - DNA, 20 bp, Artificial Sequence
  Description of Artificial Sequence: Synthetic oligonucleotide
  Target: ATXN1; (+) strand; PAM type: YTN; PAM sequence: TTC
cattatctgaggatctgagg

SEQ ID NO: 282871 - DNA, 20 bp, Artificial Sequence
  Description of Artificial Sequence: Synthetic oligonucleotide
  Target: ATXN1; (+) strand; PAM type: YTN; PAM sequence: TTA
tctgaggatctgaggatttc

SEQ ID NO: 282872 - DNA, 20 bp, Artificial Sequence
  Description of Artificial Sequence: Synthetic oligonucleotide
  Target: ATXN1; (+) strand; PAM type: YTN; PAM sequence: CTG
aggatctgaggatttctaac

SEQ ID NO: 282873 - DNA, 20 bp, Artificial Sequence
  Description of Artificial Sequence: Synthetic oligonucleotide
  Target: ATXN1; (+) strand; PAM type: YTN; PAM sequence: CTG
aggatttctaactatgttga

SEQ ID NO: 282874 - DNA, 20 bp, Artificial Sequence
  Description of Artificial Sequence: Synthetic oligonucleotide
  Target: ATXN1; (+) strand; PAM type: YTN; PAM sequence: TTT
ctaactatgttgacaaatct

SEQ ID NO: 282875 - DNA, 20 bp, Artificial Sequence
  Description of Artificial Sequence: Synthetic oligonucleotide
  Target: ATXN1; (+) strand; PAM type: YTN; PAM sequence: TTC
taactatgttgacaaatctt

SEQ ID NO: 282876 - DNA, 20 bp, Artificial Sequence
  Description of Artificial Sequence: Synthetic oligonucleotide
  Target: ATXN1; (+) strand; PAM type: YTN; PAM sequence: CTA
actatgttgacaaatcttcc

SEQ ID NO: 282877 - DNA, 20 bp, Artificial Sequence
  Description of Artificial Sequence: Synthetic oligonucleotide
  Target: ATXN1; (+) strand; PAM type: YTN; PAM sequence: CTA
tgttgacaaatcttcctttt

SEQ ID NO: 282878 - DNA, 20 bp, Artificial Sequence
  Description of Artificial Sequence: Synthetic oligonucleotide
  Target: ATXN1; (+) strand; PAM type: YTN; PAM sequence: TTG
acaaatcttccttttgcttt

SEQ ID NO: 282879 - DNA, 20 bp, Artificial Sequence
  Description of Artificial Sequence: Synthetic oligonucleotide
  Target: ATXN1; (+) strand; PAM type: YTN; PAM sequence: CTT
ccttttgctttttaaaaact

SEQ ID NO: 282880 - DNA, 20 bp, Artificial Sequence
  Description of Artificial Sequence: Synthetic oligonucleotide
  Target: ATXN1; (+) strand; PAM type: YTN; PAM sequence: TTC
cttttgctttttaaaaactg

SEQ ID NO: 282881 - DNA, 20 bp, Artificial Sequence
  Description of Artificial Sequence: Synthetic oligonucleotide
  Target: ATXN1; (+) strand; PAM type: YTN; PAM sequence: CTT
ttgctttttaaaaactgttg

SEQ ID NO: 282882 - DNA, 20 bp, Artificial Sequence
  Description of Artificial Sequence: Synthetic oligonucleotide
  Target: ATXN1; (+) strand; PAM type: YTN; PAM sequence: TTT
tgctttttaaaaactgttgc

SEQ ID NO: 282883 - DNA, 20 bp, Artificial Sequence
  Description of Artificial Sequence: Synthetic oligonucleotide
  Target: ATXN1; (+) strand; PAM type: YTN; PAM sequence: TTT
gctttttaaaaactgttgct

SEQ ID NO: 282884 - DNA, 20 bp, Artificial Sequence
  Description of Artificial Sequence: Synthetic oligonucleotide
  Target: ATXN1; (+) strand; PAM type: YTN; PAM sequence: TTG
ctttttaaaaactgttgctg

SEQ ID NO: 282885 - DNA, 20 bp, Artificial Sequence
  Description of Artificial Sequence: Synthetic oligonucleotide
  Target: ATXN1; (+) strand; PAM type: YTN; PAM sequence: CTT
tttaaaaactgttgctgcac

SEQ ID NO: 282886 - DNA, 20 bp, Artificial Sequence
  Description of Artificial Sequence: Synthetic oligonucleotide
  Target: ATXN1; (+) strand; PAM type: YTN; PAM sequence: TTT
ttaaaaactgttgctgcaca

SEQ ID NO: 282887 - DNA, 20 bp, Artificial Sequence
  Description of Artificial Sequence: Synthetic oligonucleotide
  Target: ATXN1; (+) strand; PAM type: YTN; PAM sequence: TTT
taaaaactgttgctgcacat

SEQ ID NO: 282888 - DNA, 20 bp, Artificial Sequence
  Description of Artificial Sequence: Synthetic oligonucleotide
  Target: ATXN1; (+) strand; PAM type: YTN; PAM sequence: TTT
aaaaactgttgctgcacata

SEQ ID NO: 282889 - DNA, 20 bp, Artificial Sequence
  Description of Artificial Sequence: Synthetic oligonucleotide
  Target: ATXN1; (+) strand; PAM type: YTN; PAM sequence: TTA
aaaactgttgctgcacatat

SEQ ID NO: 282890 - DNA, 20 bp, Artificial Sequence
  Description of Artificial Sequence: Synthetic oligonucleotide
  Target: ATXN1; (+) strand; PAM type: YTN; PAM sequence: CTG
ttgctgcacatattgctgag

SEQ ID NO: 282891 - DNA, 20 bp, Artificial Sequence
  Description of Artificial Sequence: Synthetic oligonucleotide
  Target: ATXN1; (+) strand; PAM type: YTN; PAM sequence: TTG
ctgcacatattgctgagtag

SEQ ID NO: 282892 - DNA, 20 bp, Artificial Sequence
  Description of Artificial Sequence: Synthetic oligonucleotide
  Target: ATXN1; (+) strand; PAM type: YTN; PAM sequence: CTG
cacatattgctgagtagctt

SEQ ID NO: 282893 - DNA, 20 bp, Artificial Sequence
  Description of Artificial Sequence: Synthetic oligonucleotide
  Target: ATXN1; (+) strand; PAM type: YTN; PAM sequence: TTG
ctgagtagctttcaaattta

SEQ ID NO: 282894 - DNA, 20 bp, Artificial Sequence
  Description of Artificial Sequence: Synthetic oligonucleotide
  Target: ATXN1; (+) strand; PAM type: YTN; PAM sequence: CTG
agtagctttcaaatttatcc

SEQ ID NO: 282895 - DNA, 20 bp, Artificial Sequence
  Description of Artificial Sequence: Synthetic oligonucleotide
  Target: ATXN1; (+) strand; PAM type: YTN; PAM sequence: CTT
tcaaatttatccactacgac

SEQ ID NO: 282896 - DNA, 20 bp, Artificial Sequence
  Description of Artificial Sequence: Synthetic oligonucleotide
  Target: ATXN1; (+) strand; PAM type: YTN; PAM sequence: TTT
caaatttatccactacgact

SEQ ID NO: 282897 - DNA, 20 bp, Artificial Sequence
  Description of Artificial Sequence: Synthetic oligonucleotide
  Target: ATXN1; (+) strand; PAM type: YTN; PAM sequence: TTC
aaatttatccactacgactt

SEQ ID NO: 282898 - DNA, 20 bp, Artificial Sequence
  Description of Artificial Sequence: Synthetic oligonucleotide
  Target: ATXN1; (+) strand; PAM type: YTN; PAM sequence: TTT
atccactacgacttccacgc

SEQ ID NO: 282899 - DNA, 20 bp, Artificial Sequence
  Description of Artificial Sequence: Synthetic oligonucleotide
  Target: ATXN1; (+) strand; PAM type: YTN; PAM sequence: TTA
tccactacgacttccacgct

SEQ ID NO: 282900 - DNA, 20 bp, Artificial Sequence
  Description of Artificial Sequence: Synthetic oligonucleotide
  Target: ATXN1; (+) strand; PAM type: YTN; PAM sequence: CTA
cgacttccacgctcatatcc

SEQ ID NO: 282901 - DNA, 20 bp, Artificial Sequence
  Description of Artificial Sequence: Synthetic oligonucleotide
  Target: ATXN1; (+) strand; PAM type: YTN; PAM sequence: CTT
ccacgctcatatcctaatat

SEQ ID NO: 282902 - DNA, 20 bp, Artificial Sequence
  Description of Artificial Sequence: Synthetic oligonucleotide
  Target: ATXN1; (+) strand; PAM type: YTN; PAM sequence: TTC
cacgctcatatcctaatatt

SEQ ID NO: 282903 - DNA, 20 bp, Artificial Sequence
  Description of Artificial Sequence: Synthetic oligonucleotide
  Target: ATXN1; (+) strand; PAM type: YTN; PAM sequence: CTC
atatcctaatatttatcaca

SEQ ID NO: 282904 - DNA, 20 bp, Artificial Sequence
  Description of Artificial Sequence: Synthetic oligonucleotide
  Target: ATXN1; (+) strand; PAM type: YTN; PAM sequence: CTA
atatttatcacaatggctac

SEQ ID NO: 282905 - DNA, 20 bp, Artificial Sequence
  Description of Artificial Sequence: Synthetic oligonucleotide
  Target: ATXN1; (+) strand; PAM type: YTN; PAM sequence: TTT
atcacaatggctaccccatt

SEQ ID NO: 282906 - DNA, 20 bp, Artificial Sequence
  Description of Artificial Sequence: Synthetic oligonucleotide
  Target: ATXN1; (+) strand; PAM type: YTN; PAM sequence: TTA
tcacaatggctaccccattc

SEQ ID NO: 282907 - DNA, 20 bp, Artificial Sequence
  Description of Artificial Sequence: Synthetic oligonucleotide
  Target: ATXN1; (+) strand; PAM type: YTN; PAM sequence: CTA
ccccattccagaaaatctga

SEQ ID NO: 282908 - DNA, 20 bp, Artificial Sequence
  Description of Artificial Sequence: Synthetic oligonucleotide
  Target: ATXN1; (+) strand; PAM type: YTN; PAM sequence: TTC
cagaaaatctgaagagttct

SEQ ID NO: 282909 - DNA, 20 bp, Artificial Sequence
  Description of Artificial Sequence: Synthetic oligonucleotide
  Target: ATXN1; (+) strand; PAM type: YTN; PAM sequence: CTG
aagagttctacatttgtact

SEQ ID NO: 282910 - DNA, 20 bp, Artificial Sequence
  Description of Artificial Sequence: Synthetic oligonucleotide
  Target: ATXN1; (+) strand; PAM type: YTN; PAM sequence: TTC
tacatttgtactcaaccaca

SEQ ID NO: 282911 - DNA, 20 bp, Artificial Sequence
  Description of Artificial Sequence: Synthetic oligonucleotide
  Target: ATXN1; (+) strand; PAM type: YTN; PAM sequence: CTA
catttgtactcaaccacatc

SEQ ID NO: 282912 - DNA, 20 bp, Artificial Sequence
  Description of Artificial Sequence: Synthetic oligonucleotide
  Target: ATXN1; (+) strand; PAM type: YTN; PAM sequence: TTT
gtactcaaccacatctactt

SEQ ID NO: 282913 - DNA, 20 bp, Artificial Sequence
  Description of Artificial Sequence: Synthetic oligonucleotide
  Target: ATXN1; (+) strand; PAM type: YTN; PAM sequence: TTG
tactcaaccacatctacttc

SEQ ID NO: 282914 - DNA, 20 bp, Artificial Sequence
  Description of Artificial Sequence: Synthetic oligonucleotide
  Target: ATXN1; (+) strand; PAM type: YTN; PAM sequence: CTC
aaccacatctacttctcgaa

SEQ ID NO: 282915 - DNA, 20 bp, Artificial Sequence
  Description of Artificial Sequence: Synthetic oligonucleotide
  Target: ATXN1; (+) strand; PAM type: YTN; PAM sequence: CTA
cttctcgaatcttctttctc

SEQ ID NO: 282916 - DNA, 20 bp, Artificial Sequence
  Description of Artificial Sequence: Synthetic oligonucleotide
  Target: ATXN1; (+) strand; PAM type: YTN; PAM sequence: CTT
ctcgaatcttctttctctgt

SEQ ID NO: 282917 - DNA, 20 bp, Artificial Sequence
  Description of Artificial Sequence: Synthetic oligonucleotide
  Target: ATXN1; (+) strand; PAM type: YTN; PAM sequence: TTC
tcgaatcttctttctctgtc

SEQ ID NO: 282918 - DNA, 20 bp, Artificial Sequence
  Description of Artificial Sequence: Synthetic oligonucleotide
  Target: ATXN1; (+) strand; PAM type: YTN; PAM sequence: CTC
gaatcttctttctctgtcac

SEQ ID NO: 282919 - DNA, 20 bp, Artificial Sequence
  Description of Artificial Sequence: Synthetic oligonucleotide
  Target: ATXN1; (+) strand; PAM type: YTN; PAM sequence: CTT
ctttctctgtcactgttatt

SEQ ID NO: 282920 - DNA, 20 bp, Artificial Sequence
  Description of Artificial Sequence: Synthetic oligonucleotide
  Target: ATXN1; (+) strand; PAM type: YTN; PAM sequence: TTC
tttctctgtcactgttattc

SEQ ID NO: 282921 - DNA, 20 bp, Artificial Sequence
  Description of Artificial Sequence: Synthetic oligonucleotide
  Target: ATXN1; (+) strand; PAM type: YTN; PAM sequence: CTT
tctctgtcactgttattccc

SEQ ID NO: 282922 - DNA, 20 bp, Artificial Sequence
  Description of Artificial Sequence: Synthetic oligonucleotide
  Target: ATXN1; (+) strand; PAM type: YTN; PAM sequence: TTT
ctctgtcactgttattccca

SEQ ID NO: 282923 - DNA, 20 bp, Artificial Sequence
  Description of Artificial Sequence: Synthetic oligonucleotide
  Target: ATXN1; (+) strand; PAM type: YTN; PAM sequence: TTC
tctgtcactgttattcccaa

SEQ ID NO: 282924 - DNA, 20 bp, Artificial Sequence
  Description of Artificial Sequence: Synthetic oligonucleotide
  Target: ATXN1; (+) strand; PAM type: YTN; PAM sequence: CTC
tgtcactgttattcccaaga

SEQ ID NO: 282925 - DNA, 20 bp, Artificial Sequence
  Description of Artificial Sequence: Synthetic oligonucleotide
  Target: ATXN1; (+) strand; PAM type: YTN; PAM sequence: CTG
tcactgttattcccaagatc

SEQ ID NO: 282926 - DNA, 20 bp, Artificial Sequence
  Description of Artificial Sequence: Synthetic oligonucleotide
  Target: ATXN1; (+) strand; PAM type: YTN; PAM sequence: CTG
ttattcccaagatcctggaa

SEQ ID NO: 282927 - DNA, 20 bp, Artificial Sequence
  Description of Artificial Sequence: Synthetic oligonucleotide
  Target: ATXN1; (+) strand; PAM type: YTN; PAM sequence: TTA
ttcccaagatcctggaatta

SEQ ID NO: 282928 - DNA, 20 bp, Artificial Sequence
  Description of Artificial Sequence: Synthetic oligonucleotide
  Target: ATXN1; (+) strand; PAM type: YTN; PAM sequence: TTC
ccaagatcctggaattaaac

SEQ ID NO: 282929 - DNA, 20 bp, Artificial Sequence
  Description of Artificial Sequence: Synthetic oligonucleotide
  Target: ATXN1; (+) strand; PAM type: YTN; PAM sequence: CTG
gaattaaacagaagagtttt

SEQ ID NO: 282930 - DNA, 20 bp, Artificial Sequence
  Description of Artificial Sequence: Synthetic oligonucleotide
  Target: ATXN1; (+) strand; PAM type: YTN; PAM sequence: TTA
aacagaagagttttcctttc

SEQ ID NO: 282931 - DNA, 20 bp, Artificial Sequence
  Description of Artificial Sequence: Synthetic oligonucleotide
  Target: ATXN1; (+) strand; PAM type: YTN; PAM sequence: TTT
tcctttctggtcagtcagtt

SEQ ID NO: 282932 - DNA, 20 bp, Artificial Sequence
  Description of Artificial Sequence: Synthetic oligonucleotide
  Target: ATXN1; (+) strand; PAM type: YTN; PAM sequence: TTT
cctttctggtcagtcagttc

SEQ ID NO: 282933 - DNA, 20 bp, Artificial Sequence
  Description of Artificial Sequence: Synthetic oligonucleotide
  Target: ATXN1; (+) strand; PAM type: YTN; PAM sequence: TTC
ctttctggtcagtcagttca

SEQ ID NO: 282934 - DNA, 20 bp, Artificial Sequence
  Description of Artificial Sequence: Synthetic oligonucleotide
  Target: ATXN1; (+) strand; PAM type: YTN; PAM sequence: CTT
tctggtcagtcagttcatcc

SEQ ID NO: 282935 - DNA, 20 bp, Artificial Sequence
  Description of Artificial Sequence: Synthetic oligonucleotide
  Target: ATXN1; (+) strand; PAM type: YTN; PAM sequence: TTT
ctggtcagtcagttcatcct

SEQ ID NO: 282936 - DNA, 20 bp, Artificial Sequence
  Description of Artificial Sequence: Synthetic oligonucleotide
  Target: ATXN1; (+) strand; PAM type: YTN; PAM sequence: TTC
tggtcagtcagttcatcctt

SEQ ID NO: 282937 - DNA, 20 bp, Artificial Sequence
  Description of Artificial Sequence: Synthetic oligonucleotide
  Target: ATXN1; (+) strand; PAM type: YTN; PAM sequence: CTG
gtcagtcagttcatccttcc

SEQ ID NO: 282938 - DNA, 20 bp, Artificial Sequence
  Description of Artificial Sequence: Synthetic oligonucleotide
  Target: ATXN1; (+) strand; PAM type: YTN; PAM sequence: TTC
atccttccagagccagccca

SEQ ID NO: 282939 - DNA, 20 bp, Artificial Sequence
  Description of Artificial Sequence: Synthetic oligonucleotide
  Target: ATXN1; (+) strand; PAM type: YTN; PAM sequence: CTT
ccagagccagcccaaagggt

SEQ ID NO: 282940 - DNA, 20 bp, Artificial Sequence
  Description of Artificial Sequence: Synthetic oligonucleotide
  Target: ATXN1; (+) strand; PAM type: YTN; PAM sequence: TTC
cagagccagcccaaagggtg

SEQ ID NO: 282941 - DNA, 20 bp, Artificial Sequence
  Description of Artificial Sequence: Synthetic oligonucleotide
  Target: ATXN1; (+) strand; PAM type: YTN; PAM sequence: CTT
taacatcactccttctcagc

SEQ ID NO: 282942 - DNA, 20 bp, Artificial Sequence
  Description of Artificial Sequence: Synthetic oligonucleotide
  Target: ATXN1; (+) strand; PAM type: YTN; PAM sequence: TTT
aacatcactccttctcagct

SEQ ID NO: 282943 - DNA, 20 bp, Artificial Sequence
  Description of Artificial Sequence: Synthetic oligonucleotide
  Target: ATXN1; (+) strand; PAM type: YTN; PAM sequence: TTA
acatcactccttctcagctg

SEQ ID NO: 282944 - DNA, 20 bp, Artificial Sequence
  Description of Artificial Sequence: Synthetic oligonucleotide
  Target: ATXN1; (+) strand; PAM type: YTN; PAM sequence: CTC
cttctcagctgagtactttc

SEQ ID NO: 282945 - DNA, 20 bp, Artificial Sequence
  Description of Artificial Sequence: Synthetic oligonucleotide
  Target: ATXN1; (+) strand; PAM type: YTN; PAM sequence: CTT
ctcagctgagtactttctga

SEQ ID NO: 282946 - DNA, 20 bp, Artificial Sequence
  Description of Artificial Sequence: Synthetic oligonucleotide
  Target: ATXN1; (+) strand; PAM type: YTN; PAM sequence: TTC
tcagctgagtactttctgat

SEQ ID NO: 282947 - DNA, 20 bp, Artificial Sequence
  Description of Artificial Sequence: Synthetic oligonucleotide
  Target: ATXN1; (+) strand; PAM type: YTN; PAM sequence: CTC
agctgagtactttctgatgt

SEQ ID NO: 282948 - DNA, 20 bp, Artificial Sequence
  Description of Artificial Sequence: Synthetic oligonucleotide
  Target: ATXN1; (+) strand; PAM type: YTN; PAM sequence: CTG
agtactttctgatgttataa

SEQ ID NO: 282949 - DNA, 20 bp, Artificial Sequence
  Description of Artificial Sequence: Synthetic oligonucleotide
  Target: ATXN1; (+) strand; PAM type: YTN; PAM sequence: CTT
tctgatgttataacatgctt

SEQ ID NO: 282950 - DNA, 20 bp, Artificial Sequence
  Description of Artificial Sequence: Synthetic oligonucleotide
  Target: ATXN1; (+) strand; PAM type: YTN; PAM sequence: TTT
ctgatgttataacatgctta

SEQ ID NO: 282951 - DNA, 20 bp, Artificial Sequence
  Description of Artificial Sequence: Synthetic oligonucleotide
  Target: ATXN1; (+) strand; PAM type: YTN; PAM sequence: TTC
tgatgttataacatgcttac

SEQ ID NO: 282952 - DNA, 20 bp, Artificial Sequence
  Description of Artificial Sequence: Synthetic oligonucleotide
  Target: ATXN1; (+) strand; PAM type: YTN; PAM sequence: CTG
atgttataacatgcttacct

SEQ ID NO: 282953 - DNA, 20 bp, Artificial Sequence
  Description of Artificial Sequence: Synthetic oligonucleotide
  Target: ATXN1; (+) strand; PAM type: YTN; PAM sequence: TTA
taacatgcttacctacaaca

SEQ ID NO: 282954 - DNA, 20 bp, Artificial Sequence
  Description of Artificial Sequence: Synthetic oligonucleotide
  Target: ATXN1; (+) strand; PAM type: YTN; PAM sequence: CTT
acctacaacactatcttatg

SEQ ID NO: 282955 - DNA, 20 bp, Artificial Sequence
  Description of Artificial Sequence: Synthetic oligonucleotide
  Target: ATXN1; (+) strand; PAM type: YTN; PAM sequence: TTA
cctacaacactatcttatgc

SEQ ID NO: 282956 - DNA, 20 bp, Artificial Sequence
  Description of Artificial Sequence: Synthetic oligonucleotide
  Target: ATXN1; (+) strand; PAM type: YTN; PAM sequence: CTA
caacactatcttatgcaggg

SEQ ID NO: 282957 - DNA, 20 bp, Artificial Sequence
  Description of Artificial Sequence: Synthetic oligonucleotide
  Target: ATXN1; (+) strand; PAM type: YTN; PAM sequence: CTA
tcttatgcagggggcaaaag

SEQ ID NO: 282958 - DNA, 20 bp, Artificial Sequence
  Description of Artificial Sequence: Synthetic oligonucleotide
  Target: ATXN1; (+) strand; PAM type: YTN; PAM sequence: CTT
atgcagggggcaaaaggaag

SEQ ID NO: 282959 - DNA, 20 bp, Artificial Sequence
  Description of Artificial Sequence: Synthetic oligonucleotide
  Target: ATXN1; (+) strand; PAM type: YTN; PAM sequence: TTA
tgcagggggcaaaaggaaga

SEQ ID NO: 282960 - DNA, 20 bp, Artificial Sequence
  Description of Artificial Sequence: Synthetic oligonucleotide
  Target: ATXN1; (+) strand; PAM type: YTN; PAM sequence: CTT
taaaaagacagatccattta

SEQ ID NO: 282961 - DNA, 20 bp, Artificial Sequence
  Description of Artificial Sequence: Synthetic oligonucleotide
  Target: ATXN1; (+) strand; PAM type: YTN; PAM sequence: TTT
aaaaagacagatccatttat

SEQ ID NO: 282962 - DNA, 20 bp, Artificial Sequence
  Description of Artificial Sequence: Synthetic oligonucleotide
  Target: ATXN1; (+) strand; PAM type: YTN; PAM sequence: TTA
aaaagacagatccatttatg

SEQ ID NO: 282963 - DNA, 20 bp, Artificial Sequence
  Description of Artificial Sequence: Synthetic oligonucleotide
  Target: ATXN1; (+) strand; PAM type: YTN; PAM sequence: TTT
atgtgccagcacagcctgat

SEQ ID NO: 282964 - DNA, 20 bp, Artificial Sequence
  Description of Artificial Sequence: Synthetic oligonucleotide
  Target: ATXN1; (+) strand; PAM type: YTN; PAM sequence: TTA
tgtgccagcacagcctgata

SEQ ID NO: 282965 - DNA, 20 bp, Artificial Sequence
  Description of Artificial Sequence: Synthetic oligonucleotide
  Target: ATXN1; (+) strand; PAM type: YTN; PAM sequence: CTG
ataactagagtagcaggaaa

SEQ ID NO: 282966 - DNA, 20 bp, Artificial Sequence
  Description of Artificial Sequence: Synthetic oligonucleotide
  Target: ATXN1; (+) strand; PAM type: YTN; PAM sequence: CTA
gagtagcaggaaaaagagaa

SEQ ID NO: 282967 - DNA, 20 bp, Artificial Sequence
  Description of Artificial Sequence: Synthetic oligonucleotide
  Target: ATXN1; (+) strand; PAM type: YTN; PAM sequence: TTA
gataagcccccctttttggg

SEQ ID NO: 282968 - DNA, 20 bp, Artificial Sequence
  Description of Artificial Sequence: Synthetic oligonucleotide
  Target: ATXN1; (+) strand; PAM type: YTN; PAM sequence: CTT
tttggggtgtgtgtagggga

SEQ ID NO: 282969 - DNA, 20 bp, Artificial Sequence
  Description of Artificial Sequence: Synthetic oligonucleotide
  Target: ATXN1; (+) strand; PAM type: YTN; PAM sequence: TTT
ttggggtgtgtgtaggggat

SEQ ID NO: 282970 - DNA, 20 bp, Artificial Sequence
  Description of Artificial Sequence: Synthetic oligonucleotide
  Target: ATXN1; (+) strand; PAM type: YTN; PAM sequence: TTT
tggggtgtgtgtaggggatt

SEQ ID NO: 282971 - DNA, 20 bp, Artificial Sequence
  Description of Artificial Sequence: Synthetic oligonucleotide
  Target: ATXN1; (+) strand; PAM type: YTN; PAM sequence: TTT
ggggtgtgtgtaggggattc

SEQ ID NO: 282972 - DNA, 20 bp, Artificial Sequence
  Description of Artificial Sequence: Synthetic oligonucleotide
  Target: ATXN1; (+) strand; PAM type: YTN; PAM sequence: TTG
gggtgtgtgtaggggattct

SEQ ID NO: 282973 - DNA, 20 bp, Artificial Sequence
  Description of Artificial Sequence: Synthetic oligonucleotide
  Target: ATXN1; (+) strand; PAM type: YTN; PAM sequence: TTC
ttgactgtggtcactatatt

SEQ ID NO: 282974 - DNA, 20 bp, Artificial Sequence
  Description of Artificial Sequence: Synthetic oligonucleotide
  Target: ATXN1; (+) strand; PAM type: YTN; PAM sequence: CTT
gactgtggtcactatattcc

SEQ ID NO: 282975 - DNA, 20 bp, Artificial Sequence
  Description of Artificial Sequence: Synthetic oligonucleotide
  Target: ATXN1; (+) strand; PAM type: YTN; PAM sequence: TTG
actgtggtcactatattcca

SEQ ID NO: 282976 - DNA, 20 bp, Artificial Sequence
  Description of Artificial Sequence: Synthetic oligonucleotide
  Target: ATXN1; (+) strand; PAM type: YTN; PAM sequence: CTG
tggtcactatattccagcag

SEQ ID NO: 282977 - DNA, 20 bp, Artificial Sequence
  Description of Artificial Sequence: Synthetic oligonucleotide
  Target: ATXN1; (+) strand; PAM type: YTN; PAM sequence: CTA
tattccagcagtgacacaag

SEQ ID NO: 282978 - DNA, 20 bp, Artificial Sequence
  Description of Artificial Sequence: Synthetic oligonucleotide
  Target: ATXN1; (+) strand; PAM type: YTN; PAM sequence: TTC
cagcagtgacacaagttaga

SEQ ID NO: 282979 - DNA, 20 bp, Artificial Sequence
  Description of Artificial Sequence: Synthetic oligonucleotide
  Target: ATXN1; (+) strand; PAM type: YTN; PAM sequence: TTA
gagcttctggggctgaagtc

SEQ ID NO: 282980 - DNA, 20 bp, Artificial Sequence
  Description of Artificial Sequence: Synthetic oligonucleotide
  Target: ATXN1; (+) strand; PAM type: YTN; PAM sequence: CTT
ctggggctgaagtccgcatt

SEQ ID NO: 282981 - DNA, 20 bp, Artificial Sequence
  Description of Artificial Sequence: Synthetic oligonucleotide
  Target: ATXN1; (+) strand; PAM type: YTN; PAM sequence: TTC
tggggctgaagtccgcattg

SEQ ID NO: 282982 - DNA, 20 bp, Artificial Sequence
  Description of Artificial Sequence: Synthetic oligonucleotide
  Target: ATXN1; (+) strand; PAM type: YTN; PAM sequence: CTG
gggctgaagtccgcattgtc

SEQ ID NO: 282983 - DNA, 20 bp, Artificial Sequence
  Description of Artificial Sequence: Synthetic oligonucleotide
  Target: ATXN1; (+) strand; PAM type: YTN; PAM sequence: CTG
aagtccgcattgtctaaaca

SEQ ID NO: 282984 - DNA, 20 bp, Artificial Sequence
  Description of Artificial Sequence: Synthetic oligonucleotide
  Target: ATXN1; (+) strand; PAM type: YTN; PAM sequence: TTG
tctaaacaggacagtcagac

SEQ ID NO: 282985 - DNA, 20 bp, Artificial Sequence
  Description of Artificial Sequence: Synthetic oligonucleotide
  Target: ATXN1; (+) strand; PAM type: YTN; PAM sequence: CTA
aacaggacagtcagactttg

SEQ ID NO: 282986 - DNA, 20 bp, Artificial Sequence
  Description of Artificial Sequence: Synthetic oligonucleotide
  Target: ATXN1; (+) strand; PAM type: YTN; PAM sequence: CTT
tggggcaaaccatcctccca

SEQ ID NO: 282987 - DNA, 20 bp, Artificial Sequence
  Description of Artificial Sequence: Synthetic oligonucleotide
  Target: ATXN1; (+) strand; PAM type: YTN; PAM sequence: TTT
ggggcaaaccatcctcccat

SEQ ID NO: 282988 - DNA, 20 bp, Artificial Sequence
  Description of Artificial Sequence: Synthetic oligonucleotide
  Target: ATXN1; (+) strand; PAM type: YTN; PAM sequence: TTG
gggcaaaccatcctcccatc

SEQ ID NO: 282989 - DNA, 20 bp, Artificial Sequence
  Description of Artificial Sequence: Synthetic oligonucleotide
  Target: ATXN1; (+) strand; PAM type: YTN; PAM sequence: CTC
ccatcttattgcccaattcc

SEQ ID NO: 282990 - DNA, 20 bp, Artificial Sequence
  Description of Artificial Sequence: Synthetic oligonucleotide
  Target: ATXN1; (+) strand; PAM type: YTN; PAM sequence: CTT
attgcccaattccactttcc

SEQ ID NO: 282991 - DNA, 20 bp, Artificial Sequence
  Description of Artificial Sequence: Synthetic oligonucleotide
  Target: ATXN1; (+) strand; PAM type: YTN; PAM sequence: TTA
ttgcccaattccactttccc

SEQ ID NO: 282992 - DNA, 20 bp, Artificial Sequence
  Description of Artificial Sequence: Synthetic oligonucleotide
  Target: ATXN1; (+) strand; PAM type: YTN; PAM sequence: TTG
cccaattccactttccctgc

SEQ ID NO: 282993 - DNA, 20 bp, Artificial Sequence
  Description of Artificial Sequence: Synthetic oligonucleotide
  Target: ATXN1; (+) strand; PAM type: YTN; PAM sequence: TTC
cactttccctgctgttttaa

SEQ ID NO: 282994 - DNA, 20 bp, Artificial Sequence
  Description of Artificial Sequence: Synthetic oligonucleotide
  Target: ATXN1; (+) strand; PAM type: YTN; PAM sequence: CTT
tccctgctgttttaatggga

SEQ ID NO: 282995 - DNA, 20 bp, Artificial Sequence
  Description of Artificial Sequence: Synthetic oligonucleotide
  Target: ATXN1; (+) strand; PAM type: YTN; PAM sequence: TTT
ccctgctgttttaatgggat

SEQ ID NO: 282996 - DNA, 20 bp, Artificial Sequence
  Description of Artificial Sequence: Synthetic oligonucleotide
  Target: ATXN1; (+) strand; PAM type: YTN; PAM sequence: TTC
cctgctgttttaatgggatt

SEQ ID NO: 282997 - DNA, 20 bp, Artificial Sequence
  Description of Artificial Sequence: Synthetic oligonucleotide
  Target: ATXN1; (+) strand; PAM type: YTN; PAM sequence: CTG
ctgttttaatgggattattt

SEQ ID NO: 282998 - DNA, 20 bp, Artificial Sequence
  Description of Artificial Sequence: Synthetic oligonucleotide
  Target: ATXN1; (+) strand; PAM type: YTN; PAM sequence: CTG
ttttaatgggattattttgg

SEQ ID NO: 282999 - DNA, 20 bp, Artificial Sequence
  Description of Artificial Sequence: Synthetic oligonucleotide
  Target: ATXN1; (+) strand; PAM type: YTN; PAM sequence: TTT
taatgggattattttggaat

SEQ ID NO: 283000 - DNA, 20 bp, Artificial Sequence
  Description of Artificial Sequence: Synthetic oligonucleotide
  Target: ATXN1; (+) strand; PAM type: YTN; PAM sequence: TTT
aatgggattattttggaatc

SEQ ID NO: 283001 - DNA, 20 bp, Artificial Sequence
  Description of Artificial Sequence: Synthetic oligonucleotide
  Target: ATXN1; (+) strand; PAM type: YTN; PAM sequence: TTA
atgggattattttggaatct

SEQ ID NO: 283002 - DNA, 20 bp, Artificial Sequence
  Description of Artificial Sequence: Synthetic oligonucleotide
  Target: ATXN1; (+) strand; PAM type: YTN; PAM sequence: TTA
ttttggaatctgctatttct

SEQ ID NO: 283003 - DNA, 20 bp, Artificial Sequence
  Description of Artificial Sequence: Synthetic oligonucleotide
  Target: ATXN1; (+) strand; PAM type: YTN; PAM sequence: TTT
tggaatctgctatttctgtc

SEQ ID NO: 283004 - DNA, 20 bp, Artificial Sequence
  Description of Artificial Sequence: Synthetic oligonucleotide
  Target: ATXN1; (+) strand; PAM type: YTN; PAM sequence: TTT
ggaatctgctatttctgtct

SEQ ID NO: 283005 - DNA, 20 bp, Artificial Sequence
  Description of Artificial Sequence: Synthetic oligonucleotide
  Target: ATXN1; (+) strand; PAM type: YTN; PAM sequence: TTG
gaatctgctatttctgtctc

SEQ ID NO: 283006 - DNA, 20 bp, Artificial Sequence
  Description of Artificial Sequence: Synthetic oligonucleotide
  Target: ATXN1; (+) strand; PAM type: YTN; PAM sequence: CTG
ctatttctgtctcactcctt

SEQ ID NO: 283007 - DNA, 20 bp, Artificial Sequence
  Description of Artificial Sequence: Synthetic oligonucleotide
  Target: ATXN1; (+) strand; PAM type: YTN; PAM sequence: CTA
tttctgtctcactccttttc

SEQ ID NO: 283008 - DNA, 20 bp, Artificial Sequence
  Description of Artificial Sequence: Synthetic oligonucleotide
  Target: ATXN1; (+) strand; PAM type: YTN; PAM sequence: TTT
ctgtctcactccttttcccc

SEQ ID NO: 283009 - DNA, 20 bp, Artificial Sequence
  Description of Artificial Sequence: Synthetic oligonucleotide
  Target: ATXN1; (+) strand; PAM type: YTN; PAM sequence: TTC
tgtctcactccttttcccca

SEQ ID NO: 283010 - DNA, 20 bp, Artificial Sequence
  Description of Artificial Sequence: Synthetic oligonucleotide
  Target: ATXN1; (+) strand; PAM type: YTN; PAM sequence: CTG
tctcactccttttccccaaa

SEQ ID NO: 283011 - DNA, 20 bp, Artificial Sequence
  Description of Artificial Sequence: Synthetic oligonucleotide
  Target: ATXN1; (+) strand; PAM type: YTN; PAM sequence: CTC
actccttttccccaaactgt

SEQ ID NO: 283012 - DNA, 20 bp, Artificial Sequence
  Description of Artificial Sequence: Synthetic oligonucleotide
  Target: ATXN1; (+) strand; PAM type: YTN; PAM sequence: CTC
cttttccccaaactgtcata

SEQ ID NO: 283013 - DNA, 20 bp, Artificial Sequence
  Description of Artificial Sequence: Synthetic oligonucleotide
  Target: ATXN1; (+) strand; PAM type: YTN; PAM sequence: CTT
ttccccaaactgtcatataa

SEQ ID NO: 283014 - DNA, 20 bp, Artificial Sequence
  Description of Artificial Sequence: Synthetic oligonucleotide
  Target: ATXN1; (+) strand; PAM type: YTN; PAM sequence: TTT
tccccaaactgtcatataag

SEQ ID NO: 283015 - DNA, 20 bp, Artificial Sequence
  Description of Artificial Sequence: Synthetic oligonucleotide
  Target: ATXN1; (+) strand; PAM type: YTN; PAM sequence: TTT
ccccaaactgtcatataagt

SEQ ID NO: 283016 - DNA, 20 bp, Artificial Sequence
  Description of Artificial Sequence: Synthetic oligonucleotide
  Target: ATXN1; (+) strand; PAM type: YTN; PAM sequence: TTC
cccaaactgtcatataagta

SEQ ID NO: 283017 - DNA, 20 bp, Artificial Sequence
  Description of Artificial Sequence: Synthetic oligonucleotide
  Target: ATXN1; (+) strand; PAM type: YTN; PAM sequence: CTG
tcatataagtactgcagctt

SEQ ID NO: 283018 - DNA, 20 bp, Artificial Sequence
  Description of Artificial Sequence: Synthetic oligonucleotide
  Target: ATXN1; (+) strand; PAM type: YTN; PAM sequence: CTG
cagcttgactacttcccagc

SEQ ID NO: 283019 - DNA, 20 bp, Artificial Sequence
  Description of Artificial Sequence: Synthetic oligonucleotide
  Target: ATXN1; (+) strand; PAM type: YTN; PAM sequence: CTT
gactacttcccagctgccaa

SEQ ID NO: 283020 - DNA, 20 bp, Artificial Sequence
  Description of Artificial Sequence: Synthetic oligonucleotide
  Target: ATXN1; (+) strand; PAM type: YTN; PAM sequence: TTG
actacttcccagctgccaaa

SEQ ID NO: 283021 - DNA, 20 bp, Artificial Sequence
  Description of Artificial Sequence: Synthetic oligonucleotide
  Target: ATXN1; (+) strand; PAM type: YTN; PAM sequence: CTA
cttcccagctgccaaatttc

SEQ ID NO: 283022 - DNA, 20 bp, Artificial Sequence
  Description of Artificial Sequence: Synthetic oligonucleotide
  Target: ATXN1; (+) strand; PAM type: YTN; PAM sequence: CTT
cccagctgccaaatttcact

SEQ ID NO: 283023 - DNA, 20 bp, Artificial Sequence
  Description of Artificial Sequence: Synthetic oligonucleotide
  Target: ATXN1; (+) strand; PAM type: YTN; PAM sequence: TTC
ccagctgccaaatttcactc

SEQ ID NO: 283024 - DNA, 20 bp, Artificial Sequence
  Description of Artificial Sequence: Synthetic oligonucleotide
  Target: ATXN1; (+) strand; PAM type: YTN; PAM sequence: CTG
ccaaatttcactccagagat

SEQ ID NO: 283025 - DNA, 20 bp, Artificial Sequence
  Description of Artificial Sequence: Synthetic oligonucleotide
  Target: ATXN1; (+) strand; PAM type: YTN; PAM sequence: TTT
cactccagagatggctgtat

SEQ ID NO: 283026 - DNA, 20 bp, Artificial Sequence
  Description of Artificial Sequence: Synthetic oligonucleotide
  Target: ATXN1; (+) strand; PAM type: YTN; PAM sequence: TTC
actccagagatggctgtatt

SEQ ID NO: 283027 - DNA, 20 bp, Artificial Sequence
  Description of Artificial Sequence: Synthetic oligonucleotide
  Target: ATXN1; (+) strand; PAM type: YTN; PAM sequence: CTC
cagagatggctgtatttcag

SEQ ID NO: 283028 - DNA, 20 bp, Artificial Sequence
  Description of Artificial Sequence: Synthetic oligonucleotide
  Target: ATXN1; (+) strand; PAM type: YTN; PAM sequence: CTG
tatttcagtggcaagtgaag

SEQ ID NO: 283029 - DNA, 20 bp, Artificial Sequence
  Description of Artificial Sequence: Synthetic oligonucleotide
  Target: ATXN1; (+) strand; PAM type: YTN; PAM sequence: TTT
cagtggcaagtgaagtgatg

SEQ ID NO: 283030 - DNA, 20 bp, Artificial Sequence
  Description of Artificial Sequence: Synthetic oligonucleotide
  Target: ATXN1; (+) strand; PAM type: YTN; PAM sequence: TTC
agtggcaagtgaagtgatga

SEQ ID NO: 283031 - DNA, 20 bp, Artificial Sequence
  Description of Artificial Sequence: Synthetic oligonucleotide
  Target: ATXN1; (+) strand; PAM type: YTN; PAM sequence: CTC
tgtgtcatcgaaatactcat

SEQ ID NO: 283032 - DNA, 20 bp, Artificial Sequence
  Description of Artificial Sequence: Synthetic oligonucleotide
  Target: ATXN1; (+) strand; PAM type: YTN; PAM sequence: CTG
tgtcatcgaaatactcattt

SEQ ID NO: 283033 - DNA, 20 bp, Artificial Sequence
  Description of Artificial Sequence: Synthetic oligonucleotide
  Target: ATXN1; (+) strand; PAM type: YTN; PAM sequence: CTC
atttaaggggttaagcatct

SEQ ID NO: 283034 - DNA, 20 bp, Artificial Sequence
  Description of Artificial Sequence: Synthetic oligonucleotide
  Target: ATXN1; (+) strand; PAM type: YTN; PAM sequence: TTT
aaggggttaagcatctggaa

SEQ ID NO: 283035 - DNA, 20 bp, Artificial Sequence
  Description of Artificial Sequence: Synthetic oligonucleotide
  Target: ATXN1; (+) strand; PAM type: YTN; PAM sequence: TTA
aggggttaagcatctggaag

SEQ ID NO: 283036 - DNA, 20 bp, Artificial Sequence
  Description of Artificial Sequence: Synthetic oligonucleotide
  Target: ATXN1; (+) strand; PAM type: YTN; PAM sequence: TTA
agcatctggaagagggttgc

SEQ ID NO: 283037 - DNA, 20 bp, Artificial Sequence
  Description of Artificial Sequence: Synthetic oligonucleotide
  Target: ATXN1; (+) strand; PAM type: YTN; PAM sequence: CTG
gaagagggttgcctttgtgc

SEQ ID NO: 283038 - DNA, 20 bp, Artificial Sequence
  Description of Artificial Sequence: Synthetic oligonucleotide
  Target: ATXN1; (+) strand; PAM type: YTN; PAM sequence: TTG
cctttgtgcatgaacagagt

SEQ ID NO: 283039 - DNA, 20 bp, Artificial Sequence
  Description of Artificial Sequence: Synthetic oligonucleotide
  Target: ATXN1; (+) strand; PAM type: YTN; PAM sequence: CTT
tgtgcatgaacagagtgttt

SEQ ID NO: 283040 - DNA, 20 bp, Artificial Sequence
  Description of Artificial Sequence: Synthetic oligonucleotide
  Target: ATXN1; (+) strand; PAM type: YTN; PAM sequence: TTT
gtgcatgaacagagtgtttt

SEQ ID NO: 283041 - DNA, 20 bp, Artificial Sequence
  Description of Artificial Sequence: Synthetic oligonucleotide
  Target: ATXN1; (+) strand; PAM type: YTN; PAM sequence: TTG
tgcatgaacagagtgttttt

SEQ ID NO: 283042 - DNA, 20 bp, Artificial Sequence
  Description of Artificial Sequence: Synthetic oligonucleotide
  Target: ATXN1; (+) strand; PAM type: YTN; PAM sequence: TTT
ttgttttggtttgttttatt

SEQ ID NO: 283043 - DNA, 20 bp, Artificial Sequence
  Description of Artificial Sequence: Synthetic oligonucleotide
  Target: ATXN1; (+) strand; PAM type: YTN; PAM sequence: TTT
tgttttggtttgttttattg

SEQ ID NO: 283044 - DNA, 20 bp, Artificial Sequence
  Description of Artificial Sequence: Synthetic oligonucleotide
  Target: ATXN1; (+) strand; PAM type: YTN; PAM sequence: TTT
gttttggtttgttttattgt

SEQ ID NO: 283045 - DNA, 20 bp, Artificial Sequence
  Description of Artificial Sequence: Synthetic oligonucleotide
  Target: ATXN1; (+) strand; PAM type: YTN; PAM sequence: TTG
ttttggtttgttttattgtc

SEQ ID NO: 283046 - DNA, 20 bp, Artificial Sequence
  Description of Artificial Sequence: Synthetic oligonucleotide
  Target: ATXN1; (+) strand; PAM type: YTN; PAM sequence: TTT
tggtttgttttattgtctat

SEQ ID NO: 283047 - DNA, 20 bp, Artificial Sequence
  Description of Artificial Sequence: Synthetic oligonucleotide
  Target: ATXN1; (+) strand; PAM type: YTN; PAM sequence: TTT
ggtttgttttattgtctatc

SEQ ID NO: 283048 - DNA, 20 bp, Artificial Sequence
  Description of Artificial Sequence: Synthetic oligonucleotide
  Target: ATXN1; (+) strand; PAM type: YTN; PAM sequence: TTG
gtttgttttattgtctatcc

SEQ ID NO: 283049 - DNA, 20 bp, Artificial Sequence
  Description of Artificial Sequence: Synthetic oligonucleotide
  Target: ATXN1; (+) strand; PAM type: YTN; PAM sequence: TTT
gttttattgtctatcctgga

SEQ ID NO: 283050 - DNA, 20 bp, Artificial Sequence
  Description of Artificial Sequence: Synthetic oligonucleotide
  Target: ATXN1; (+) strand; PAM type: YTN; PAM sequence: TTG
ttttattgtctatcctggag

SEQ ID NO: 283051 - DNA, 20 bp, Artificial Sequence
  Description of Artificial Sequence: Synthetic oligonucleotide
  Target: ATXN1; (+) strand; PAM type: YTN; PAM sequence: TTT
tattgtctatcctggagaag

SEQ ID NO: 283052 - DNA, 20 bp, Artificial Sequence
  Description of Artificial Sequence: Synthetic oligonucleotide
  Target: ATXN1; (+) strand; PAM type: YTN; PAM sequence: TTT
attgtctatcctggagaagg

SEQ ID NO: 283053 - DNA, 20 bp, Artificial Sequence
  Description of Artificial Sequence: Synthetic oligonucleotide
  Target: ATXN1; (+) strand; PAM type: YTN; PAM sequence: TTA
ttgtctatcctggagaagga

SEQ ID NO: 283054 - DNA, 20 bp, Artificial Sequence
  Description of Artificial Sequence: Synthetic oligonucleotide
  Target: ATXN1; (+) strand; PAM type: YTN; PAM sequence: TTG
tctatcctggagaaggaggt

SEQ ID NO: 283055 - DNA, 20 bp, Artificial Sequence
  Description of Artificial Sequence: Synthetic oligonucleotide
  Target: ATXN1; (+) strand; PAM type: YTN; PAM sequence: CTA
tcctggagaaggaggtcatt

SEQ ID NO: 283056 - DNA, 20 bp, Artificial Sequence
  Description of Artificial Sequence: Synthetic oligonucleotide
  Target: ATXN1; (+) strand; PAM type: YTN; PAM sequence: CTG
gagaaggaggtcattagctc

SEQ ID NO: 283057 - DNA, 20 bp, Artificial Sequence
  Description of Artificial Sequence: Synthetic oligonucleotide
  Target: ATXN1; (+) strand; PAM type: YTN; PAM sequence: TTA
gctccacctgagcaagatgg

SEQ ID NO: 283058 - DNA, 20 bp, Artificial Sequence
  Description of Artificial Sequence: Synthetic oligonucleotide
  Target: ATXN1; (+) strand; PAM type: YTN; PAM sequence: CTC
cacctgagcaagatggaaga

SEQ ID NO: 283059 - DNA, 20 bp, Artificial Sequence
  Description of Artificial Sequence: Synthetic oligonucleotide
  Target: ATXN1; (+) strand; PAM type: YTN; PAM sequence: CTG
agcaagatggaagacacaca

SEQ ID NO: 283060 - DNA, 20 bp, Artificial Sequence
  Description of Artificial Sequence: Synthetic oligonucleotide
  Target: ATXN1; (+) strand; PAM type: YTN; PAM sequence: CTC
tatgcagccactaaaatgca

SEQ ID NO: 283061 - DNA, 20 bp, Artificial Sequence
  Description of Artificial Sequence: Synthetic oligonucleotide
  Target: ATXN1; (+) strand; PAM type: YTN; PAM sequence: CTA
tgcagccactaaaatgcacg

SEQ ID NO: 283062 - DNA, 20 bp, Artificial Sequence
  Description of Artificial Sequence: Synthetic oligonucleotide
  Target: ATXN1; (+) strand; PAM type: YTN; PAM sequence: CTA
aaatgcacggggaaaacaga

SEQ ID NO: 283063 - DNA, 20 bp, Artificial Sequence
  Description of Artificial Sequence: Synthetic oligonucleotide
  Target: ATXN1; (+) strand; PAM type: YTN; PAM sequence: CTT
ttcataggttcttttccaca

SEQ ID NO: 283064 - DNA, 20 bp, Artificial Sequence
  Description of Artificial Sequence: Synthetic oligonucleotide
  Target: ATXN1; (+) strand; PAM type: YTN; PAM sequence: TTT
tcataggttcttttccacag

SEQ ID NO: 283065 - DNA, 20 bp, Artificial Sequence
  Description of Artificial Sequence: Synthetic oligonucleotide
  Target: ATXN1; (+) strand; PAM type: YTN; PAM sequence: TTT
cataggttcttttccacagg

SEQ ID NO: 283066 - DNA, 20 bp, Artificial Sequence
  Description of Artificial Sequence: Synthetic oligonucleotide
  Target: ATXN1; (+) strand; PAM type: YTN; PAM sequence: TTC
ataggttcttttccacaggg

SEQ ID NO: 283067 - DNA, 20 bp, Artificial Sequence
  Description of Artificial Sequence: Synthetic oligonucleotide
  Target: ATXN1; (+) strand; PAM type: YTN; PAM sequence: TTC
ttttccacagggacttcaaa

SEQ ID NO: 283068 - DNA, 20 bp, Artificial Sequence
  Description of Artificial Sequence: Synthetic oligonucleotide
  Target: ATXN1; (+) strand; PAM type: YTN; PAM sequence: CTT
ttccacagggacttcaaagt

SEQ ID NO: 283069 - DNA, 20 bp, Artificial Sequence
  Description of Artificial Sequence: Synthetic oligonucleotide
  Target: ATXN1; (+) strand; PAM type: YTN; PAM sequence: TTT
tccacagggacttcaaagtc

SEQ ID NO: 283070 - DNA, 20 bp, Artificial Sequence
  Description of Artificial Sequence: Synthetic oligonucleotide
  Target: ATXN1; (+) strand; PAM type: YTN; PAM sequence: TTT
ccacagggacttcaaagtct

SEQ ID NO: 283071 - DNA, 20 bp, Artificial Sequence
  Description of Artificial Sequence: Synthetic oligonucleotide
  Target: ATXN1; (+) strand; PAM type: YTN; PAM sequence: TTC
cacagggacttcaaagtctt

SEQ ID NO: 283072 - DNA, 20 bp, Artificial Sequence
  Description of Artificial Sequence: Synthetic oligonucleotide
  Target: ATXN1; (+) strand; PAM type: YTN; PAM sequence: CTT
caaagtcttaaagcatcaag

SEQ ID NO: 283073 - DNA, 20 bp, Artificial Sequence
  Description of Artificial Sequence: Synthetic oligonucleotide
  Target: ATXN1; (+) strand; PAM type: YTN; PAM sequence: TTC
aaagtcttaaagcatcaagg

SEQ ID NO: 283074 - DNA, 20 bp, Artificial Sequence
  Description of Artificial Sequence: Synthetic oligonucleotide
  Target: ATXN1; (+) strand; PAM type: YTN; PAM sequence: CTT
aaagcatcaaggttgcaaaa

SEQ ID NO: 283075 - DNA, 20 bp, Artificial Sequence
  Description of Artificial Sequence: Synthetic oligonucleotide
  Target: ATXN1; (+) strand; PAM type: YTN; PAM sequence: TTA
aagcatcaaggttgcaaaat

SEQ ID NO: 283076 - DNA, 20 bp, Artificial Sequence
  Description of Artificial Sequence: Synthetic oligonucleotide
  Target: ATXN1; (+) strand; PAM type: YTN; PAM sequence: TTG
caaaatgatggtaattttta

SEQ ID NO: 283077 - DNA, 20 bp, Artificial Sequence
  Description of Artificial Sequence: Synthetic oligonucleotide
  Target: ATXN1; (+) strand; PAM type: YTN; PAM sequence: TTT
ttagaggtggaagaaacctc

SEQ ID NO: 283078 - DNA, 20 bp, Artificial Sequence
  Description of Artificial Sequence: Synthetic oligonucleotide
  Target: ATXN1; (+) strand; PAM type: YTN; PAM sequence: TTT
tagaggtggaagaaacctct

SEQ ID NO: 283079 - DNA, 20 bp, Artificial Sequence
  Description of Artificial Sequence: Synthetic oligonucleotide
  Target: ATXN1; (+) strand; PAM type: YTN; PAM sequence: TTT
agaggtggaagaaacctctg

SEQ ID NO: 283080 - DNA, 20 bp, Artificial Sequence
  Description of Artificial Sequence: Synthetic oligonucleotide
  Target: ATXN1; (+) strand; PAM type: YTN; PAM sequence: TTA
gaggtggaagaaacctctga

SEQ ID NO: 283081 - DNA, 20 bp, Artificial Sequence
  Description of Artificial Sequence: Synthetic oligonucleotide
  Target: ATXN1; (+) strand; PAM type: YTN; PAM sequence: CTC
tgagagcaaaccactcatgt

SEQ ID NO: 283082 - DNA, 20 bp, Artificial Sequence
  Description of Artificial Sequence: Synthetic oligonucleotide
  Target: ATXN1; (+) strand; PAM type: YTN; PAM sequence: CTG
agagcaaaccactcatgtta

SEQ ID NO: 283083 - DNA, 20 bp, Artificial Sequence
  Description of Artificial Sequence: Synthetic oligonucleotide
  Target: ATXN1; (+) strand; PAM type: YTN; PAM sequence: CTC
atgttacagatggagaactt

SEQ ID NO: 283084 - DNA, 20 bp, Artificial Sequence
  Description of Artificial Sequence: Synthetic oligonucleotide
  Target: ATXN1; (+) strand; PAM type: YTN; PAM sequence: TTA
cagatggagaacttggaagc

SEQ ID NO: 283085 - DNA, 20 bp, Artificial Sequence
  Description of Artificial Sequence: Synthetic oligonucleotide
  Target: ATXN1; (+) strand; PAM type: YTN; PAM sequence: CTT
ggaagcacagggtcactgag

SEQ ID NO: 283086 - DNA, 20 bp, Artificial Sequence
  Description of Artificial Sequence: Synthetic oligonucleotide
  Target: ATXN1; (+) strand; PAM type: YTN; PAM sequence: TTG
gaagcacagggtcactgagt

SEQ ID NO: 283087 - DNA, 20 bp, Artificial Sequence
  Description of Artificial Sequence: Synthetic oligonucleotide
  Target: ATXN1; (+) strand; PAM type: YTN; PAM sequence: CTG
agtaccttggtcaaagcccc

SEQ ID NO: 283088 - DNA, 20 bp, Artificial Sequence
  Description of Artificial Sequence: Synthetic oligonucleotide
  Target: ATXN1; (+) strand; PAM type: YTN; PAM sequence: CTT
ggtcaaagcccccccccccc

SEQ ID NO: 283089 - DNA, 20 bp, Artificial Sequence
  Description of Artificial Sequence: Synthetic oligonucleotide
  Target: ATXN1; (+) strand; PAM type: YTN; PAM sequence: TTG
gtcaaagcccccccccccca

SEQ ID NO: 283090 - DNA, 20 bp, Artificial Sequence
  Description of Artificial Sequence: Synthetic oligonucleotide
  Target: ATXN1; (+) strand; PAM type: YTN; PAM sequence: TTC
attcccaagtccaagggcgt

SEQ ID NO: 283091 - DNA, 20 bp, Artificial Sequence
  Description of Artificial Sequence: Synthetic oligonucleotide
  Target: ATXN1; (+) strand; PAM type: YTN; PAM sequence: TTC
ccaagtccaagggcgtttca

SEQ ID NO: 283092 - DNA, 20 bp, Artificial Sequence
  Description of Artificial Sequence: Synthetic oligonucleotide
  Target: ATXN1; (+) strand; PAM type: YTN; PAM sequence: TTT
cacttgaattttgaatttgg

SEQ ID NO: 283093 - DNA, 20 bp, Artificial Sequence
  Description of Artificial Sequence: Synthetic oligonucleotide
  Target: ATXN1; (+) strand; PAM type: YTN; PAM sequence: TTC
acttgaattttgaatttggc

SEQ ID NO: 283094 - DNA, 20 bp, Artificial Sequence
  Description of Artificial Sequence: Synthetic oligonucleotide
  Target: ATXN1; (+) strand; PAM type: YTN; PAM sequence: CTT
gaattttgaatttggcttta

SEQ ID NO: 283095 - DNA, 20 bp, Artificial Sequence
  Description of Artificial Sequence: Synthetic oligonucleotide
  Target: ATXN1; (+) strand; PAM type: YTN; PAM sequence: TTG
aattttgaatttggctttat

SEQ ID NO: 283096 - DNA, 20 bp, Artificial Sequence
  Description of Artificial Sequence: Synthetic oligonucleotide
  Target: ATXN1; (+) strand; PAM type: YTN; PAM sequence: TTT
tgaatttggctttatctgca

SEQ ID NO: 283097 - DNA, 20 bp, Artificial Sequence
  Description of Artificial Sequence: Synthetic oligonucleotide
  Target: ATXN1; (+) strand; PAM type: YTN; PAM sequence: TTT
gaatttggctttatctgcag

SEQ ID NO: 283098 - DNA, 20 bp, Artificial Sequence
  Description of Artificial Sequence: Synthetic oligonucleotide
  Target: ATXN1; (+) strand; PAM type: YTN; PAM sequence: TTG
aatttggctttatctgcaga

SEQ ID NO: 283099 - DNA, 20 bp, Artificial Sequence
  Description of Artificial Sequence: Synthetic oligonucleotide
  Target: ATXN1; (+) strand; PAM type: YTN; PAM sequence: TTT
ggctttatctgcagacacac

SEQ ID NO: 283100 - DNA, 20 bp, Artificial Sequence
  Description of Artificial Sequence: Synthetic oligonucleotide
  Target: ATXN1; (+) strand; PAM type: YTN; PAM sequence: TTG
gctttatctgcagacacact

SEQ ID NO: 283101 - DNA, 20 bp, Artificial Sequence
  Description of Artificial Sequence: Synthetic oligonucleotide
  Target: ATXN1; (+) strand; PAM type: YTN; PAM sequence: CTT
tatctgcagacacactcaga

SEQ ID NO: 283102 - DNA, 20 bp, Artificial Sequence
  Description of Artificial Sequence: Synthetic oligonucleotide
  Target: ATXN1; (+) strand; PAM type: YTN; PAM sequence: TTT
atctgcagacacactcagag

SEQ ID NO: 283103 - DNA, 20 bp, Artificial Sequence
  Description of Artificial Sequence: Synthetic oligonucleotide
  Target: ATXN1; (+) strand; PAM type: YTN; PAM sequence: TTA
tctgcagacacactcagagt

SEQ ID NO: 283104 - DNA, 20 bp, Artificial Sequence
  Description of Artificial Sequence: Synthetic oligonucleotide
  Target: ATXN1; (+) strand; PAM type: YTN; PAM sequence: CTG
cagacacactcagagtatca

SEQ ID NO: 283105 - DNA, 20 bp, Artificial Sequence
  Description of Artificial Sequence: Synthetic oligonucleotide
  Target: ATXN1; (+) strand; PAM type: YTN; PAM sequence: CTC
agagtatcacatctccgtca

SEQ ID NO: 283106 - DNA, 20 bp, Artificial Sequence
  Description of Artificial Sequence: Synthetic oligonucleotide
  Target: ATXN1; (+) strand; PAM type: YTN; PAM sequence: CTC
cgtcagtcaagtcaagcaca

SEQ ID NO: 283107 - DNA, 20 bp, Artificial Sequence
  Description of Artificial Sequence: Synthetic oligonucleotide
  Target: ATXN1; (+) strand; PAM type: YTN; PAM sequence: CTT
ctaaagcacacggcatcagc

SEQ ID NO: 283108 - DNA, 20 bp, Artificial Sequence
  Description of Artificial Sequence: Synthetic oligonucleotide
  Target: ATXN1; (+) strand; PAM type: YTN; PAM sequence: TTC
taaagcacacggcatcagca

SEQ ID NO: 283109 - DNA, 20 bp, Artificial Sequence
  Description of Artificial Sequence: Synthetic oligonucleotide
  Target: ATXN1; (+) strand; PAM type: YTN; PAM sequence: CTA
aagcacacggcatcagcact

SEQ ID NO: 283110 - DNA, 20 bp, Artificial Sequence
  Description of Artificial Sequence: Synthetic oligonucleotide
  Target: ATXN1; (+) strand; PAM type: YTN; PAM sequence: CTG
aattcttgttttgtttggct

SEQ ID NO: 283111 - DNA, 20 bp, Artificial Sequence
  Description of Artificial Sequence: Synthetic oligonucleotide
  Target: ATXN1; (+) strand; PAM type: YTN; PAM sequence: TTC
ttgttttgtttggctatgtt

SEQ ID NO: 283112 - DNA, 20 bp, Artificial Sequence
  Description of Artificial Sequence: Synthetic oligonucleotide
  Target: ATXN1; (+) strand; PAM type: YTN; PAM sequence: CTT
gttttgtttggctatgttta

SEQ ID NO: 283113 - DNA, 20 bp, Artificial Sequence
  Description of Artificial Sequence: Synthetic oligonucleotide
  Target: ATXN1; (+) strand; PAM type: YTN; PAM sequence: TTG
ttttgtttggctatgtttat

SEQ ID NO: 283114 - DNA, 20 bp, Artificial Sequence
  Description of Artificial Sequence: Synthetic oligonucleotide
  Target: ATXN1; (+) strand; PAM type: YTN; PAM sequence: TTT
tgtttggctatgtttatttg

SEQ ID NO: 283115 - DNA, 20 bp, Artificial Sequence
  Description of Artificial Sequence: Synthetic oligonucleotide
  Target: ATXN1; (+) strand; PAM type: YTN; PAM sequence: TTT
gtttggctatgtttatttgt

SEQ ID NO: 283116 - DNA, 20 bp, Artificial Sequence
  Description of Artificial Sequence: Synthetic oligonucleotide
  Target: ATXN1; (+) strand; PAM type: YTN; PAM sequence: TTG
tttggctatgtttatttgtt

SEQ ID NO: 283117 - DNA, 20 bp, Artificial Sequence
  Description of Artificial Sequence: Synthetic oligonucleotide
  Target: ATXN1; (+) strand; PAM type: YTN; PAM sequence: TTT
ggctatgtttatttgtttag

SEQ ID NO: 283118 - DNA, 20 bp, Artificial Sequence
  Description of Artificial Sequence: Synthetic oligonucleotide
  Target: ATXN1; (+) strand; PAM type: YTN; PAM sequence: TTG
gctatgtttatttgtttagg

SEQ ID NO: 283119 - DNA, 20 bp, Artificial Sequence
  Description of Artificial Sequence: Synthetic oligonucleotide
  Target: ATXN1; (+) strand; PAM type: YTN; PAM sequence: CTA
tgtttatttgtttaggtact

SEQ ID NO: 283120 - DNA, 20 bp, Artificial Sequence
  Description of Artificial Sequence: Synthetic oligonucleotide
  Target: ATXN1; (+) strand; PAM type: YTN; PAM sequence: TTT
atttgtttaggtactcagga

SEQ ID NO: 283121 - DNA, 20 bp, Artificial Sequence
  Description of Artificial Sequence: Synthetic oligonucleotide
  Target: ATXN1; (+) strand; PAM type: YTN; PAM sequence: TTA
tttgtttaggtactcaggaa

SEQ ID NO: 283122 - DNA, 20 bp, Artificial Sequence
  Description of Artificial Sequence: Synthetic oligonucleotide
  Target: ATXN1; (+) strand; PAM type: YTN; PAM sequence: TTT
gtttaggtactcaggaaaat

SEQ ID NO: 283123 - DNA, 20 bp, Artificial Sequence
  Description of Artificial Sequence: Synthetic oligonucleotide
  Target: ATXN1; (+) strand; PAM type: YTN; PAM sequence: TTG
tttaggtactcaggaaaatc

SEQ ID NO: 283124 - DNA, 20 bp, Artificial Sequence
  Description of Artificial Sequence: Synthetic oligonucleotide
  Target: ATXN1; (+) strand; PAM type: YTN; PAM sequence: TTT
aggtactcaggaaaatctcc

SEQ ID NO: 283125 - DNA, 20 bp, Artificial Sequence
  Description of Artificial Sequence: Synthetic oligonucleotide
  Target: ATXN1; (+) strand; PAM type: YTN; PAM sequence: TTA
ggtactcaggaaaatctcca

SEQ ID NO: 283126 - DNA, 20 bp, Artificial Sequence
  Description of Artificial Sequence: Synthetic oligonucleotide
  Target: ATXN1; (+) strand; PAM type: YTN; PAM sequence: CTC
aggaaaatctccaccaggaa

SEQ ID NO: 283127 - DNA, 20 bp, Artificial Sequence
  Description of Artificial Sequence: Synthetic oligonucleotide
  Target: ATXN1; (+) strand; PAM type: YTN; PAM sequence: CTC
caccaggaaaaaatacaggg

SEQ ID NO: 283128 - DNA, 20 bp, Artificial Sequence
  Description of Artificial Sequence: Synthetic oligonucleotide
  Target: ATXN1; (+) strand; PAM type: YTN; PAM sequence: TTG
aacagagggggaacagaaca

SEQ ID NO: 283129 - DNA, 20 bp, Artificial Sequence
  Description of Artificial Sequence: Synthetic oligonucleotide
  Target: ATXN1; (+) strand; PAM type: YTN; PAM sequence: TTT
attgagcattgactatgtgc

SEQ ID NO: 283130 - DNA, 20 bp, Artificial Sequence
  Description of Artificial Sequence: Synthetic oligonucleotide
  Target: ATXN1; (+) strand; PAM type: YTN; PAM sequence: TTA
ttgagcattgactatgtgcc

SEQ ID NO: 283131 - DNA, 20 bp, Artificial Sequence
  Description of Artificial Sequence: Synthetic oligonucleotide
  Target: ATXN1; (+) strand; PAM type: YTN; PAM sequence: TTG
agcattgactatgtgccagg

SEQ ID NO: 283132 - DNA, 20 bp, Artificial Sequence
  Description of Artificial Sequence: Synthetic oligonucleotide
  Target: ATXN1; (+) strand; PAM type: YTN; PAM sequence: TTG
actatgtgccaggccaggca

SEQ ID NO: 283133 - DNA, 20 bp, Artificial Sequence
  Description of Artificial Sequence: Synthetic oligonucleotide
  Target: ATXN1; (+) strand; PAM type: YTN; PAM sequence: CTA
tgtgccaggccaggcaatgt

SEQ ID NO: 283134 - DNA, 20 bp, Artificial Sequence
  Description of Artificial Sequence: Synthetic oligonucleotide
  Target: ATXN1; (+) strand; PAM type: YTN; PAM sequence: TTC
tcaggtttatatgtatacaa

SEQ ID NO: 283135 - DNA, 20 bp, Artificial Sequence
  Description of Artificial Sequence: Synthetic oligonucleotide
  Target: ATXN1; (+) strand; PAM type: YTN; PAM sequence: CTC
aggtttatatgtatacaatt

SEQ ID NO: 283136 - DNA, 20 bp, Artificial Sequence
  Description of Artificial Sequence: Synthetic oligonucleotide
  Target: ATXN1; (+) strand; PAM type: YTN; PAM sequence: TTT
atatgtatacaattctgaca

SEQ ID NO: 283137 - DNA, 20 bp, Artificial Sequence
  Description of Artificial Sequence: Synthetic oligonucleotide
  Target: ATXN1; (+) strand; PAM type: YTN; PAM sequence: TTA
tatgtatacaattctgacag

SEQ ID NO: 283138 - DNA, 20 bp, Artificial Sequence
  Description of Artificial Sequence: Synthetic oligonucleotide
  Target: ATXN1; (+) strand; PAM type: YTN; PAM sequence: TTC
tgacagtggctctgtggctc

SEQ ID NO: 283139 - DNA, 20 bp, Artificial Sequence
  Description of Artificial Sequence: Synthetic oligonucleotide
  Target: ATXN1; (+) strand; PAM type: YTN; PAM sequence: CTG
acagtggctctgtggctccc

SEQ ID NO: 283140 - DNA, 20 bp, Artificial Sequence
  Description of Artificial Sequence: Synthetic oligonucleotide
  Target: ATXN1; (+) strand; PAM type: YTN; PAM sequence: CTC
tgtggctcccattttagaga

SEQ ID NO: 283141 - DNA, 20 bp, Artificial Sequence
  Description of Artificial Sequence: Synthetic oligonucleotide
  Target: ATXN1; (+) strand; PAM type: YTN; PAM sequence: CTG
tggctcccattttagagaga

SEQ ID NO: 283142 - DNA, 20 bp, Artificial Sequence
  Description of Artificial Sequence: Synthetic oligonucleotide
  Target: ATXN1; (+) strand; PAM type: YTN; PAM sequence: CTC
ccattttagagagagagaga

SEQ ID NO: 283143 - DNA, 20 bp, Artificial Sequence
  Description of Artificial Sequence: Synthetic oligonucleotide
  Target: ATXN1; (+) strand; PAM type: YTN; PAM sequence: TTT
tagagagagagagagagaga

SEQ ID NO: 283144 - DNA, 20 bp, Artificial Sequence
  Description of Artificial Sequence: Synthetic oligonucleotide
  Target: ATXN1; (+) strand; PAM type: YTN; PAM sequence: TTT
agagagagagagagagagaa

SEQ ID NO: 283145 - DNA, 20 bp, Artificial Sequence
  Description of Artificial Sequence: Synthetic oligonucleotide
  Target: ATXN1; (+) strand; PAM type: YTN; PAM sequence: TTA
gagagagagagagagagaag

SEQ ID NO: 283146 - DNA, 20 bp, Artificial Sequence
  Description of Artificial Sequence: Synthetic oligonucleotide
  Target: ATXN1; (+) strand; PAM type: YTN; PAM sequence: TTA
ttttggaagagaaaacaaga

SEQ ID NO: 283147 - DNA, 20 bp, Artificial Sequence
  Description of Artificial Sequence: Synthetic oligonucleotide
  Target: ATXN1; (+) strand; PAM type: YTN; PAM sequence: TTT
tggaagagaaaacaagaggg

SEQ ID NO: 283148 - DNA, 20 bp, Artificial Sequence
  Description of Artificial Sequence: Synthetic oligonucleotide
  Target: ATXN1; (+) strand; PAM type: YTN; PAM sequence: TTT
ggaagagaaaacaagaggga

SEQ ID NO: 283149 - DNA, 20 bp, Artificial Sequence
  Description of Artificial Sequence: Synthetic oligonucleotide
  Target: ATXN1; (+) strand; PAM type: YTN; PAM sequence: TTG
gaagagaaaacaagagggac

SEQ ID NO: 283150 - DNA, 20 bp, Artificial Sequence
  Description of Artificial Sequence: Synthetic oligonucleotide
  Target: ATXN1; (+) strand; PAM type: YTN; PAM sequence: TTG
ccaactcaaaaaaaaactac

SEQ ID NO: 283151 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaactaccttccca

SEQ ID NO: 283152 - DNA, 20 bp, Artificial Sequence
  Description of Artificial Sequence: Synthetic oligonucleotide
  Target: ATXN1; (+) strand; PAM type: YTN; PAM sequence: CTA
ccttcccaaattttactaaa

SEQ ID NO: 283153 - DNA, 20 bp, Artificial Sequence
  Description of Artificial Sequence: Synthetic oligonucleotide
  Target: ATXN1; (+) strand; PAM type: YTN; PAM sequence: CTT
cccaaattttactaaaacat

SEQ ID NO: 283154 - DNA, 20 bp, Artificial Sequence
  Description of Artificial Sequence: Synthetic oligonucleotide
  Target: ATXN1; (+) strand; PAM type: YTN; PAM sequence: TTC
ccaaattttactaaaacatt

SEQ ID NO: 283155 - DNA, 20 bp, Artificial Sequence
  Description of Artificial Sequence: Synthetic oligonucleotide
  Target: ATXN1; (+) strand; PAM type: YTN; PAM sequence: TTT
tactaaaacattcagcaaaa

SEQ ID NO: 283156 - DNA, 20 bp, Artificial Sequence
  Description of Artificial Sequence: Synthetic oligonucleotide
  Target: ATXN1; (+) strand; PAM type: YTN; PAM sequence: TTT
actaaaacattcagcaaaaa

SEQ ID NO: 283157 - DNA, 20 bp, Artificial Sequence
  Description of Artificial Sequence: Synthetic oligonucleotide
  Target: ATXN1; (+) strand; PAM type: YTN; PAM sequence: TTA
ctaaaacattcagcaaaaat

SEQ ID NO: 283158 - DNA, 20 bp, Artificial Sequence
  Description of Artificial Sequence: Synthetic oligonucleotide
  Target: ATXN1; (+) strand; PAM type: YTN; PAM sequence: CTA
aaacattcagcaaaaatcta

SEQ ID NO: 283159 - DNA, 20 bp, Artificial Sequence
  Description of Artificial Sequence: Synthetic oligonucleotide
  Target: ATXN1; (+) strand; PAM type: YTN; PAM sequence: TTC
agcaaaaatctaaaaaatta

SEQ ID NO: 283160 - DNA, 20 bp, Artificial Sequence
  Description of Artificial Sequence: Synthetic oligonucleotide
  Target: ATXN1; (+) strand; PAM type: YTN; PAM sequence: CTA
aaaaattaccagtgatatac

SEQ ID NO: 283161 - DNA, 20 bp, Artificial Sequence
  Description of Artificial Sequence: Synthetic oligonucleotide
  Target: ATXN1; (+) strand; PAM type: YTN; PAM sequence: TTA
ccagtgatatacttctcact

SEQ ID NO: 283162 - DNA, 20 bp, Artificial Sequence
  Description of Artificial Sequence: Synthetic oligonucleotide
  Target: ATXN1; (+) strand; PAM type: YTN; PAM sequence: CTT
ctcacttattctgaagagat

SEQ ID NO: 283163 - DNA, 20 bp, Artificial Sequence
  Description of Artificial Sequence: Synthetic oligonucleotide
  Target: ATXN1; (+) strand; PAM type: YTN; PAM sequence: TTC
tcacttattctgaagagatg

SEQ ID NO: 283164 - DNA, 20 bp, Artificial Sequence
  Description of Artificial Sequence: Synthetic oligonucleotide
  Target: ATXN1; (+) strand; PAM type: YTN; PAM sequence: CTC
acttattctgaagagatgat

SEQ ID NO: 283165 - DNA, 20 bp, Artificial Sequence
  Description of Artificial Sequence: Synthetic oligonucleotide
  Target: ATXN1; (+) strand; PAM type: YTN; PAM sequence: CTT
attctgaagagatgatcctt

SEQ ID NO: 283166 - DNA, 20 bp, Artificial Sequence
  Description of Artificial Sequence: Synthetic oligonucleotide
  Target: ATXN1; (+) strand; PAM type: YTN; PAM sequence: TTA
ttctgaagagatgatccttc

SEQ ID NO: 283167 - DNA, 20 bp, Artificial Sequence
  Description of Artificial Sequence: Synthetic oligonucleotide
  Target: ATXN1; (+) strand; PAM type: YTN; PAM sequence: TTC
tgaagagatgatccttctta

SEQ ID NO: 283168 - DNA, 20 bp, Artificial Sequence
  Description of Artificial Sequence: Synthetic oligonucleotide
  Target: ATXN1; (+) strand; PAM type: YTN; PAM sequence: CTG
aagagatgatccttcttaat

SEQ ID NO: 283169 - DNA, 20 bp, Artificial Sequence
  Description of Artificial Sequence: Synthetic oligonucleotide
  Target: ATXN1; (+) strand; PAM type: YTN; PAM sequence: CTT
cttaatacttttggcatata

SEQ ID NO: 283170 - DNA, 20 bp, Artificial Sequence
  Description of Artificial Sequence: Synthetic oligonucleotide
  Target: ATXN1; (+) strand; PAM type: YTN; PAM sequence: TTC
ttaatacttttggcatatag

SEQ ID NO: 283171 - DNA, 20 bp, Artificial Sequence
  Description of Artificial Sequence: Synthetic oligonucleotide
  Target: ATXN1; (+) strand; PAM type: YTN; PAM sequence: CTT
aatacttttggcatatagct

SEQ ID NO: 283172 - DNA, 20 bp, Artificial Sequence
  Description of Artificial Sequence: Synthetic oligonucleotide
  Target: ATXN1; (+) strand; PAM type: YTN; PAM sequence: TTA
atacttttggcatatagctg

SEQ ID NO: 283173 - DNA, 20 bp, Artificial Sequence
  Description of Artificial Sequence: Synthetic oligonucleotide
  Target: ATXN1; (+) strand; PAM type: YTN; PAM sequence: CTT
ttggcatatagctgcttctt

SEQ ID NO: 283174 - DNA, 20 bp, Artificial Sequence
  Description of Artificial Sequence: Synthetic oligonucleotide
  Target: ATXN1; (+) strand; PAM type: YTN; PAM sequence: TTT
tggcatatagctgcttcttg

SEQ ID NO: 283175 - DNA, 20 bp, Artificial Sequence
  Description of Artificial Sequence: Synthetic oligonucleotide
  Target: ATXN1; (+) strand; PAM type: YTN; PAM sequence: TTT
ggcatatagctgcttcttgc

SEQ ID NO: 283176 - DNA, 20 bp, Artificial Sequence
  Description of Artificial Sequence: Synthetic oligonucleotide
  Target: ATXN1; (+) strand; PAM type: YTN; PAM sequence: TTG
gcatatagctgcttcttgct

SEQ ID NO: 283177 - DNA, 20 bp, Artificial Sequence
  Description of Artificial Sequence: Synthetic oligonucleotide
  Target: ATXN1; (+) strand; PAM type: YTN; PAM sequence: CTG
cttcttgctaataaaaaaaa

SEQ ID NO: 283178 - DNA, 20 bp, Artificial Sequence
  Description of Artificial Sequence: Synthetic oligonucleotide
  Target: ATXN1; (+) strand; PAM type: YTN; PAM sequence: CTT
cttgctaataaaaaaaaagt

SEQ ID NO: 283179 - DNA, 20 bp, Artificial Sequence
  Description of Artificial Sequence: Synthetic oligonucleotide
  Target: ATXN1; (+) strand; PAM type: YTN; PAM sequence: TTC
ttgctaataaaaaaaaagta

SEQ ID NO: 283180 - DNA, 20 bp, Artificial Sequence
  Description of Artificial Sequence: Synthetic oligonucleotide
  Target: ATXN1; (+) strand; PAM type: YTN; PAM sequence: CTT
gctaataaaaaaaaagtact

SEQ ID NO: 283181 - DNA, 20 bp, Artificial Sequence
  Description of Artificial Sequence: Synthetic oligonucleotide
  Target: ATXN1; (+) strand; PAM type: YTN; PAM sequence: TTG
ctaataaaaaaaaagtactt

SEQ ID NO: 283182 - DNA, 20 bp, Artificial Sequence
  Description of Artificial Sequence: Synthetic oligonucleotide
  Target: ATXN1; (+) strand; PAM type: YTN; PAM sequence: CTA
ataaaaaaaaagtacttcca

SEQ ID NO: 283183 - DNA, 20 bp, Artificial Sequence
  Description of Artificial Sequence: Synthetic oligonucleotide
  Target: ATXN1; (+) strand; PAM type: YTN; PAM sequence: CTT
ccaagatgttctgtatatta

SEQ ID NO: 283184 - DNA, 20 bp, Artificial Sequence
  Description of Artificial Sequence: Synthetic oligonucleotide
  Target: ATXN1; (+) strand; PAM type: YTN; PAM sequence: TTC
caagatgttctgtatattat

SEQ ID NO: 283185 - DNA, 20 bp, Artificial Sequence
  Description of Artificial Sequence: Synthetic oligonucleotide
  Target: ATXN1; (+) strand; PAM type: YTN; PAM sequence: TTC
tgtatattatttccaaatct

SEQ ID NO: 283186 - DNA, 20 bp, Artificial Sequence
  Description of Artificial Sequence: Synthetic oligonucleotide
  Target: ATXN1; (+) strand; PAM type: YTN; PAM sequence: CTG
tatattatttccaaatctta

SEQ ID NO: 283187 - DNA, 20 bp, Artificial Sequence
  Description of Artificial Sequence: Synthetic oligonucleotide
  Target: ATXN1; (+) strand; PAM type: YTN; PAM sequence: TTA
tttccaaatcttataacagt

SEQ ID NO: 283188 - DNA, 20 bp, Artificial Sequence
  Description of Artificial Sequence: Synthetic oligonucleotide
  Target: ATXN1; (+) strand; PAM type: YTN; PAM sequence: TTT
ccaaatcttataacagttgt

SEQ ID NO: 283189 - DNA, 20 bp, Artificial Sequence
  Description of Artificial Sequence: Synthetic oligonucleotide
  Target: ATXN1; (+) strand; PAM type: YTN; PAM sequence: TTC
caaatcttataacagttgtt

SEQ ID NO: 283190 - DNA, 20 bp, Artificial Sequence
  Description of Artificial Sequence: Synthetic oligonucleotide
  Target: ATXN1; (+) strand; PAM type: YTN; PAM sequence: CTT
ataacagttgtttcaacaat

SEQ ID NO: 283191 - DNA, 20 bp, Artificial Sequence
  Description of Artificial Sequence: Synthetic oligonucleotide
  Target: ATXN1; (+) strand; PAM type: YTN; PAM sequence: TTA
taacagttgtttcaacaatc

SEQ ID NO: 283192 - DNA, 20 bp, Artificial Sequence
  Description of Artificial Sequence: Synthetic oligonucleotide
  Target: ATXN1; (+) strand; PAM type: YTN; PAM sequence: TTG
tttcaacaatcagtgaatga

SEQ ID NO: 283193 - DNA, 20 bp, Artificial Sequence
  Description of Artificial Sequence: Synthetic oligonucleotide
  Target: ATXN1; (+) strand; PAM type: YTN; PAM sequence: TTT
caacaatcagtgaatgaatg

SEQ ID NO: 283194 - DNA, 20 bp, Artificial Sequence
  Description of Artificial Sequence: Synthetic oligonucleotide
  Target: ATXN1; (+) strand; PAM type: YTN; PAM sequence: TTC
aacaatcagtgaatgaatga

SEQ ID NO: 283195 - DNA, 20 bp, Artificial Sequence
  Description of Artificial Sequence: Synthetic oligonucleotide
  Target: ATXN1; (+) strand; PAM type: YTN; PAM sequence: TTC
actatttgaacactgatgaa

SEQ ID NO: 283196 - DNA, 20 bp, Artificial Sequence
  Description of Artificial Sequence: Synthetic oligonucleotide
  Target: ATXN1; (+) strand; PAM type: YTN; PAM sequence: CTA
tttgaacactgatgaaatga

SEQ ID NO: 283197 - DNA, 20 bp, Artificial Sequence
  Description of Artificial Sequence: Synthetic oligonucleotide
  Target: ATXN1; (+) strand; PAM type: YTN; PAM sequence: TTT
gaacactgatgaaatgagaa

SEQ ID NO: 283198 - DNA, 20 bp, Artificial Sequence
  Description of Artificial Sequence: Synthetic oligonucleotide
  Target: ATXN1; (+) strand; PAM type: YTN; PAM sequence: TTG
aacactgatgaaatgagaag

SEQ ID NO: 283199 - DNA, 20 bp, Artificial Sequence
  Description of Artificial Sequence: Synthetic oligonucleotide
  Target: ATXN1; (+) strand; PAM type: YTN; PAM sequence: CTG
atgaaatgagaagcactaat

SEQ ID NO: 283200 - DNA, 20 bp, Artificial Sequence
  Description of Artificial Sequence: Synthetic oligonucleotide
  Target: ATXN1; (+) strand; PAM type: YTN; PAM sequence: CTA
atgatattcagggagcacag

SEQ ID NO: 283201 - DNA, 20 bp, Artificial Sequence
  Description of Artificial Sequence: Synthetic oligonucleotide
  Target: ATXN1; (+) strand; PAM type: YTN; PAM sequence: TTC
agggagcacagatcttgagt

SEQ ID NO: 283202 - DNA, 20 bp, Artificial Sequence
  Description of Artificial Sequence: Synthetic oligonucleotide
  Target: ATXN1; (+) strand; PAM type: YTN; PAM sequence: CTT
gagttagggagaaagggaac

SEQ ID NO: 283203 - DNA, 20 bp, Artificial Sequence
  Description of Artificial Sequence: Synthetic oligonucleotide
  Target: ATXN1; (+) strand; PAM type: YTN; PAM sequence: TTG
agttagggagaaagggaact

SEQ ID NO: 283204 - DNA, 20 bp, Artificial Sequence
  Description of Artificial Sequence: Synthetic oligonucleotide
  Target: ATXN1; (+) strand; PAM type: YTN; PAM sequence: TTA
gggagaaagggaactggatg

SEQ ID NO: 283205 - DNA, 20 bp, Artificial Sequence
  Description of Artificial Sequence: Synthetic oligonucleotide
  Target: ATXN1; (+) strand; PAM type: YTN; PAM sequence: CTG
gatgttcattttctcttcca

SEQ ID NO: 283206 - DNA, 20 bp, Artificial Sequence
  Description of Artificial Sequence: Synthetic oligonucleotide
  Target: ATXN1; (+) strand; PAM type: YTN; PAM sequence: TTC
attttctcttccaccgctga

SEQ ID NO: 283207 - DNA, 20 bp, Artificial Sequence
  Description of Artificial Sequence: Synthetic oligonucleotide
  Target: ATXN1; (+) strand; PAM type: YTN; PAM sequence: TTT
tctcttccaccgctgaatcc

SEQ ID NO: 283208 - DNA, 20 bp, Artificial Sequence
  Description of Artificial Sequence: Synthetic oligonucleotide
  Target: ATXN1; (+) strand; PAM type: YTN; PAM sequence: TTT
ctcttccaccgctgaatcct

SEQ ID NO: 283209 - DNA, 20 bp, Artificial Sequence
  Description of Artificial Sequence: Synthetic oligonucleotide
  Target: ATXN1; (+) strand; PAM type: YTN; PAM sequence: TTC
tcttccaccgctgaatccta

SEQ ID NO: 283210 - DNA, 20 bp, Artificial Sequence
  Description of Artificial Sequence: Synthetic oligonucleotide
  Target: ATXN1; (+) strand; PAM type: YTN; PAM sequence: CTC
ttccaccgctgaatcctata

SEQ ID NO: 283211 - DNA, 20 bp, Artificial Sequence
  Description of Artificial Sequence: Synthetic oligonucleotide
  Target: ATXN1; (+) strand; PAM type: YTN; PAM sequence: CTT
ccaccgctgaatcctataat

SEQ ID NO: 283212 - DNA, 20 bp, Artificial Sequence
  Description of Artificial Sequence: Synthetic oligonucleotide
  Target: ATXN1; (+) strand; PAM type: YTN; PAM sequence: TTC
caccgctgaatcctataatg

SEQ ID NO: 283213 - DNA, 20 bp, Artificial Sequence
  Description of Artificial Sequence: Synthetic oligonucleotide
  Target: ATXN1; (+) strand; PAM type: YTN; PAM sequence: CTG
aatcctataatgtcaaaagc

SEQ ID NO: 283214 - DNA, 20 bp, Artificial Sequence
  Description of Artificial Sequence: Synthetic oligonucleotide
  Target: ATXN1; (+) strand; PAM type: YTN; PAM sequence: CTA
taatgtcaaaagctctccta

SEQ ID NO: 283215 - DNA, 20 bp, Artificial Sequence
  Description of Artificial Sequence: Synthetic oligonucleotide
  Target: ATXN1; (+) strand; PAM type: YTN; PAM sequence: CTC
tcctatctcacattcctgaa

SEQ ID NO: 283216 - DNA, 20 bp, Artificial Sequence
  Description of Artificial Sequence: Synthetic oligonucleotide
  Target: ATXN1; (+) strand; PAM type: YTN; PAM sequence: CTC
ctatctcacattcctgaatt

SEQ ID NO: 283217 - DNA, 20 bp, Artificial Sequence
  Description of Artificial Sequence: Synthetic oligonucleotide
  Target: ATXN1; (+) strand; PAM type: YTN; PAM sequence: CTA
tctcacattcctgaatttag

SEQ ID NO: 283218 - DNA, 20 bp, Artificial Sequence
  Description of Artificial Sequence: Synthetic oligonucleotide
  Target: ATXN1; (+) strand; PAM type: YTN; PAM sequence: CTC
acattcctgaatttagaaaa

SEQ ID NO: 283219 - DNA, 20 bp, Artificial Sequence
  Description of Artificial Sequence: Synthetic oligonucleotide
  Target: ATXN1; (+) strand; PAM type: YTN; PAM sequence: TTC
ctgaatttagaaaacatatt

SEQ ID NO: 283220 - DNA, 20 bp, Artificial Sequence
  Description of Artificial Sequence: Synthetic oligonucleotide
  Target: ATXN1; (+) strand; PAM type: YTN; PAM sequence: CTG
aatttagaaaacatatttaa

SEQ ID NO: 283221 - DNA, 20 bp, Artificial Sequence
  Description of Artificial Sequence: Synthetic oligonucleotide
  Target: ATXN1; (+) strand; PAM type: YTN; PAM sequence: TTT
agaaaacatatttaaatgct

SEQ ID NO: 283222 - DNA, 20 bp, Artificial Sequence
  Description of Artificial Sequence: Synthetic oligonucleotide
  Target: ATXN1; (+) strand; PAM type: YTN; PAM sequence: TTA
gaaaacatatttaaatgctt

SEQ ID NO: 283223 - DNA, 20 bp, Artificial Sequence
  Description of Artificial Sequence: Synthetic oligonucleotide
  Target: ATXN1; (+) strand; PAM type: YTN; PAM sequence: TTT
aaatgcttcatttcatttga

SEQ ID NO: 283224 - DNA, 20 bp, Artificial Sequence
  Description of Artificial Sequence: Synthetic oligonucleotide
  Target: ATXN1; (+) strand; PAM type: YTN; PAM sequence: TTA
aatgcttcatttcatttgat

SEQ ID NO: 283225 - DNA, 20 bp, Artificial Sequence
  Description of Artificial Sequence: Synthetic oligonucleotide
  Target: ATXN1; (+) strand; PAM type: YTN; PAM sequence: CTT
catttcatttgataacctct

SEQ ID NO: 283226 - DNA, 20 bp, Artificial Sequence
  Description of Artificial Sequence: Synthetic oligonucleotide
  Target: ATXN1; (+) strand; PAM type: YTN; PAM sequence: TTC
atttcatttgataacctcta

SEQ ID NO: 283227 - DNA, 20 bp, Artificial Sequence
  Description of Artificial Sequence: Synthetic oligonucleotide
  Target: ATXN1; (+) strand; PAM type: YTN; PAM sequence: TTT
catttgataacctctaagag

SEQ ID NO: 283228 - DNA, 20 bp, Artificial Sequence
  Description of Artificial Sequence: Synthetic oligonucleotide
  Target: ATXN1; (+) strand; PAM type: YTN; PAM sequence: TTC
atttgataacctctaagaga

SEQ ID NO: 283229 - DNA, 20 bp, Artificial Sequence
  Description of Artificial Sequence: Synthetic oligonucleotide
  Target: ATXN1; (+) strand; PAM type: YTN; PAM sequence: TTT
gataacctctaagagaaaaa

SEQ ID NO: 283230 - DNA, 20 bp, Artificial Sequence
  Description of Artificial Sequence: Synthetic oligonucleotide
  Target: ATXN1; (+) strand; PAM type: YTN; PAM sequence: TTG
ataacctctaagagaaaaaa

SEQ ID NO: 283231 - DNA, 20 bp, Artificial Sequence
  Description of Artificial Sequence: Synthetic oligonucleotide
  Target: ATXN1; (+) strand; PAM type: YTN; PAM sequence: CTC
taagagaaaaaaatagtgat

SEQ ID NO: 283232 - DNA, 20 bp, Artificial Sequence
  Description of Artificial Sequence: Synthetic oligonucleotide
  Target: ATXN1; (+) strand; PAM type: YTN; PAM sequence: CTA
agagaaaaaaatagtgattt

SEQ ID NO: 283233 - DNA, 20 bp, Artificial Sequence
  Description of Artificial Sequence: Synthetic oligonucleotide
  Target: ATXN1; (+) strand; PAM type: YTN; PAM sequence: TTT
gaaaagtaccatagaatact

SEQ ID NO: 283234 - DNA, 20 bp, Artificial Sequence
  Description of Artificial Sequence: Synthetic oligonucleotide
  Target: ATXN1; (+) strand; PAM type: YTN; PAM sequence: TTG
aaaagtaccatagaatactg

SEQ ID NO: 283235 - DNA, 20 bp, Artificial Sequence
  Description of Artificial Sequence: Synthetic oligonucleotide
  Target: ATXN1; (+) strand; PAM type: YTN; PAM sequence: CTG
tcattttgataaagctgtat

SEQ ID NO: 283236 - DNA, 20 bp, Artificial Sequence
  Description of Artificial Sequence: Synthetic oligonucleotide
  Target: ATXN1; (+) strand; PAM type: YTN; PAM sequence: TTT
tgataaagctgtatgaaagt

SEQ ID NO: 283237 - DNA, 20 bp, Artificial Sequence
  Description of Artificial Sequence: Synthetic oligonucleotide
  Target: ATXN1; (+) strand; PAM type: YTN; PAM sequence: TTT
gataaagctgtatgaaagtt

SEQ ID NO: 283238 - DNA, 20 bp, Artificial Sequence
  Description of Artificial Sequence: Synthetic oligonucleotide
  Target: ATXN1; (+) strand; PAM type: YTN; PAM sequence: TTG
ataaagctgtatgaaagttg

SEQ ID NO: 283239 - DNA, 20 bp, Artificial Sequence
  Description of Artificial Sequence: Synthetic oligonucleotide
  Target: ATXN1; (+) strand; PAM type: YTN; PAM sequence: CTG
tatgaaagttggatttctac

SEQ ID NO: 283240 - DNA, 20 bp, Artificial Sequence
  Description of Artificial Sequence: Synthetic oligonucleotide
  Target: ATXN1; (+) strand; PAM type: YTN; PAM sequence: TTG
gatttctacctcgagttttg

SEQ ID NO: 283241 - DNA, 20 bp, Artificial Sequence
  Description of Artificial Sequence: Synthetic oligonucleotide
  Target: ATXN1; (+) strand; PAM type: YTN; PAM sequence: TTT
ctacctcgagttttgcccgc

SEQ ID NO: 283242 - DNA, 20 bp, Artificial Sequence
  Description of Artificial Sequence: Synthetic oligonucleotide
  Target: ATXN1; (+) strand; PAM type: YTN; PAM sequence: TTC
tacctcgagttttgcccgca

SEQ ID NO: 283243 - DNA, 20 bp, Artificial Sequence
  Description of Artificial Sequence: Synthetic oligonucleotide
  Target: ATXN1; (+) strand; PAM type: YTN; PAM sequence: CTA
cctcgagttttgcccgcact

SEQ ID NO: 283244 - DNA, 20 bp, Artificial Sequence
  Description of Artificial Sequence: Synthetic oligonucleotide
  Target: ATXN1; (+) strand; PAM type: YTN; PAM sequence: CTC
gagttttgcccgcactttga

SEQ ID NO: 283245 - DNA, 20 bp, Artificial Sequence
  Description of Artificial Sequence: Synthetic oligonucleotide
  Target: ATXN1; (+) strand; PAM type: YTN; PAM sequence: TTT
tgcccgcactttgagtagta

SEQ ID NO: 283246 - DNA, 20 bp, Artificial Sequence
  Description of Artificial Sequence: Synthetic oligonucleotide
  Target: ATXN1; (+) strand; PAM type: YTN; PAM sequence: TTT
gcccgcactttgagtagtat

SEQ ID NO: 283247 - DNA, 20 bp, Artificial Sequence
  Description of Artificial Sequence: Synthetic oligonucleotide
  Target: ATXN1; (+) strand; PAM type: YTN; PAM sequence: TTG
cccgcactttgagtagtatg

SEQ ID NO: 283248 - DNA, 20 bp, Artificial Sequence
  Description of Artificial Sequence: Synthetic oligonucleotide
  Target: ATXN1; (+) strand; PAM type: YTN; PAM sequence: CTT
tgagtagtatggtttgccaa

SEQ ID NO: 283249 - DNA, 20 bp, Artificial Sequence
  Description of Artificial Sequence: Synthetic oligonucleotide
  Target: ATXN1; (+) strand; PAM type: YTN; PAM sequence: TTT
gagtagtatggtttgccaac

SEQ ID NO: 283250 - DNA, 20 bp, Artificial Sequence
  Description of Artificial Sequence: Synthetic oligonucleotide
  Target: ATXN1; (+) strand; PAM type: YTN; PAM sequence: TTG
agtagtatggtttgccaaca

SEQ ID NO: 283251 - DNA, 20 bp, Artificial Sequence
  Description of Artificial Sequence: Synthetic oligonucleotide
  Target: ATXN1; (+) strand; PAM type: YTN; PAM sequence: TTT
gccaacattgaaagcagcat

SEQ ID NO: 283252 - DNA, 20 bp, Artificial Sequence
  Description of Artificial Sequence: Synthetic oligonucleotide
  Target: ATXN1; (+) strand; PAM type: YTN; PAM sequence: TTG
ccaacattgaaagcagcatt

SEQ ID NO: 283253 - DNA, 20 bp, Artificial Sequence
  Description of Artificial Sequence: Synthetic oligonucleotide
  Target: ATXN1; (+) strand; PAM type: YTN; PAM sequence: TTG
aaagcagcattagtgtagca

SEQ ID NO: 283254 - DNA, 20 bp, Artificial Sequence
  Description of Artificial Sequence: Synthetic oligonucleotide
  Target: ATXN1; (+) strand; PAM type: YTN; PAM sequence: TTA
gtgtagcaggggaaggtctg

SEQ ID NO: 283255 - DNA, 20 bp, Artificial Sequence
  Description of Artificial Sequence: Synthetic oligonucleotide
  Target: ATXN1; (+) strand; PAM type: YTN; PAM sequence: CTG
tgcagcagtctgctttaggg

SEQ ID NO: 283256 - DNA, 20 bp, Artificial Sequence
  Description of Artificial Sequence: Synthetic oligonucleotide
  Target: ATXN1; (+) strand; PAM type: YTN; PAM sequence: CTG
ctttagggtagcaataagaa

SEQ ID NO: 283257 - DNA, 20 bp, Artificial Sequence
  Description of Artificial Sequence: Synthetic oligonucleotide
  Target: ATXN1; (+) strand; PAM type: YTN; PAM sequence: CTT
tagggtagcaataagaaaga

SEQ ID NO: 283258 - DNA, 20 bp, Artificial Sequence
  Description of Artificial Sequence: Synthetic oligonucleotide
  Target: ATXN1; (+) strand; PAM type: YTN; PAM sequence: TTT
agggtagcaataagaaagac

SEQ ID NO: 283259 - DNA, 20 bp, Artificial Sequence
  Description of Artificial Sequence: Synthetic oligonucleotide
  Target: ATXN1; (+) strand; PAM type: YTN; PAM sequence: TTA
gggtagcaataagaaagaca

SEQ ID NO: 283260 - DNA, 20 bp, Artificial Sequence
  Description of Artificial Sequence: Synthetic oligonucleotide
  Target: ATXN1; (+) strand; PAM type: YTN; PAM sequence: TTG
taagctttgatatcaaccat

SEQ ID NO: 283261 - DNA, 20 bp, Artificial Sequence
  Description of Artificial Sequence: Synthetic oligonucleotide
  Target: ATXN1; (+) strand; PAM type: YTN; PAM sequence: CTT
tgatatcaaccattttctaa

SEQ ID NO: 283262 - DNA, 20 bp, Artificial Sequence
  Description of Artificial Sequence: Synthetic oligonucleotide
  Target: ATXN1; (+) strand; PAM type: YTN; PAM sequence: TTT
gatatcaaccattttctaat

SEQ ID NO: 283263 - DNA, 20 bp, Artificial Sequence
  Description of Artificial Sequence: Synthetic oligonucleotide
  Target: ATXN1; (+) strand; PAM type: YTN; PAM sequence: TTG
atatcaaccattttctaatg

SEQ ID NO: 283264 - DNA, 20 bp, Artificial Sequence
  Description of Artificial Sequence: Synthetic oligonucleotide
  Target: ATXN1; (+) strand; PAM type: YTN; PAM sequence: TTT
tctaatgtgttttaagagta

SEQ ID NO: 283265 - DNA, 20 bp, Artificial Sequence
  Description of Artificial Sequence: Synthetic oligonucleotide
  Target: ATXN1; (+) strand; PAM type: YTN; PAM sequence: TTT
ctaatgtgttttaagagtaa

SEQ ID NO: 283266 - DNA, 20 bp, Artificial Sequence
  Description of Artificial Sequence: Synthetic oligonucleotide
  Target: ATXN1; (+) strand; PAM type: YTN; PAM sequence: TTC
taatgtgttttaagagtaaa

SEQ ID NO: 283267 - DNA, 20 bp, Artificial Sequence
  Description of Artificial Sequence: Synthetic oligonucleotide
  Target: ATXN1; (+) strand; PAM type: YTN; PAM sequence: CTA
atgtgttttaagagtaaaca

SEQ ID NO: 283268 - DNA, 20 bp, Artificial Sequence
  Description of Artificial Sequence: Synthetic oligonucleotide
  Target: ATXN1; (+) strand; PAM type: YTN; PAM sequence: TTT
taagagtaaacacagatgat

SEQ ID NO: 283269 - DNA, 20 bp, Artificial Sequence
  Description of Artificial Sequence: Synthetic oligonucleotide
  Target: ATXN1; (+) strand; PAM type: YTN; PAM sequence: TTT
aagagtaaacacagatgatg

SEQ ID NO: 283270 - DNA, 20 bp, Artificial Sequence
  Description of Artificial Sequence: Synthetic oligonucleotide
  Target: ATXN1; (+) strand; PAM type: YTN; PAM sequence: TTA
agagtaaacacagatgatgg

SEQ ID NO: 283271 - DNA, 20 bp, Artificial Sequence
  Description of Artificial Sequence: Synthetic oligonucleotide
  Target: ATXN1; (+) strand; PAM type: YTN; PAM sequence: CTA
ccttatttcatgagagttat

SEQ ID NO: 283272 - DNA, 20 bp, Artificial Sequence
  Description of Artificial Sequence: Synthetic oligonucleotide
  Target: ATXN1; (+) strand; PAM type: YTN; PAM sequence: CTT
atttcatgagagttattaca

SEQ ID NO: 283273 - DNA, 20 bp, Artificial Sequence
  Description of Artificial Sequence: Synthetic oligonucleotide
  Target: ATXN1; (+) strand; PAM type: YTN; PAM sequence: TTA
tttcatgagagttattacaa

SEQ ID NO: 283274 - DNA, 20 bp, Artificial Sequence
  Description of Artificial Sequence: Synthetic oligonucleotide
  Target: ATXN1; (+) strand; PAM type: YTN; PAM sequence: TTT
catgagagttattacaacta

SEQ ID NO: 283275 - DNA, 20 bp, Artificial Sequence
  Description of Artificial Sequence: Synthetic oligonucleotide
  Target: ATXN1; (+) strand; PAM type: YTN; PAM sequence: TTC
atgagagttattacaactat

SEQ ID NO: 283276 - DNA, 20 bp, Artificial Sequence
  Description of Artificial Sequence: Synthetic oligonucleotide
  Target: ATXN1; (+) strand; PAM type: YTN; PAM sequence: TTA
ttacaactatgtgaatgttt

SEQ ID NO: 283277 - DNA, 20 bp, Artificial Sequence
  Description of Artificial Sequence: Synthetic oligonucleotide
  Target: ATXN1; (+) strand; PAM type: YTN; PAM sequence: TTA
caactatgtgaatgtttcca

SEQ ID NO: 283278 - DNA, 20 bp, Artificial Sequence
  Description of Artificial Sequence: Synthetic oligonucleotide
  Target: ATXN1; (+) strand; PAM type: YTN; PAM sequence: CTA
tgtgaatgtttccatactga

SEQ ID NO: 283279 - DNA, 20 bp, Artificial Sequence
  Description of Artificial Sequence: Synthetic oligonucleotide
  Target: ATXN1; (+) strand; PAM type: YTN; PAM sequence: TTT
ccatactgacaccagaaatc

SEQ ID NO: 283280 - DNA, 20 bp, Artificial Sequence
  Description of Artificial Sequence: Synthetic oligonucleotide
  Target: ATXN1; (+) strand; PAM type: YTN; PAM sequence: TTC
catactgacaccagaaatca

SEQ ID NO: 283281 - DNA, 20 bp, Artificial Sequence
  Description of Artificial Sequence: Synthetic oligonucleotide
  Target: ATXN1; (+) strand; PAM type: YTN; PAM sequence: CTG
acaccagaaatcatattatt

SEQ ID NO: 283282 - DNA, 20 bp, Artificial Sequence
  Description of Artificial Sequence: Synthetic oligonucleotide
  Target: ATXN1; (+) strand; PAM type: YTN; PAM sequence: TTA
tttataaaactttcaaagaa

SEQ ID NO: 283283 - DNA, 20 bp, Artificial Sequence
  Description of Artificial Sequence: Synthetic oligonucleotide
  Target: ATXN1; (+) strand; PAM type: YTN; PAM sequence: TTT
ataaaactttcaaagaataa

SEQ ID NO: 283284 - DNA, 20 bp, Artificial Sequence
  Description of Artificial Sequence: Synthetic oligonucleotide
  Target: ATXN1; (+) strand; PAM type: YTN; PAM sequence: TTA
taaaactttcaaagaataaa

SEQ ID NO: 283285 - DNA, 20 bp, Artificial Sequence
  Description of Artificial Sequence: Synthetic oligonucleotide
  Target: ATXN1; (+) strand; PAM type: YTN; PAM sequence: CTT
tcaaagaataaaatgcttca

SEQ ID NO: 283286 - DNA, 20 bp, Artificial Sequence
  Description of Artificial Sequence: Synthetic oligonucleotide
  Target: ATXN1; (+) strand; PAM type: YTN; PAM sequence: TTT
caaagaataaaatgcttcat

SEQ ID NO: 283287 - DNA, 20 bp, Artificial Sequence
  Description of Artificial Sequence: Synthetic oligonucleotide
  Target: ATXN1; (+) strand; PAM type: YTN; PAM sequence: TTC
aaagaataaaatgcttcata

SEQ ID NO: 283288 - DNA, 20 bp, Artificial Sequence
  Description of Artificial Sequence: Synthetic oligonucleotide
  Target: ATXN1; (+) strand; PAM type: YTN; PAM sequence: CTT
cataaagaagcctggtaagt

SEQ ID NO: 283289 - DNA, 20 bp, Artificial Sequence
  Description of Artificial Sequence: Synthetic oligonucleotide
  Target: ATXN1; (+) strand; PAM type: YTN; PAM sequence: TTC
ataaagaagcctggtaagtt

SEQ ID NO: 283290 - DNA, 20 bp, Artificial Sequence
  Description of Artificial Sequence: Synthetic oligonucleotide
  Target: ATXN1; (+) strand; PAM type: YTN; PAM sequence: CTG
gtaagttattttaaaacttt

SEQ ID NO: 283291 - DNA, 20 bp, Artificial Sequence
  Description of Artificial Sequence: Synthetic oligonucleotide
  Target: ATXN1; (+) strand; PAM type: YTN; PAM sequence: TTA
ttttaaaactttaaagtatc

SEQ ID NO: 283292 - DNA, 20 bp, Artificial Sequence
  Description of Artificial Sequence: Synthetic oligonucleotide
  Target: ATXN1; (+) strand; PAM type: YTN; PAM sequence: TTT
taaaactttaaagtatccaa

SEQ ID NO: 283293 - DNA, 20 bp, Artificial Sequence
  Description of Artificial Sequence: Synthetic oligonucleotide
  Target: ATXN1; (+) strand; PAM type: YTN; PAM sequence: TTT
aaaactttaaagtatccaaa

SEQ ID NO: 283294 - DNA, 20 bp, Artificial Sequence
  Description of Artificial Sequence: Synthetic oligonucleotide
  Target: ATXN1; (+) strand; PAM type: YTN; PAM sequence: TTA
aaactttaaagtatccaaaa

SEQ ID NO: 283295 - DNA, 20 bp, Artificial Sequence
  Description of Artificial Sequence: Synthetic oligonucleotide
  Target: ATXN1; (+) strand; PAM type: YTN; PAM sequence: CTT
taaagtatccaaaatagttt

SEQ ID NO: 283296 - DNA, 20 bp, Artificial Sequence
  Description of Artificial Sequence: Synthetic oligonucleotide
  Target: ATXN1; (+) strand; PAM type: YTN; PAM sequence: TTT
aaagtatccaaaatagttta

SEQ ID NO: 283297 - DNA, 20 bp, Artificial Sequence
  Description of Artificial Sequence: Synthetic oligonucleotide
  Target: ATXN1; (+) strand; PAM type: YTN; PAM sequence: TTA
aagtatccaaaatagtttaa

SEQ ID NO: 283298 - DNA, 20 bp, Artificial Sequence
  Description of Artificial Sequence: Synthetic oligonucleotide
  Target: ATXN1; (+) strand; PAM type: YTN; PAM sequence: TTT
aaaagctacgcctacatata

SEQ ID NO: 283299 - DNA, 20 bp, Artificial Sequence
  Description of Artificial Sequence: Synthetic oligonucleotide
  Target: ATXN1; (+) strand; PAM type: YTN; PAM sequence: TTA
aaagctacgcctacatataa

SEQ ID NO: 283300 - DNA, 20 bp, Artificial Sequence
  Description of Artificial Sequence: Synthetic oligonucleotide
  Target: ATXN1; (+) strand; PAM type: YTN; PAM sequence: CTA
cgcctacatataaaacacaa

SEQ ID NO: 283301 - DNA, 20 bp, Artificial Sequence
  Description of Artificial Sequence: Synthetic oligonucleotide
  Target: ATXN1; (+) strand; PAM type: YTN; PAM sequence: CTA
catataaaacacaatatact

SEQ ID NO: 283302 - DNA, 20 bp, Artificial Sequence
  Description of Artificial Sequence: Synthetic oligonucleotide
  Target: ATXN1; (+) strand; PAM type: YTN; PAM sequence: CTC
ttgaatctttgaccctacat

SEQ ID NO: 283303 - DNA, 20 bp, Artificial Sequence
  Description of Artificial Sequence: Synthetic oligonucleotide
  Target: ATXN1; (+) strand; PAM type: YTN; PAM sequence: CTT
gaatctttgaccctacattt

SEQ ID NO: 283304 - DNA, 20 bp, Artificial Sequence
  Description of Artificial Sequence: Synthetic oligonucleotide
  Target: ATXN1; (+) strand; PAM type: YTN; PAM sequence: TTG
aatctttgaccctacatttt

SEQ ID NO: 283305 - DNA, 20 bp, Artificial Sequence
  Description of Artificial Sequence: Synthetic oligonucleotide
  Target: ATXN1; (+) strand; PAM type: YTN; PAM sequence: CTT
tgaccctacattttttcgct

SEQ ID NO: 283306 - DNA, 20 bp, Artificial Sequence
  Description of Artificial Sequence: Synthetic oligonucleotide
  Target: ATXN1; (+) strand; PAM type: YTN; PAM sequence: TTT
gaccctacattttttcgctt

SEQ ID NO: 283307 - DNA, 20 bp, Artificial Sequence
  Description of Artificial Sequence: Synthetic oligonucleotide
  Target: ATXN1; (+) strand; PAM type: YTN; PAM sequence: TTG
accctacattttttcgcttt

SEQ ID NO: 283308 - DNA, 20 bp, Artificial Sequence
  Description of Artificial Sequence: Synthetic oligonucleotide
  Target: ATXN1; (+) strand; PAM type: YTN; PAM sequence: CTA
cattttttcgcttttcctaa

SEQ ID NO: 283309 - DNA, 20 bp, Artificial Sequence
  Description of Artificial Sequence: Synthetic oligonucleotide
  Target: ATXN1; (+) strand; PAM type: YTN; PAM sequence: TTT
tttcgcttttcctaaaaaaa

SEQ ID NO: 283310 - DNA, 20 bp, Artificial Sequence
  Description of Artificial Sequence: Synthetic oligonucleotide
  Target: ATXN1; (+) strand; PAM type: YTN; PAM sequence: TTT
ttcgcttttcctaaaaaaat

SEQ ID NO: 283311 - DNA, 20 bp, Artificial Sequence
  Description of Artificial Sequence: Synthetic oligonucleotide
  Target: ATXN1; (+) strand; PAM type: YTN; PAM sequence: TTT
tcgcttttcctaaaaaaatc

SEQ ID NO: 283312 - DNA, 20 bp, Artificial Sequence
  Description of Artificial Sequence: Synthetic oligonucleotide
  Target: ATXN1; (+) strand; PAM type: YTN; PAM sequence: TTT
cgcttttcctaaaaaaatca

SEQ ID NO: 283313 - DNA, 20 bp, Artificial Sequence
  Description of Artificial Sequence: Synthetic oligonucleotide
  Target: ATXN1; (+) strand; PAM type: YTN; PAM sequence: TTC
gcttttcctaaaaaaatcat

SEQ ID NO: 283314 - DNA, 20 bp, Artificial Sequence
  Description of Artificial Sequence: Synthetic oligonucleotide
  Target: ATXN1; (+) strand; PAM type: YTN; PAM sequence: CTT
ttcctaaaaaaatcattaaa

SEQ ID NO: 283315 - DNA, 20 bp, Artificial Sequence
  Description of Artificial Sequence: Synthetic oligonucleotide
  Target: ATXN1; (+) strand; PAM type: YTN; PAM sequence: TTT
tcctaaaaaaatcattaaat

SEQ ID NO: 283316 - DNA, 20 bp, Artificial Sequence
  Description of Artificial Sequence: Synthetic oligonucleotide
  Target: ATXN1; (+) strand; PAM type: YTN; PAM sequence: TTT
cctaaaaaaatcattaaatg

SEQ ID NO: 283317 - DNA, 20 bp, Artificial Sequence
  Description of Artificial Sequence: Synthetic oligonucleotide
  Target: ATXN1; (+) strand; PAM type: YTN; PAM sequence: TTC
ctaaaaaaatcattaaatgt

SEQ ID NO: 283318 - DNA, 20 bp, Artificial Sequence
  Description of Artificial Sequence: Synthetic oligonucleotide
  Target: ATXN1; (+) strand; PAM type: YTN; PAM sequence: CTA
aaaaaatcattaaatgtctc

SEQ ID NO: 283319 - DNA, 20 bp, Artificial Sequence
  Description of Artificial Sequence: Synthetic oligonucleotide
  Target: ATXN1; (+) strand; PAM type: YTN; PAM sequence: TTA
aatgtctcaaaataatgcct

SEQ ID NO: 283320 - DNA, 20 bp, Artificial Sequence
  Description of Artificial Sequence: Synthetic oligonucleotide
  Target: ATXN1; (+) strand; PAM type: YTN; PAM sequence: CTC
aaaataatgcctttacccaa

SEQ ID NO: 283321 - DNA, 20 bp, Artificial Sequence
  Description of Artificial Sequence: Synthetic oligonucleotide
  Target: ATXN1; (+) strand; PAM type: YTN; PAM sequence: CTT
tacccaaactggctatgaat

SEQ ID NO: 283322 - DNA, 20 bp, Artificial Sequence
  Description of Artificial Sequence: Synthetic oligonucleotide
  Target: ATXN1; (+) strand; PAM type: YTN; PAM sequence: TTT
acccaaactggctatgaatt

SEQ ID NO: 283323 - DNA, 20 bp, Artificial Sequence
  Description of Artificial Sequence: Synthetic oligonucleotide
  Target: ATXN1; (+) strand; PAM type: YTN; PAM sequence: TTA
cccaaactggctatgaatta

SEQ ID NO: 283324 - DNA, 20 bp, Artificial Sequence
  Description of Artificial Sequence: Synthetic oligonucleotide
  Target: ATXN1; (+) strand; PAM type: YTN; PAM sequence: CTG
gctatgaattatggaggcta

SEQ ID NO: 283325 - DNA, 20 bp, Artificial Sequence
  Description of Artificial Sequence: Synthetic oligonucleotide
  Target: ATXN1; (+) strand; PAM type: YTN; PAM sequence: CTA
tgaattatggaggctatcta

SEQ ID NO: 283326 - DNA, 20 bp, Artificial Sequence
  Description of Artificial Sequence: Synthetic oligonucleotide
  Target: ATXN1; (+) strand; PAM type: YTN; PAM sequence: TTA
tggaggctatctacagattg

SEQ ID NO: 283327 - DNA, 20 bp, Artificial Sequence
  Description of Artificial Sequence: Synthetic oligonucleotide
  Target: ATXN1; (+) strand; PAM type: YTN; PAM sequence: CTA
tctacagattgaaggaaggg

SEQ ID NO: 283328 - DNA, 20 bp, Artificial Sequence
  Description of Artificial Sequence: Synthetic oligonucleotide
  Target: ATXN1; (+) strand; PAM type: YTN; PAM sequence: CTA
cagattgaaggaagggtggg

SEQ ID NO: 283329 - DNA, 20 bp, Artificial Sequence
  Description of Artificial Sequence: Synthetic oligonucleotide
  Target: ATXN1; (+) strand; PAM type: YTN; PAM sequence: TTG
aaggaagggtgggagaaaag

SEQ ID NO: 283330 - DNA, 20 bp, Artificial Sequence
  Description of Artificial Sequence: Synthetic oligonucleotide
  Target: ATXN1; (+) strand; PAM type: YTN; PAM sequence: TTT
atgctgaaagataaattttg

SEQ ID NO: 283331 - DNA, 20 bp, Artificial Sequence
  Description of Artificial Sequence: Synthetic oligonucleotide
  Target: ATXN1; (+) strand; PAM type: YTN; PAM sequence: TTA
tgctgaaagataaattttgg

SEQ ID NO: 283332 - DNA, 20 bp, Artificial Sequence
  Description of Artificial Sequence: Synthetic oligonucleotide
  Target: ATXN1; (+) strand; PAM type: YTN; PAM sequence: CTG
aaagataaattttggggaag

SEQ ID NO: 283333 - DNA, 20 bp, Artificial Sequence
  Description of Artificial Sequence: Synthetic oligonucleotide
  Target: ATXN1; (+) strand; PAM type: YTN; PAM sequence: TTT
tggggaagtctgtgttttaa

SEQ ID NO: 283334 - DNA, 20 bp, Artificial Sequence
  Description of Artificial Sequence: Synthetic oligonucleotide
  Target: ATXN1; (+) strand; PAM type: YTN; PAM sequence: TTT
ggggaagtctgtgttttaaa

SEQ ID NO: 283335 - DNA, 20 bp, Artificial Sequence
  Description of Artificial Sequence: Synthetic oligonucleotide
  Target: ATXN1; (+) strand; PAM type: YTN; PAM sequence: TTG
gggaagtctgtgttttaaat

SEQ ID NO: 283336 - DNA, 20 bp, Artificial Sequence
  Description of Artificial Sequence: Synthetic oligonucleotide
  Target: ATXN1; (+) strand; PAM type: YTN; PAM sequence: CTG
tgttttaaatacttaatatc

SEQ ID NO: 283337 - DNA, 20 bp, Artificial Sequence
  Description of Artificial Sequence: Synthetic oligonucleotide
  Target: ATXN1; (+) strand; PAM type: YTN; PAM sequence: TTT
taaatacttaatatcagtag

SEQ ID NO: 283338 - DNA, 20 bp, Artificial Sequence
  Description of Artificial Sequence: Synthetic oligonucleotide
  Target: ATXN1; (+) strand; PAM type: YTN; PAM sequence: TTT
aaatacttaatatcagtagg

SEQ ID NO: 283339 - DNA, 20 bp, Artificial Sequence
  Description of Artificial Sequence: Synthetic oligonucleotide
  Target: ATXN1; (+) strand; PAM type: YTN; PAM sequence: TTA
aatacttaatatcagtagga

SEQ ID NO: 283340 - DNA, 20 bp, Artificial Sequence
  Description of Artificial Sequence: Synthetic oligonucleotide
  Target: ATXN1; (+) strand; PAM type: YTN; PAM sequence: CTT
aatatcagtaggattttctt

SEQ ID NO: 283341 - DNA, 20 bp, Artificial Sequence
  Description of Artificial Sequence: Synthetic oligonucleotide
  Target: ATXN1; (+) strand; PAM type: YTN; PAM sequence: TTA
atatcagtaggattttctta

SEQ ID NO: 283342 - DNA, 20 bp, Artificial Sequence
  Description of Artificial Sequence: Synthetic oligonucleotide
  Target: ATXN1; (+) strand; PAM type: YTN; PAM sequence: TTT
tcttaaccttagaaatgtac

SEQ ID NO: 283343 - DNA, 20 bp, Artificial Sequence
  Description of Artificial Sequence: Synthetic oligonucleotide
  Target: ATXN1; (+) strand; PAM type: YTN; PAM sequence: TTT
cttaaccttagaaatgtaca

SEQ ID NO: 283344 - DNA, 20 bp, Artificial Sequence
  Description of Artificial Sequence: Synthetic oligonucleotide
  Target: ATXN1; (+) strand; PAM type: YTN; PAM sequence: TTC
ttaaccttagaaatgtacat

SEQ ID NO: 283345 - DNA, 20 bp, Artificial Sequence
  Description of Artificial Sequence: Synthetic oligonucleotide
  Target: ATXN1; (+) strand; PAM type: YTN; PAM sequence: CTT
aaccttagaaatgtacattt

SEQ ID NO: 283346 - DNA, 20 bp, Artificial Sequence
  Description of Artificial Sequence: Synthetic oligonucleotide
  Target: ATXN1; (+) strand; PAM type: YTN; PAM sequence: TTA
accttagaaatgtacatttc

SEQ ID NO: 283347 - DNA, 20 bp, Artificial Sequence
  Description of Artificial Sequence: Synthetic oligonucleotide
  Target: ATXN1; (+) strand; PAM type: YTN; PAM sequence: CTT
agaaatgtacatttcaacct

SEQ ID NO: 283348 - DNA, 20 bp, Artificial Sequence
  Description of Artificial Sequence: Synthetic oligonucleotide
  Target: ATXN1; (+) strand; PAM type: YTN; PAM sequence: TTA
gaaatgtacatttcaacctt

SEQ ID NO: 283349 - DNA, 20 bp, Artificial Sequence
  Description of Artificial Sequence: Synthetic oligonucleotide
  Target: ATXN1; (+) strand; PAM type: YTN; PAM sequence: TTT
caacctttttcatttcattt

SEQ ID NO: 283350 - DNA, 20 bp, Artificial Sequence
  Description of Artificial Sequence: Synthetic oligonucleotide
  Target: ATXN1; (+) strand; PAM type: YTN; PAM sequence: TTC
aacctttttcatttcatttt

SEQ ID NO: 283351 - DNA, 20 bp, Artificial Sequence
  Description of Artificial Sequence: Synthetic oligonucleotide
  Target: ATXN1; (+) strand; PAM type: YTN; PAM sequence: CTT
tttcatttcattttcaacct

SEQ ID NO: 283352 - DNA, 20 bp, Artificial Sequence
  Description of Artificial Sequence: Synthetic oligonucleotide
  Target: ATXN1; (+) strand; PAM type: YTN; PAM sequence: TTT
ttcatttcattttcaacctt

SEQ ID NO: 283353 - DNA, 20 bp, Artificial Sequence
  Description of Artificial Sequence: Synthetic oligonucleotide
  Target: ATXN1; (+) strand; PAM type: YTN; PAM sequence: TTT
tcatttcattttcaacctta

SEQ ID NO: 283354 - DNA, 20 bp, Artificial Sequence
  Description of Artificial Sequence: Synthetic oligonucleotide
  Target: ATXN1; (+) strand; PAM type: YTN; PAM sequence: TTT
catttcattttcaaccttat

SEQ ID NO: 283355 - DNA, 20 bp, Artificial Sequence
  Description of Artificial Sequence: Synthetic oligonucleotide
  Target: ATXN1; (+) strand; PAM type: YTN; PAM sequence: TTC
atttcattttcaaccttatg

SEQ ID NO: 283356 - DNA, 20 bp, Artificial Sequence
  Description of Artificial Sequence: Synthetic oligonucleotide
  Target: ATXN1; (+) strand; PAM type: YTN; PAM sequence: TTT
cattttcaaccttatgatat

SEQ ID NO: 283357 - DNA, 20 bp, Artificial Sequence
  Description of Artificial Sequence: Synthetic oligonucleotide
  Target: ATXN1; (+) strand; PAM type: YTN; PAM sequence: TTC
attttcaaccttatgatata

SEQ ID NO: 283358 - DNA, 20 bp, Artificial Sequence
  Description of Artificial Sequence: Synthetic oligonucleotide
  Target: ATXN1; (+) strand; PAM type: YTN; PAM sequence: TTT
tcaaccttatgatatagatg

SEQ ID NO: 283359 - DNA, 20 bp, Artificial Sequence
  Description of Artificial Sequence: Synthetic oligonucleotide
  Target: ATXN1; (+) strand; PAM type: YTN; PAM sequence: TTT
caaccttatgatatagatgt

SEQ ID NO: 283360 - DNA, 20 bp, Artificial Sequence
  Description of Artificial Sequence: Synthetic oligonucleotide
  Target: ATXN1; (+) strand; PAM type: YTN; PAM sequence: TTC
aaccttatgatatagatgta

SEQ ID NO: 283361 - DNA, 20 bp, Artificial Sequence
  Description of Artificial Sequence: Synthetic oligonucleotide
  Target: ATXN1; (+) strand; PAM type: YTN; PAM sequence: CTT
atgatatagatgtagtcgaa

SEQ ID NO: 283362 - DNA, 20 bp, Artificial Sequence
  Description of Artificial Sequence: Synthetic oligonucleotide
  Target: ATXN1; (+) strand; PAM type: YTN; PAM sequence: TTA
tgatatagatgtagtcgaag

SEQ ID NO: 283363 - DNA, 20 bp, Artificial Sequence
  Description of Artificial Sequence: Synthetic oligonucleotide
  Target: ATXN1; (+) strand; PAM type: YTN; PAM sequence: TTG
agagggactcacaaccctac

SEQ ID NO: 283364 - DNA, 20 bp, Artificial Sequence
  Description of Artificial Sequence: Synthetic oligonucleotide
  Target: ATXN1; (+) strand; PAM type: YTN; PAM sequence: CTC
acaaccctacagtttttctt

SEQ ID NO: 283365 - DNA, 20 bp, Artificial Sequence
  Description of Artificial Sequence: Synthetic oligonucleotide
  Target: ATXN1; (+) strand; PAM type: YTN; PAM sequence: CTA
cagtttttctttttgtgttt

SEQ ID NO: 283366 - DNA, 20 bp, Artificial Sequence
  Description of Artificial Sequence: Synthetic oligonucleotide
  Target: ATXN1; (+) strand; PAM type: YTN; PAM sequence: TTT
ttctttttgtgtttctgtag

SEQ ID NO: 283367 - DNA, 20 bp, Artificial Sequence
  Description of Artificial Sequence: Synthetic oligonucleotide
  Target: ATXN1; (+) strand; PAM type: YTN; PAM sequence: TTT
tctttttgtgtttctgtagg

SEQ ID NO: 283368 - DNA, 20 bp, Artificial Sequence
  Description of Artificial Sequence: Synthetic oligonucleotide
  Target: ATXN1; (+) strand; PAM type: YTN; PAM sequence: TTT
ctttttgtgtttctgtagga

SEQ ID NO: 283369 - DNA, 20 bp, Artificial Sequence
  Description of Artificial Sequence: Synthetic oligonucleotide
  Target: ATXN1; (+) strand; PAM type: YTN; PAM sequence: TTC
tttttgtgtttctgtaggat

SEQ ID NO: 283370 - DNA, 20 bp, Artificial Sequence
  Description of Artificial Sequence: Synthetic oligonucleotide
  Target: ATXN1; (+) strand; PAM type: YTN; PAM sequence: CTT
tttgtgtttctgtaggataa

SEQ ID NO: 283371 - DNA, 20 bp, Artificial Sequence
  Description of Artificial Sequence: Synthetic oligonucleotide
  Target: ATXN1; (+) strand; PAM type: YTN; PAM sequence: TTT
ttgtgtttctgtaggataaa

SEQ ID NO: 283372 - DNA, 20 bp, Artificial Sequence
  Description of Artificial Sequence: Synthetic oligonucleotide
  Target: ATXN1; (+) strand; PAM type: YTN; PAM sequence: TTT
tgtgtttctgtaggataaag

SEQ ID NO: 283373 - DNA, 20 bp, Artificial Sequence
  Description of Artificial Sequence: Synthetic oligonucleotide
  Target: ATXN1; (+) strand; PAM type: YTN; PAM sequence: TTT
gtgtttctgtaggataaagg

SEQ ID NO: 283374 - DNA, 20 bp, Artificial Sequence
  Description of Artificial Sequence: Synthetic oligonucleotide
  Target: ATXN1; (+) strand; PAM type: YTN; PAM sequence: TTG
tgtttctgtaggataaagga

SEQ ID NO: 283375 - DNA, 20 bp, Artificial Sequence
  Description of Artificial Sequence: Synthetic oligonucleotide
  Target: ATXN1; (+) strand; PAM type: YTN; PAM sequence: TTT
ctgtaggataaaggaaacat

SEQ ID NO: 283376 - DNA, 20 bp, Artificial Sequence
  Description of Artificial Sequence: Synthetic oligonucleotide
  Target: ATXN1; (+) strand; PAM type: YTN; PAM sequence: TTC
tgtaggataaaggaaacatt

SEQ ID NO: 283377 - DNA, 20 bp, Artificial Sequence
  Description of Artificial Sequence: Synthetic oligonucleotide
  Target: ATXN1; (+) strand; PAM type: YTN; PAM sequence: CTG
taggataaaggaaacatttc

SEQ ID NO: 283378 - DNA, 20 bp, Artificial Sequence
  Description of Artificial Sequence: Synthetic oligonucleotide
  Target: ATXN1; (+) strand; PAM type: YTN; PAM sequence: TTT
cctaagagctgaggggcggg

SEQ ID NO: 283379 - DNA, 20 bp, Artificial Sequence
  Description of Artificial Sequence: Synthetic oligonucleotide
  Target: ATXN1; (+) strand; PAM type: YTN; PAM sequence: TTC
ctaagagctgaggggcgggg

SEQ ID NO: 283380 - DNA, 20 bp, Artificial Sequence
  Description of Artificial Sequence: Synthetic oligonucleotide
  Target: ATXN1; (+) strand; PAM type: YTN; PAM sequence: CTA
agagctgaggggcggggtgg

SEQ ID NO: 283381 - DNA, 20 bp, Artificial Sequence
  Description of Artificial Sequence: Synthetic oligonucleotide
  Target: ATXN1; (+) strand; PAM type: YTN; PAM sequence: CTG
aggggcggggtgggttacat

SEQ ID NO: 283382 - DNA, 20 bp, Artificial Sequence
  Description of Artificial Sequence: Synthetic oligonucleotide
  Target: ATXN1; (+) strand; PAM type: YTN; PAM sequence: TTA
catacggtgcctgaagggga

SEQ ID NO: 283383 - DNA, 20 bp, Artificial Sequence
  Description of Artificial Sequence: Synthetic oligonucleotide
  Target: ATXN1; (+) strand; PAM type: YTN; PAM sequence: CTG
aaggggaaaagaccccatgt

SEQ ID NO: 283384 - DNA, 20 bp, Artificial Sequence
  Description of Artificial Sequence: Synthetic oligonucleotide
  Target: ATXN1; (+) strand; PAM type: YTN; PAM sequence: TTC
gagaatgcactgtgtgtgtg

SEQ ID NO: 283385 - DNA, 20 bp, Artificial Sequence
  Description of Artificial Sequence: Synthetic oligonucleotide
  Target: ATXN1; (+) strand; PAM type: YTN; PAM sequence: CTG
tgtgtgtgtgtgtgtgtgtg

SEQ ID NO: 283386 - DNA, 20 bp, Artificial Sequence
  Description of Artificial Sequence: Synthetic oligonucleotide
  Target: ATXN1; (+) strand; PAM type: YTN; PAM sequence: CTG
ggtgggtgtgtggatgggga

SEQ ID NO: 283387 - DNA, 20 bp, Artificial Sequence
  Description of Artificial Sequence: Synthetic oligonucleotide
  Target: ATXN1; (+) strand; PAM type: YTN; PAM sequence: CTC
aactggacatgttaaagaaa

SEQ ID NO: 283388 - DNA, 20 bp, Artificial Sequence
  Description of Artificial Sequence: Synthetic oligonucleotide
  Target: ATXN1; (+) strand; PAM type: YTN; PAM sequence: CTG
gacatgttaaagaaagaaga

SEQ ID NO: 283389 - DNA, 20 bp, Artificial Sequence
  Description of Artificial Sequence: Synthetic oligonucleotide
  Target: ATXN1; (+) strand; PAM type: YTN; PAM sequence: TTA
aagaaagaagaaaacatctg

SEQ ID NO: 283390 - DNA, 20 bp, Artificial Sequence
  Description of Artificial Sequence: Synthetic oligonucleotide
  Target: ATXN1; (+) strand; PAM type: YTN; PAM sequence: CTG
ggtagagtacgtggtggatg

SEQ ID NO: 283391 - DNA, 20 bp, Artificial Sequence
  Description of Artificial Sequence: Synthetic oligonucleotide
  Target: ATXN1; (+) strand; PAM type: YTN; PAM sequence: TTT
gagggcccgaagagagcagc

SEQ ID NO: 283392 - DNA, 20 bp, Artificial Sequence
  Description of Artificial Sequence: Synthetic oligonucleotide
  Target: ATXN1; (+) strand; PAM type: YTN; PAM sequence: TTG
agggcccgaagagagcagct

SEQ ID NO: 283393 - DNA, 20 bp, Artificial Sequence
  Description of Artificial Sequence: Synthetic oligonucleotide
  Target: ATXN1; (+) strand; PAM type: YTN; PAM sequence: CTG
accagggagggatacaatag

SEQ ID NO: 283394 - DNA, 20 bp, Artificial Sequence
  Description of Artificial Sequence: Synthetic oligonucleotide
  Target: ATXN1; (+) strand; PAM type: YTN; PAM sequence: TTC
gtcaaagacagtaaatccga

SEQ ID NO: 283395 - DNA, 20 bp, Artificial Sequence
  Description of Artificial Sequence: Synthetic oligonucleotide
  Target: ATXN1; (+) strand; PAM type: YTN; PAM sequence: CTA
aaaatgcagcctttaccaaa

SEQ ID NO: 283396 - DNA, 20 bp, Artificial Sequence
  Description of Artificial Sequence: Synthetic oligonucleotide
  Target: ATXN1; (+) strand; PAM type: YTN; PAM sequence: CTT
taccaaatgcaggtcaaggc

SEQ ID NO: 283397 - DNA, 20 bp, Artificial Sequence
  Description of Artificial Sequence: Synthetic oligonucleotide
  Target: ATXN1; (+) strand; PAM type: YTN; PAM sequence: TTT
accaaatgcaggtcaaggcc

SEQ ID NO: 283398 - DNA, 20 bp, Artificial Sequence
  Description of Artificial Sequence: Synthetic oligonucleotide
  Target: ATXN1; (+) strand; PAM type: YTN; PAM sequence: TTA
ccaaatgcaggtcaaggcct

SEQ ID NO: 283399 - DNA, 20 bp, Artificial Sequence
  Description of Artificial Sequence: Synthetic oligonucleotide
  Target: ATXN1; (+) strand; PAM type: YTN; PAM sequence: CTA
aggagataaaagaaatctct

SEQ ID NO: 283400 - DNA, 20 bp, Artificial Sequence
  Description of Artificial Sequence: Synthetic oligonucleotide
  Target: ATXN1; (+) strand; PAM type: YTN; PAM sequence: CTC
tgagcagagcctgttattta

SEQ ID NO: 283401 - DNA, 20 bp, Artificial Sequence
  Description of Artificial Sequence: Synthetic oligonucleotide
  Target: ATXN1; (+) strand; PAM type: YTN; PAM sequence: CTG
agcagagcctgttatttaag

SEQ ID NO: 283402 - DNA, 20 bp, Artificial Sequence
  Description of Artificial Sequence: Synthetic oligonucleotide
  Target: ATXN1; (+) strand; PAM type: YTN; PAM sequence: CTG
ttatttaagagaccactaaa

SEQ ID NO: 283403 - DNA, 20 bp, Artificial Sequence
  Description of Artificial Sequence: Synthetic oligonucleotide
  Target: ATXN1; (+) strand; PAM type: YTN; PAM sequence: TTA
tttaagagaccactaaaagc

SEQ ID NO: 283404 - DNA, 20 bp, Artificial Sequence
  Description of Artificial Sequence: Synthetic oligonucleotide
  Target: ATXN1; (+) strand; PAM type: YTN; PAM sequence: TTT
aagagaccactaaaagcacc

SEQ ID NO: 283405 - DNA, 20 bp, Artificial Sequence
  Description of Artificial Sequence: Synthetic oligonucleotide
  Target: ATXN1; (+) strand; PAM type: YTN; PAM sequence: TTA
agagaccactaaaagcaccc

SEQ ID NO: 283406 - DNA, 20 bp, Artificial Sequence
  Description of Artificial Sequence: Synthetic oligonucleotide
  Target: ATXN1; (+) strand; PAM type: YTN; PAM sequence: CTA
aaagcacccaggaatggagg

SEQ ID NO: 283407 - DNA, 20 bp, Artificial Sequence
  Description of Artificial Sequence: Synthetic oligonucleotide
  Target: ATXN1; (+) strand; PAM type: YTN; PAM sequence: CTG
agtggaagggtaccaaatag

SEQ ID NO: 283408 - DNA, 20 bp, Artificial Sequence
  Description of Artificial Sequence: Synthetic oligonucleotide
  Target: ATXN1; (+) strand; PAM type: YTN; PAM sequence: CTA
ttatttagatctggaaccta

SEQ ID NO: 283409 - DNA, 20 bp, Artificial Sequence
  Description of Artificial Sequence: Synthetic oligonucleotide
  Target: ATXN1; (+) strand; PAM type: YTN; PAM sequence: TTA
tttagatctggaacctaaaa

SEQ ID NO: 283410 - DNA, 20 bp, Artificial Sequence
  Description of Artificial Sequence: Synthetic oligonucleotide
  Target: ATXN1; (+) strand; PAM type: YTN; PAM sequence: TTT
agatctggaacctaaaatct

SEQ ID NO: 283411 - DNA, 20 bp, Artificial Sequence
  Description of Artificial Sequence: Synthetic oligonucleotide
  Target: ATXN1; (+) strand; PAM type: YTN; PAM sequence: TTA
gatctggaacctaaaatctg

SEQ ID NO: 283412 - DNA, 20 bp, Artificial Sequence
  Description of Artificial Sequence: Synthetic oligonucleotide
  Target: ATXN1; (+) strand; PAM type: YTN; PAM sequence: CTG
gaacctaaaatctgtttaaa

SEQ ID NO: 283413 - DNA, 20 bp, Artificial Sequence
  Description of Artificial Sequence: Synthetic oligonucleotide
  Target: ATXN1; (+) strand; PAM type: YTN; PAM sequence: CTA
aaatctgtttaaagtgaact

SEQ ID NO: 283414 - DNA, 20 bp, Artificial Sequence
  Description of Artificial Sequence: Synthetic oligonucleotide
  Target: ATXN1; (+) strand; PAM type: YTN; PAM sequence: CTG
tttaaagtgaactaaataaa

SEQ ID NO: 283415 - DNA, 20 bp, Artificial Sequence
  Description of Artificial Sequence: Synthetic oligonucleotide
  Target: ATXN1; (+) strand; PAM type: YTN; PAM sequence: TTT
aaagtgaactaaataaagtt

SEQ ID NO: 283416 - DNA, 20 bp, Artificial Sequence
  Description of Artificial Sequence: Synthetic oligonucleotide
  Target: ATXN1; (+) strand; PAM type: YTN; PAM sequence: TTA
aagtgaactaaataaagtta

SEQ ID NO: 283417 - DNA, 20 bp, Artificial Sequence
  Description of Artificial Sequence: Synthetic oligonucleotide
  Target: ATXN1; (+) strand; PAM type: YTN; PAM sequence: CTA
aataaagttaattatgcatg

SEQ ID NO: 283418 - DNA, 20 bp, Artificial Sequence
  Description of Artificial Sequence: Synthetic oligonucleotide
  Target: ATXN1; (+) strand; PAM type: YTN; PAM sequence: TTA
attatgcatgtgcacaaaag

SEQ ID NO: 283419 - DNA, 20 bp, Artificial Sequence
  Description of Artificial Sequence: Synthetic oligonucleotide
  Target: ATXN1; (+) strand; PAM type: YTN; PAM sequence: TTA
tgcatgtgcacaaaaggtag

SEQ ID NO: 283420 - DNA, 20 bp, Artificial Sequence
  Description of Artificial Sequence: Synthetic oligonucleotide
  Target: ATXN1; (+) strand; PAM type: YTN; PAM sequence: TTA
attatataattaatctcact

SEQ ID NO: 283421 - DNA, 20 bp, Artificial Sequence
  Description of Artificial Sequence: Synthetic oligonucleotide
  Target: ATXN1; (+) strand; PAM type: YTN; PAM sequence: TTA
tataattaatctcactctct

SEQ ID NO: 283422 - DNA, 20 bp, Artificial Sequence
  Description of Artificial Sequence: Synthetic oligonucleotide
  Target: ATXN1; (+) strand; PAM type: YTN; PAM sequence: TTA
atctcactctctgaggtgaa

SEQ ID NO: 283423 - DNA, 20 bp, Artificial Sequence
  Description of Artificial Sequence: Synthetic oligonucleotide
  Target: ATXN1; (+) strand; PAM type: YTN; PAM sequence: CTC
actctctgaggtgaattata

SEQ ID NO: 283424 - DNA, 20 bp, Artificial Sequence
  Description of Artificial Sequence: Synthetic oligonucleotide
  Target: ATXN1; (+) strand; PAM type: YTN; PAM sequence: CTC
tctgaggtgaattatagtgg

SEQ ID NO: 283425 - DNA, 20 bp, Artificial Sequence
  Description of Artificial Sequence: Synthetic oligonucleotide
  Target: ATXN1; (+) strand; PAM type: YTN; PAM sequence: CTC
tgaggtgaattatagtgggt

SEQ ID NO: 283426 - DNA, 20 bp, Artificial Sequence
  Description of Artificial Sequence: Synthetic oligonucleotide
  Target: ATXN1; (+) strand; PAM type: YTN; PAM sequence: CTG
aggtgaattatagtgggtaa

SEQ ID NO: 283427 - DNA, 20 bp, Artificial Sequence
  Description of Artificial Sequence: Synthetic oligonucleotide
  Target: ATXN1; (+) strand; PAM type: YTN; PAM sequence: TTA
tagtgggtaaagtaagaaaa

SEQ ID NO: 283428 - DNA, 20 bp, Artificial Sequence
  Description of Artificial Sequence: Synthetic oligonucleotide
  Target: ATXN1; (+) strand; PAM type: YTN; PAM sequence: TTA
ataagagaacaaggtacacg

SEQ ID NO: 283429 - DNA, 20 bp, Artificial Sequence
  Description of Artificial Sequence: Synthetic oligonucleotide
  Target: ATXN1; (+) strand; PAM type: YTN; PAM sequence: TTC
tggtgcacctcgattcttcc

SEQ ID NO: 283430 - DNA, 20 bp, Artificial Sequence
  Description of Artificial Sequence: Synthetic oligonucleotide
  Target: ATXN1; (+) strand; PAM type: YTN; PAM sequence: CTG
gtgcacctcgattcttcctt

SEQ ID NO: 283431 - DNA, 20 bp, Artificial Sequence
  Description of Artificial Sequence: Synthetic oligonucleotide
  Target: ATXN1; (+) strand; PAM type: YTN; PAM sequence: CTC
gattcttcctttgggtggtt

SEQ ID NO: 283432 - DNA, 20 bp, Artificial Sequence
  Description of Artificial Sequence: Synthetic oligonucleotide
  Target: ATXN1; (+) strand; PAM type: YTN; PAM sequence: TTC
ttcctttgggtggttaagaa

SEQ ID NO: 283433 - DNA, 20 bp, Artificial Sequence
  Description of Artificial Sequence: Synthetic oligonucleotide
  Target: ATXN1; (+) strand; PAM type: YTN; PAM sequence: CTT
cctttgggtggttaagaaaa

SEQ ID NO: 283434 - DNA, 20 bp, Artificial Sequence
  Description of Artificial Sequence: Synthetic oligonucleotide
  Target: ATXN1; (+) strand; PAM type: YTN; PAM sequence: TTC
ctttgggtggttaagaaaaa

SEQ ID NO: 283435 - DNA, 20 bp, Artificial Sequence
  Description of Artificial Sequence: Synthetic oligonucleotide
  Target: ATXN1; (+) strand; PAM type: YTN; PAM sequence: CTT
tgggtggttaagaaaaatca

SEQ ID NO: 283436 - DNA, 20 bp, Artificial Sequence
  Description of Artificial Sequence: Synthetic oligonucleotide
  Target: ATXN1; (+) strand; PAM type: YTN; PAM sequence: TTT
gggtggttaagaaaaatcac

SEQ ID NO: 283437 - DNA, 20 bp, Artificial Sequence
  Description of Artificial Sequence: Synthetic oligonucleotide
  Target: ATXN1; (+) strand; PAM type: YTN; PAM sequence: TTG
ggtggttaagaaaaatcacc

SEQ ID NO: 283438 - DNA, 20 bp, Artificial Sequence
  Description of Artificial Sequence: Synthetic oligonucleotide
  Target: ATXN1; (+) strand; PAM type: YTN; PAM sequence: TTA
agaaaaatcaccatactgtg

SEQ ID NO: 283439 - DNA, 20 bp, Artificial Sequence
  Description of Artificial Sequence: Synthetic oligonucleotide
  Target: ATXN1; (+) strand; PAM type: YTN; PAM sequence: CTG
tgataaagacacggtgacat

SEQ ID NO: 283440 - DNA, 20 bp, Artificial Sequence
  Description of Artificial Sequence: Synthetic oligonucleotide
  Target: ATXN1; (+) strand; PAM type: YTN; PAM sequence: CTT
tctaacatgtttgtagagtt

SEQ ID NO: 283441 - DNA, 20 bp, Artificial Sequence
  Description of Artificial Sequence: Synthetic oligonucleotide
  Target: ATXN1; (+) strand; PAM type: YTN; PAM sequence: TTT
ctaacatgtttgtagagtta

SEQ ID NO: 283442 - DNA, 20 bp, Artificial Sequence
  Description of Artificial Sequence: Synthetic oligonucleotide
  Target: ATXN1; (+) strand; PAM type: YTN; PAM sequence: TTC
taacatgtttgtagagttat

SEQ ID NO: 283443 - DNA, 20 bp, Artificial Sequence
  Description of Artificial Sequence: Synthetic oligonucleotide
  Target: ATXN1; (+) strand; PAM type: YTN; PAM sequence: CTA
acatgtttgtagagttataa

SEQ ID NO: 283444 - DNA, 20 bp, Artificial Sequence
  Description of Artificial Sequence: Synthetic oligonucleotide
  Target: ATXN1; (+) strand; PAM type: YTN; PAM sequence: TTT
gtagagttataaaaagtaaa

SEQ ID NO: 283445 - DNA, 20 bp, Artificial Sequence
  Description of Artificial Sequence: Synthetic oligonucleotide
  Target: ATXN1; (+) strand; PAM type: YTN; PAM sequence: TTG
tagagttataaaaagtaaaa

SEQ ID NO: 283446 - DNA, 20 bp, Artificial Sequence
  Description of Artificial Sequence: Synthetic oligonucleotide
  Target: ATXN1; (+) strand; PAM type: YTN; PAM sequence: TTA
taaaaagtaaaagactcatt

SEQ ID NO: 283447 - DNA, 20 bp, Artificial Sequence
  Description of Artificial Sequence: Synthetic oligonucleotide
  Target: ATXN1; (+) strand; PAM type: YTN; PAM sequence: CTC
atttcacaatttcttaagga

SEQ ID NO: 283448 - DNA, 20 bp, Artificial Sequence
  Description of Artificial Sequence: Synthetic oligonucleotide
  Target: ATXN1; (+) strand; PAM type: YTN; PAM sequence: TTT
cacaatttcttaaggatatg

SEQ ID NO: 283449 - DNA, 20 bp, Artificial Sequence
  Description of Artificial Sequence: Synthetic oligonucleotide
  Target: ATXN1; (+) strand; PAM type: YTN; PAM sequence: TTC
acaatttcttaaggatatgg

SEQ ID NO: 283450 - DNA, 20 bp, Artificial Sequence
  Description of Artificial Sequence: Synthetic oligonucleotide
  Target: ATXN1; (+) strand; PAM type: YTN; PAM sequence: TTT
cttaaggatatggattgtca

SEQ ID NO: 283451 - DNA, 20 bp, Artificial Sequence
  Description of Artificial Sequence: Synthetic oligonucleotide
  Target: ATXN1; (+) strand; PAM type: YTN; PAM sequence: TTC
ttaaggatatggattgtcaa

SEQ ID NO: 283452 - DNA, 20 bp, Artificial Sequence
  Description of Artificial Sequence: Synthetic oligonucleotide
  Target: ATXN1; (+) strand; PAM type: YTN; PAM sequence: CTT
aaggatatggattgtcaata

SEQ ID NO: 283453 - DNA, 20 bp, Artificial Sequence
  Description of Artificial Sequence: Synthetic oligonucleotide
  Target: ATXN1; (+) strand; PAM type: YTN; PAM sequence: TTA
aggatatggattgtcaataa

SEQ ID NO: 283454 - DNA, 20 bp, Artificial Sequence
  Description of Artificial Sequence: Synthetic oligonucleotide
  Target: ATXN1; (+) strand; PAM type: YTN; PAM sequence: TTG
tcaataagatgcatcattta

SEQ ID NO: 283455 - DNA, 20 bp, Artificial Sequence
  Description of Artificial Sequence: Synthetic oligonucleotide
  Target: ATXN1; (+) strand; PAM type: YTN; PAM sequence: TTT
acattacctaaattgagaga

SEQ ID NO: 283456 - DNA, 20 bp, Artificial Sequence
  Description of Artificial Sequence: Synthetic oligonucleotide
  Target: ATXN1; (+) strand; PAM type: YTN; PAM sequence: TTA
cattacctaaattgagagat

SEQ ID NO: 283457 - DNA, 20 bp, Artificial Sequence
  Description of Artificial Sequence: Synthetic oligonucleotide
  Target: ATXN1; (+) strand; PAM type: YTN; PAM sequence: TTA
cctaaattgagagatgagta

SEQ ID NO: 283458 - DNA, 20 bp, Artificial Sequence
  Description of Artificial Sequence: Synthetic oligonucleotide
  Target: ATXN1; (+) strand; PAM type: YTN; PAM sequence: CTA
aattgagagatgagtagccc

SEQ ID NO: 283459 - DNA, 20 bp, Artificial Sequence
  Description of Artificial Sequence: Synthetic oligonucleotide
  Target: ATXN1; (+) strand; PAM type: YTN; PAM sequence: TTG
agagatgagtagcccgatga

SEQ ID NO: 283460 - DNA, 20 bp, Artificial Sequence
  Description of Artificial Sequence: Synthetic oligonucleotide
  Target: ATXN1; (+) strand; PAM type: YTN; PAM sequence: CTT
tactggccctagcaactgtg

SEQ ID NO: 283461 - DNA, 20 bp, Artificial Sequence
  Description of Artificial Sequence: Synthetic oligonucleotide
  Target: ATXN1; (+) strand; PAM type: YTN; PAM sequence: TTT
actggccctagcaactgtgc

SEQ ID NO: 283462 - DNA, 20 bp, Artificial Sequence
  Description of Artificial Sequence: Synthetic oligonucleotide
  Target: ATXN1; (+) strand; PAM type: YTN; PAM sequence: TTA
ctggccctagcaactgtgca

SEQ ID NO: 283463 - DNA, 20 bp, Artificial Sequence
  Description of Artificial Sequence: Synthetic oligonucleotide
  Target: ATXN1; (+) strand; PAM type: YTN; PAM sequence: CTG
gccctagcaactgtgcattc

SEQ ID NO: 283464 - DNA, 20 bp, Artificial Sequence
  Description of Artificial Sequence: Synthetic oligonucleotide
  Target: ATXN1; (+) strand; PAM type: YTN; PAM sequence: CTA
gcaactgtgcattcgagggg

SEQ ID NO: 283465 - DNA, 20 bp, Artificial Sequence
  Description of Artificial Sequence: Synthetic oligonucleotide
  Target: ATXN1; (+) strand; PAM type: YTN; PAM sequence: CTG
tgcattcgaggggtgttaga

SEQ ID NO: 283466 - DNA, 20 bp, Artificial Sequence
  Description of Artificial Sequence: Synthetic oligonucleotide
  Target: ATXN1; (+) strand; PAM type: YTN; PAM sequence: TTC
gaggggtgttagacagtacg

SEQ ID NO: 283467 - DNA, 20 bp, Artificial Sequence
  Description of Artificial Sequence: Synthetic oligonucleotide
  Target: ATXN1; (+) strand; PAM type: YTN; PAM sequence: TTA
gacagtacgcttctctcctt

SEQ ID NO: 283468 - DNA, 20 bp, Artificial Sequence
  Description of Artificial Sequence: Synthetic oligonucleotide
  Target: ATXN1; (+) strand; PAM type: YTN; PAM sequence: CTT
ctctccttaccttcttcatt

SEQ ID NO: 283469 - DNA, 20 bp, Artificial Sequence
  Description of Artificial Sequence: Synthetic oligonucleotide
  Target: ATXN1; (+) strand; PAM type: YTN; PAM sequence: TTC
tctccttaccttcttcattt

SEQ ID NO: 283470 - DNA, 20 bp, Artificial Sequence
  Description of Artificial Sequence: Synthetic oligonucleotide
  Target: ATXN1; (+) strand; PAM type: YTN; PAM sequence: CTC
tccttaccttcttcatttcc

SEQ ID NO: 283471 - DNA, 20 bp, Artificial Sequence
  Description of Artificial Sequence: Synthetic oligonucleotide
  Target: ATXN1; (+) strand; PAM type: YTN; PAM sequence: CTC
cttaccttcttcatttcctg

SEQ ID NO: 283472 - DNA, 20 bp, Artificial Sequence
  Description of Artificial Sequence: Synthetic oligonucleotide
  Target: ATXN1; (+) strand; PAM type: YTN; PAM sequence: CTT
accttcttcatttcctggcc

SEQ ID NO: 283473 - DNA, 20 bp, Artificial Sequence
  Description of Artificial Sequence: Synthetic oligonucleotide
  Target: ATXN1; (+) strand; PAM type: YTN; PAM sequence: TTA
ccttcttcatttcctggcct

SEQ ID NO: 283474 - DNA, 20 bp, Artificial Sequence
  Description of Artificial Sequence: Synthetic oligonucleotide
  Target: ATXN1; (+) strand; PAM type: YTN; PAM sequence: CTT
cttcatttcctggcctggtc

SEQ ID NO: 283475 - DNA, 20 bp, Artificial Sequence
  Description of Artificial Sequence: Synthetic oligonucleotide
  Target: ATXN1; (+) strand; PAM type: YTN; PAM sequence: TTC
ttcatttcctggcctggtcc

SEQ ID NO: 283476 - DNA, 20 bp, Artificial Sequence
  Description of Artificial Sequence: Synthetic oligonucleotide
  Target: ATXN1; (+) strand; PAM type: YTN; PAM sequence: CTT
catttcctggcctggtccgg

SEQ ID NO: 283477 - DNA, 20 bp, Artificial Sequence
  Description of Artificial Sequence: Synthetic oligonucleotide
  Target: ATXN1; (+) strand; PAM type: YTN; PAM sequence: TTC
atttcctggcctggtccggc

SEQ ID NO: 283478 - DNA, 20 bp, Artificial Sequence
  Description of Artificial Sequence: Synthetic oligonucleotide
  Target: ATXN1; (+) strand; PAM type: YTN; PAM sequence: TTT
cctggcctggtccggctgtc

SEQ ID NO: 283479 - DNA, 20 bp, Artificial Sequence
  Description of Artificial Sequence: Synthetic oligonucleotide
  Target: ATXN1; (+) strand; PAM type: YTN; PAM sequence: TTC
ctggcctggtccggctgtca

SEQ ID NO: 283480 - DNA, 20 bp, Artificial Sequence
  Description of Artificial Sequence: Synthetic oligonucleotide
  Target: ATXN1; (+) strand; PAM type: YTN; PAM sequence: CTG
gcctggtccggctgtcaaca

SEQ ID NO: 283481 - DNA, 20 bp, Artificial Sequence
  Description of Artificial Sequence: Synthetic oligonucleotide
  Target: ATXN1; (+) strand; PAM type: YTN; PAM sequence: CTG
gtccggctgtcaacaatcac

SEQ ID NO: 283482 - DNA, 20 bp, Artificial Sequence
  Description of Artificial Sequence: Synthetic oligonucleotide
  Target: ATXN1; (+) strand; PAM type: YTN; PAM sequence: CTG
tcaacaatcacaacctcatt

SEQ ID NO: 283483 - DNA, 20 bp, Artificial Sequence
  Description of Artificial Sequence: Synthetic oligonucleotide
  Target: ATXN1; (+) strand; PAM type: YTN; PAM sequence: CTC
attgtcagtccctgactatt

SEQ ID NO: 283484 - DNA, 20 bp, Artificial Sequence
  Description of Artificial Sequence: Synthetic oligonucleotide
  Target: ATXN1; (+) strand; PAM type: YTN; PAM sequence: TTG
tcagtccctgactattctct

SEQ ID NO: 283485 - DNA, 20 bp, Artificial Sequence
  Description of Artificial Sequence: Synthetic oligonucleotide
  Target: ATXN1; (+) strand; PAM type: YTN; PAM sequence: CTG
actattctctggttctttct

SEQ ID NO: 283486 - DNA, 20 bp, Artificial Sequence
  Description of Artificial Sequence: Synthetic oligonucleotide
  Target: ATXN1; (+) strand; PAM type: YTN; PAM sequence: CTA
ttctctggttctttctgttc

SEQ ID NO: 283487 - DNA, 20 bp, Artificial Sequence
  Description of Artificial Sequence: Synthetic oligonucleotide
  Target: ATXN1; (+) strand; PAM type: YTN; PAM sequence: TTC
tctggttctttctgttctat

SEQ ID NO: 283488 - DNA, 20 bp, Artificial Sequence
  Description of Artificial Sequence: Synthetic oligonucleotide
  Target: ATXN1; (+) strand; PAM type: YTN; PAM sequence: CTC
tggttctttctgttctatgc

SEQ ID NO: 283489 - DNA, 20 bp, Artificial Sequence
  Description of Artificial Sequence: Synthetic oligonucleotide
  Target: ATXN1; (+) strand; PAM type: YTN; PAM sequence: CTG
gttctttctgttctatgcct

SEQ ID NO: 283490 - DNA, 20 bp, Artificial Sequence
  Description of Artificial Sequence: Synthetic oligonucleotide
  Target: ATXN1; (+) strand; PAM type: YTN; PAM sequence: TTC
tttctgttctatgccttcca

SEQ ID NO: 283491 - DNA, 20 bp, Artificial Sequence
  Description of Artificial Sequence: Synthetic oligonucleotide
  Target: ATXN1; (+) strand; PAM type: YTN; PAM sequence: CTT
tctgttctatgccttccaga

SEQ ID NO: 283492 - DNA, 20 bp, Artificial Sequence
  Description of Artificial Sequence: Synthetic oligonucleotide
  Target: ATXN1; (+) strand; PAM type: YTN; PAM sequence: TTT
ctgttctatgccttccagat

SEQ ID NO: 283493 - DNA, 20 bp, Artificial Sequence
  Description of Artificial Sequence: Synthetic oligonucleotide
  Target: ATXN1; (+) strand; PAM type: YTN; PAM sequence: TTC
tgttctatgccttccagatc

SEQ ID NO: 283494 - DNA, 20 bp, Artificial Sequence
  Description of Artificial Sequence: Synthetic oligonucleotide
  Target: ATXN1; (+) strand; PAM type: YTN; PAM sequence: CTG
ttctatgccttccagatcaa

SEQ ID NO: 283495 - DNA, 20 bp, Artificial Sequence
  Description of Artificial Sequence: Synthetic oligonucleotide
  Target: ATXN1; (+) strand; PAM type: YTN; PAM sequence: TTC
tatgccttccagatcaacag

SEQ ID NO: 283496 - DNA, 20 bp, Artificial Sequence
  Description of Artificial Sequence: Synthetic oligonucleotide
  Target: ATXN1; (+) strand; PAM type: YTN; PAM sequence: CTA
tgccttccagatcaacaggt

SEQ ID NO: 283497 - DNA, 20 bp, Artificial Sequence
  Description of Artificial Sequence: Synthetic oligonucleotide
  Target: ATXN1; (+) strand; PAM type: YTN; PAM sequence: CTT
ccagatcaacaggtctgtct

SEQ ID NO: 283498 - DNA, 20 bp, Artificial Sequence
  Description of Artificial Sequence: Synthetic oligonucleotide
  Target: ATXN1; (+) strand; PAM type: YTN; PAM sequence: TTC
cagatcaacaggtctgtctc

SEQ ID NO: 283499 - DNA, 20 bp, Artificial Sequence
  Description of Artificial Sequence: Synthetic oligonucleotide
  Target: ATXN1; (+) strand; PAM type: YTN; PAM sequence: CTG
tctcccctggtttctccagt

SEQ ID NO: 283500 - DNA, 20 bp, Artificial Sequence
  Description of Artificial Sequence: Synthetic oligonucleotide
  Target: ATXN1; (+) strand; PAM type: YTN; PAM sequence: CTC
ccctggtttctccagtttcc

SEQ ID NO: 283501 - DNA, 20 bp, Artificial Sequence
  Description of Artificial Sequence: Synthetic oligonucleotide
  Target: ATXN1; (+) strand; PAM type: YTN; PAM sequence: CTG
gtttctccagtttccaattt

SEQ ID NO: 283502 - DNA, 20 bp, Artificial Sequence
  Description of Artificial Sequence: Synthetic oligonucleotide
  Target: ATXN1; (+) strand; PAM type: YTN; PAM sequence: TTT
ctccagtttccaatttcaga

SEQ ID NO: 283503 - DNA, 20 bp, Artificial Sequence
  Description of Artificial Sequence: Synthetic oligonucleotide
  Target: ATXN1; (+) strand; PAM type: YTN; PAM sequence: TTC
tccagtttccaatttcagat

SEQ ID NO: 283504 - DNA, 20 bp, Artificial Sequence
  Description of Artificial Sequence: Synthetic oligonucleotide
  Target: ATXN1; (+) strand; PAM type: YTN; PAM sequence: CTC
cagtttccaatttcagatgc

SEQ ID NO: 283505 - DNA, 20 bp, Artificial Sequence
  Description of Artificial Sequence: Synthetic oligonucleotide
  Target: ATXN1; (+) strand; PAM type: YTN; PAM sequence: TTT
ccaatttcagatgcacctct

SEQ ID NO: 283506 - DNA, 20 bp, Artificial Sequence
  Description of Artificial Sequence: Synthetic oligonucleotide
  Target: ATXN1; (+) strand; PAM type: YTN; PAM sequence: TTC
caatttcagatgcacctctt

SEQ ID NO: 283507 - DNA, 20 bp, Artificial Sequence
  Description of Artificial Sequence: Synthetic oligonucleotide
  Target: ATXN1; (+) strand; PAM type: YTN; PAM sequence: TTT
cagatgcacctcttgcctcc

SEQ ID NO: 283508 - DNA, 20 bp, Artificial Sequence
  Description of Artificial Sequence: Synthetic oligonucleotide
  Target: ATXN1; (+) strand; PAM type: YTN; PAM sequence: TTC
agatgcacctcttgcctcct

SEQ ID NO: 283509 - DNA, 20 bp, Artificial Sequence
  Description of Artificial Sequence: Synthetic oligonucleotide
  Target: ATXN1; (+) strand; PAM type: YTN; PAM sequence: CTC
ttgcctccttttagaatggt

SEQ ID NO: 283510 - DNA, 20 bp, Artificial Sequence
  Description of Artificial Sequence: Synthetic oligonucleotide
  Target: ATXN1; (+) strand; PAM type: YTN; PAM sequence: CTT
gcctccttttagaatggtcc

SEQ ID NO: 283511 - DNA, 20 bp, Artificial Sequence
  Description of Artificial Sequence: Synthetic oligonucleotide
  Target: ATXN1; (+) strand; PAM type: YTN; PAM sequence: TTG
cctccttttagaatggtcca

SEQ ID NO: 283512 - DNA, 20 bp, Artificial Sequence
  Description of Artificial Sequence: Synthetic oligonucleotide
  Target: ATXN1; (+) strand; PAM type: YTN; PAM sequence: CTC
cttttagaatggtccagttc

SEQ ID NO: 283513 - DNA, 20 bp, Artificial Sequence
  Description of Artificial Sequence: Synthetic oligonucleotide
  Target: ATXN1; (+) strand; PAM type: YTN; PAM sequence: CTT
ttagaatggtccagttcatc

SEQ ID NO: 283514 - DNA, 20 bp, Artificial Sequence
  Description of Artificial Sequence: Synthetic oligonucleotide
  Target: ATXN1; (+) strand; PAM type: YTN; PAM sequence: TTT
tagaatggtccagttcatct

SEQ ID NO: 283515 - DNA, 20 bp, Artificial Sequence
  Description of Artificial Sequence: Synthetic oligonucleotide
  Target: ATXN1; (+) strand; PAM type: YTN; PAM sequence: TTT
agaatggtccagttcatctc

SEQ ID NO: 283516 - DNA, 20 bp, Artificial Sequence
  Description of Artificial Sequence: Synthetic oligonucleotide
  Target: ATXN1; (+) strand; PAM type: YTN; PAM sequence: TTA
gaatggtccagttcatctcc

SEQ ID NO: 283517 - DNA, 20 bp, Artificial Sequence
  Description of Artificial Sequence: Synthetic oligonucleotide
  Target: ATXN1; (+) strand; PAM type: YTN; PAM sequence: TTC
atctcccctgttcccccaaa

SEQ ID NO: 283518 - DNA, 20 bp, Artificial Sequence
  Description of Artificial Sequence: Synthetic oligonucleotide
  Target: ATXN1; (+) strand; PAM type: YTN; PAM sequence: CTC
ccctgttcccccaaaccagt

SEQ ID NO: 283519 - DNA, 20 bp, Artificial Sequence
  Description of Artificial Sequence: Synthetic oligonucleotide
  Target: ATXN1; (+) strand; PAM type: YTN; PAM sequence: CTG
ttcccccaaaccagttatga

SEQ ID NO: 283520 - DNA, 20 bp, Artificial Sequence
  Description of Artificial Sequence: Synthetic oligonucleotide
  Target: ATXN1; (+) strand; PAM type: YTN; PAM sequence: TTC
ccccaaaccagttatgatgg

SEQ ID NO: 283521 - DNA, 20 bp, Artificial Sequence
  Description of Artificial Sequence: Synthetic oligonucleotide
  Target: ATXN1; (+) strand; PAM type: YTN; PAM sequence: TTA
tgatggtgttgactgtatct

SEQ ID NO: 283522 - DNA, 20 bp, Artificial Sequence
  Description of Artificial Sequence: Synthetic oligonucleotide
  Target: ATXN1; (+) strand; PAM type: YTN; PAM sequence: TTG
actgtatctccctgagaact

SEQ ID NO: 283523 - DNA, 20 bp, Artificial Sequence
  Description of Artificial Sequence: Synthetic oligonucleotide
  Target: ATXN1; (+) strand; PAM type: YTN; PAM sequence: CTG
tatctccctgagaactgtaa

SEQ ID NO: 283524 - DNA, 20 bp, Artificial Sequence
  Description of Artificial Sequence: Synthetic oligonucleotide
  Target: ATXN1; (+) strand; PAM type: YTN; PAM sequence: CTC
cctgagaactgtaaactcca

SEQ ID NO: 283525 - DNA, 20 bp, Artificial Sequence
  Description of Artificial Sequence: Synthetic oligonucleotide
  Target: ATXN1; (+) strand; PAM type: YTN; PAM sequence: CTG
agaactgtaaactccattag

SEQ ID NO: 283526 - DNA, 20 bp, Artificial Sequence
  Description of Artificial Sequence: Synthetic oligonucleotide
  Target: ATXN1; (+) strand; PAM type: YTN; PAM sequence: CTG
taaactccattagggccagt

SEQ ID NO: 283527 - DNA, 20 bp, Artificial Sequence
  Description of Artificial Sequence: Synthetic oligonucleotide
  Target: ATXN1; (+) strand; PAM type: YTN; PAM sequence: CTC
cattagggccagtcttttgt

SEQ ID NO: 283528 - DNA, 20 bp, Artificial Sequence
  Description of Artificial Sequence: Synthetic oligonucleotide
  Target: ATXN1; (+) strand; PAM type: YTN; PAM sequence: TTA
gggccagtcttttgtcaatc

SEQ ID NO: 283529 - DNA, 20 bp, Artificial Sequence
  Description of Artificial Sequence: Synthetic oligonucleotide
  Target: ATXN1; (+) strand; PAM type: YTN; PAM sequence: CTT
ttgtcaatcttgttttcctc

SEQ ID NO: 283530 - DNA, 20 bp, Artificial Sequence
  Description of Artificial Sequence: Synthetic oligonucleotide
  Target: ATXN1; (+) strand; PAM type: YTN; PAM sequence: TTT
tgtcaatcttgttttcctcc

SEQ ID NO: 283531 - DNA, 20 bp, Artificial Sequence
  Description of Artificial Sequence: Synthetic oligonucleotide
  Target: ATXN1; (+) strand; PAM type: YTN; PAM sequence: TTT
gtcaatcttgttttcctcca

SEQ ID NO: 283532 - DNA, 20 bp, Artificial Sequence
  Description of Artificial Sequence: Synthetic oligonucleotide
  Target: ATXN1; (+) strand; PAM type: YTN; PAM sequence: TTG
tcaatcttgttttcctccat

SEQ ID NO: 283533 - DNA, 20 bp, Artificial Sequence
  Description of Artificial Sequence: Synthetic oligonucleotide
  Target: ATXN1; (+) strand; PAM type: YTN; PAM sequence: CTT
gttttcctccattatcttca

SEQ ID NO: 283534 - DNA, 20 bp, Artificial Sequence
  Description of Artificial Sequence: Synthetic oligonucleotide
  Target: ATXN1; (+) strand; PAM type: YTN; PAM sequence: TTG
ttttcctccattatcttcaa

SEQ ID NO: 283535 - DNA, 20 bp, Artificial Sequence
  Description of Artificial Sequence: Synthetic oligonucleotide
  Target: ATXN1; (+) strand; PAM type: YTN; PAM sequence: TTT
tcctccattatcttcaatgc

SEQ ID NO: 283536 - DNA, 20 bp, Artificial Sequence
  Description of Artificial Sequence: Synthetic oligonucleotide
  Target: ATXN1; (+) strand; PAM type: YTN; PAM sequence: TTT
cctccattatcttcaatgcc

SEQ ID NO: 283537 - DNA, 20 bp, Artificial Sequence
  Description of Artificial Sequence: Synthetic oligonucleotide
  Target: ATXN1; (+) strand; PAM type: YTN; PAM sequence: TTC
ctccattatcttcaatgccc

SEQ ID NO: 283538 - DNA, 20 bp, Artificial Sequence
  Description of Artificial Sequence: Synthetic oligonucleotide
  Target: ATXN1; (+) strand; PAM type: YTN; PAM sequence: CTC
cattatcttcaatgcccagc

SEQ ID NO: 283539 - DNA, 20 bp, Artificial Sequence
  Description of Artificial Sequence: Synthetic oligonucleotide
  Target: ATXN1; (+) strand; PAM type: YTN; PAM sequence: TTA
tcttcaatgcccagccctat

SEQ ID NO: 283540 - DNA, 20 bp, Artificial Sequence
  Description of Artificial Sequence: Synthetic oligonucleotide
  Target: ATXN1; (+) strand; PAM type: YTN; PAM sequence: CTT
caatgcccagccctatactg

SEQ ID NO: 283541 - DNA, 20 bp, Artificial Sequence
  Description of Artificial Sequence: Synthetic oligonucleotide
  Target: ATXN1; (+) strand; PAM type: YTN; PAM sequence: TTC
aatgcccagccctatactgg

SEQ ID NO: 283542 - DNA, 20 bp, Artificial Sequence
  Description of Artificial Sequence: Synthetic oligonucleotide
  Target: ATXN1; (+) strand; PAM type: YTN; PAM sequence: CTA
tactgggacatagctgcccc

SEQ ID NO: 283543 - DNA, 20 bp, Artificial Sequence
  Description of Artificial Sequence: Synthetic oligonucleotide
  Target: ATXN1; (+) strand; PAM type: YTN; PAM sequence: CTG
ggacatagctgcccctaaaa

SEQ ID NO: 283544 - DNA, 20 bp, Artificial Sequence
  Description of Artificial Sequence: Synthetic oligonucleotide
  Target: ATXN1; (+) strand; PAM type: YTN; PAM sequence: CTG
cccctaaaaaggcctttgct

SEQ ID NO: 283545 - DNA, 20 bp, Artificial Sequence
  Description of Artificial Sequence: Synthetic oligonucleotide
  Target: ATXN1; (+) strand; PAM type: YTN; PAM sequence: CTA
aaaaggcctttgctaaatta

SEQ ID NO: 283546 - DNA, 20 bp, Artificial Sequence
  Description of Artificial Sequence: Synthetic oligonucleotide
  Target: ATXN1; (+) strand; PAM type: YTN; PAM sequence: CTT
tgctaaattaataaatgagt

SEQ ID NO: 283547 - DNA, 20 bp, Artificial Sequence
  Description of Artificial Sequence: Synthetic oligonucleotide
  Target: ATXN1; (+) strand; PAM type: YTN; PAM sequence: TTT
gctaaattaataaatgagtg

SEQ ID NO: 283548 - DNA, 20 bp, Artificial Sequence
  Description of Artificial Sequence: Synthetic oligonucleotide
  Target: ATXN1; (+) strand; PAM type: YTN; PAM sequence: TTG
ctaaattaataaatgagtga

SEQ ID NO: 283549 - DNA, 20 bp, Artificial Sequence
  Description of Artificial Sequence: Synthetic oligonucleotide
  Target: ATXN1; (+) strand; PAM type: YTN; PAM sequence: CTA
aattaataaatgagtgagga

SEQ ID NO: 283550 - DNA, 20 bp, Artificial Sequence
  Description of Artificial Sequence: Synthetic oligonucleotide
  Target: ATXN1; (+) strand; PAM type: YTN; PAM sequence: TTA
ataaatgagtgaggaatgac

SEQ ID NO: 283551 - DNA, 20 bp, Artificial Sequence
  Description of Artificial Sequence: Synthetic oligonucleotide
  Target: ATXN1; (+) strand; PAM type: YTN; PAM sequence: CTG
aatgggattaaaattaaaga

SEQ ID NO: 283552 - DNA, 20 bp, Artificial Sequence
  Description of Artificial Sequence: Synthetic oligonucleotide
  Target: ATXN1; (+) strand; PAM type: YTN; PAM sequence: TTA
aaattaaagaccttgtctca

SEQ ID NO: 283553 - DNA, 20 bp, Artificial Sequence
  Description of Artificial Sequence: Synthetic oligonucleotide
  Target: ATXN1; (+) strand; PAM type: YTN; PAM sequence: TTA
aagaccttgtctcagtttct

SEQ ID NO: 283554 - DNA, 20 bp, Artificial Sequence
  Description of Artificial Sequence: Synthetic oligonucleotide
  Target: ATXN1; (+) strand; PAM type: YTN; PAM sequence: CTT
gtctcagtttctcacaattc

SEQ ID NO: 283555 - DNA, 20 bp, Artificial Sequence
  Description of Artificial Sequence: Synthetic oligonucleotide
  Target: ATXN1; (+) strand; PAM type: YTN; PAM sequence: TTG
tctcagtttctcacaattca

SEQ ID NO: 283556 - DNA, 20 bp, Artificial Sequence
  Description of Artificial Sequence: Synthetic oligonucleotide
  Target: ATXN1; (+) strand; PAM type: YTN; PAM sequence: CTC
agtttctcacaattcaaaag

SEQ ID NO: 283557 - DNA, 20 bp, Artificial Sequence
  Description of Artificial Sequence: Synthetic oligonucleotide
  Target: ATXN1; (+) strand; PAM type: YTN; PAM sequence: TTT
ctcacaattcaaaagttgtg

SEQ ID NO: 283558 - DNA, 20 bp, Artificial Sequence
  Description of Artificial Sequence: Synthetic oligonucleotide
  Target: ATXN1; (+) strand; PAM type: YTN; PAM sequence: TTC
tcacaattcaaaagttgtgc

SEQ ID NO: 283559 - DNA, 20 bp, Artificial Sequence
  Description of Artificial Sequence: Synthetic oligonucleotide
  Target: ATXN1; (+) strand; PAM type: YTN; PAM sequence: CTC
acaattcaaaagttgtgctt

SEQ ID NO: 283560 - DNA, 20 bp, Artificial Sequence
  Description of Artificial Sequence: Synthetic oligonucleotide
  Target: ATXN1; (+) strand; PAM type: YTN; PAM sequence: TTC
aaaagttgtgctttaacttt

SEQ ID NO: 283561 - DNA, 20 bp, Artificial Sequence
  Description of Artificial Sequence: Synthetic oligonucleotide
  Target: ATXN1; (+) strand; PAM type: YTN; PAM sequence: TTG
tgctttaactttgtgctggc

SEQ ID NO: 283562 - DNA, 20 bp, Artificial Sequence
  Description of Artificial Sequence: Synthetic oligonucleotide
  Target: ATXN1; (+) strand; PAM type: YTN; PAM sequence: CTT
taactttgtgctggcaaaat

SEQ ID NO: 283563 - DNA, 20 bp, Artificial Sequence
  Description of Artificial Sequence: Synthetic oligonucleotide
  Target: ATXN1; (+) strand; PAM type: YTN; PAM sequence: TTT
aactttgtgctggcaaaatc

SEQ ID NO: 283564 - DNA, 20 bp, Artificial Sequence
  Description of Artificial Sequence: Synthetic oligonucleotide
  Target: ATXN1; (+) strand; PAM type: YTN; PAM sequence: TTA
actttgtgctggcaaaatcc

SEQ ID NO: 283565 - DNA, 20 bp, Artificial Sequence
  Description of Artificial Sequence: Synthetic oligonucleotide
  Target: ATXN1; (+) strand; PAM type: YTN; PAM sequence: CTT
tgtgctggcaaaatcctaag

SEQ ID NO: 283566 - DNA, 20 bp, Artificial Sequence
  Description of Artificial Sequence: Synthetic oligonucleotide
  Target: ATXN1; (+) strand; PAM type: YTN; PAM sequence: TTT
gtgctggcaaaatcctaaga

SEQ ID NO: 283567 - DNA, 20 bp, Artificial Sequence
  Description of Artificial Sequence: Synthetic oligonucleotide
  Target: ATXN1; (+) strand; PAM type: YTN; PAM sequence: TTG
tgctggcaaaatcctaagac

SEQ ID NO: 283568 - DNA, 20 bp, Artificial Sequence
  Description of Artificial Sequence: Synthetic oligonucleotide
  Target: ATXN1; (+) strand; PAM type: YTN; PAM sequence: CTG
gcaaaatcctaagacacccc

SEQ ID NO: 283569 - DNA, 20 bp, Artificial Sequence
  Description of Artificial Sequence: Synthetic oligonucleotide
  Target: ATXN1; (+) strand; PAM type: YTN; PAM sequence: CTA
agacaccccaaagtccccat

SEQ ID NO: 283570 - DNA, 20 bp, Artificial Sequence
  Description of Artificial Sequence: Synthetic oligonucleotide
  Target: ATXN1; (+) strand; PAM type: YTN; PAM sequence: CTT
tgcgaactaagatttcaaca

SEQ ID NO: 283571 - DNA, 20 bp, Artificial Sequence
  Description of Artificial Sequence: Synthetic oligonucleotide
  Target: ATXN1; (+) strand; PAM type: YTN; PAM sequence: TTT
gcgaactaagatttcaacaa

SEQ ID NO: 283572 - DNA, 20 bp, Artificial Sequence
  Description of Artificial Sequence: Synthetic oligonucleotide
  Target: ATXN1; (+) strand; PAM type: YTN; PAM sequence: TTG
cgaactaagatttcaacaat

SEQ ID NO: 283573 - DNA, 20 bp, Artificial Sequence
  Description of Artificial Sequence: Synthetic oligonucleotide
  Target: ATXN1; (+) strand; PAM type: YTN; PAM sequence: CTA
agatttcaacaatgattctg

SEQ ID NO: 283574 - DNA, 20 bp, Artificial Sequence
  Description of Artificial Sequence: Synthetic oligonucleotide
  Target: ATXN1; (+) strand; PAM type: YTN; PAM sequence: TTT
caacaatgattctgcctggt

SEQ ID NO: 283575 - DNA, 20 bp, Artificial Sequence
  Description of Artificial Sequence: Synthetic oligonucleotide
  Target: ATXN1; (+) strand; PAM type: YTN; PAM sequence: TTC
aacaatgattctgcctggtc

SEQ ID NO: 283576 - DNA, 20 bp, Artificial Sequence
  Description of Artificial Sequence: Synthetic oligonucleotide
  Target: ATXN1; (+) strand; PAM type: YTN; PAM sequence: TTC
tgcctggtcttgcagatagg

SEQ ID NO: 283577 - DNA, 20 bp, Artificial Sequence
  Description of Artificial Sequence: Synthetic oligonucleotide
  Target: ATXN1; (+) strand; PAM type: YTN; PAM sequence: CTG
cctggtcttgcagataggtc

SEQ ID NO: 283578 - DNA, 20 bp, Artificial Sequence
  Description of Artificial Sequence: Synthetic oligonucleotide
  Target: ATXN1; (+) strand; PAM type: YTN; PAM sequence: CTG
gtcttgcagataggtcttgt

SEQ ID NO: 283579 - DNA, 20 bp, Artificial Sequence
  Description of Artificial Sequence: Synthetic oligonucleotide
  Target: ATXN1; (+) strand; PAM type: YTN; PAM sequence: CTT
gcagataggtcttgtacatg

SEQ ID NO: 283580 - DNA, 20 bp, Artificial Sequence
  Description of Artificial Sequence: Synthetic oligonucleotide
  Target: ATXN1; (+) strand; PAM type: YTN; PAM sequence: TTG
cagataggtcttgtacatga

SEQ ID NO: 283581 - DNA, 20 bp, Artificial Sequence
  Description of Artificial Sequence: Synthetic oligonucleotide
  Target: ATXN1; (+) strand; PAM type: YTN; PAM sequence: CTT
gtacatgaatgcaaaaatgg

SEQ ID NO: 283582 - DNA, 20 bp, Artificial Sequence
  Description of Artificial Sequence: Synthetic oligonucleotide
  Target: ATXN1; (+) strand; PAM type: YTN; PAM sequence: TTG
tacatgaatgcaaaaatggt

SEQ ID NO: 283583 - DNA, 20 bp, Artificial Sequence
  Description of Artificial Sequence: Synthetic oligonucleotide
  Target: ATXN1; (+) strand; PAM type: YTN; PAM sequence: CTG
ctgaccacagatctgaggtc

SEQ ID NO: 283584 - DNA, 20 bp, Artificial Sequence
  Description of Artificial Sequence: Synthetic oligonucleotide
  Target: ATXN1; (+) strand; PAM type: YTN; PAM sequence: CTG
accacagatctgaggtcaca

SEQ ID NO: 283585 - DNA, 20 bp, Artificial Sequence
  Description of Artificial Sequence: Synthetic oligonucleotide
  Target: ATXN1; (+) strand; PAM type: YTN; PAM sequence: CTG
aggtcacagcacaattaata

SEQ ID NO: 283586 - DNA, 20 bp, Artificial Sequence
  Description of Artificial Sequence: Synthetic oligonucleotide
  Target: ATXN1; (+) strand; PAM type: YTN; PAM sequence: TTA
atatggttaagtatttccca

SEQ ID NO: 283587 - DNA, 20 bp, Artificial Sequence
  Description of Artificial Sequence: Synthetic oligonucleotide
  Target: ATXN1; (+) strand; PAM type: YTN; PAM sequence: TTA
agtatttcccactctcctgt

SEQ ID NO: 283588 - DNA, 20 bp, Artificial Sequence
  Description of Artificial Sequence: Synthetic oligonucleotide
  Target: ATXN1; (+) strand; PAM type: YTN; PAM sequence: TTT
cccactctcctgtctcccta

SEQ ID NO: 283589 - DNA, 20 bp, Artificial Sequence
  Description of Artificial Sequence: Synthetic oligonucleotide
  Target: ATXN1; (+) strand; PAM type: YTN; PAM sequence: TTC
ccactctcctgtctccctag

SEQ ID NO: 283590 - DNA, 20 bp, Artificial Sequence
  Description of Artificial Sequence: Synthetic oligonucleotide
  Target: ATXN1; (+) strand; PAM type: YTN; PAM sequence: CTC
tcctgtctccctagagaaat

SEQ ID NO: 283591 - DNA, 20 bp, Artificial Sequence
  Description of Artificial Sequence: Synthetic oligonucleotide
  Target: ATXN1; (+) strand; PAM type: YTN; PAM sequence: CTC
ctgtctccctagagaaattt

SEQ ID NO: 283592 - DNA, 20 bp, Artificial Sequence
  Description of Artificial Sequence: Synthetic oligonucleotide
  Target: ATXN1; (+) strand; PAM type: YTN; PAM sequence: CTG
tctccctagagaaatttatt

SEQ ID NO: 283593 - DNA, 20 bp, Artificial Sequence
  Description of Artificial Sequence: Synthetic oligonucleotide
  Target: ATXN1; (+) strand; PAM type: YTN; PAM sequence: CTC
cctagagaaatttattctgg

SEQ ID NO: 283594 - DNA, 20 bp, Artificial Sequence
  Description of Artificial Sequence: Synthetic oligonucleotide
  Target: ATXN1; (+) strand; PAM type: YTN; PAM sequence: CTA
gagaaatttattctggtaag

SEQ ID NO: 283595 - DNA, 20 bp, Artificial Sequence
  Description of Artificial Sequence: Synthetic oligonucleotide
  Target: ATXN1; (+) strand; PAM type: YTN; PAM sequence: TTT
attctggtaagcccttgaca

SEQ ID NO: 283596 - DNA, 20 bp, Artificial Sequence
  Description of Artificial Sequence: Synthetic oligonucleotide
  Target: ATXN1; (+) strand; PAM type: YTN; PAM sequence: TTA
ttctggtaagcccttgacaa

SEQ ID NO: 283597 - DNA, 20 bp, Artificial Sequence
  Description of Artificial Sequence: Synthetic oligonucleotide
  Target: ATXN1; (+) strand; PAM type: YTN; PAM sequence: TTC
tggtaagcccttgacaacca

SEQ ID NO: 283598 - DNA, 20 bp, Artificial Sequence
  Description of Artificial Sequence: Synthetic oligonucleotide
  Target: ATXN1; (+) strand; PAM type: YTN; PAM sequence: CTG
gtaagcccttgacaaccaac

SEQ ID NO: 283599 - DNA, 20 bp, Artificial Sequence
  Description of Artificial Sequence: Synthetic oligonucleotide
  Target: ATXN1; (+) strand; PAM type: YTN; PAM sequence: CTT
gacaaccaacacgtctgcat

SEQ ID NO: 283600 - DNA, 20 bp, Artificial Sequence
  Description of Artificial Sequence: Synthetic oligonucleotide
  Target: ATXN1; (+) strand; PAM type: YTN; PAM sequence: TTG
acaaccaacacgtctgcatt

SEQ ID NO: 283601 - DNA, 20 bp, Artificial Sequence
  Description of Artificial Sequence: Synthetic oligonucleotide
  Target: ATXN1; (+) strand; PAM type: YTN; PAM sequence: CTG
catttctgcacaccagccag

SEQ ID NO: 283602 - DNA, 20 bp, Artificial Sequence
  Description of Artificial Sequence: Synthetic oligonucleotide
  Target: ATXN1; (+) strand; PAM type: YTN; PAM sequence: TTT
ctgcacaccagccagtgatc

SEQ ID NO: 283603 - DNA, 20 bp, Artificial Sequence
  Description of Artificial Sequence: Synthetic oligonucleotide
  Target: ATXN1; (+) strand; PAM type: YTN; PAM sequence: TTC
tgcacaccagccagtgatcc

SEQ ID NO: 283604 - DNA, 20 bp, Artificial Sequence
  Description of Artificial Sequence: Synthetic oligonucleotide
  Target: ATXN1; (+) strand; PAM type: YTN; PAM sequence: CTG
cacaccagccagtgatccac

SEQ ID NO: 283605 - DNA, 20 bp, Artificial Sequence
  Description of Artificial Sequence: Synthetic oligonucleotide
  Target: ATXN1; (+) strand; PAM type: YTN; PAM sequence: CTT
tcttcctctctgagtcttta

SEQ ID NO: 283606 - DNA, 20 bp, Artificial Sequence
  Description of Artificial Sequence: Synthetic oligonucleotide
  Target: ATXN1; (+) strand; PAM type: YTN; PAM sequence: TTT
cttcctctctgagtctttat

SEQ ID NO: 283607 - DNA, 20 bp, Artificial Sequence
  Description of Artificial Sequence: Synthetic oligonucleotide
  Target: ATXN1; (+) strand; PAM type: YTN; PAM sequence: TTC
ttcctctctgagtctttatt

SEQ ID NO: 283608 - DNA, 20 bp, Artificial Sequence
  Description of Artificial Sequence: Synthetic oligonucleotide
  Target: ATXN1; (+) strand; PAM type: YTN; PAM sequence: CTT
cctctctgagtctttattga

SEQ ID NO: 283609 - DNA, 20 bp, Artificial Sequence
  Description of Artificial Sequence: Synthetic oligonucleotide
  Target: ATXN1; (+) strand; PAM type: YTN; PAM sequence: TTC
ctctctgagtctttattgat

SEQ ID NO: 283610 - DNA, 20 bp, Artificial Sequence
  Description of Artificial Sequence: Synthetic oligonucleotide
  Target: ATXN1; (+) strand; PAM type: YTN; PAM sequence: CTC
tctgagtctttattgatttt

SEQ ID NO: 283611 - DNA, 20 bp, Artificial Sequence
  Description of Artificial Sequence: Synthetic oligonucleotide
  Target: ATXN1; (+) strand; PAM type: YTN; PAM sequence: CTC
tgagtctttattgattttgt

SEQ ID NO: 283612 - DNA, 20 bp, Artificial Sequence
  Description of Artificial Sequence: Synthetic oligonucleotide
  Target: ATXN1; (+) strand; PAM type: YTN; PAM sequence: CTG
agtctttattgattttgtag

SEQ ID NO: 283613 - DNA, 20 bp, Artificial Sequence
  Description of Artificial Sequence: Synthetic oligonucleotide
  Target: ATXN1; (+) strand; PAM type: YTN; PAM sequence: CTT
tattgattttgtagtttggg

SEQ ID NO: 283614 - DNA, 20 bp, Artificial Sequence
  Description of Artificial Sequence: Synthetic oligonucleotide
  Target: ATXN1; (+) strand; PAM type: YTN; PAM sequence: TTT
attgattttgtagtttggga

SEQ ID NO: 283615 - DNA, 20 bp, Artificial Sequence
  Description of Artificial Sequence: Synthetic oligonucleotide
  Target: ATXN1; (+) strand; PAM type: YTN; PAM sequence: TTA
ttgattttgtagtttgggag

SEQ ID NO: 283616 - DNA, 20 bp, Artificial Sequence
  Description of Artificial Sequence: Synthetic oligonucleotide
  Target: ATXN1; (+) strand; PAM type: YTN; PAM sequence: TTG
attttgtagtttgggaggaa

SEQ ID NO: 283617 - DNA, 20 bp, Artificial Sequence
  Description of Artificial Sequence: Synthetic oligonucleotide
  Target: ATXN1; (+) strand; PAM type: YTN; PAM sequence: TTT
tgtagtttgggaggaagcta

SEQ ID NO: 283618 - DNA, 20 bp, Artificial Sequence
  Description of Artificial Sequence: Synthetic oligonucleotide
  Target: ATXN1; (+) strand; PAM type: YTN; PAM sequence: TTT
gtagtttgggaggaagctaa

SEQ ID NO: 283619 - DNA, 20 bp, Artificial Sequence
  Description of Artificial Sequence: Synthetic oligonucleotide
  Target: ATXN1; (+) strand; PAM type: YTN; PAM sequence: TTG
tagtttgggaggaagctaag

SEQ ID NO: 283620 - DNA, 20 bp, Artificial Sequence
  Description of Artificial Sequence: Synthetic oligonucleotide
  Target: ATXN1; (+) strand; PAM type: YTN; PAM sequence: TTT
gggaggaagctaagtgctat

SEQ ID NO: 283621 - DNA, 20 bp, Artificial Sequence
  Description of Artificial Sequence: Synthetic oligonucleotide
  Target: ATXN1; (+) strand; PAM type: YTN; PAM sequence: TTG
ggaggaagctaagtgctatt

SEQ ID NO: 283622 - DNA, 20 bp, Artificial Sequence
  Description of Artificial Sequence: Synthetic oligonucleotide
  Target: ATXN1; (+) strand; PAM type: YTN; PAM sequence: CTA
agtgctattcaaataccaaa

SEQ ID NO: 283623 - DNA, 20 bp, Artificial Sequence
  Description of Artificial Sequence: Synthetic oligonucleotide
  Target: ATXN1; (+) strand; PAM type: YTN; PAM sequence: CTA
ttcaaataccaaatgttcca

SEQ ID NO: 283624 - DNA, 20 bp, Artificial Sequence
  Description of Artificial Sequence: Synthetic oligonucleotide
  Target: ATXN1; (+) strand; PAM type: YTN; PAM sequence: TTC
aaataccaaatgttccatat

SEQ ID NO: 283625 - DNA, 20 bp, Artificial Sequence
  Description of Artificial Sequence: Synthetic oligonucleotide
  Target: ATXN1; (+) strand; PAM type: YTN; PAM sequence: TTC
catatggtagtgttattacc

SEQ ID NO: 283626 - DNA, 20 bp, Artificial Sequence
  Description of Artificial Sequence: Synthetic oligonucleotide
  Target: ATXN1; (+) strand; PAM type: YTN; PAM sequence: TTA
ttaccattcccactaccgtt

SEQ ID NO: 283627 - DNA, 20 bp, Artificial Sequence
  Description of Artificial Sequence: Synthetic oligonucleotide
  Target: ATXN1; (+) strand; PAM type: YTN; PAM sequence: TTA
ccattcccactaccgttact

SEQ ID NO: 283628 - DNA, 20 bp, Artificial Sequence
  Description of Artificial Sequence: Synthetic oligonucleotide
  Target: ATXN1; (+) strand; PAM type: YTN; PAM sequence: TTC
ccactaccgttacttgaggc

SEQ ID NO: 283629 - DNA, 20 bp, Artificial Sequence
  Description of Artificial Sequence: Synthetic oligonucleotide
  Target: ATXN1; (+) strand; PAM type: YTN; PAM sequence: CTA
ccgttacttgaggccttcta

SEQ ID NO: 283630 - DNA, 20 bp, Artificial Sequence
  Description of Artificial Sequence: Synthetic oligonucleotide
  Target: ATXN1; (+) strand; PAM type: YTN; PAM sequence: TTA
cttgaggccttctacctaca

SEQ ID NO: 283631 - DNA, 20 bp, Artificial Sequence
  Description of Artificial Sequence: Synthetic oligonucleotide
  Target: ATXN1; (+) strand; PAM type: YTN; PAM sequence: CTT
gaggccttctacctacactc

SEQ ID NO: 283632 - DNA, 20 bp, Artificial Sequence
  Description of Artificial Sequence: Synthetic oligonucleotide
  Target: ATXN1; (+) strand; PAM type: YTN; PAM sequence: TTG
aggccttctacctacactca

SEQ ID NO: 283633 - DNA, 20 bp, Artificial Sequence
  Description of Artificial Sequence: Synthetic oligonucleotide
  Target: ATXN1; (+) strand; PAM type: YTN; PAM sequence: CTT
ctacctacactcatgaggtg

SEQ ID NO: 283634 - DNA, 20 bp, Artificial Sequence
  Description of Artificial Sequence: Synthetic oligonucleotide
  Target: ATXN1; (+) strand; PAM type: YTN; PAM sequence: TTC
tacctacactcatgaggtgc

SEQ ID NO: 283635 - DNA, 20 bp, Artificial Sequence
  Description of Artificial Sequence: Synthetic oligonucleotide
  Target: ATXN1; (+) strand; PAM type: YTN; PAM sequence: CTA
cctacactcatgaggtgcct

SEQ ID NO: 283636 - DNA, 20 bp, Artificial Sequence
  Description of Artificial Sequence: Synthetic oligonucleotide
  Target: ATXN1; (+) strand; PAM type: YTN; PAM sequence: CTA
cactcatgaggtgcctcatc

SEQ ID NO: 283637 - DNA, 20 bp, Artificial Sequence
  Description of Artificial Sequence: Synthetic oligonucleotide
  Target: ATXN1; (+) strand; PAM type: YTN; PAM sequence: CTC
atgaggtgcctcatcagaat

SEQ ID NO: 283638 - DNA, 20 bp, Artificial Sequence
  Description of Artificial Sequence: Synthetic oligonucleotide
  Target: ATXN1; (+) strand; PAM type: YTN; PAM sequence: CTC
atcagaatctggcagaacat

SEQ ID NO: 283639 - DNA, 20 bp, Artificial Sequence
  Description of Artificial Sequence: Synthetic oligonucleotide
  Target: ATXN1; (+) strand; PAM type: YTN; PAM sequence: CTG
gcagaacattatgaactctt

SEQ ID NO: 283640 - DNA, 20 bp, Artificial Sequence
  Description of Artificial Sequence: Synthetic oligonucleotide
  Target: ATXN1; (+) strand; PAM type: YTN; PAM sequence: TTA
tgaactcttttcctgaccta

SEQ ID NO: 283641 - DNA, 20 bp, Artificial Sequence
  Description of Artificial Sequence: Synthetic oligonucleotide
  Target: ATXN1; (+) strand; PAM type: YTN; PAM sequence: CTC
ttttcctgacctatatttgc

SEQ ID NO: 283642 - DNA, 20 bp, Artificial Sequence
  Description of Artificial Sequence: Synthetic oligonucleotide
  Target: ATXN1; (+) strand; PAM type: YTN; PAM sequence: CTT
ttcctgacctatatttgcta

SEQ ID NO: 283643 - DNA, 20 bp, Artificial Sequence
  Description of Artificial Sequence: Synthetic oligonucleotide
  Target: ATXN1; (+) strand; PAM type: YTN; PAM sequence: TTT
tcctgacctatatttgctaa

SEQ ID NO: 283644 - DNA, 20 bp, Artificial Sequence
  Description of Artificial Sequence: Synthetic oligonucleotide
  Target: ATXN1; (+) strand; PAM type: YTN; PAM sequence: TTT
cctgacctatatttgctaac

SEQ ID NO: 283645 - DNA, 20 bp, Artificial Sequence
  Description of Artificial Sequence: Synthetic oligonucleotide
  Target: ATXN1; (+) strand; PAM type: YTN; PAM sequence: TTC
ctgacctatatttgctaaca

SEQ ID NO: 283646 - DNA, 20 bp, Artificial Sequence
  Description of Artificial Sequence: Synthetic oligonucleotide
  Target: ATXN1; (+) strand; PAM type: YTN; PAM sequence: CTG
acctatatttgctaacacat

SEQ ID NO: 283647 - DNA, 20 bp, Artificial Sequence
  Description of Artificial Sequence: Synthetic oligonucleotide
  Target: ATXN1; (+) strand; PAM type: YTN; PAM sequence: CTA
tatttgctaacacatttgtt

SEQ ID NO: 283648 - DNA, 20 bp, Artificial Sequence
  Description of Artificial Sequence: Synthetic oligonucleotide
  Target: ATXN1; (+) strand; PAM type: YTN; PAM sequence: TTT
gctaacacatttgttgtcct

SEQ ID NO: 283649 - DNA, 20 bp, Artificial Sequence
  Description of Artificial Sequence: Synthetic oligonucleotide
  Target: ATXN1; (+) strand; PAM type: YTN; PAM sequence: TTG
ctaacacatttgttgtcctc

SEQ ID NO: 283650 - DNA, 20 bp, Artificial Sequence
  Description of Artificial Sequence: Synthetic oligonucleotide
  Target: ATXN1; (+) strand; PAM type: YTN; PAM sequence: CTA
acacatttgttgtcctctct

SEQ ID NO: 283651 - DNA, 20 bp, Artificial Sequence
  Description of Artificial Sequence: Synthetic oligonucleotide
  Target: ATXN1; (+) strand; PAM type: YTN; PAM sequence: TTT
gttgtcctctctccctctat

SEQ ID NO: 283652 - DNA, 20 bp, Artificial Sequence
  Description of Artificial Sequence: Synthetic oligonucleotide
  Target: ATXN1; (+) strand; PAM type: YTN; PAM sequence: TTG
ttgtcctctctccctctatg

SEQ ID NO: 283653 - DNA, 20 bp, Artificial Sequence
  Description of Artificial Sequence: Synthetic oligonucleotide
  Target: ATXN1; (+) strand; PAM type: YTN; PAM sequence: TTG
tcctctctccctctatgaac

SEQ ID NO: 283654 - DNA, 20 bp, Artificial Sequence
  Description of Artificial Sequence: Synthetic oligonucleotide
  Target: ATXN1; (+) strand; PAM type: YTN; PAM sequence: CTC
tctccctctatgaacttatt

SEQ ID NO: 283655 - DNA, 20 bp, Artificial Sequence
  Description of Artificial Sequence: Synthetic oligonucleotide
  Target: ATXN1; (+) strand; PAM type: YTN; PAM sequence: CTC
tccctctatgaacttattaa

SEQ ID NO: 283656 - DNA, 20 bp, Artificial Sequence
  Description of Artificial Sequence: Synthetic oligonucleotide
  Target: ATXN1; (+) strand; PAM type: YTN; PAM sequence: CTC
cctctatgaacttattaatt

SEQ ID NO: 283657 - DNA, 20 bp, Artificial Sequence
  Description of Artificial Sequence: Synthetic oligonucleotide
  Target: ATXN1; (+) strand; PAM type: YTN; PAM sequence: CTC
tatgaacttattaattttgt

SEQ ID NO: 283658 - DNA, 20 bp, Artificial Sequence
  Description of Artificial Sequence: Synthetic oligonucleotide
  Target: ATXN1; (+) strand; PAM type: YTN; PAM sequence: CTA
tgaacttattaattttgttg

SEQ ID NO: 283659 - DNA, 20 bp, Artificial Sequence
  Description of Artificial Sequence: Synthetic oligonucleotide
  Target: ATXN1; (+) strand; PAM type: YTN; PAM sequence: CTT
attaattttgttgaaataat

SEQ ID NO: 283660 - DNA, 20 bp, Artificial Sequence
  Description of Artificial Sequence: Synthetic oligonucleotide
  Target: ATXN1; (+) strand; PAM type: YTN; PAM sequence: TTA
ttaattttgttgaaataata

SEQ ID NO: 283661 - DNA, 20 bp, Artificial Sequence
  Description of Artificial Sequence: Synthetic oligonucleotide
  Target: ATXN1; (+) strand; PAM type: YTN; PAM sequence: TTA
attttgttgaaataatatac

SEQ ID NO: 283662 - DNA, 20 bp, Artificial Sequence
  Description of Artificial Sequence: Synthetic oligonucleotide
  Target: ATXN1; (+) strand; PAM type: YTN; PAM sequence: TTT
tgttgaaataatatacatgt

SEQ ID NO: 283663 - DNA, 20 bp, Artificial Sequence
  Description of Artificial Sequence: Synthetic oligonucleotide
  Target: ATXN1; (+) strand; PAM type: YTN; PAM sequence: TTT
gttgaaataatatacatgtg

SEQ ID NO: 283664 - DNA, 20 bp, Artificial Sequence
  Description of Artificial Sequence: Synthetic oligonucleotide
  Target: ATXN1; (+) strand; PAM type: YTN; PAM sequence: TTG
ttgaaataatatacatgtgt

SEQ ID NO: 283665 - DNA, 20 bp, Artificial Sequence
  Description of Artificial Sequence: Synthetic oligonucleotide
  Target: ATXN1; (+) strand; PAM type: YTN; PAM sequence: TTG
aaataatatacatgtgtgta

SEQ ID NO: 283666 - DNA, 20 bp, Artificial Sequence
  Description of Artificial Sequence: Synthetic oligonucleotide
  Target: ATXN1; (+) strand; PAM type: YTN; PAM sequence: TTT
tgttttcttattcatcctca

SEQ ID NO: 283667 - DNA, 20 bp, Artificial Sequence
  Description of Artificial Sequence: Synthetic oligonucleotide
  Target: ATXN1; (+) strand; PAM type: YTN; PAM sequence: TTT
gttttcttattcatcctcat

SEQ ID NO: 283668 - DNA, 20 bp, Artificial Sequence
  Description of Artificial Sequence: Synthetic oligonucleotide
  Target: ATXN1; (+) strand; PAM type: YTN; PAM sequence: TTG
ttttcttattcatcctcata

SEQ ID NO: 283669 - DNA, 20 bp, Artificial Sequence
  Description of Artificial Sequence: Synthetic oligonucleotide
  Target: ATXN1; (+) strand; PAM type: YTN; PAM sequence: TTT
tcttattcatcctcatagtc

SEQ ID NO: 283670 - DNA, 20 bp, Artificial Sequence
  Description of Artificial Sequence: Synthetic oligonucleotide
  Target: ATXN1; (+) strand; PAM type: YTN; PAM sequence: TTT
cttattcatcctcatagtca

SEQ ID NO: 283671 - DNA, 20 bp, Artificial Sequence
  Description of Artificial Sequence: Synthetic oligonucleotide
  Target: ATXN1; (+) strand; PAM type: YTN; PAM sequence: TTC
ttattcatcctcatagtcac

SEQ ID NO: 283672 - DNA, 20 bp, Artificial Sequence
  Description of Artificial Sequence: Synthetic oligonucleotide
  Target: ATXN1; (+) strand; PAM type: YTN; PAM sequence: CTT
attcatcctcatagtcacag

SEQ ID NO: 283673 - DNA, 20 bp, Artificial Sequence
  Description of Artificial Sequence: Synthetic oligonucleotide
  Target: ATXN1; (+) strand; PAM type: YTN; PAM sequence: TTA
ttcatcctcatagtcacagg

SEQ ID NO: 283674 - DNA, 20 bp, Artificial Sequence
  Description of Artificial Sequence: Synthetic oligonucleotide
  Target: ATXN1; (+) strand; PAM type: YTN; PAM sequence: TTC
atcctcatagtcacagggga

SEQ ID NO: 283675 - DNA, 20 bp, Artificial Sequence
  Description of Artificial Sequence: Synthetic oligonucleotide
  Target: ATXN1; (+) strand; PAM type: YTN; PAM sequence: CTC
atagtcacaggggaatgatt

SEQ ID NO: 283676 - DNA, 20 bp, Artificial Sequence
  Description of Artificial Sequence: Synthetic oligonucleotide
  Target: ATXN1; (+) strand; PAM type: YTN; PAM sequence: TTT
atgacacattaaggaggtat

SEQ ID NO: 283677 - DNA, 20 bp, Artificial Sequence
  Description of Artificial Sequence: Synthetic oligonucleotide
  Target: ATXN1; (+) strand; PAM type: YTN; PAM sequence: TTA
tgacacattaaggaggtatt

SEQ ID NO: 283678 - DNA, 20 bp, Artificial Sequence
  Description of Artificial Sequence: Synthetic oligonucleotide
  Target: ATXN1; (+) strand; PAM type: YTN; PAM sequence: TTA
aggaggtattcttaagctaa

SEQ ID NO: 283679 - DNA, 20 bp, Artificial Sequence
  Description of Artificial Sequence: Synthetic oligonucleotide
  Target: ATXN1; (+) strand; PAM type: YTN; PAM sequence: TTC
ttaagctaacatgtcttaat

SEQ ID NO: 283680 - DNA, 20 bp, Artificial Sequence
  Description of Artificial Sequence: Synthetic oligonucleotide
  Target: ATXN1; (+) strand; PAM type: YTN; PAM sequence: CTT
aagctaacatgtcttaatta

SEQ ID NO: 283681 - DNA, 20 bp, Artificial Sequence
  Description of Artificial Sequence: Synthetic oligonucleotide
  Target: ATXN1; (+) strand; PAM type: YTN; PAM sequence: TTA
agctaacatgtcttaattag

SEQ ID NO: 283682 - DNA, 20 bp, Artificial Sequence
  Description of Artificial Sequence: Synthetic oligonucleotide
  Target: ATXN1; (+) strand; PAM type: YTN; PAM sequence: CTA
acatgtcttaattaggaatt

SEQ ID NO: 283683 - DNA, 20 bp, Artificial Sequence
  Description of Artificial Sequence: Synthetic oligonucleotide
  Target: ATXN1; (+) strand; PAM type: YTN; PAM sequence: CTT
aattaggaattcagatattc

SEQ ID NO: 283684 - DNA, 20 bp, Artificial Sequence
  Description of Artificial Sequence: Synthetic oligonucleotide
  Target: ATXN1; (+) strand; PAM type: YTN; PAM sequence: TTA
attaggaattcagatattcc

SEQ ID NO: 283685 - DNA, 20 bp, Artificial Sequence
  Description of Artificial Sequence: Synthetic oligonucleotide
  Target: ATXN1; (+) strand; PAM type: YTN; PAM sequence: TTA
ggaattcagatattcctctt

SEQ ID NO: 283686 - DNA, 20 bp, Artificial Sequence
  Description of Artificial Sequence: Synthetic oligonucleotide
  Target: ATXN1; (+) strand; PAM type: YTN; PAM sequence: TTC
agatattcctcttctgctga

SEQ ID NO: 283687 - DNA, 20 bp, Artificial Sequence
  Description of Artificial Sequence: Synthetic oligonucleotide
  Target: ATXN1; (+) strand; PAM type: YTN; PAM sequence: TTC
ctcttctgctgagaaataca

SEQ ID NO: 283688 - DNA, 20 bp, Artificial Sequence
  Description of Artificial Sequence: Synthetic oligonucleotide
  Target: ATXN1; (+) strand; PAM type: YTN; PAM sequence: CTC
ttctgctgagaaatacagag

SEQ ID NO: 283689 - DNA, 20 bp, Artificial Sequence
  Description of Artificial Sequence: Synthetic oligonucleotide
  Target: ATXN1; (+) strand; PAM type: YTN; PAM sequence: CTT
ctgctgagaaatacagagct

SEQ ID NO: 283690 - DNA, 20 bp, Artificial Sequence
  Description of Artificial Sequence: Synthetic oligonucleotide
  Target: ATXN1; (+) strand; PAM type: YTN; PAM sequence: TTC
tgctgagaaatacagagctg

SEQ ID NO: 283691 - DNA, 20 bp, Artificial Sequence
  Description of Artificial Sequence: Synthetic oligonucleotide
  Target: ATXN1; (+) strand; PAM type: YTN; PAM sequence: CTG
ctgagaaatacagagctgtt

SEQ ID NO: 283692 - DNA, 20 bp, Artificial Sequence
  Description of Artificial Sequence: Synthetic oligonucleotide
  Target: ATXN1; (+) strand; PAM type: YTN; PAM sequence: CTG
agaaatacagagctgttcaa

SEQ ID NO: 283693 - DNA, 20 bp, Artificial Sequence
  Description of Artificial Sequence: Synthetic oligonucleotide
  Target: ATXN1; (+) strand; PAM type: YTN; PAM sequence: CTG
ttcaaattagaccagaaatt

SEQ ID NO: 283694 - DNA, 20 bp, Artificial Sequence
  Description of Artificial Sequence: Synthetic oligonucleotide
  Target: ATXN1; (+) strand; PAM type: YTN; PAM sequence: TTC
aaattagaccagaaattagg

SEQ ID NO: 283695 - DNA, 20 bp, Artificial Sequence
  Description of Artificial Sequence: Synthetic oligonucleotide
  Target: ATXN1; (+) strand; PAM type: YTN; PAM sequence: TTA
gaccagaaattagggccaaa

SEQ ID NO: 283696 - DNA, 20 bp, Artificial Sequence
  Description of Artificial Sequence: Synthetic oligonucleotide
  Target: ATXN1; (+) strand; PAM type: YTN; PAM sequence: TTA
gggccaaaacgaatgcagcg

SEQ ID NO: 283697 - DNA, 20 bp, Artificial Sequence
  Description of Artificial Sequence: Synthetic oligonucleotide
  Target: ATXN1; (+) strand; PAM type: YTN; PAM sequence: CTA
catacacaagctcatagcag

SEQ ID NO: 283698 - DNA, 20 bp, Artificial Sequence
  Description of Artificial Sequence: Synthetic oligonucleotide
  Target: ATXN1; (+) strand; PAM type: YTN; PAM sequence: CTC
atagcagggtaaccagtgaa

SEQ ID NO: 283699 - DNA, 20 bp, Artificial Sequence
  Description of Artificial Sequence: Synthetic oligonucleotide
  Target: ATXN1; (+) strand; PAM type: YTN; PAM sequence: CTG
aagccgtacacgtcgttctg

SEQ ID NO: 283700 - DNA, 20 bp, Artificial Sequence
  Description of Artificial Sequence: Synthetic oligonucleotide
  Target: ATXN1; (+) strand; PAM type: YTN; PAM sequence: TTC
tgtgtttgtctccttcatgc

SEQ ID NO: 283701 - DNA, 20 bp, Artificial Sequence
  Description of Artificial Sequence: Synthetic oligonucleotide
  Target: ATXN1; (+) strand; PAM type: YTN; PAM sequence: CTG
tgtttgtctccttcatgcca

SEQ ID NO: 283702 - DNA, 20 bp, Artificial Sequence
  Description of Artificial Sequence: Synthetic oligonucleotide
  Target: ATXN1; (+) strand; PAM type: YTN; PAM sequence: TTT
gtctccttcatgccaaatga

SEQ ID NO: 283703 - DNA, 20 bp, Artificial Sequence
  Description of Artificial Sequence: Synthetic oligonucleotide
  Target: ATXN1; (+) strand; PAM type: YTN; PAM sequence: TTG
tctccttcatgccaaatgat

SEQ ID NO: 283704 - DNA, 20 bp, Artificial Sequence
  Description of Artificial Sequence: Synthetic oligonucleotide
  Target: ATXN1; (+) strand; PAM type: YTN; PAM sequence: CTC
cttcatgccaaatgattctt

SEQ ID NO: 283705 - DNA, 20 bp, Artificial Sequence
  Description of Artificial Sequence: Synthetic oligonucleotide
  Target: ATXN1; (+) strand; PAM type: YTN; PAM sequence: CTT
catgccaaatgattctttga

SEQ ID NO: 283706 - DNA, 20 bp, Artificial Sequence
  Description of Artificial Sequence: Synthetic oligonucleotide
  Target: ATXN1; (+) strand; PAM type: YTN; PAM sequence: TTC
atgccaaatgattctttgac

SEQ ID NO: 283707 - DNA, 20 bp, Artificial Sequence
  Description of Artificial Sequence: Synthetic oligonucleotide
  Target: ATXN1; (+) strand; PAM type: YTN; PAM sequence: TTC
tttgaccacttttcctttca

SEQ ID NO: 283708 - DNA, 20 bp, Artificial Sequence
  Description of Artificial Sequence: Synthetic oligonucleotide
  Target: ATXN1; (+) strand; PAM type: YTN; PAM sequence: CTT
tgaccacttttcctttcact

SEQ ID NO: 283709 - DNA, 20 bp, Artificial Sequence
  Description of Artificial Sequence: Synthetic oligonucleotide
  Target: ATXN1; (+) strand; PAM type: YTN; PAM sequence: TTT
gaccacttttcctttcactt

SEQ ID NO: 283710 - DNA, 20 bp, Artificial Sequence
  Description of Artificial Sequence: Synthetic oligonucleotide
  Target: ATXN1; (+) strand; PAM type: YTN; PAM sequence: TTG
accacttttcctttcacttt

SEQ ID NO: 283711 - DNA, 20 bp, Artificial Sequence
  Description of Artificial Sequence: Synthetic oligonucleotide
  Target: ATXN1; (+) strand; PAM type: YTN; PAM sequence: CTT
ttcctttcacttttcaacgt

SEQ ID NO: 283712 - DNA, 20 bp, Artificial Sequence
  Description of Artificial Sequence: Synthetic oligonucleotide
  Target: ATXN1; (+) strand; PAM type: YTN; PAM sequence: TTT
tcctttcacttttcaacgtt

SEQ ID NO: 283713 - DNA, 20 bp, Artificial Sequence
  Description of Artificial Sequence: Synthetic oligonucleotide
  Target: ATXN1; (+) strand; PAM type: YTN; PAM sequence: TTT
cctttcacttttcaacgtta

SEQ ID NO: 283714 - DNA, 20 bp, Artificial Sequence
  Description of Artificial Sequence: Synthetic oligonucleotide
  Target: ATXN1; (+) strand; PAM type: YTN; PAM sequence: TTC
ctttcacttttcaacgttac

SEQ ID NO: 283715 - DNA, 20 bp, Artificial Sequence
  Description of Artificial Sequence: Synthetic oligonucleotide
  Target: ATXN1; (+) strand; PAM type: YTN; PAM sequence: CTT
tcacttttcaacgttacgat

SEQ ID NO: 283716 - DNA, 20 bp, Artificial Sequence
  Description of Artificial Sequence: Synthetic oligonucleotide
  Target: ATXN1; (+) strand; PAM type: YTN; PAM sequence: TTT
cacttttcaacgttacgatg

SEQ ID NO: 283717 - DNA, 20 bp, Artificial Sequence
  Description of Artificial Sequence: Synthetic oligonucleotide
  Target: ATXN1; (+) strand; PAM type: YTN; PAM sequence: TTC
acttttcaacgttacgatgg

SEQ ID NO: 283718 - DNA, 20 bp, Artificial Sequence
  Description of Artificial Sequence: Synthetic oligonucleotide
  Target: ATXN1; (+) strand; PAM type: YTN; PAM sequence: CTT
ttcaacgttacgatggagcc

SEQ ID NO: 283719 - DNA, 20 bp, Artificial Sequence
  Description of Artificial Sequence: Synthetic oligonucleotide
  Target: ATXN1; (+) strand; PAM type: YTN; PAM sequence: TTT
tcaacgttacgatggagcca

SEQ ID NO: 283720 - DNA, 20 bp, Artificial Sequence
  Description of Artificial Sequence: Synthetic oligonucleotide
  Target: ATXN1; (+) strand; PAM type: YTN; PAM sequence: TTT
caacgttacgatggagccaa

SEQ ID NO: 283721 - DNA, 20 bp, Artificial Sequence
  Description of Artificial Sequence: Synthetic oligonucleotide
  Target: ATXN1; (+) strand; PAM type: YTN; PAM sequence: TTC
aacgttacgatggagccaaa

SEQ ID NO: 283722 - DNA, 20 bp, Artificial Sequence
  Description of Artificial Sequence: Synthetic oligonucleotide
  Target: ATXN1; (+) strand; PAM type: YTN; PAM sequence: TTA
cgatggagccaaagggtcaa

SEQ ID NO: 283723 - DNA, 20 bp, Artificial Sequence
  Description of Artificial Sequence: Synthetic oligonucleotide
  Target: ATXN1; (+) strand; PAM type: YTN; PAM sequence: TTC
acaaacctacagccttcccc

SEQ ID NO: 283724 - DNA, 20 bp, Artificial Sequence
  Description of Artificial Sequence: Synthetic oligonucleotide
  Target: ATXN1; (+) strand; PAM type: YTN; PAM sequence: CTA
cagccttccccttcatgcat

SEQ ID NO: 283725 - DNA, 20 bp, Artificial Sequence
  Description of Artificial Sequence: Synthetic oligonucleotide
  Target: ATXN1; (+) strand; PAM type: YTN; PAM sequence: CTT
ccccttcatgcatctgtagg

SEQ ID NO: 283726 - DNA, 20 bp, Artificial Sequence
  Description of Artificial Sequence: Synthetic oligonucleotide
  Target: ATXN1; (+) strand; PAM type: YTN; PAM sequence: TTC
cccttcatgcatctgtagga

SEQ ID NO: 283727 - DNA, 20 bp, Artificial Sequence
  Description of Artificial Sequence: Synthetic oligonucleotide
  Target: ATXN1; (+) strand; PAM type: YTN; PAM sequence: CTT
catgcatctgtaggataaag

SEQ ID NO: 283728 - DNA, 20 bp, Artificial Sequence
  Description of Artificial Sequence: Synthetic oligonucleotide
  Target: ATXN1; (+) strand; PAM type: YTN; PAM sequence: TTC
atgcatctgtaggataaagc

SEQ ID NO: 283729 - DNA, 20 bp, Artificial Sequence
  Description of Artificial Sequence: Synthetic oligonucleotide
  Target: ATXN1; (+) strand; PAM type: YTN; PAM sequence: CTG
taggataaagcatgcgtttc

SEQ ID NO: 283730 - DNA, 20 bp, Artificial Sequence
  Description of Artificial Sequence: Synthetic oligonucleotide
  Target: ATXN1; (+) strand; PAM type: YTN; PAM sequence: TTT
cctaagagctgggtgtggcg

SEQ ID NO: 283731 - DNA, 20 bp, Artificial Sequence
  Description of Artificial Sequence: Synthetic oligonucleotide
  Target: ATXN1; (+) strand; PAM type: YTN; PAM sequence: TTC
ctaagagctgggtgtggcgg

SEQ ID NO: 283732 - DNA, 20 bp, Artificial Sequence
  Description of Artificial Sequence: Synthetic oligonucleotide
  Target: ATXN1; (+) strand; PAM type: YTN; PAM sequence: CTA
agagctgggtgtggcggggg

SEQ ID NO: 283733 - DNA, 20 bp, Artificial Sequence
  Description of Artificial Sequence: Synthetic oligonucleotide
  Target: ATXN1; (+) strand; PAM type: YTN; PAM sequence: CTG
ggtgtggcgggggggtctct

SEQ ID NO: 283734 - DNA, 20 bp, Artificial Sequence
  Description of Artificial Sequence: Synthetic oligonucleotide
  Target: ATXN1; (+) strand; PAM type: YTN; PAM sequence: CTC
ttcatctaccttctctttca

SEQ ID NO: 283735 - DNA, 20 bp, Artificial Sequence
  Description of Artificial Sequence: Synthetic oligonucleotide
  Target: ATXN1; (+) strand; PAM type: YTN; PAM sequence: CTT
catctaccttctctttcatt

SEQ ID NO: 283736 - DNA, 20 bp, Artificial Sequence
  Description of Artificial Sequence: Synthetic oligonucleotide
  Target: ATXN1; (+) strand; PAM type: YTN; PAM sequence: TTC
atctaccttctctttcattt

SEQ ID NO: 283737 - DNA, 20 bp, Artificial Sequence
  Description of Artificial Sequence: Synthetic oligonucleotide
  Target: ATXN1; (+) strand; PAM type: YTN; PAM sequence: CTA
ccttctctttcatttattta

SEQ ID NO: 283738 - DNA, 20 bp, Artificial Sequence
  Description of Artificial Sequence: Synthetic oligonucleotide
  Target: ATXN1; (+) strand; PAM type: YTN; PAM sequence: CTT
ctctttcatttatttagtga

SEQ ID NO: 283739 - DNA, 20 bp, Artificial Sequence
  Description of Artificial Sequence: Synthetic oligonucleotide
  Target: ATXN1; (+) strand; PAM type: YTN; PAM sequence: TTC
tctttcatttatttagtgaa

SEQ ID NO: 283740 - DNA, 20 bp, Artificial Sequence
  Description of Artificial Sequence: Synthetic oligonucleotide
  Target: ATXN1; (+) strand; PAM type: YTN; PAM sequence: CTC
tttcatttatttagtgaaat

SEQ ID NO: 283741 - DNA, 20 bp, Artificial Sequence
  Description of Artificial Sequence: Synthetic oligonucleotide
  Target: ATXN1; (+) strand; PAM type: YTN; PAM sequence: CTT
tcatttatttagtgaaatga

SEQ ID NO: 283742 - DNA, 20 bp, Artificial Sequence
  Description of Artificial Sequence: Synthetic oligonucleotide
  Target: ATXN1; (+) strand; PAM type: YTN; PAM sequence: TTT
catttatttagtgaaatgaa

SEQ ID NO: 283743 - DNA, 20 bp, Artificial Sequence
  Description of Artificial Sequence: Synthetic oligonucleotide
  Target: ATXN1; (+) strand; PAM type: YTN; PAM sequence: TTC
atttatttagtgaaatgaag

SEQ ID NO: 283744 - DNA, 20 bp, Artificial Sequence
  Description of Artificial Sequence: Synthetic oligonucleotide
  Target: ATXN1; (+) strand; PAM type: YTN; PAM sequence: TTT
atttagtgaaatgaagctta

SEQ ID NO: 283745 - DNA, 20 bp, Artificial Sequence
  Description of Artificial Sequence: Synthetic oligonucleotide
  Target: ATXN1; (+) strand; PAM type: YTN; PAM sequence: TTA
tttagtgaaatgaagcttat

SEQ ID NO: 283746 - DNA, 20 bp, Artificial Sequence
  Description of Artificial Sequence: Synthetic oligonucleotide
  Target: ATXN1; (+) strand; PAM type: YTN; PAM sequence: TTT
agtgaaatgaagcttattta

SEQ ID NO: 283747 - DNA, 20 bp, Artificial Sequence
  Description of Artificial Sequence: Synthetic oligonucleotide
  Target: ATXN1; (+) strand; PAM type: YTN; PAM sequence: TTA
gtgaaatgaagcttatttag

SEQ ID NO: 283748 - DNA, 20 bp, Artificial Sequence
  Description of Artificial Sequence: Synthetic oligonucleotide
  Target: ATXN1; (+) strand; PAM type: YTN; PAM sequence: CTT
atttagtaatgacgggaaga

SEQ ID NO: 283749 - DNA, 20 bp, Artificial Sequence
  Description of Artificial Sequence: Synthetic oligonucleotide
  Target: ATXN1; (+) strand; PAM type: YTN; PAM sequence: TTA
tttagtaatgacgggaagag

SEQ ID NO: 283750 - DNA, 20 bp, Artificial Sequence
  Description of Artificial Sequence: Synthetic oligonucleotide
  Target: ATXN1; (+) strand; PAM type: YTN; PAM sequence: TTT
agtaatgacgggaagagatg

SEQ ID NO: 283751 - DNA, 20 bp, Artificial Sequence
  Description of Artificial Sequence: Synthetic oligonucleotide
  Target: ATXN1; (+) strand; PAM type: YTN; PAM sequence: TTA
gtaatgacgggaagagatga

SEQ ID NO: 283752 - DNA, 20 bp, Artificial Sequence
  Description of Artificial Sequence: Synthetic oligonucleotide
  Target: ATXN1; (+) strand; PAM type: YTN; PAM sequence: CTA
gggcagctcacatatggtgc

SEQ ID NO: 283753 - DNA, 20 bp, Artificial Sequence
  Description of Artificial Sequence: Synthetic oligonucleotide
  Target: ATXN1; (+) strand; PAM type: YTN; PAM sequence: CTC
acatatggtgccagacggtg

SEQ ID NO: 283754 - DNA, 20 bp, Artificial Sequence
  Description of Artificial Sequence: Synthetic oligonucleotide
  Target: ATXN1; (+) strand; PAM type: YTN; PAM sequence: CTC
tgtgcccaaggcacttgctg

SEQ ID NO: 283755 - DNA, 20 bp, Artificial Sequence
  Description of Artificial Sequence: Synthetic oligonucleotide
  Target: ATXN1; (+) strand; PAM type: YTN; PAM sequence: CTG
tgcccaaggcacttgctgta

SEQ ID NO: 283756 - DNA, 20 bp, Artificial Sequence
  Description of Artificial Sequence: Synthetic oligonucleotide
  Target: ATXN1; (+) strand; PAM type: YTN; PAM sequence: CTT
gctgtaccacaggagctagg

SEQ ID NO: 283757 - DNA, 20 bp, Artificial Sequence
  Description of Artificial Sequence: Synthetic oligonucleotide
  Target: ATXN1; (+) strand; PAM type: YTN; PAM sequence: TTG
ctgtaccacaggagctaggc

SEQ ID NO: 283758 - DNA, 20 bp, Artificial Sequence
  Description of Artificial Sequence: Synthetic oligonucleotide
  Target: ATXN1; (+) strand; PAM type: YTN; PAM sequence: CTG
taccacaggagctaggcagc

SEQ ID NO: 283759 - DNA, 20 bp, Artificial Sequence
  Description of Artificial Sequence: Synthetic oligonucleotide
  Target: ATXN1; (+) strand; PAM type: YTN; PAM sequence: CTA
ggcagccctggctgggaagg

SEQ ID NO: 283760 - DNA, 20 bp, Artificial Sequence
  Description of Artificial Sequence: Synthetic oligonucleotide
  Target: ATXN1; (+) strand; PAM type: YTN; PAM sequence: CTG
gctgggaaggaagctctgct

SEQ ID NO: 283761 - DNA, 20 bp, Artificial Sequence
  Description of Artificial Sequence: Synthetic oligonucleotide
  Target: ATXN1; (+) strand; PAM type: YTN; PAM sequence: CTG
ggaaggaagctctgctctca

SEQ ID NO: 283762 - DNA, 20 bp, Artificial Sequence
  Description of Artificial Sequence: Synthetic oligonucleotide
  Target: ATXN1; (+) strand; PAM type: YTN; PAM sequence: CTC
tgctctcacccaacggctgc

SEQ ID NO: 283763 - DNA, 20 bp, Artificial Sequence
  Description of Artificial Sequence: Synthetic oligonucleotide
  Target: ATXN1; (+) strand; PAM type: YTN; PAM sequence: CTG
ctctcacccaacggctgctc

SEQ ID NO: 283764 - DNA, 20 bp, Artificial Sequence
  Description of Artificial Sequence: Synthetic oligonucleotide
  Target: ATXN1; (+) strand; PAM type: YTN; PAM sequence: CTC
tcacccaacggctgctccaa

SEQ ID NO: 283765 - DNA, 20 bp, Artificial Sequence
  Description of Artificial Sequence: Synthetic oligonucleotide
  Target: ATXN1; (+) strand; PAM type: YTN; PAM sequence: CTC
acccaacggctgctccaagg

SEQ ID NO: 283766 - DNA, 20 bp, Artificial Sequence
  Description of Artificial Sequence: Synthetic oligonucleotide
  Target: ATXN1; (+) strand; PAM type: YTN; PAM sequence: CTG
ctccaagggtgcccccagcc

SEQ ID NO: 283767 - DNA, 20 bp, Artificial Sequence
  Description of Artificial Sequence: Synthetic oligonucleotide
  Target: ATXN1; (+) strand; PAM type: YTN; PAM sequence: CTC
caagggtgcccccagccagg

SEQ ID NO: 283768 - DNA, 20 bp, Artificial Sequence
  Description of Artificial Sequence: Synthetic oligonucleotide
  Target: ATXN1; (+) strand; PAM type: YTN; PAM sequence: TTT
caaagctctgtgaaaaatgg

SEQ ID NO: 283769 - DNA, 20 bp, Artificial Sequence
  Description of Artificial Sequence: Synthetic oligonucleotide
  Target: ATXN1; (+) strand; PAM type: YTN; PAM sequence: TTC
aaagctctgtgaaaaatggg

SEQ ID NO: 283770 - DNA, 20 bp, Artificial Sequence
  Description of Artificial Sequence: Synthetic oligonucleotide
  Target: ATXN1; (+) strand; PAM type: YTN; PAM sequence: CTC
tgtgaaaaatgggtctctga

SEQ ID NO: 283771 - DNA, 20 bp, Artificial Sequence
  Description of Artificial Sequence: Synthetic oligonucleotide
  Target: ATXN1; (+) strand; PAM type: YTN; PAM sequence: CTG
tgaaaaatgggtctctgact

SEQ ID NO: 283772 - DNA, 20 bp, Artificial Sequence
  Description of Artificial Sequence: Synthetic oligonucleotide
  Target: ATXN1; (+) strand; PAM type: YTN; PAM sequence: CTC
tgacttgaaaacttgaatca

SEQ ID NO: 283773 - DNA, 20 bp, Artificial Sequence
  Description of Artificial Sequence: Synthetic oligonucleotide
  Target: ATXN1; (+) strand; PAM type: YTN; PAM sequence: CTG
acttgaaaacttgaatcagg

SEQ ID NO: 283774 - DNA, 20 bp, Artificial Sequence
  Description of Artificial Sequence: Synthetic oligonucleotide
  Target: ATXN1; (+) strand; PAM type: YTN; PAM sequence: CTT
gaaaacttgaatcaggaagt

SEQ ID NO: 283775 - DNA, 20 bp, Artificial Sequence
  Description of Artificial Sequence: Synthetic oligonucleotide
  Target: ATXN1; (+) strand; PAM type: YTN; PAM sequence: TTG
aaaacttgaatcaggaagtc

SEQ ID NO: 283776 - DNA, 20 bp, Artificial Sequence
  Description of Artificial Sequence: Synthetic oligonucleotide
  Target: ATXN1; (+) strand; PAM type: YTN; PAM sequence: CTT
gaatcaggaagtctctccag

SEQ ID NO: 283777 - DNA, 20 bp, Artificial Sequence
  Description of Artificial Sequence: Synthetic oligonucleotide
  Target: ATXN1; (+) strand; PAM type: YTN; PAM sequence: TTG
aatcaggaagtctctccagg

SEQ ID NO: 283778 - DNA, 20 bp, Artificial Sequence
  Description of Artificial Sequence: Synthetic oligonucleotide
  Target: ATXN1; (+) strand; PAM type: YTN; PAM sequence: CTC
tccaggactgggattactcc

SEQ ID NO: 283779 - DNA, 20 bp, Artificial Sequence
  Description of Artificial Sequence: Synthetic oligonucleotide
  Target: ATXN1; (+) strand; PAM type: YTN; PAM sequence: CTC
caggactgggattactccac

SEQ ID NO: 283780 - DNA, 20 bp, Artificial Sequence
  Description of Artificial Sequence: Synthetic oligonucleotide
  Target: ATXN1; (+) strand; PAM type: YTN; PAM sequence: CTG
ggattactccactaatacaa

SEQ ID NO: 283781 - DNA, 20 bp, Artificial Sequence
  Description of Artificial Sequence: Synthetic oligonucleotide
  Target: ATXN1; (+) strand; PAM type: YTN; PAM sequence: TTA
ctccactaatacaaattaaa

SEQ ID NO: 283782 - DNA, 20 bp, Artificial Sequence
  Description of Artificial Sequence: Synthetic oligonucleotide
  Target: ATXN1; (+) strand; PAM type: YTN; PAM sequence: CTC
cactaatacaaattaaatcc

SEQ ID NO: 283783 - DNA, 20 bp, Artificial Sequence
  Description of Artificial Sequence: Synthetic oligonucleotide
  Target: ATXN1; (+) strand; PAM type: YTN; PAM sequence: CTA
atacaaattaaatccattca

SEQ ID NO: 283784 - DNA, 20 bp, Artificial Sequence
  Description of Artificial Sequence: Synthetic oligonucleotide
  Target: ATXN1; (+) strand; PAM type: YTN; PAM sequence: TTA
aatccattcagaagtatgct

SEQ ID NO: 283785 - DNA, 20 bp, Artificial Sequence
  Description of Artificial Sequence: Synthetic oligonucleotide
  Target: ATXN1; (+) strand; PAM type: YTN; PAM sequence: TTC
agaagtatgctaaacccttt

SEQ ID NO: 283786 - DNA, 20 bp, Artificial Sequence
  Description of Artificial Sequence: Synthetic oligonucleotide
  Target: ATXN1; (+) strand; PAM type: YTN; PAM sequence: CTA
aaccctttttgtagatacta

SEQ ID NO: 283787 - DNA, 20 bp, Artificial Sequence
  Description of Artificial Sequence: Synthetic oligonucleotide
  Target: ATXN1; (+) strand; PAM type: YTN; PAM sequence: CTT
tttgtagatactagaggagg

SEQ ID NO: 283788 - DNA, 20 bp, Artificial Sequence
  Description of Artificial Sequence: Synthetic oligonucleotide
  Target: ATXN1; (+) strand; PAM type: YTN; PAM sequence: TTT
ttgtagatactagaggagga

SEQ ID NO: 283789 - DNA, 20 bp, Artificial Sequence
  Description of Artificial Sequence: Synthetic oligonucleotide
  Target: ATXN1; (+) strand; PAM type: YTN; PAM sequence: TTT
tgtagatactagaggaggat

SEQ ID NO: 283790 - DNA, 20 bp, Artificial Sequence
  Description of Artificial Sequence: Synthetic oligonucleotide
  Target: ATXN1; (+) strand; PAM type: YTN; PAM sequence: TTT
gtagatactagaggaggatg

SEQ ID NO: 283791 - DNA, 20 bp, Artificial Sequence
  Description of Artificial Sequence: Synthetic oligonucleotide
  Target: ATXN1; (+) strand; PAM type: YTN; PAM sequence: TTG
tagatactagaggaggatga

SEQ ID NO: 283792 - DNA, 20 bp, Artificial Sequence
  Description of Artificial Sequence: Synthetic oligonucleotide
  Target: ATXN1; (+) strand; PAM type: YTN; PAM sequence: CTA
gaggaggatgaaaagaggga

SEQ ID NO: 283793 - DNA, 20 bp, Artificial Sequence
  Description of Artificial Sequence: Synthetic oligonucleotide
  Target: ATXN1; (+) strand; PAM type: YTN; PAM sequence: TTT
tggaagattaggattatact

SEQ ID NO: 283794 - DNA, 20 bp, Artificial Sequence
  Description of Artificial Sequence: Synthetic oligonucleotide
  Target: ATXN1; (+) strand; PAM type: YTN; PAM sequence: TTT
ggaagattaggattatacta

SEQ ID NO: 283795 - DNA, 20 bp, Artificial Sequence
  Description of Artificial Sequence: Synthetic oligonucleotide
  Target: ATXN1; (+) strand; PAM type: YTN; PAM sequence: TTG
gaagattaggattatactat

SEQ ID NO: 283796 - DNA, 20 bp, Artificial Sequence
  Description of Artificial Sequence: Synthetic oligonucleotide
  Target: ATXN1; (+) strand; PAM type: YTN; PAM sequence: TTA
ggattatactatggttcatg

SEQ ID NO: 283797 - DNA, 20 bp, Artificial Sequence
  Description of Artificial Sequence: Synthetic oligonucleotide
  Target: ATXN1; (+) strand; PAM type: YTN; PAM sequence: TTA
tactatggttcatgccaata

SEQ ID NO: 283798 - DNA, 20 bp, Artificial Sequence
  Description of Artificial Sequence: Synthetic oligonucleotide
  Target: ATXN1; (+) strand; PAM type: YTN; PAM sequence: CTA
tggttcatgccaatacccta

SEQ ID NO: 283799 - DNA, 20 bp, Artificial Sequence
  Description of Artificial Sequence: Synthetic oligonucleotide
  Target: ATXN1; (+) strand; PAM type: YTN; PAM sequence: TTC
atgccaataccctacatttg

SEQ ID NO: 283800 - DNA, 20 bp, Artificial Sequence
  Description of Artificial Sequence: Synthetic oligonucleotide
  Target: ATXN1; (+) strand; PAM type: YTN; PAM sequence: CTA
catttgtttacttctatatt

SEQ ID NO: 283801 - DNA, 20 bp, Artificial Sequence
  Description of Artificial Sequence: Synthetic oligonucleotide
  Target: ATXN1; (+) strand; PAM type: YTN; PAM sequence: TTT
gtttacttctatattgatca

SEQ ID NO: 283802 - DNA, 20 bp, Artificial Sequence
  Description of Artificial Sequence: Synthetic oligonucleotide
  Target: ATXN1; (+) strand; PAM type: YTN; PAM sequence: TTG
tttacttctatattgatcat

SEQ ID NO: 283803 - DNA, 20 bp, Artificial Sequence
  Description of Artificial Sequence: Synthetic oligonucleotide
  Target: ATXN1; (+) strand; PAM type: YTN; PAM sequence: TTT
acttctatattgatcatttt

SEQ ID NO: 283804 - DNA, 20 bp, Artificial Sequence
  Description of Artificial Sequence: Synthetic oligonucleotide
  Target: ATXN1; (+) strand; PAM type: YTN; PAM sequence: TTA
cttctatattgatcattttc

SEQ ID NO: 283805 - DNA, 20 bp, Artificial Sequence
  Description of Artificial Sequence: Synthetic oligonucleotide
  Target: ATXN1; (+) strand; PAM type: YTN; PAM sequence: CTT
ctatattgatcattttctca

SEQ ID NO: 283806 - DNA, 20 bp, Artificial Sequence
  Description of Artificial Sequence: Synthetic oligonucleotide
  Target: ATXN1; (+) strand; PAM type: YTN; PAM sequence: TTC
tatattgatcattttctcaa

SEQ ID NO: 283807 - DNA, 20 bp, Artificial Sequence
  Description of Artificial Sequence: Synthetic oligonucleotide
  Target: ATXN1; (+) strand; PAM type: YTN; PAM sequence: CTA
tattgatcattttctcaaat

SEQ ID NO: 283808 - DNA, 20 bp, Artificial Sequence
  Description of Artificial Sequence: Synthetic oligonucleotide
  Target: ATXN1; (+) strand; PAM type: YTN; PAM sequence: TTG
atcattttctcaaatgatta

SEQ ID NO: 283809 - DNA, 20 bp, Artificial Sequence
  Description of Artificial Sequence: Synthetic oligonucleotide
  Target: ATXN1; (+) strand; PAM type: YTN; PAM sequence: TTT
tctcaaatgattaaatactc

SEQ ID NO: 283810 - DNA, 20 bp, Artificial Sequence
  Description of Artificial Sequence: Synthetic oligonucleotide
  Target: ATXN1; (+) strand; PAM type: YTN; PAM sequence: TTT
ctcaaatgattaaatactcc

SEQ ID NO: 283811 - DNA, 20 bp, Artificial Sequence
  Description of Artificial Sequence: Synthetic oligonucleotide
  Target: ATXN1; (+) strand; PAM type: YTN; PAM sequence: TTC
tcaaatgattaaatactcct

SEQ ID NO: 283812 - DNA, 20 bp, Artificial Sequence
  Description of Artificial Sequence: Synthetic oligonucleotide
  Target: ATXN1; (+) strand; PAM type: YTN; PAM sequence: CTC
aaatgattaaatactcctga

SEQ ID NO: 283813 - DNA, 20 bp, Artificial Sequence
  Description of Artificial Sequence: Synthetic oligonucleotide
  Target: ATXN1; (+) strand; PAM type: YTN; PAM sequence: TTA
aatactcctgaaataggagt

SEQ ID NO: 283814 - DNA, 20 bp, Artificial Sequence
  Description of Artificial Sequence: Synthetic oligonucleotide
  Target: ATXN1; (+) strand; PAM type: YTN; PAM sequence: CTC
ctgaaataggagttttaacg

SEQ ID NO: 283815 - DNA, 20 bp, Artificial Sequence
  Description of Artificial Sequence: Synthetic oligonucleotide
  Target: ATXN1; (+) strand; PAM type: YTN; PAM sequence: CTG
aaataggagttttaacgatt

SEQ ID NO: 283816 - DNA, 20 bp, Artificial Sequence
  Description of Artificial Sequence: Synthetic oligonucleotide
  Target: ATXN1; (+) strand; PAM type: YTN; PAM sequence: TTT
taacgattttaaacatttca

SEQ ID NO: 283817 - DNA, 20 bp, Artificial Sequence
  Description of Artificial Sequence: Synthetic oligonucleotide
  Target: ATXN1; (+) strand; PAM type: YTN; PAM sequence: TTT
aacgattttaaacatttcat

SEQ ID NO: 283818 - DNA, 20 bp, Artificial Sequence
  Description of Artificial Sequence: Synthetic oligonucleotide
  Target: ATXN1; (+) strand; PAM type: YTN; PAM sequence: TTA
acgattttaaacatttcata

SEQ ID NO: 283819 - DNA, 20 bp, Artificial Sequence
  Description of Artificial Sequence: Synthetic oligonucleotide
  Target: ATXN1; (+) strand; PAM type: YTN; PAM sequence: TTT
taaacatttcatatatatta

SEQ ID NO: 283820 - DNA, 20 bp, Artificial Sequence
  Description of Artificial Sequence: Synthetic oligonucleotide
  Target: ATXN1; (+) strand; PAM type: YTN; PAM sequence: TTT
aaacatttcatatatattat

SEQ ID NO: 283821 - DNA, 20 bp, Artificial Sequence
  Description of Artificial Sequence: Synthetic oligonucleotide
  Target: ATXN1; (+) strand; PAM type: YTN; PAM sequence: TTA
aacatttcatatatattatt

SEQ ID NO: 283822 - DNA, 20 bp, Artificial Sequence
  Description of Artificial Sequence: Synthetic oligonucleotide
  Target: ATXN1; (+) strand; PAM type: YTN; PAM sequence: TTT
catatatattatttgcagca

SEQ ID NO: 283823 - DNA, 20 bp, Artificial Sequence
  Description of Artificial Sequence: Synthetic oligonucleotide
  Target: ATXN1; (+) strand; PAM type: YTN; PAM sequence: TTC
atatatattatttgcagcaa

SEQ ID NO: 283824 - DNA, 20 bp, Artificial Sequence
  Description of Artificial Sequence: Synthetic oligonucleotide
  Target: ATXN1; (+) strand; PAM type: YTN; PAM sequence: TTA
tttgcagcaacacccaaggg

SEQ ID NO: 283825 - DNA, 20 bp, Artificial Sequence
  Description of Artificial Sequence: Synthetic oligonucleotide
  Target: ATXN1; (+) strand; PAM type: YTN; PAM sequence: TTT
gcagcaacacccaagggaga

SEQ ID NO: 283826 - DNA, 20 bp, Artificial Sequence
  Description of Artificial Sequence: Synthetic oligonucleotide
  Target: ATXN1; (+) strand; PAM type: YTN; PAM sequence: TTG
cagcaacacccaagggagaa

SEQ ID NO: 283827 - DNA, 20 bp, Artificial Sequence
  Description of Artificial Sequence: Synthetic oligonucleotide
  Target: ATXN1; (+) strand; PAM type: YTN; PAM sequence: CTA
ttattatccgaattttacat

SEQ ID NO: 283828 - DNA, 20 bp, Artificial Sequence
  Description of Artificial Sequence: Synthetic oligonucleotide
  Target: ATXN1; (+) strand; PAM type: YTN; PAM sequence: TTA
ttatccgaattttacatgca

SEQ ID NO: 283829 - DNA, 20 bp, Artificial Sequence
  Description of Artificial Sequence: Synthetic oligonucleotide
  Target: ATXN1; (+) strand; PAM type: YTN; PAM sequence: TTA
tccgaattttacatgcaaag

SEQ ID NO: 283830 - DNA, 20 bp, Artificial Sequence
  Description of Artificial Sequence: Synthetic oligonucleotide
  Target: ATXN1; (+) strand; PAM type: YTN; PAM sequence: TTT
tacatgcaaagtaacttgcc

SEQ ID NO: 283831 - DNA, 20 bp, Artificial Sequence
  Description of Artificial Sequence: Synthetic oligonucleotide
  Target: ATXN1; (+) strand; PAM type: YTN; PAM sequence: TTT
acatgcaaagtaacttgccc

SEQ ID NO: 283832 - DNA, 20 bp, Artificial Sequence
  Description of Artificial Sequence: Synthetic oligonucleotide
  Target: ATXN1; (+) strand; PAM type: YTN; PAM sequence: TTA
catgcaaagtaacttgccca

SEQ ID NO: 283833 - DNA, 20 bp, Artificial Sequence
  Description of Artificial Sequence: Synthetic oligonucleotide
  Target: ATXN1; (+) strand; PAM type: YTN; PAM sequence: CTT
gcccaatgtcacacttcaag

SEQ ID NO: 283834 - DNA, 20 bp, Artificial Sequence
  Description of Artificial Sequence: Synthetic oligonucleotide
  Target: ATXN1; (+) strand; PAM type: YTN; PAM sequence: TTG
cccaatgtcacacttcaaga

SEQ ID NO: 283835 - DNA, 20 bp, Artificial Sequence
  Description of Artificial Sequence: Synthetic oligonucleotide
  Target: ATXN1; (+) strand; PAM type: YTN; PAM sequence: CTT
caagaaaacagcagagctgg

SEQ ID NO: 283836 - DNA, 20 bp, Artificial Sequence
  Description of Artificial Sequence: Synthetic oligonucleotide
  Target: ATXN1; (+) strand; PAM type: YTN; PAM sequence: TTC
aagaaaacagcagagctgga

SEQ ID NO: 283837 - DNA, 20 bp, Artificial Sequence
  Description of Artificial Sequence: Synthetic oligonucleotide
  Target: ATXN1; (+) strand; PAM type: YTN; PAM sequence: CTG
gaatttgagcccaggcagcc

SEQ ID NO: 283838 - DNA, 20 bp, Artificial Sequence
  Description of Artificial Sequence: Synthetic oligonucleotide
  Target: ATXN1; (+) strand; PAM type: YTN; PAM sequence: TTT
gagcccaggcagcctgaagc

SEQ ID NO: 283839 - DNA, 20 bp, Artificial Sequence
  Description of Artificial Sequence: Synthetic oligonucleotide
  Target: ATXN1; (+) strand; PAM type: YTN; PAM sequence: TTG
agcccaggcagcctgaagct

SEQ ID NO: 283840 - DNA, 20 bp, Artificial Sequence
  Description of Artificial Sequence: Synthetic oligonucleotide
  Target: ATXN1; (+) strand; PAM type: YTN; PAM sequence: CTG
aagcttgcaatcttatctac

SEQ ID NO: 283841 - DNA, 20 bp, Artificial Sequence
  Description of Artificial Sequence: Synthetic oligonucleotide
  Target: ATXN1; (+) strand; PAM type: YTN; PAM sequence: CTT
gcaatcttatctacagcttt

SEQ ID NO: 283842 - DNA, 20 bp, Artificial Sequence
  Description of Artificial Sequence: Synthetic oligonucleotide
  Target: ATXN1; (+) strand; PAM type: YTN; PAM sequence: TTG
caatcttatctacagctttt

SEQ ID NO: 283843 - DNA, 20 bp, Artificial Sequence
  Description of Artificial Sequence: Synthetic oligonucleotide
  Target: ATXN1; (+) strand; PAM type: YTN; PAM sequence: CTT
atctacagcttttccatcat

SEQ ID NO: 283844 - DNA, 20 bp, Artificial Sequence
  Description of Artificial Sequence: Synthetic oligonucleotide
  Target: ATXN1; (+) strand; PAM type: YTN; PAM sequence: TTA
tctacagcttttccatcata

SEQ ID NO: 283845 - DNA, 20 bp, Artificial Sequence
  Description of Artificial Sequence: Synthetic oligonucleotide
  Target: ATXN1; (+) strand; PAM type: YTN; PAM sequence: CTA
cagcttttccatcatatggc

SEQ ID NO: 283846 - DNA, 20 bp, Artificial Sequence
  Description of Artificial Sequence: Synthetic oligonucleotide
  Target: ATXN1; (+) strand; PAM type: YTN; PAM sequence: CTT
ttccatcatatggcactaac

SEQ ID NO: 283847 - DNA, 20 bp, Artificial Sequence
  Description of Artificial Sequence: Synthetic oligonucleotide
  Target: ATXN1; (+) strand; PAM type: YTN; PAM sequence: TTT
tccatcatatggcactaaca

SEQ ID NO: 283848 - DNA, 20 bp, Artificial Sequence
  Description of Artificial Sequence: Synthetic oligonucleotide
  Target: ATXN1; (+) strand; PAM type: YTN; PAM sequence: TTT
ccatcatatggcactaacat

SEQ ID NO: 283849 - DNA, 20 bp, Artificial Sequence
  Description of Artificial Sequence: Synthetic oligonucleotide
  Target: ATXN1; (+) strand; PAM type: YTN; PAM sequence: TTC
catcatatggcactaacata

SEQ ID NO: 283850 - DNA, 20 bp, Artificial Sequence
  Description of Artificial Sequence: Synthetic oligonucleotide
  Target: ATXN1; (+) strand; PAM type: YTN; PAM sequence: CTA
acatagttatatttaatcat

SEQ ID NO: 283851 - DNA, 20 bp, Artificial Sequence
  Description of Artificial Sequence: Synthetic oligonucleotide
  Target: ATXN1; (+) strand; PAM type: YTN; PAM sequence: TTA
tatttaatcatgttcccgat

SEQ ID NO: 283852 - DNA, 20 bp, Artificial Sequence
  Description of Artificial Sequence: Synthetic oligonucleotide
  Target: ATXN1; (+) strand; PAM type: YTN; PAM sequence: TTT
aatcatgttcccgatattgg

SEQ ID NO: 283853 - DNA, 20 bp, Artificial Sequence
  Description of Artificial Sequence: Synthetic oligonucleotide
  Target: ATXN1; (+) strand; PAM type: YTN; PAM sequence: TTA
atcatgttcccgatattgga

SEQ ID NO: 283854 - DNA, 20 bp, Artificial Sequence
  Description of Artificial Sequence: Synthetic oligonucleotide
  Target: ATXN1; (+) strand; PAM type: YTN; PAM sequence: TTC
ccgatattggacatatatat

SEQ ID NO: 283855 - DNA, 20 bp, Artificial Sequence
  Description of Artificial Sequence: Synthetic oligonucleotide
  Target: ATXN1; (+) strand; PAM type: YTN; PAM sequence: TTG
gacatatatatatatatata

SEQ ID NO: 283856 - DNA, 20 bp, Artificial Sequence
  Description of Artificial Sequence: Synthetic oligonucleotide
  Target: ATXN1; (+) strand; PAM type: YTN; PAM sequence: TTT
ttaaactaatgagcagtata

SEQ ID NO: 283857 - DNA, 20 bp, Artificial Sequence
  Description of Artificial Sequence: Synthetic oligonucleotide
  Target: ATXN1; (+) strand; PAM type: YTN; PAM sequence: TTT
taaactaatgagcagtataa

SEQ ID NO: 283858 - DNA, 20 bp, Artificial Sequence
  Description of Artificial Sequence: Synthetic oligonucleotide
  Target: ATXN1; (+) strand; PAM type: YTN; PAM sequence: TTT
aaactaatgagcagtataac

SEQ ID NO: 283859 - DNA, 20 bp, Artificial Sequence
  Description of Artificial Sequence: Synthetic oligonucleotide
  Target: ATXN1; (+) strand; PAM type: YTN; PAM sequence: TTA
aactaatgagcagtataact

SEQ ID NO: 283860 - DNA, 20 bp, Artificial Sequence
  Description of Artificial Sequence: Synthetic oligonucleotide
  Target: ATXN1; (+) strand; PAM type: YTN; PAM sequence: CTA
atgagcagtataacttcaga

SEQ ID NO: 283861 - DNA, 20 bp, Artificial Sequence
  Description of Artificial Sequence: Synthetic oligonucleotide
  Target: ATXN1; (+) strand; PAM type: YTN; PAM sequence: CTT
cagatacatatctaataaaa

SEQ ID NO: 283862 - DNA, 20 bp, Artificial Sequence
  Description of Artificial Sequence: Synthetic oligonucleotide
  Target: ATXN1; (+) strand; PAM type: YTN; PAM sequence: TTC
agatacatatctaataaaat

SEQ ID NO: 283863 - DNA, 20 bp, Artificial Sequence
  Description of Artificial Sequence: Synthetic oligonucleotide
  Target: ATXN1; (+) strand; PAM type: YTN; PAM sequence: CTA
ataaaatttttttattaaat

SEQ ID NO: 283864 - DNA, 20 bp, Artificial Sequence
  Description of Artificial Sequence: Synthetic oligonucleotide
  Target: ATXN1; (+) strand; PAM type: YTN; PAM sequence: TTT
ttttattaaatacctttttg

SEQ ID NO: 283865 - DNA, 20 bp, Artificial Sequence
  Description of Artificial Sequence: Synthetic oligonucleotide
  Target: ATXN1; (+) strand; PAM type: YTN; PAM sequence: TTT
tttattaaatacctttttgc

SEQ ID NO: 283866 - DNA, 20 bp, Artificial Sequence
  Description of Artificial Sequence: Synthetic oligonucleotide
  Target: ATXN1; (+) strand; PAM type: YTN; PAM sequence: TTT
ttattaaatacctttttgct

SEQ ID NO: 283867 - DNA, 20 bp, Artificial Sequence
  Description of Artificial Sequence: Synthetic oligonucleotide
  Target: ATXN1; (+) strand; PAM type: YTN; PAM sequence: TTT
tattaaatacctttttgctc

SEQ ID NO: 283868 - DNA, 20 bp, Artificial Sequence
  Description of Artificial Sequence: Synthetic oligonucleotide
  Target: ATXN1; (+) strand; PAM type: YTN; PAM sequence: TTT
attaaatacctttttgctct

SEQ ID NO: 283869 - DNA, 20 bp, Artificial Sequence
  Description of Artificial Sequence: Synthetic oligonucleotide
  Target: ATXN1; (+) strand; PAM type: YTN; PAM sequence: TTA
ttaaatacctttttgctctt

SEQ ID NO: 283870 - DNA, 20 bp, Artificial Sequence
  Description of Artificial Sequence: Synthetic oligonucleotide
  Target: ATXN1; (+) strand; PAM type: YTN; PAM sequence: TTA
aatacctttttgctcttttt

SEQ ID NO: 283871 - DNA, 20 bp, Artificial Sequence
  Description of Artificial Sequence: Synthetic oligonucleotide
  Target: ATXN1; (+) strand; PAM type: YTN; PAM sequence: CTT
tttgctctttttaagaaatg

SEQ ID NO: 283872 - DNA, 20 bp, Artificial Sequence
  Description of Artificial Sequence: Synthetic oligonucleotide
  Target: ATXN1; (+) strand; PAM type: YTN; PAM sequence: TTT
ttgctctttttaagaaatga

SEQ ID NO: 283873 - DNA, 20 bp, Artificial Sequence
  Description of Artificial Sequence: Synthetic oligonucleotide
  Target: ATXN1; (+) strand; PAM type: YTN; PAM sequence: TTT
tgctctttttaagaaatgaa

SEQ ID NO: 283874 - DNA, 20 bp, Artificial Sequence
  Description of Artificial Sequence: Synthetic oligonucleotide
  Target: ATXN1; (+) strand; PAM type: YTN; PAM sequence: TTT
gctctttttaagaaatgaaa

SEQ ID NO: 283875 - DNA, 20 bp, Artificial Sequence
  Description of Artificial Sequence: Synthetic oligonucleotide
  Target: ATXN1; (+) strand; PAM type: YTN; PAM sequence: TTG
ctctttttaagaaatgaaaa

SEQ ID NO: 283876 - DNA, 20 bp, Artificial Sequence
  Description of Artificial Sequence: Synthetic oligonucleotide
  Target: ATXN1; (+) strand; PAM type: YTN; PAM sequence: CTC
tttttaagaaatgaaaaatt

SEQ ID NO: 283877 - DNA, 20 bp, Artificial Sequence
  Description of Artificial Sequence: Synthetic oligonucleotide
  Target: ATXN1; (+) strand; PAM type: YTN; PAM sequence: CTT
tttaagaaatgaaaaattat

SEQ ID NO: 283878 - DNA, 20 bp, Artificial Sequence
  Description of Artificial Sequence: Synthetic oligonucleotide
  Target: ATXN1; (+) strand; PAM type: YTN; PAM sequence: TTT
ttaagaaatgaaaaattatg

SEQ ID NO: 283879 - DNA, 20 bp, Artificial Sequence
  Description of Artificial Sequence: Synthetic oligonucleotide
  Target: ATXN1; (+) strand; PAM type: YTN; PAM sequence: TTT
taagaaatgaaaaattatgc

SEQ ID NO: 283880 - DNA, 20 bp, Artificial Sequence
  Description of Artificial Sequence: Synthetic oligonucleotide
  Target: ATXN1; (+) strand; PAM type: YTN; PAM sequence: TTT
aagaaatgaaaaattatgct

SEQ ID NO: 283881 - DNA, 20 bp, Artificial Sequence
  Description of Artificial Sequence: Synthetic oligonucleotide
  Target: ATXN1; (+) strand; PAM type: YTN; PAM sequence: TTA
agaaatgaaaaattatgctt

SEQ ID NO: 283882 - DNA, 20 bp, Artificial Sequence
  Description of Artificial Sequence: Synthetic oligonucleotide
  Target: ATXN1; (+) strand; PAM type: YTN; PAM sequence: TTA
tgctttccactgaaaaatga

SEQ ID NO: 283883 - DNA, 20 bp, Artificial Sequence
  Description of Artificial Sequence: Synthetic oligonucleotide
  Target: ATXN1; (+) strand; PAM type: YTN; PAM sequence: CTT
tccactgaaaaatgattgta

SEQ ID NO: 283884 - DNA, 20 bp, Artificial Sequence
  Description of Artificial Sequence: Synthetic oligonucleotide
  Target: ATXN1; (+) strand; PAM type: YTN; PAM sequence: TTT
ccactgaaaaatgattgtat

SEQ ID NO: 283885 - DNA, 20 bp, Artificial Sequence
  Description of Artificial Sequence: Synthetic oligonucleotide
  Target: ATXN1; (+) strand; PAM type: YTN; PAM sequence: TTC
cactgaaaaatgattgtatc

SEQ ID NO: 283886 - DNA, 20 bp, Artificial Sequence
  Description of Artificial Sequence: Synthetic oligonucleotide
  Target: ATXN1; (+) strand; PAM type: YTN; PAM sequence: CTG
aaaaatgattgtatctagtg

SEQ ID NO: 283887 - DNA, 20 bp, Artificial Sequence
  Description of Artificial Sequence: Synthetic oligonucleotide
  Target: ATXN1; (+) strand; PAM type: YTN; PAM sequence: TTG
tatctagtgatttcatagtt

SEQ ID NO: 283888 - DNA, 20 bp, Artificial Sequence
  Description of Artificial Sequence: Synthetic oligonucleotide
  Target: ATXN1; (+) strand; PAM type: YTN; PAM sequence: CTA
gtgatttcatagttgtctaa

SEQ ID NO: 283889 - DNA, 20 bp, Artificial Sequence
  Description of Artificial Sequence: Synthetic oligonucleotide
  Target: ATXN1; (+) strand; PAM type: YTN; PAM sequence: TTT
catagttgtctaaaaatact

SEQ ID NO: 283890 - DNA, 20 bp, Artificial Sequence
  Description of Artificial Sequence: Synthetic oligonucleotide
  Target: ATXN1; (+) strand; PAM type: YTN; PAM sequence: TTC
atagttgtctaaaaatactt

SEQ ID NO: 283891 - DNA, 20 bp, Artificial Sequence
  Description of Artificial Sequence: Synthetic oligonucleotide
  Target: ATXN1; (+) strand; PAM type: YTN; PAM sequence: TTG
tctaaaaatacttggccaga

SEQ ID NO: 283892 - DNA, 20 bp, Artificial Sequence
  Description of Artificial Sequence: Synthetic oligonucleotide
  Target: ATXN1; (+) strand; PAM type: YTN; PAM sequence: CTA
aaaatacttggccagaaagg

SEQ ID NO: 283893 - DNA, 20 bp, Artificial Sequence
  Description of Artificial Sequence: Synthetic oligonucleotide
  Target: ATXN1; (+) strand; PAM type: YTN; PAM sequence: CTT
ggccagaaaggaagaactta

SEQ ID NO: 283894 - DNA, 20 bp, Artificial Sequence
  Description of Artificial Sequence: Synthetic oligonucleotide
  Target: ATXN1; (+) strand; PAM type: YTN; PAM sequence: TTG
gccagaaaggaagaacttaa

SEQ ID NO: 283895 - DNA, 20 bp, Artificial Sequence
  Description of Artificial Sequence: Synthetic oligonucleotide
  Target: ATXN1; (+) strand; PAM type: YTN; PAM sequence: CTT
aaaattccctaggacccttc

SEQ ID NO: 283896 - DNA, 20 bp, Artificial Sequence
  Description of Artificial Sequence: Synthetic oligonucleotide
  Target: ATXN1; (+) strand; PAM type: YTN; PAM sequence: TTA
aaattccctaggacccttct

SEQ ID NO: 283897 - DNA, 20 bp, Artificial Sequence
  Description of Artificial Sequence: Synthetic oligonucleotide
  Target: ATXN1; (+) strand; PAM type: YTN; PAM sequence: TTC
cctaggacccttctactcct

SEQ ID NO: 283898 - DNA, 20 bp, Artificial Sequence
  Description of Artificial Sequence: Synthetic oligonucleotide
  Target: ATXN1; (+) strand; PAM type: YTN; PAM sequence: CTA
ggacccttctactccttctg

SEQ ID NO: 283899 - DNA, 20 bp, Artificial Sequence
  Description of Artificial Sequence: Synthetic oligonucleotide
  Target: ATXN1; (+) strand; PAM type: YTN; PAM sequence: CTT
ctactccttctggatttaat

SEQ ID NO: 283900 - DNA, 20 bp, Artificial Sequence
  Description of Artificial Sequence: Synthetic oligonucleotide
  Target: ATXN1; (+) strand; PAM type: YTN; PAM sequence: TTC
tactccttctggatttaata

SEQ ID NO: 283901 - DNA, 20 bp, Artificial Sequence
  Description of Artificial Sequence: Synthetic oligonucleotide
  Target: ATXN1; (+) strand; PAM type: YTN; PAM sequence: CTA
ctccttctggatttaatatt

SEQ ID NO: 283902 - DNA, 20 bp, Artificial Sequence
  Description of Artificial Sequence: Synthetic oligonucleotide
  Target: ATXN1; (+) strand; PAM type: YTN; PAM sequence: CTC
cttctggatttaatattatt

SEQ ID NO: 283903 - DNA, 20 bp, Artificial Sequence
  Description of Artificial Sequence: Synthetic oligonucleotide
  Target: ATXN1; (+) strand; PAM type: YTN; PAM sequence: CTT
ctggatttaatattatttct

SEQ ID NO: 283904 - DNA, 20 bp, Artificial Sequence
  Description of Artificial Sequence: Synthetic oligonucleotide
  Target: ATXN1; (+) strand; PAM type: YTN; PAM sequence: TTC
tggatttaatattatttctg

SEQ ID NO: 283905 - DNA, 20 bp, Artificial Sequence
  Description of Artificial Sequence: Synthetic oligonucleotide
  Target: ATXN1; (+) strand; PAM type: YTN; PAM sequence: CTG
gatttaatattatttctgaa

SEQ ID NO: 283906 - DNA, 20 bp, Artificial Sequence
  Description of Artificial Sequence: Synthetic oligonucleotide
  Target: ATXN1; (+) strand; PAM type: YTN; PAM sequence: TTT
aatattatttctgaaatgtc

SEQ ID NO: 283907 - DNA, 20 bp, Artificial Sequence
  Description of Artificial Sequence: Synthetic oligonucleotide
  Target: ATXN1; (+) strand; PAM type: YTN; PAM sequence: TTA
atattatttctgaaatgtcg

SEQ ID NO: 283908 - DNA, 20 bp, Artificial Sequence
  Description of Artificial Sequence: Synthetic oligonucleotide
  Target: ATXN1; (+) strand; PAM type: YTN; PAM sequence: TTA
tttctgaaatgtcgaaatct

SEQ ID NO: 283909 - DNA, 20 bp, Artificial Sequence
  Description of Artificial Sequence: Synthetic oligonucleotide
  Target: ATXN1; (+) strand; PAM type: YTN; PAM sequence: TTT
ctgaaatgtcgaaatctggt

SEQ ID NO: 283910 - DNA, 20 bp, Artificial Sequence
  Description of Artificial Sequence: Synthetic oligonucleotide
  Target: ATXN1; (+) strand; PAM type: YTN; PAM sequence: TTC
tgaaatgtcgaaatctggta

SEQ ID NO: 283911 - DNA, 20 bp, Artificial Sequence
  Description of Artificial Sequence: Synthetic oligonucleotide
  Target: ATXN1; (+) strand; PAM type: YTN; PAM sequence: CTG
aaatgtcgaaatctggtaag

SEQ ID NO: 283912 - DNA, 20 bp, Artificial Sequence
  Description of Artificial Sequence: Synthetic oligonucleotide
  Target: ATXN1; (+) strand; PAM type: YTN; PAM sequence: CTG
gtaagtttcaaggatgctgc

SEQ ID NO: 283913 - DNA, 20 bp, Artificial Sequence
  Description of Artificial Sequence: Synthetic oligonucleotide
  Target: ATXN1; (+) strand; PAM type: YTN; PAM sequence: TTT
caaggatgctgctgtctaat

SEQ ID NO: 283914 - DNA, 20 bp, Artificial Sequence
  Description of Artificial Sequence: Synthetic oligonucleotide
  Target: ATXN1; (+) strand; PAM type: YTN; PAM sequence: TTC
aaggatgctgctgtctaatg

SEQ ID NO: 283915 - DNA, 20 bp, Artificial Sequence
  Description of Artificial Sequence: Synthetic oligonucleotide
  Target: ATXN1; (+) strand; PAM type: YTN; PAM sequence: CTG
ctgtctaatggaggaaggtt

SEQ ID NO: 283916 - DNA, 20 bp, Artificial Sequence
  Description of Artificial Sequence: Synthetic oligonucleotide
  Target: ATXN1; (+) strand; PAM type: YTN; PAM sequence: CTG
tctaatggaggaaggttcta

SEQ ID NO: 283917 - DNA, 20 bp, Artificial Sequence
  Description of Artificial Sequence: Synthetic oligonucleotide
  Target: ATXN1; (+) strand; PAM type: YTN; PAM sequence: CTA
atggaggaaggttctacaaa

SEQ ID NO: 283918 - DNA, 20 bp, Artificial Sequence
  Description of Artificial Sequence: Synthetic oligonucleotide
  Target: ATXN1; (+) strand; PAM type: YTN; PAM sequence: TTC
tacaaaacagtacaatttac

SEQ ID NO: 283919 - DNA, 20 bp, Artificial Sequence
  Description of Artificial Sequence: Synthetic oligonucleotide
  Target: ATXN1; (+) strand; PAM type: YTN; PAM sequence: CTA
caaaacagtacaatttactt

SEQ ID NO: 283920 - DNA, 20 bp, Artificial Sequence
  Description of Artificial Sequence: Synthetic oligonucleotide
  Target: ATXN1; (+) strand; PAM type: YTN; PAM sequence: TTT
acttgacttacaaatgaccc

SEQ ID NO: 283921 - DNA, 20 bp, Artificial Sequence
  Description of Artificial Sequence: Synthetic oligonucleotide
  Target: ATXN1; (+) strand; PAM type: YTN; PAM sequence: TTA
cttgacttacaaatgacccc

SEQ ID NO: 283922 - DNA, 20 bp, Artificial Sequence
  Description of Artificial Sequence: Synthetic oligonucleotide
  Target: ATXN1; (+) strand; PAM type: YTN; PAM sequence: CTT
gacttacaaatgaccccccc

SEQ ID NO: 283923 - DNA, 20 bp, Artificial Sequence
  Description of Artificial Sequence: Synthetic oligonucleotide
  Target: ATXN1; (+) strand; PAM type: YTN; PAM sequence: TTG
acttacaaatgacccccccc

SEQ ID NO: 283924 - DNA, 20 bp, Artificial Sequence
  Description of Artificial Sequence: Synthetic oligonucleotide
  Target: ATXN1; (+) strand; PAM type: YTN; PAM sequence: CTT
acaaatgaccccccccaccc

SEQ ID NO: 283925 - DNA, 20 bp, Artificial Sequence
  Description of Artificial Sequence: Synthetic oligonucleotide
  Target: ATXN1; (+) strand; PAM type: YTN; PAM sequence: TTA
caaatgaccccccccacccc

SEQ ID NO: 283926 - DNA, 20 bp, Artificial Sequence
  Description of Artificial Sequence: Synthetic oligonucleotide
  Target: ATXN1; (+) strand; PAM type: YTN; PAM sequence: TTT
tgcataatcagtcagcaaaa

SEQ ID NO: 283927 - DNA, 20 bp, Artificial Sequence
  Description of Artificial Sequence: Synthetic oligonucleotide
  Target: ATXN1; (+) strand; PAM type: YTN; PAM sequence: TTT
gcataatcagtcagcaaaaa

SEQ ID NO: 283928 - DNA, 20 bp, Artificial Sequence
  Description of Artificial Sequence: Synthetic oligonucleotide
  Target: ATXN1; (+) strand; PAM type: YTN; PAM sequence: TTG
cataatcagtcagcaaaaaa

SEQ ID NO: 283929 - DNA, 20 bp, Artificial Sequence
  Description of Artificial Sequence: Synthetic oligonucleotide
  Target: ATXN1; (+) strand; PAM type: YTN; PAM sequence: CTC
tttttgttttcaaaattctc

SEQ ID NO: 283930 - DNA, 20 bp, Artificial Sequence
  Description of Artificial Sequence: Synthetic oligonucleotide
  Target: ATXN1; (+) strand; PAM type: YTN; PAM sequence: CTT
tttgttttcaaaattctcag

SEQ ID NO: 283931 - DNA, 20 bp, Artificial Sequence
  Description of Artificial Sequence: Synthetic oligonucleotide
  Target: ATXN1; (+) strand; PAM type: YTN; PAM sequence: TTT
ttgttttcaaaattctcagc

SEQ ID NO: 283932 - DNA, 20 bp, Artificial Sequence
  Description of Artificial Sequence: Synthetic oligonucleotide
  Target: ATXN1; (+) strand; PAM type: YTN; PAM sequence: TTT
tgttttcaaaattctcagca

SEQ ID NO: 283933 - DNA, 20 bp, Artificial Sequence
  Description of Artificial Sequence: Synthetic oligonucleotide
  Target: ATXN1; (+) strand; PAM type: YTN; PAM sequence: TTT
gttttcaaaattctcagcat

SEQ ID NO: 283934 - DNA, 20 bp, Artificial Sequence
  Description of Artificial Sequence: Synthetic oligonucleotide
  Target: ATXN1; (+) strand; PAM type: YTN; PAM sequence: TTG
ttttcaaaattctcagcatt

SEQ ID NO: 283935 - DNA, 20 bp, Artificial Sequence
  Description of Artificial Sequence: Synthetic oligonucleotide
  Target: ATXN1; (+) strand; PAM type: YTN; PAM sequence: TTT
tcaaaattctcagcattgga

SEQ ID NO: 283936 - DNA, 20 bp, Artificial Sequence
  Description of Artificial Sequence: Synthetic oligonucleotide
  Target: ATXN1; (+) strand; PAM type: YTN; PAM sequence: TTT
caaaattctcagcattggaa

SEQ ID NO: 283937 - DNA, 20 bp, Artificial Sequence
  Description of Artificial Sequence: Synthetic oligonucleotide
  Target: ATXN1; (+) strand; PAM type: YTN; PAM sequence: TTC
aaaattctcagcattggaaa

SEQ ID NO: 283938 - DNA, 20 bp, Artificial Sequence
  Description of Artificial Sequence: Synthetic oligonucleotide
  Target: ATXN1; (+) strand; PAM type: YTN; PAM sequence: TTC
tcagcattggaaaactgtat

SEQ ID NO: 283939 - DNA, 20 bp, Artificial Sequence
  Description of Artificial Sequence: Synthetic oligonucleotide
  Target: ATXN1; (+) strand; PAM type: YTN; PAM sequence: CTC
agcattggaaaactgtatta

SEQ ID NO: 283940 - DNA, 20 bp, Artificial Sequence
  Description of Artificial Sequence: Synthetic oligonucleotide
  Target: ATXN1; (+) strand; PAM type: YTN; PAM sequence: TTG
gaaaactgtattaagtagac

SEQ ID NO: 283941 - DNA, 20 bp, Artificial Sequence
  Description of Artificial Sequence: Synthetic oligonucleotide
  Target: ATXN1; (+) strand; PAM type: YTN; PAM sequence: CTG
tattaagtagacgctctcat

SEQ ID NO: 283942 - DNA, 20 bp, Artificial Sequence
  Description of Artificial Sequence: Synthetic oligonucleotide
  Target: ATXN1; (+) strand; PAM type: YTN; PAM sequence: TTA
agtagacgctctcataaact

SEQ ID NO: 283943 - DNA, 20 bp, Artificial Sequence
  Description of Artificial Sequence: Synthetic oligonucleotide
  Target: ATXN1; (+) strand; PAM type: YTN; PAM sequence: CTC
tcataaactgcctctggaaa

SEQ ID NO: 283944 - DNA, 20 bp, Artificial Sequence
  Description of Artificial Sequence: Synthetic oligonucleotide
  Target: ATXN1; (+) strand; PAM type: YTN; PAM sequence: CTC
ataaactgcctctggaaata

SEQ ID NO: 283945 - DNA, 20 bp, Artificial Sequence
  Description of Artificial Sequence: Synthetic oligonucleotide
  Target: ATXN1; (+) strand; PAM type: YTN; PAM sequence: CTG
cctctggaaatacaaactgg

SEQ ID NO: 283946 - DNA, 20 bp, Artificial Sequence
  Description of Artificial Sequence: Synthetic oligonucleotide
  Target: ATXN1; (+) strand; PAM type: YTN; PAM sequence: CTC
tggaaatacaaactggtatg

SEQ ID NO: 283947 - DNA, 20 bp, Artificial Sequence
  Description of Artificial Sequence: Synthetic oligonucleotide
  Target: ATXN1; (+) strand; PAM type: YTN; PAM sequence: CTG
gaaatacaaactggtatgac

SEQ ID NO: 283948 - DNA, 20 bp, Artificial Sequence
  Description of Artificial Sequence: Synthetic oligonucleotide
  Target: ATXN1; (+) strand; PAM type: YTN; PAM sequence: CTG
gtatgactttactgaaagta

SEQ ID NO: 283949 - DNA, 20 bp, Artificial Sequence
  Description of Artificial Sequence: Synthetic oligonucleotide
  Target: ATXN1; (+) strand; PAM type: YTN; PAM sequence: CTT
tactgaaagtaatttggcaa

SEQ ID NO: 283950 - DNA, 20 bp, Artificial Sequence
  Description of Artificial Sequence: Synthetic oligonucleotide
  Target: ATXN1; (+) strand; PAM type: YTN; PAM sequence: TTT
actgaaagtaatttggcaac

SEQ ID NO: 283951 - DNA, 20 bp, Artificial Sequence
  Description of Artificial Sequence: Synthetic oligonucleotide
  Target: ATXN1; (+) strand; PAM type: YTN; PAM sequence: TTA
ctgaaagtaatttggcaaca

SEQ ID NO: 283952 - DNA, 20 bp, Artificial Sequence
  Description of Artificial Sequence: Synthetic oligonucleotide
  Target: ATXN1; (+) strand; PAM type: YTN; PAM sequence: CTG
aaagtaatttggcaacaagt

SEQ ID NO: 283953 - DNA, 20 bp, Artificial Sequence
  Description of Artificial Sequence: Synthetic oligonucleotide
  Target: ATXN1; (+) strand; PAM type: YTN; PAM sequence: TTT
ggcaacaagttaccaaaagc

SEQ ID NO: 283954 - DNA, 20 bp, Artificial Sequence
  Description of Artificial Sequence: Synthetic oligonucleotide
  Target: ATXN1; (+) strand; PAM type: YTN; PAM sequence: TTG
gcaacaagttaccaaaagcc

SEQ ID NO: 283955 - DNA, 20 bp, Artificial Sequence
  Description of Artificial Sequence: Synthetic oligonucleotide
  Target: ATXN1; (+) strand; PAM type: YTN; PAM sequence: TTA
ccaaaagccgtaaaacttga

SEQ ID NO: 283956 - DNA, 20 bp, Artificial Sequence
  Description of Artificial Sequence: Synthetic oligonucleotide
  Target: ATXN1; (+) strand; PAM type: YTN; PAM sequence: CTT
gaaaactcttacatttacca

SEQ ID NO: 283957 - DNA, 20 bp, Artificial Sequence
  Description of Artificial Sequence: Synthetic oligonucleotide
  Target: ATXN1; (+) strand; PAM type: YTN; PAM sequence: TTG
aaaactcttacatttaccag

SEQ ID NO: 283958 - DNA, 20 bp, Artificial Sequence
  Description of Artificial Sequence: Synthetic oligonucleotide
  Target: ATXN1; (+) strand; PAM type: YTN; PAM sequence: CTC
ttacatttaccagtatgctg

SEQ ID NO: 283959 - DNA, 20 bp, Artificial Sequence
  Description of Artificial Sequence: Synthetic oligonucleotide
  Target: ATXN1; (+) strand; PAM type: YTN; PAM sequence: CTT
acatttaccagtatgctgct

SEQ ID NO: 283960 - DNA, 20 bp, Artificial Sequence
  Description of Artificial Sequence: Synthetic oligonucleotide
  Target: ATXN1; (+) strand; PAM type: YTN; PAM sequence: TTA
catttaccagtatgctgcta

SEQ ID NO: 283961 - DNA, 20 bp, Artificial Sequence
  Description of Artificial Sequence: Synthetic oligonucleotide
  Target: ATXN1; (+) strand; PAM type: YTN; PAM sequence: TTT
accagtatgctgctaagaaa

SEQ ID NO: 283962 - DNA, 20 bp, Artificial Sequence
  Description of Artificial Sequence: Synthetic oligonucleotide
  Target: ATXN1; (+) strand; PAM type: YTN; PAM sequence: TTA
ccagtatgctgctaagaaat

SEQ ID NO: 283963 - DNA, 20 bp, Artificial Sequence
  Description of Artificial Sequence: Synthetic oligonucleotide
  Target: ATXN1; (+) strand; PAM type: YTN; PAM sequence: CTG
ctaagaaattagcctaagga

SEQ ID NO: 283964 - DNA, 20 bp, Artificial Sequence
  Description of Artificial Sequence: Synthetic oligonucleotide
  Target: ATXN1; (+) strand; PAM type: YTN; PAM sequence: CTA
agaaattagcctaaggaaat

SEQ ID NO: 283965 - DNA, 20 bp, Artificial Sequence
  Description of Artificial Sequence: Synthetic oligonucleotide
  Target: ATXN1; (+) strand; PAM type: YTN; PAM sequence: TTA
gcctaaggaaataatttgta

SEQ ID NO: 283966 - DNA, 20 bp, Artificial Sequence
  Description of Artificial Sequence: Synthetic oligonucleotide
  Target: ATXN1; (+) strand; PAM type: YTN; PAM sequence: CTA
aggaaataatttgtaatggg

SEQ ID NO: 283967 - DNA, 20 bp, Artificial Sequence
  Description of Artificial Sequence: Synthetic oligonucleotide
  Target: ATXN1; (+) strand; PAM type: YTN; PAM sequence: TTT
gtaatgggaactaatacaga

SEQ ID NO: 283968 - DNA, 20 bp, Artificial Sequence
  Description of Artificial Sequence: Synthetic oligonucleotide
  Target: ATXN1; (+) strand; PAM type: YTN; PAM sequence: TTG
taatgggaactaatacagag

SEQ ID NO: 283969 - DNA, 20 bp, Artificial Sequence
  Description of Artificial Sequence: Synthetic oligonucleotide
  Target: ATXN1; (+) strand; PAM type: YTN; PAM sequence: CTA
atacagagctataagaatat

SEQ ID NO: 283970 - DNA, 20 bp, Artificial Sequence
  Description of Artificial Sequence: Synthetic oligonucleotide
  Target: ATXN1; (+) strand; PAM type: YTN; PAM sequence: CTA
taagaatatttttggcatca

SEQ ID NO: 283971 - DNA, 20 bp, Artificial Sequence
  Description of Artificial Sequence: Synthetic oligonucleotide
  Target: ATXN1; (+) strand; PAM type: YTN; PAM sequence: TTT
ttggcatcatgaaagcaata

SEQ ID NO: 283972 - DNA, 20 bp, Artificial Sequence
  Description of Artificial Sequence: Synthetic oligonucleotide
  Target: ATXN1; (+) strand; PAM type: YTN; PAM sequence: TTT
tggcatcatgaaagcaataa

SEQ ID NO: 283973 - DNA, 20 bp, Artificial Sequence
  Description of Artificial Sequence: Synthetic oligonucleotide
  Target: ATXN1; (+) strand; PAM type: YTN; PAM sequence: TTT
ggcatcatgaaagcaataaa

SEQ ID NO: 283974 - DNA, 20 bp, Artificial Sequence
  Description of Artificial Sequence: Synthetic oligonucleotide
  Target: ATXN1; (+) strand; PAM type: YTN; PAM sequence: TTG
gcatcatgaaagcaataaaa

SEQ ID NO: 283975 - DNA, 20 bp, Artificial Sequence
  Description of Artificial Sequence: Synthetic oligonucleotide
  Target: ATXN1; (+) strand; PAM type: YTN; PAM sequence: CTG
ggtgtggtggatcacgcctg

SEQ ID NO: 283976 - DNA, 20 bp, Artificial Sequence
  Description of Artificial Sequence: Synthetic oligonucleotide
  Target: ATXN1; (+) strand; PAM type: YTN; PAM sequence: CTG
taatcccaacactttgggag

SEQ ID NO: 283977 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgaggtgggaag

SEQ ID NO: 283978 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaggtgggaaga

SEQ ID NO: 283979 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggtgggaagac

SEQ ID NO: 283980 - DNA, 20 bp, Artificial Sequence
  Description of Artificial Sequence: Synthetic oligonucleotide
  Target: ATXN1; (+) strand; PAM type: YTN; PAM sequence: CTG
aggtgggaagactgcttgag

SEQ ID NO: 283981 - DNA, 20 bp, Artificial Sequence
  Description of Artificial Sequence: Synthetic oligonucleotide
  Target: ATXN1; (+) strand; PAM type: YTN; PAM sequence: CTG
cttgaggtcacgagtttgag

SEQ ID NO: 283982 - DNA, 20 bp, Artificial Sequence
  Description of Artificial Sequence: Synthetic oligonucleotide
  Target: ATXN1; (+) strand; PAM type: YTN; PAM sequence: CTT
gaggtcacgagtttgagacc

SEQ ID NO: 283983 - DNA, 20 bp, Artificial Sequence
  Description of Artificial Sequence: Synthetic oligonucleotide
  Target: ATXN1; (+) strand; PAM type: YTN; PAM sequence: TTG
aggtcacgagtttgagacca

SEQ ID NO: 283984 - DNA, 20 bp, Artificial Sequence
  Description of Artificial Sequence: Synthetic oligonucleotide
  Target: ATXN1; (+) strand; PAM type: YTN; PAM sequence: TTT
gagaccagcctgggcaacat

SEQ ID NO: 283985 - DNA, 20 bp, Artificial Sequence
  Description of Artificial Sequence: Synthetic oligonucleotide
  Target: ATXN1; (+) strand; PAM type: YTN; PAM sequence: TTG
agaccagcctgggcaacatg

SEQ ID NO: 283986 - DNA, 20 bp, Artificial Sequence
  Description of Artificial Sequence: Synthetic oligonucleotide
  Target: ATXN1; (+) strand; PAM type: YTN; PAM sequence: CTG
ggcaacatggcaaaacctca

SEQ ID NO: 283987 - DNA, 20 bp, Artificial Sequence
  Description of Artificial Sequence: Synthetic oligonucleotide
  Target: ATXN1; (+) strand; PAM type: YTN; PAM sequence: CTC
atcactatataaaaaaaaaa

SEQ ID NO: 283988 - DNA, 20 bp, Artificial Sequence
  Description of Artificial Sequence: Synthetic oligonucleotide
  Target: ATXN1; (+) strand; PAM type: YTN; PAM sequence: CTA
tataaaaaaaaaaaatacaa

SEQ ID NO: 283989 - DNA, 20 bp, Artificial Sequence
  Description of Artificial Sequence: Synthetic oligonucleotide
  Target: ATXN1; (+) strand; PAM type: YTN; PAM sequence: TTA
gccaggcatggtgatgtgca

SEQ ID NO: 283990 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctattaatact

SEQ ID NO: 283991 - DNA, 20 bp, Artificial Sequence
  Description of Artificial Sequence: Synthetic oligonucleotide
  Target: ATXN1; (+) strand; PAM type: YTN; PAM sequence: CTA
ttaatacttgggaggctgag

SEQ ID NO: 283992 - DNA, 20 bp, Artificial Sequence
  Description of Artificial Sequence: Synthetic oligonucleotide
  Target: ATXN1; (+) strand; PAM type: YTN; PAM sequence: TTA
atacttgggaggctgaggtg

SEQ ID NO: 283993 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggtgggagga

SEQ ID NO: 283994 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggtgggaggat

SEQ ID NO: 283995 - DNA, 20 bp, Artificial Sequence
  Description of Artificial Sequence: Synthetic oligonucleotide
  Target: ATXN1; (+) strand; PAM type: YTN; PAM sequence: CTG
aggtgggaggatcacttgag

SEQ ID NO: 283996 - DNA, 20 bp, Artificial Sequence
  Description of Artificial Sequence: Synthetic oligonucleotide
  Target: ATXN1; (+) strand; PAM type: YTN; PAM sequence: CTT
gagccttggaggtggaagct

SEQ ID NO: 283997 - DNA, 20 bp, Artificial Sequence
  Description of Artificial Sequence: Synthetic oligonucleotide
  Target: ATXN1; (+) strand; PAM type: YTN; PAM sequence: TTG
agccttggaggtggaagctg

SEQ ID NO: 283998 - DNA, 20 bp, Artificial Sequence
  Description of Artificial Sequence: Synthetic oligonucleotide
  Target: ATXN1; (+) strand; PAM type: YTN; PAM sequence: CTT
ggaggtggaagctgcaatga

SEQ ID NO: 283999 - DNA, 20 bp, Artificial Sequence
  Description of Artificial Sequence: Synthetic oligonucleotide
  Target: ATXN1; (+) strand; PAM type: YTN; PAM sequence: TTG
gaggtggaagctgcaatgag

SEQ ID NO: 284000 - DNA, 20 bp, Artificial Sequence
  Description of Artificial Sequence: Synthetic oligonucleotide
  Target: ATXN1; (+) strand; PAM type: YTN; PAM sequence: CTG
caatgagccaaaatcatgcc

SEQ ID NO: 284001 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggtgacag

SEQ ID NO: 284002 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgacagagtga

SEQ ID NO: 284003 - DNA, 20 bp, Artificial Sequence
  Description of Artificial Sequence: Synthetic oligonucleotide
  Target: ATXN1; (+) strand; PAM type: YTN; PAM sequence: CTG
ggtgacagagtgagacccta

SEQ ID NO: 284004 - DNA, 20 bp, Artificial Sequence
  Description of Artificial Sequence: Synthetic oligonucleotide
  Target: ATXN1; (+) strand; PAM type: YTN; PAM sequence: CTA
tctcaagaaaataaaaaggc

SEQ ID NO: 284005 - DNA, 20 bp, Artificial Sequence
  Description of Artificial Sequence: Synthetic oligonucleotide
  Target: ATXN1; (+) strand; PAM type: YTN; PAM sequence: CTC
aagaaaataaaaaggcaaaa

SEQ ID NO: 284006 - DNA, 20 bp, Artificial Sequence
  Description of Artificial Sequence: Synthetic oligonucleotide
  Target: ATXN1; (+) strand; PAM type: YTN; PAM sequence: TTA
gaaacggctaactgtccagt

SEQ ID NO: 284007 - DNA, 20 bp, Artificial Sequence
  Description of Artificial Sequence: Synthetic oligonucleotide
  Target: ATXN1; (+) strand; PAM type: YTN; PAM sequence: CTA
actgtccagttagaagggat

SEQ ID NO: 284008 - DNA, 20 bp, Artificial Sequence
  Description of Artificial Sequence: Synthetic oligonucleotide
  Target: ATXN1; (+) strand; PAM type: YTN; PAM sequence: CTG
tccagttagaagggatataa

SEQ ID NO: 284009 - DNA, 20 bp, Artificial Sequence
  Description of Artificial Sequence: Synthetic oligonucleotide
  Target: ATXN1; (+) strand; PAM type: YTN; PAM sequence: TTA
gaagggatataaattaaata

SEQ ID NO: 284010 - DNA, 20 bp, Artificial Sequence
  Description of Artificial Sequence: Synthetic oligonucleotide
  Target: ATXN1; (+) strand; PAM type: YTN; PAM sequence: TTA
aataaattttagaatgttta

SEQ ID NO: 284011 - DNA, 20 bp, Artificial Sequence
  Description of Artificial Sequence: Synthetic oligonucleotide
  Target: ATXN1; (+) strand; PAM type: YTN; PAM sequence: TTT
tagaatgtttactcaatggt

SEQ ID NO: 284012 - DNA, 20 bp, Artificial Sequence
  Description of Artificial Sequence: Synthetic oligonucleotide
  Target: ATXN1; (+) strand; PAM type: YTN; PAM sequence: TTT
agaatgtttactcaatggta

SEQ ID NO: 284013 - DNA, 20 bp, Artificial Sequence
  Description of Artificial Sequence: Synthetic oligonucleotide
  Target: ATXN1; (+) strand; PAM type: YTN; PAM sequence: TTA
gaatgtttactcaatggtat

SEQ ID NO: 284014 - DNA, 20 bp, Artificial Sequence
  Description of Artificial Sequence: Synthetic oligonucleotide
  Target: ATXN1; (+) strand; PAM type: YTN; PAM sequence: TTT
actcaatggtatactaatca

SEQ ID NO: 284015 - DNA, 20 bp, Artificial Sequence
  Description of Artificial Sequence: Synthetic oligonucleotide
  Target: ATXN1; (+) strand; PAM type: YTN; PAM sequence: TTA
ctcaatggtatactaatcat

SEQ ID NO: 284016 - DNA, 20 bp, Artificial Sequence
  Description of Artificial Sequence: Synthetic oligonucleotide
  Target: ATXN1; (+) strand; PAM type: YTN; PAM sequence: CTC
aatggtatactaatcattaa

SEQ ID NO: 284017 - DNA, 20 bp, Artificial Sequence
  Description of Artificial Sequence: Synthetic oligonucleotide
  Target: ATXN1; (+) strand; PAM type: YTN; PAM sequence: CTA
atcattaataactatacggt

SEQ ID NO: 284018 - DNA, 20 bp, Artificial Sequence
  Description of Artificial Sequence: Synthetic oligonucleotide
  Target: ATXN1; (+) strand; PAM type: YTN; PAM sequence: TTA
ataactatacggtagaaaaa

SEQ ID NO: 284019 - DNA, 20 bp, Artificial Sequence
  Description of Artificial Sequence: Synthetic oligonucleotide
  Target: ATXN1; (+) strand; PAM type: YTN; PAM sequence: CTA
tacggtagaaaaatatctgt

SEQ ID NO: 284020 - DNA, 20 bp, Artificial Sequence
  Description of Artificial Sequence: Synthetic oligonucleotide
  Target: ATXN1; (+) strand; PAM type: YTN; PAM sequence: CTG
ttgctatgaaagatgttcag

SEQ ID NO: 284021 - DNA, 20 bp, Artificial Sequence
  Description of Artificial Sequence: Synthetic oligonucleotide
  Target: ATXN1; (+) strand; PAM type: YTN; PAM sequence: TTG
ctatgaaagatgttcagaat

SEQ ID NO: 284022 - DNA, 20 bp, Artificial Sequence
  Description of Artificial Sequence: Synthetic oligonucleotide
  Target: ATXN1; (+) strand; PAM type: YTN; PAM sequence: CTA
tgaaagatgttcagaattat

SEQ ID NO: 284023 - DNA, 20 bp, Artificial Sequence
  Description of Artificial Sequence: Synthetic oligonucleotide
  Target: ATXN1; (+) strand; PAM type: YTN; PAM sequence: TTC
agaattatattgttaagagg

SEQ ID NO: 284024 - DNA, 20 bp, Artificial Sequence
  Description of Artificial Sequence: Synthetic oligonucleotide
  Target: ATXN1; (+) strand; PAM type: YTN; PAM sequence: TTA
tattgttaagaggaacaata

SEQ ID NO: 284025 - DNA, 20 bp, Artificial Sequence
  Description of Artificial Sequence: Synthetic oligonucleotide
  Target: ATXN1; (+) strand; PAM type: YTN; PAM sequence: TTG
ttaagaggaacaatactctt

SEQ ID NO: 284026 - DNA, 20 bp, Artificial Sequence
  Description of Artificial Sequence: Synthetic oligonucleotide
  Target: ATXN1; (+) strand; PAM type: YTN; PAM sequence: TTA
agaggaacaatactcttaat

SEQ ID NO: 284027 - DNA, 20 bp, Artificial Sequence
  Description of Artificial Sequence: Synthetic oligonucleotide
  Target: ATXN1; (+) strand; PAM type: YTN; PAM sequence: CTC
ttaataatctctactacttc

SEQ ID NO: 284028 - DNA, 20 bp, Artificial Sequence
  Description of Artificial Sequence: Synthetic oligonucleotide
  Target: ATXN1; (+) strand; PAM type: YTN; PAM sequence: CTT
aataatctctactacttcta

SEQ ID NO: 284029 - DNA, 20 bp, Artificial Sequence
  Description of Artificial Sequence: Synthetic oligonucleotide
  Target: ATXN1; (+) strand; PAM type: YTN; PAM sequence: TTA
ataatctctactacttctac

SEQ ID NO: 284030 - DNA, 20 bp, Artificial Sequence
  Description of Artificial Sequence: Synthetic oligonucleotide
  Target: ATXN1; (+) strand; PAM type: YTN; PAM sequence: CTC
tactacttctacaatctcta

SEQ ID NO: 284031 - DNA, 20 bp, Artificial Sequence
  Description of Artificial Sequence: Synthetic oligonucleotide
  Target: ATXN1; (+) strand; PAM type: YTN; PAM sequence: CTA
ctacttctacaatctctact

SEQ ID NO: 284032 - DNA, 20 bp, Artificial Sequence
  Description of Artificial Sequence: Synthetic oligonucleotide
  Target: ATXN1; (+) strand; PAM type: YTN; PAM sequence: CTA
cttctacaatctctactacc

SEQ ID NO: 284033 - DNA, 20 bp, Artificial Sequence
  Description of Artificial Sequence: Synthetic oligonucleotide
  Target: ATXN1; (+) strand; PAM type: YTN; PAM sequence: CTT
ctacaatctctactaccatt

SEQ ID NO: 284034 - DNA, 20 bp, Artificial Sequence
  Description of Artificial Sequence: Synthetic oligonucleotide
  Target: ATXN1; (+) strand; PAM type: YTN; PAM sequence: TTC
tacaatctctactaccattt

SEQ ID NO: 284035 - DNA, 20 bp, Artificial Sequence
  Description of Artificial Sequence: Synthetic oligonucleotide
  Target: ATXN1; (+) strand; PAM type: YTN; PAM sequence: CTA
caatctctactaccatttga

SEQ ID NO: 284036 - DNA, 20 bp, Artificial Sequence
  Description of Artificial Sequence: Synthetic oligonucleotide
  Target: ATXN1; (+) strand; PAM type: YTN; PAM sequence: CTC
tactaccatttgatgtttgt

SEQ ID NO: 284037 - DNA, 20 bp, Artificial Sequence
  Description of Artificial Sequence: Synthetic oligonucleotide
  Target: ATXN1; (+) strand; PAM type: YTN; PAM sequence: CTA
ctaccatttgatgtttgtct

SEQ ID NO: 284038 - DNA, 20 bp, Artificial Sequence
  Description of Artificial Sequence: Synthetic oligonucleotide
  Target: ATXN1; (+) strand; PAM type: YTN; PAM sequence: CTA
ccatttgatgtttgtctctc

SEQ ID NO: 284039 - DNA, 20 bp, Artificial Sequence
  Description of Artificial Sequence: Synthetic oligonucleotide
  Target: ATXN1; (+) strand; PAM type: YTN; PAM sequence: TTT
gatgtttgtctctctaagtg

SEQ ID NO: 284040 - DNA, 20 bp, Artificial Sequence
  Description of Artificial Sequence: Synthetic oligonucleotide
  Target: ATXN1; (+) strand; PAM type: YTN; PAM sequence: TTG
atgtttgtctctctaagtga

SEQ ID NO: 284041 - DNA, 20 bp, Artificial Sequence
  Description of Artificial Sequence: Synthetic oligonucleotide
  Target: ATXN1; (+) strand; PAM type: YTN; PAM sequence: TTT
gtctctctaagtgaatttat

SEQ ID NO: 284042 - DNA, 20 bp, Artificial Sequence
  Description of Artificial Sequence: Synthetic oligonucleotide
  Target: ATXN1; (+) strand; PAM type: YTN; PAM sequence: TTG
tctctctaagtgaatttata

SEQ ID NO: 284043 - DNA, 20 bp, Artificial Sequence
  Description of Artificial Sequence: Synthetic oligonucleotide
  Target: ATXN1; (+) strand; PAM type: YTN; PAM sequence: CTC
tctaagtgaatttataaatc

SEQ ID NO: 284044 - DNA, 20 bp, Artificial Sequence
  Description of Artificial Sequence: Synthetic oligonucleotide
  Target: ATXN1; (+) strand; PAM type: YTN; PAM sequence: CTC
taagtgaatttataaatcta

SEQ ID NO: 284045 - DNA, 20 bp, Artificial Sequence
  Description of Artificial Sequence: Synthetic oligonucleotide
  Target: ATXN1; (+) strand; PAM type: YTN; PAM sequence: CTA
agtgaatttataaatctata

SEQ ID NO: 284046 - DNA, 20 bp, Artificial Sequence
  Description of Artificial Sequence: Synthetic oligonucleotide
  Target: ATXN1; (+) strand; PAM type: YTN; PAM sequence: TTT
ataaatctataaatttataa

SEQ ID NO: 284047 - DNA, 20 bp, Artificial Sequence
  Description of Artificial Sequence: Synthetic oligonucleotide
  Target: ATXN1; (+) strand; PAM type: YTN; PAM sequence: TTA
taaatctataaatttataaa

SEQ ID NO: 284048 - DNA, 20 bp, Artificial Sequence
  Description of Artificial Sequence: Synthetic oligonucleotide
  Target: ATXN1; (+) strand; PAM type: YTN; PAM sequence: CTA
taaatttataaatgccttca

SEQ ID NO: 284049 - DNA, 20 bp, Artificial Sequence
  Description of Artificial Sequence: Synthetic oligonucleotide
  Target: ATXN1; (+) strand; PAM type: YTN; PAM sequence: TTT
ataaatgccttcagaattat

SEQ ID NO: 284050 - DNA, 20 bp, Artificial Sequence
  Description of Artificial Sequence: Synthetic oligonucleotide
  Target: ATXN1; (+) strand; PAM type: YTN; PAM sequence: TTA
taaatgccttcagaattatc

SEQ ID NO: 284051 - DNA, 20 bp, Artificial Sequence
  Description of Artificial Sequence: Synthetic oligonucleotide
  Target: ATXN1; (+) strand; PAM type: YTN; PAM sequence: CTT
cagaattatcagcaatgcct

SEQ ID NO: 284052 - DNA, 20 bp, Artificial Sequence
  Description of Artificial Sequence: Synthetic oligonucleotide
  Target: ATXN1; (+) strand; PAM type: YTN; PAM sequence: TTC
agaattatcagcaatgcctt

SEQ ID NO: 284053 - DNA, 20 bp, Artificial Sequence
  Description of Artificial Sequence: Synthetic oligonucleotide
  Target: ATXN1; (+) strand; PAM type: YTN; PAM sequence: TTA
tcagcaatgccttgtcatct

SEQ ID NO: 284054 - DNA, 20 bp, Artificial Sequence
  Description of Artificial Sequence: Synthetic oligonucleotide
  Target: ATXN1; (+) strand; PAM type: YTN; PAM sequence: CTT
gtcatctatcctaactagtg

SEQ ID NO: 284055 - DNA, 20 bp, Artificial Sequence
  Description of Artificial Sequence: Synthetic oligonucleotide
  Target: ATXN1; (+) strand; PAM type: YTN; PAM sequence: TTG
tcatctatcctaactagtga

SEQ ID NO: 284056 - DNA, 20 bp, Artificial Sequence
  Description of Artificial Sequence: Synthetic oligonucleotide
  Target: ATXN1; (+) strand; PAM type: YTN; PAM sequence: CTA
tcctaactagtgacctcaaa

SEQ ID NO: 284057 - DNA, 20 bp, Artificial Sequence
  Description of Artificial Sequence: Synthetic oligonucleotide
  Target: ATXN1; (+) strand; PAM type: YTN; PAM sequence: CTA
actagtgacctcaaaataag

SEQ ID NO: 284058 - DNA, 20 bp, Artificial Sequence
  Description of Artificial Sequence: Synthetic oligonucleotide
  Target: ATXN1; (+) strand; PAM type: YTN; PAM sequence: CTA
gtgacctcaaaataagtaga

SEQ ID NO: 284059 - DNA, 20 bp, Artificial Sequence
  Description of Artificial Sequence: Synthetic oligonucleotide
  Target: ATXN1; (+) strand; PAM type: YTN; PAM sequence: CTC
aaaataagtagaagttattt

SEQ ID NO: 284060 - DNA, 20 bp, Artificial Sequence
  Description of Artificial Sequence: Synthetic oligonucleotide
  Target: ATXN1; (+) strand; PAM type: YTN; PAM sequence: TTA
tttcctttcccataaaaaag

SEQ ID NO: 284061 - DNA, 20 bp, Artificial Sequence
  Description of Artificial Sequence: Synthetic oligonucleotide
  Target: ATXN1; (+) strand; PAM type: YTN; PAM sequence: TTT
cctttcccataaaaaagcaa

SEQ ID NO: 284062 - DNA, 20 bp, Artificial Sequence
  Description of Artificial Sequence: Synthetic oligonucleotide
  Target: ATXN1; (+) strand; PAM type: YTN; PAM sequence: TTC
ctttcccataaaaaagcaag

SEQ ID NO: 284063 - DNA, 20 bp, Artificial Sequence
  Description of Artificial Sequence: Synthetic oligonucleotide
  Target: ATXN1; (+) strand; PAM type: YTN; PAM sequence: CTT
tcccataaaaaagcaagggt

SEQ ID NO: 284064 - DNA, 20 bp, Artificial Sequence
  Description of Artificial Sequence: Synthetic oligonucleotide
  Target: ATXN1; (+) strand; PAM type: YTN; PAM sequence: TTT
cccataaaaaagcaagggtt

SEQ ID NO: 284065 - DNA, 20 bp, Artificial Sequence
  Description of Artificial Sequence: Synthetic oligonucleotide
  Target: ATXN1; (+) strand; PAM type: YTN; PAM sequence: TTC
ccataaaaaagcaagggttc

SEQ ID NO: 284066 - DNA, 20 bp, Artificial Sequence
  Description of Artificial Sequence: Synthetic oligonucleotide
  Target: ATXN1; (+) strand; PAM type: YTN; PAM sequence: TTC
catttttataaaagagacag

SEQ ID NO: 284067 - DNA, 20 bp, Artificial Sequence
  Description of Artificial Sequence: Synthetic oligonucleotide
  Target: ATXN1; (+) strand; PAM type: YTN; PAM sequence: TTT
ttataaaagagacagtagga

SEQ ID NO: 284068 - DNA, 20 bp, Artificial Sequence
  Description of Artificial Sequence: Synthetic oligonucleotide
  Target: ATXN1; (+) strand; PAM type: YTN; PAM sequence: TTT
tataaaagagacagtaggaa

SEQ ID NO: 284069 - DNA, 20 bp, Artificial Sequence
  Description of Artificial Sequence: Synthetic oligonucleotide
  Target: ATXN1; (+) strand; PAM type: YTN; PAM sequence: TTT
ataaaagagacagtaggaaa

SEQ ID NO: 284070 - DNA, 20 bp, Artificial Sequence
  Description of Artificial Sequence: Synthetic oligonucleotide
  Target: ATXN1; (+) strand; PAM type: YTN; PAM sequence: TTA
taaaagagacagtaggaaaa

SEQ ID NO: 284071 - DNA, 20 bp, Artificial Sequence
  Description of Artificial Sequence: Synthetic oligonucleotide
  Target: ATXN1; (+) strand; PAM type: YTN; PAM sequence: CTA
catgaatagacatgtgtatg

SEQ ID NO: 284072 - DNA, 20 bp, Artificial Sequence
  Description of Artificial Sequence: Synthetic oligonucleotide
  Target: ATXN1; (+) strand; PAM type: YTN; PAM sequence: TTG
tgtgtgtatgtttgtgtgac

SEQ ID NO: 284073 - DNA, 20 bp, Artificial Sequence
  Description of Artificial Sequence: Synthetic oligonucleotide
  Target: ATXN1; (+) strand; PAM type: YTN; PAM sequence: TTT
gtgtgaccagatatgtatac

SEQ ID NO: 284074 - DNA, 20 bp, Artificial Sequence
  Description of Artificial Sequence: Synthetic oligonucleotide
  Target: ATXN1; (+) strand; PAM type: YTN; PAM sequence: TTG
tgtgaccagatatgtataca

SEQ ID NO: 284075 - DNA, 20 bp, Artificial Sequence
  Description of Artificial Sequence: Synthetic oligonucleotide
  Target: ATXN1; (+) strand; PAM type: YTN; PAM sequence: CTA
tcttggggactttacaactc

SEQ ID NO: 284076 - DNA, 20 bp, Artificial Sequence
  Description of Artificial Sequence: Synthetic oligonucleotide
  Target: ATXN1; (+) strand; PAM type: YTN; PAM sequence: CTT
ggggactttacaactcaatg

SEQ ID NO: 284077 - DNA, 20 bp, Artificial Sequence
  Description of Artificial Sequence: Synthetic oligonucleotide
  Target: ATXN1; (+) strand; PAM type: YTN; PAM sequence: TTG
gggactttacaactcaatga

SEQ ID NO: 284078 - DNA, 20 bp, Artificial Sequence
  Description of Artificial Sequence: Synthetic oligonucleotide
  Target: ATXN1; (+) strand; PAM type: YTN; PAM sequence: CTT
tacaactcaatgataattat

SEQ ID NO: 284079 - DNA, 20 bp, Artificial Sequence
  Description of Artificial Sequence: Synthetic oligonucleotide
  Target: ATXN1; (+) strand; PAM type: YTN; PAM sequence: TTT
acaactcaatgataattatt

SEQ ID NO: 284080 - DNA, 20 bp, Artificial Sequence
  Description of Artificial Sequence: Synthetic oligonucleotide
  Target: ATXN1; (+) strand; PAM type: YTN; PAM sequence: TTA
caactcaatgataattattt

SEQ ID NO: 284081 - DNA, 20 bp, Artificial Sequence
  Description of Artificial Sequence: Synthetic oligonucleotide
  Target: ATXN1; (+) strand; PAM type: YTN; PAM sequence: CTC
aatgataattattttccttt

SEQ ID NO: 284082 - DNA, 20 bp, Artificial Sequence
  Description of Artificial Sequence: Synthetic oligonucleotide
  Target: ATXN1; (+) strand; PAM type: YTN; PAM sequence: TTA
ttttcctttaaagcttttgg

SEQ ID NO: 284083 - DNA, 20 bp, Artificial Sequence
  Description of Artificial Sequence: Synthetic oligonucleotide
  Target: ATXN1; (+) strand; PAM type: YTN; PAM sequence: TTT
tcctttaaagcttttggaga

SEQ ID NO: 284084 - DNA, 20 bp, Artificial Sequence
  Description of Artificial Sequence: Synthetic oligonucleotide
  Target: ATXN1; (+) strand; PAM type: YTN; PAM sequence: TTT
cctttaaagcttttggagat

SEQ ID NO: 284085 - DNA, 20 bp, Artificial Sequence
  Description of Artificial Sequence: Synthetic oligonucleotide
  Target: ATXN1; (+) strand; PAM type: YTN; PAM sequence: TTC
ctttaaagcttttggagatg

SEQ ID NO: 284086 - DNA, 20 bp, Artificial Sequence
  Description of Artificial Sequence: Synthetic oligonucleotide
  Target: ATXN1; (+) strand; PAM type: YTN; PAM sequence: CTT
taaagcttttggagatgttt

SEQ ID NO: 284087 - DNA, 20 bp, Artificial Sequence
  Description of Artificial Sequence: Synthetic oligonucleotide
  Target: ATXN1; (+) strand; PAM type: YTN; PAM sequence: TTT
aaagcttttggagatgttta

SEQ ID NO: 284088 - DNA, 20 bp, Artificial Sequence
  Description of Artificial Sequence: Synthetic oligonucleotide
  Target: ATXN1; (+) strand; PAM type: YTN; PAM sequence: TTA
aagcttttggagatgtttac

SEQ ID NO: 284089 - DNA, 20 bp, Artificial Sequence
  Description of Artificial Sequence: Synthetic oligonucleotide
  Target: ATXN1; (+) strand; PAM type: YTN; PAM sequence: CTT
ttggagatgtttacctgtac

SEQ ID NO: 284090 - DNA, 20 bp, Artificial Sequence
  Description of Artificial Sequence: Synthetic oligonucleotide
  Target: ATXN1; (+) strand; PAM type: YTN; PAM sequence: TTT
tggagatgtttacctgtacc

SEQ ID NO: 284091 - DNA, 20 bp, Artificial Sequence
  Description of Artificial Sequence: Synthetic oligonucleotide
  Target: ATXN1; (+) strand; PAM type: YTN; PAM sequence: TTT
ggagatgtttacctgtacca

SEQ ID NO: 284092 - DNA, 20 bp, Artificial Sequence
  Description of Artificial Sequence: Synthetic oligonucleotide
  Target: ATXN1; (+) strand; PAM type: YTN; PAM sequence: TTG
gagatgtttacctgtaccat

SEQ ID NO: 284093 - DNA, 20 bp, Artificial Sequence
  Description of Artificial Sequence: Synthetic oligonucleotide
  Target: ATXN1; (+) strand; PAM type: YTN; PAM sequence: TTT
acctgtaccatgtgctttca

SEQ ID NO: 284094 - DNA, 20 bp, Artificial Sequence
  Description of Artificial Sequence: Synthetic oligonucleotide
  Target: ATXN1; (+) strand; PAM type: YTN; PAM sequence: TTA
cctgtaccatgtgctttcat

SEQ ID NO: 284095 - DNA, 20 bp, Artificial Sequence
  Description of Artificial Sequence: Synthetic oligonucleotide
  Target: ATXN1; (+) strand; PAM type: YTN; PAM sequence: CTG
taccatgtgctttcatcaca

SEQ ID NO: 284096 - DNA, 20 bp, Artificial Sequence
  Description of Artificial Sequence: Synthetic oligonucleotide
  Target: ATXN1; (+) strand; PAM type: YTN; PAM sequence: CTT
tcatcacaatggagaaccat

SEQ ID NO: 284097 - DNA, 20 bp, Artificial Sequence
  Description of Artificial Sequence: Synthetic oligonucleotide
  Target: ATXN1; (+) strand; PAM type: YTN; PAM sequence: TTT
catcacaatggagaaccata

SEQ ID NO: 284098 - DNA, 20 bp, Artificial Sequence
  Description of Artificial Sequence: Synthetic oligonucleotide
  Target: ATXN1; (+) strand; PAM type: YTN; PAM sequence: TTC
atcacaatggagaaccataa

SEQ ID NO: 284099 - DNA, 20 bp, Artificial Sequence
  Description of Artificial Sequence: Synthetic oligonucleotide
  Target: ATXN1; (+) strand; PAM type: YTN; PAM sequence: CTA
tcagttccttgcagcagatc

SEQ ID NO: 284100 - DNA, 20 bp, Artificial Sequence
  Description of Artificial Sequence: Synthetic oligonucleotide
  Target: ATXN1; (+) strand; PAM type: YTN; PAM sequence: TTC
cttgcagcagatcttttcac

SEQ ID NO: 284101 - DNA, 20 bp, Artificial Sequence
  Description of Artificial Sequence: Synthetic oligonucleotide
  Target: ATXN1; (+) strand; PAM type: YTN; PAM sequence: CTT
gcagcagatcttttcacgaa

SEQ ID NO: 284102 - DNA, 20 bp, Artificial Sequence
  Description of Artificial Sequence: Synthetic oligonucleotide
  Target: ATXN1; (+) strand; PAM type: YTN; PAM sequence: TTG
cagcagatcttttcacgaag

SEQ ID NO: 284103 - DNA, 20 bp, Artificial Sequence
  Description of Artificial Sequence: Synthetic oligonucleotide
  Target: ATXN1; (+) strand; PAM type: YTN; PAM sequence: CTT
ttcacgaagattttgcttga

SEQ ID NO: 284104 - DNA, 20 bp, Artificial Sequence
  Description of Artificial Sequence: Synthetic oligonucleotide
  Target: ATXN1; (+) strand; PAM type: YTN; PAM sequence: TTT
tcacgaagattttgcttgag

SEQ ID NO: 284105 - DNA, 20 bp, Artificial Sequence
  Description of Artificial Sequence: Synthetic oligonucleotide
  Target: ATXN1; (+) strand; PAM type: YTN; PAM sequence: TTT
cacgaagattttgcttgagt

SEQ ID NO: 284106 - DNA, 20 bp, Artificial Sequence
  Description of Artificial Sequence: Synthetic oligonucleotide
  Target: ATXN1; (+) strand; PAM type: YTN; PAM sequence: TTC
acgaagattttgcttgagta

SEQ ID NO: 284107 - DNA, 20 bp, Artificial Sequence
  Description of Artificial Sequence: Synthetic oligonucleotide
  Target: ATXN1; (+) strand; PAM type: YTN; PAM sequence: TTT
tgcttgagtagaaagggtgg

SEQ ID NO: 284108 - DNA, 20 bp, Artificial Sequence
  Description of Artificial Sequence: Synthetic oligonucleotide
  Target: ATXN1; (+) strand; PAM type: YTN; PAM sequence: TTT
gcttgagtagaaagggtggc

SEQ ID NO: 284109 - DNA, 20 bp, Artificial Sequence
  Description of Artificial Sequence: Synthetic oligonucleotide
  Target: ATXN1; (+) strand; PAM type: YTN; PAM sequence: TTG
cttgagtagaaagggtggca

SEQ ID NO: 284110 - DNA, 20 bp, Artificial Sequence
  Description of Artificial Sequence: Synthetic oligonucleotide
  Target: ATXN1; (+) strand; PAM type: YTN; PAM sequence: CTT
gagtagaaagggtggcagtg

SEQ ID NO: 284111 - DNA, 20 bp, Artificial Sequence
  Description of Artificial Sequence: Synthetic oligonucleotide
  Target: ATXN1; (+) strand; PAM type: YTN; PAM sequence: TTG
agtagaaagggtggcagtgg

SEQ ID NO: 284112 - DNA, 20 bp, Artificial Sequence
  Description of Artificial Sequence: Synthetic oligonucleotide
  Target: ATXN1; (+) strand; PAM type: YTN; PAM sequence: CTC
agtgtaaaacgcctagacct

SEQ ID NO: 284113 - DNA, 20 bp, Artificial Sequence
  Description of Artificial Sequence: Synthetic oligonucleotide
  Target: ATXN1; (+) strand; PAM type: YTN; PAM sequence: CTA
gacctgtaattataaaaaca

SEQ ID NO: 284114 - DNA, 20 bp, Artificial Sequence
  Description of Artificial Sequence: Synthetic oligonucleotide
  Target: ATXN1; (+) strand; PAM type: YTN; PAM sequence: CTG
taattataaaaacaatattc

SEQ ID NO: 284115 - DNA, 20 bp, Artificial Sequence
  Description of Artificial Sequence: Synthetic oligonucleotide
  Target: ATXN1; (+) strand; PAM type: YTN; PAM sequence: TTA
taaaaacaatattctcactg

SEQ ID NO: 284116 - DNA, 20 bp, Artificial Sequence
  Description of Artificial Sequence: Synthetic oligonucleotide
  Target: ATXN1; (+) strand; PAM type: YTN; PAM sequence: TTC
tcactgagttaggctgcttc

SEQ ID NO: 284117 - DNA, 20 bp, Artificial Sequence
  Description of Artificial Sequence: Synthetic oligonucleotide
  Target: ATXN1; (+) strand; PAM type: YTN; PAM sequence: CTC
actgagttaggctgcttctg

SEQ ID NO: 284118 - DNA, 20 bp, Artificial Sequence
  Description of Artificial Sequence: Synthetic oligonucleotide
  Target: ATXN1; (+) strand; PAM type: YTN; PAM sequence: CTG
agttaggctgcttctgtggt

SEQ ID NO: 284119 - DNA, 20 bp, Artificial Sequence
  Description of Artificial Sequence: Synthetic oligonucleotide
  Target: ATXN1; (+) strand; PAM type: YTN; PAM sequence: TTA
ggctgcttctgtggtcttca

SEQ ID NO: 284120 - DNA, 20 bp, Artificial Sequence
  Description of Artificial Sequence: Synthetic oligonucleotide
  Target: ATXN1; (+) strand; PAM type: YTN; PAM sequence: CTG
cttctgtggtcttcattcac

SEQ ID NO: 284121 - DNA, 20 bp, Artificial Sequence
  Description of Artificial Sequence: Synthetic oligonucleotide
  Target: ATXN1; (+) strand; PAM type: YTN; PAM sequence: CTT
ctgtggtcttcattcacatt

SEQ ID NO: 284122 - DNA, 20 bp, Artificial Sequence
  Description of Artificial Sequence: Synthetic oligonucleotide
  Target: ATXN1; (+) strand; PAM type: YTN; PAM sequence: TTC
tgtggtcttcattcacattc

SEQ ID NO: 284123 - DNA, 20 bp, Artificial Sequence
  Description of Artificial Sequence: Synthetic oligonucleotide
  Target: ATXN1; (+) strand; PAM type: YTN; PAM sequence: CTG
tggtcttcattcacattcgc

SEQ ID NO: 284124 - DNA, 20 bp, Artificial Sequence
  Description of Artificial Sequence: Synthetic oligonucleotide
  Target: ATXN1; (+) strand; PAM type: YTN; PAM sequence: CTT
cattcacattcgctgaagtc

SEQ ID NO: 284125 - DNA, 20 bp, Artificial Sequence
  Description of Artificial Sequence: Synthetic oligonucleotide
  Target: ATXN1; (+) strand; PAM type: YTN; PAM sequence: TTC
attcacattcgctgaagtca

SEQ ID NO: 284126 - DNA, 20 bp, Artificial Sequence
  Description of Artificial Sequence: Synthetic oligonucleotide
  Target: ATXN1; (+) strand; PAM type: YTN; PAM sequence: TTC
acattcgctgaagtcacaga

SEQ ID NO: 284127 - DNA, 20 bp, Artificial Sequence
  Description of Artificial Sequence: Synthetic oligonucleotide
  Target: ATXN1; (+) strand; PAM type: YTN; PAM sequence: TTC
gctgaagtcacagaaacggg

SEQ ID NO: 284128 - DNA, 20 bp, Artificial Sequence
  Description of Artificial Sequence: Synthetic oligonucleotide
  Target: ATXN1; (+) strand; PAM type: YTN; PAM sequence: CTG
aagtcacagaaacgggaaac

SEQ ID NO: 284129 - DNA, 20 bp, Artificial Sequence
  Description of Artificial Sequence: Synthetic oligonucleotide
  Target: ATXN1; (+) strand; PAM type: YTN; PAM sequence: TTG
cataatctctcacacacaca

SEQ ID NO: 284130 - DNA, 20 bp, Artificial Sequence
  Description of Artificial Sequence: Synthetic oligonucleotide
  Target: ATXN1; (+) strand; PAM type: YTN; PAM sequence: CTC
tcacacacacatgcacacac

SEQ ID NO: 284131 - DNA, 20 bp, Artificial Sequence
  Description of Artificial Sequence: Synthetic oligonucleotide
  Target: ATXN1; (+) strand; PAM type: YTN; PAM sequence: CTC
acacacacatgcacacacgc

SEQ ID NO: 284132 - DNA, 20 bp, Artificial Sequence
  Description of Artificial Sequence: Synthetic oligonucleotide
  Target: ATXN1; (+) strand; PAM type: YTN; PAM sequence: TTT
ttaaatcagaatgtcaaaaa

SEQ ID NO: 284133 - DNA, 20 bp, Artificial Sequence
  Description of Artificial Sequence: Synthetic oligonucleotide
  Target: ATXN1; (+) strand; PAM type: YTN; PAM sequence: TTT
taaatcagaatgtcaaaaac

SEQ ID NO: 284134 - DNA, 20 bp, Artificial Sequence
  Description of Artificial Sequence: Synthetic oligonucleotide
  Target: ATXN1; (+) strand; PAM type: YTN; PAM sequence: TTT
aaatcagaatgtcaaaaact

SEQ ID NO: 284135 - DNA, 20 bp, Artificial Sequence
  Description of Artificial Sequence: Synthetic oligonucleotide
  Target: ATXN1; (+) strand; PAM type: YTN; PAM sequence: TTA
aatcagaatgtcaaaaactc

SEQ ID NO: 284136 - DNA, 20 bp, Artificial Sequence
  Description of Artificial Sequence: Synthetic oligonucleotide
  Target: ATXN1; (+) strand; PAM type: YTN; PAM sequence: CTC
agcaggcagagacacagcag

SEQ ID NO: 284137 - DNA, 20 bp, Artificial Sequence
  Description of Artificial Sequence: Synthetic oligonucleotide
  Target: ATXN1; (+) strand; PAM type: YTN; PAM sequence: CTA
tccccagggatgagtgggtt

SEQ ID NO: 284138 - DNA, 20 bp, Artificial Sequence
  Description of Artificial Sequence: Synthetic oligonucleotide
  Target: ATXN1; (+) strand; PAM type: YTN; PAM sequence: TTC
tggccaggggttgcttccca

SEQ ID NO: 284139 - DNA, 20 bp, Artificial Sequence
  Description of Artificial Sequence: Synthetic oligonucleotide
  Target: ATXN1; (+) strand; PAM type: YTN; PAM sequence: CTG
gccaggggttgcttcccacc

SEQ ID NO: 284140 - DNA, 20 bp, Artificial Sequence
  Description of Artificial Sequence: Synthetic oligonucleotide
  Target: ATXN1; (+) strand; PAM type: YTN; PAM sequence: TTG
cttcccaccccatctcctcc

SEQ ID NO: 284141 - DNA, 20 bp, Artificial Sequence
  Description of Artificial Sequence: Synthetic oligonucleotide
  Target: ATXN1; (+) strand; PAM type: YTN; PAM sequence: CTT
cccaccccatctcctcccct

SEQ ID NO: 284142 - DNA, 20 bp, Artificial Sequence
  Description of Artificial Sequence: Synthetic oligonucleotide
  Target: ATXN1; (+) strand; PAM type: YTN; PAM sequence: TTC
ccaccccatctcctcccctt

SEQ ID NO: 284143 - DNA, 20 bp, Artificial Sequence
  Description of Artificial Sequence: Synthetic oligonucleotide
  Target: ATXN1; (+) strand; PAM type: YTN; PAM sequence: CTC
ctccccttgaggacaccact

SEQ ID NO: 284144 - DNA, 20 bp, Artificial Sequence
  Description of Artificial Sequence: Synthetic oligonucleotide
  Target: ATXN1; (+) strand; PAM type: YTN; PAM sequence: CTC
cccttgaggacaccactatc

SEQ ID NO: 284145 - DNA, 20 bp, Artificial Sequence
  Description of Artificial Sequence: Synthetic oligonucleotide
  Target: ATXN1; (+) strand; PAM type: YTN; PAM sequence: CTT
gaggacaccactatcaaaat

SEQ ID NO: 284146 - DNA, 20 bp, Artificial Sequence
  Description of Artificial Sequence: Synthetic oligonucleotide
  Target: ATXN1; (+) strand; PAM type: YTN; PAM sequence: TTG
aggacaccactatcaaaata

SEQ ID NO: 284147 - DNA, 20 bp, Artificial Sequence
  Description of Artificial Sequence: Synthetic oligonucleotide
  Target: ATXN1; (+) strand; PAM type: YTN; PAM sequence: CTA
tcaaaataatcccgttcctg

SEQ ID NO: 284148 - DNA, 20 bp, Artificial Sequence
  Description of Artificial Sequence: Synthetic oligonucleotide
  Target: ATXN1; (+) strand; PAM type: YTN; PAM sequence: TTC
ctgcccctccttccctgctc

SEQ ID NO: 284149 - DNA, 20 bp, Artificial Sequence
  Description of Artificial Sequence: Synthetic oligonucleotide
  Target: ATXN1; (+) strand; PAM type: YTN; PAM sequence: CTG
cccctccttccctgctcaat

SEQ ID NO: 284150 - DNA, 20 bp, Artificial Sequence
  Description of Artificial Sequence: Synthetic oligonucleotide
  Target: ATXN1; (+) strand; PAM type: YTN; PAM sequence: CTC
cttccctgctcaatgattct

SEQ ID NO: 284151 - DNA, 20 bp, Artificial Sequence
  Description of Artificial Sequence: Synthetic oligonucleotide
  Target: ATXN1; (+) strand; PAM type: YTN; PAM sequence: CTT
ccctgctcaatgattctaag

SEQ ID NO: 284152 - DNA, 20 bp, Artificial Sequence
  Description of Artificial Sequence: Synthetic oligonucleotide
  Target: ATXN1; (+) strand; PAM type: YTN; PAM sequence: TTC
cctgctcaatgattctaaga

SEQ ID NO: 284153 - DNA, 20 bp, Artificial Sequence
  Description of Artificial Sequence: Synthetic oligonucleotide
  Target: ATXN1; (+) strand; PAM type: YTN; PAM sequence: CTG
ctcaatgattctaagatttc

SEQ ID NO: 284154 - DNA, 20 bp, Artificial Sequence
  Description of Artificial Sequence: Synthetic oligonucleotide
  Target: ATXN1; (+) strand; PAM type: YTN; PAM sequence: CTC
aatgattctaagatttctaa

SEQ ID NO: 284155 - DNA, 20 bp, Artificial Sequence
  Description of Artificial Sequence: Synthetic oligonucleotide
  Target: ATXN1; (+) strand; PAM type: YTN; PAM sequence: TTC
taagatttctaagaaataac

SEQ ID NO: 284156 - DNA, 20 bp, Artificial Sequence
  Description of Artificial Sequence: Synthetic oligonucleotide
  Target: ATXN1; (+) strand; PAM type: YTN; PAM sequence: CTA
agatttctaagaaataacaa

SEQ ID NO: 284157 - DNA, 20 bp, Artificial Sequence
  Description of Artificial Sequence: Synthetic oligonucleotide
  Target: ATXN1; (+) strand; PAM type: YTN; PAM sequence: TTT
ctaagaaataacaagcagtc

SEQ ID NO: 284158 - DNA, 20 bp, Artificial Sequence
  Description of Artificial Sequence: Synthetic oligonucleotide
  Target: ATXN1; (+) strand; PAM type: YTN; PAM sequence: TTC
taagaaataacaagcagtca

SEQ ID NO: 284159 - DNA, 20 bp, Artificial Sequence
  Description of Artificial Sequence: Synthetic oligonucleotide
  Target: ATXN1; (+) strand; PAM type: YTN; PAM sequence: CTA
agaaataacaagcagtcagt

SEQ ID NO: 284160 - DNA, 20 bp, Artificial Sequence
  Description of Artificial Sequence: Synthetic oligonucleotide
  Target: ATXN1; (+) strand; PAM type: YTN; PAM sequence: TTC
ttcatagaaaatgtcagaaa

SEQ ID NO: 284161 - DNA, 20 bp, Artificial Sequence
  Description of Artificial Sequence: Synthetic oligonucleotide
  Target: ATXN1; (+) strand; PAM type: YTN; PAM sequence: CTT
catagaaaatgtcagaaaca

SEQ ID NO: 284162 - DNA, 20 bp, Artificial Sequence
  Description of Artificial Sequence: Synthetic oligonucleotide
  Target: ATXN1; (+) strand; PAM type: YTN; PAM sequence: TTC
atagaaaatgtcagaaacat

SEQ ID NO: 284163 - DNA, 20 bp, Artificial Sequence
  Description of Artificial Sequence: Synthetic oligonucleotide
  Target: ATXN1; (+) strand; PAM type: YTN; PAM sequence: TTG
ctgaatttgatgctctcttt

SEQ ID NO: 284164 - DNA, 20 bp, Artificial Sequence
  Description of Artificial Sequence: Synthetic oligonucleotide
  Target: ATXN1; (+) strand; PAM type: YTN; PAM sequence: CTG
aatttgatgctctctttctc

SEQ ID NO: 284165 - DNA, 20 bp, Artificial Sequence
  Description of Artificial Sequence: Synthetic oligonucleotide
  Target: ATXN1; (+) strand; PAM type: YTN; PAM sequence: TTT
gatgctctctttctctaaga

SEQ ID NO: 284166 - DNA, 20 bp, Artificial Sequence
  Description of Artificial Sequence: Synthetic oligonucleotide
  Target: ATXN1; (+) strand; PAM type: YTN; PAM sequence: TTG
atgctctctttctctaagac

SEQ ID NO: 284167 - DNA, 20 bp, Artificial Sequence
  Description of Artificial Sequence: Synthetic oligonucleotide
  Target: ATXN1; (+) strand; PAM type: YTN; PAM sequence: CTC
tctttctctaagactccttc

SEQ ID NO: 284168 - DNA, 20 bp, Artificial Sequence
  Description of Artificial Sequence: Synthetic oligonucleotide
  Target: ATXN1; (+) strand; PAM type: YTN; PAM sequence: CTC
tttctctaagactccttcta

SEQ ID NO: 284169 - DNA, 20 bp, Artificial Sequence
  Description of Artificial Sequence: Synthetic oligonucleotide
  Target: ATXN1; (+) strand; PAM type: YTN; PAM sequence: CTT
tctctaagactccttctagc

SEQ ID NO: 284170 - DNA, 20 bp, Artificial Sequence
  Description of Artificial Sequence: Synthetic oligonucleotide
  Target: ATXN1; (+) strand; PAM type: YTN; PAM sequence: TTT
ctctaagactccttctagcc

SEQ ID NO: 284171 - DNA, 20 bp, Artificial Sequence
  Description of Artificial Sequence: Synthetic oligonucleotide
  Target: ATXN1; (+) strand; PAM type: YTN; PAM sequence: TTC
tctaagactccttctagcca

SEQ ID NO: 284172 - DNA, 20 bp, Artificial Sequence
  Description of Artificial Sequence: Synthetic oligonucleotide
  Target: ATXN1; (+) strand; PAM type: YTN; PAM sequence: CTC
taagactccttctagccaca

SEQ ID NO: 284173 - DNA, 20 bp, Artificial Sequence
  Description of Artificial Sequence: Synthetic oligonucleotide
  Target: ATXN1; (+) strand; PAM type: YTN; PAM sequence: CTA
agactccttctagccacaaa

SEQ ID NO: 284174 - DNA, 20 bp, Artificial Sequence
  Description of Artificial Sequence: Synthetic oligonucleotide
  Target: ATXN1; (+) strand; PAM type: YTN; PAM sequence: CTC
cttctagccacaaaattatg

SEQ ID NO: 284175 - DNA, 20 bp, Artificial Sequence
  Description of Artificial Sequence: Synthetic oligonucleotide
  Target: ATXN1; (+) strand; PAM type: YTN; PAM sequence: CTT
ctagccacaaaattatgcaa

SEQ ID NO: 284176 - DNA, 20 bp, Artificial Sequence
  Description of Artificial Sequence: Synthetic oligonucleotide
  Target: ATXN1; (+) strand; PAM type: YTN; PAM sequence: TTC
tagccacaaaattatgcaaa

SEQ ID NO: 284177 - DNA, 20 bp, Artificial Sequence
  Description of Artificial Sequence: Synthetic oligonucleotide
  Target: ATXN1; (+) strand; PAM type: YTN; PAM sequence: CTA
gccacaaaattatgcaaatt

SEQ ID NO: 284178 - DNA, 20 bp, Artificial Sequence
  Description of Artificial Sequence: Synthetic oligonucleotide
  Target: ATXN1; (+) strand; PAM type: YTN; PAM sequence: TTA
tgcaaattcagtgcatgtat

SEQ ID NO: 284179 - DNA, 20 bp, Artificial Sequence
  Description of Artificial Sequence: Synthetic oligonucleotide
  Target: ATXN1; (+) strand; PAM type: YTN; PAM sequence: TTC
agtgcatgtatttaccattc

SEQ ID NO: 284180 - DNA, 20 bp, Artificial Sequence
  Description of Artificial Sequence: Synthetic oligonucleotide
  Target: ATXN1; (+) strand; PAM type: YTN; PAM sequence: TTT
accattccggcctcactttc

SEQ ID NO: 284181 - DNA, 20 bp, Artificial Sequence
  Description of Artificial Sequence: Synthetic oligonucleotide
  Target: ATXN1; (+) strand; PAM type: YTN; PAM sequence: TTA
ccattccggcctcactttca

SEQ ID NO: 284182 - DNA, 20 bp, Artificial Sequence
  Description of Artificial Sequence: Synthetic oligonucleotide
  Target: ATXN1; (+) strand; PAM type: YTN; PAM sequence: TTC
cggcctcactttcacttttg

SEQ ID NO: 284183 - DNA, 20 bp, Artificial Sequence
  Description of Artificial Sequence: Synthetic oligonucleotide
  Target: ATXN1; (+) strand; PAM type: YTN; PAM sequence: CTC
actttcacttttgaaactac

SEQ ID NO: 284184 - DNA, 20 bp, Artificial Sequence
  Description of Artificial Sequence: Synthetic oligonucleotide
  Target: ATXN1; (+) strand; PAM type: YTN; PAM sequence: CTT
tcacttttgaaactacacat

SEQ ID NO: 284185 - DNA, 20 bp, Artificial Sequence
  Description of Artificial Sequence: Synthetic oligonucleotide
  Target: ATXN1; (+) strand; PAM type: YTN; PAM sequence: TTT
cacttttgaaactacacatg

SEQ ID NO: 284186 - DNA, 20 bp, Artificial Sequence
  Description of Artificial Sequence: Synthetic oligonucleotide
  Target: ATXN1; (+) strand; PAM type: YTN; PAM sequence: TTC
acttttgaaactacacatgc

SEQ ID NO: 284187 - DNA, 20 bp, Artificial Sequence
  Description of Artificial Sequence: Synthetic oligonucleotide
  Target: ATXN1; (+) strand; PAM type: YTN; PAM sequence: CTT
ttgaaactacacatgcctct

SEQ ID NO: 284188 - DNA, 20 bp, Artificial Sequence
  Description of Artificial Sequence: Synthetic oligonucleotide
  Target: ATXN1; (+) strand; PAM type: YTN; PAM sequence: TTT
tgaaactacacatgcctctt

SEQ ID NO: 284189 - DNA, 20 bp, Artificial Sequence
  Description of Artificial Sequence: Synthetic oligonucleotide
  Target: ATXN1; (+) strand; PAM type: YTN; PAM sequence: TTT
gaaactacacatgcctcttt

SEQ ID NO: 284190 - DNA, 20 bp, Artificial Sequence
  Description of Artificial Sequence: Synthetic oligonucleotide
  Target: ATXN1; (+) strand; PAM type: YTN; PAM sequence: TTG
aaactacacatgcctctttg

SEQ ID NO: 284191 - DNA, 20 bp, Artificial Sequence
  Description of Artificial Sequence: Synthetic oligonucleotide
  Target: ATXN1; (+) strand; PAM type: YTN; PAM sequence: CTA
cacatgcctctttgttaata

SEQ ID NO: 284192 - DNA, 20 bp, Artificial Sequence
  Description of Artificial Sequence: Synthetic oligonucleotide
  Target: ATXN1; (+) strand; PAM type: YTN; PAM sequence: CTC
tttgttaataactcagttaa

SEQ ID NO: 284193 - DNA, 20 bp, Artificial Sequence
  Description of Artificial Sequence: Synthetic oligonucleotide
  Target: ATXN1; (+) strand; PAM type: YTN; PAM sequence: CTT
tgttaataactcagttaaga

SEQ ID NO: 284194 - DNA, 20 bp, Artificial Sequence
  Description of Artificial Sequence: Synthetic oligonucleotide
  Target: ATXN1; (+) strand; PAM type: YTN; PAM sequence: TTT
gttaataactcagttaagac

SEQ ID NO: 284195 - DNA, 20 bp, Artificial Sequence
  Description of Artificial Sequence: Synthetic oligonucleotide
  Target: ATXN1; (+) strand; PAM type: YTN; PAM sequence: TTG
ttaataactcagttaagaca

SEQ ID NO: 284196 - DNA, 20 bp, Artificial Sequence
  Description of Artificial Sequence: Synthetic oligonucleotide
  Target: ATXN1; (+) strand; PAM type: YTN; PAM sequence: TTA
ataactcagttaagacatga

SEQ ID NO: 284197 - DNA, 20 bp, Artificial Sequence
  Description of Artificial Sequence: Synthetic oligonucleotide
  Target: ATXN1; (+) strand; PAM type: YTN; PAM sequence: CTC
agttaagacatgatgtcagt

SEQ ID NO: 284198 - DNA, 20 bp, Artificial Sequence
  Description of Artificial Sequence: Synthetic oligonucleotide
  Target: ATXN1; (+) strand; PAM type: YTN; PAM sequence: TTA
agacatgatgtcagtgatgg

SEQ ID NO: 284199 - DNA, 20 bp, Artificial Sequence
  Description of Artificial Sequence: Synthetic oligonucleotide
  Target: ATXN1; (+) strand; PAM type: YTN; PAM sequence: TTG
attaaacatttactatgttc

SEQ ID NO: 284200 - DNA, 20 bp, Artificial Sequence
  Description of Artificial Sequence: Synthetic oligonucleotide
  Target: ATXN1; (+) strand; PAM type: YTN; PAM sequence: TTA
aacatttactatgttctggg

SEQ ID NO: 284201 - DNA, 20 bp, Artificial Sequence
  Description of Artificial Sequence: Synthetic oligonucleotide
  Target: ATXN1; (+) strand; PAM type: YTN; PAM sequence: TTT
actatgttctgggccatgtg

SEQ ID NO: 284202 - DNA, 20 bp, Artificial Sequence
  Description of Artificial Sequence: Synthetic oligonucleotide
  Target: ATXN1; (+) strand; PAM type: YTN; PAM sequence: TTA
ctatgttctgggccatgtgc

SEQ ID NO: 284203 - DNA, 20 bp, Artificial Sequence
  Description of Artificial Sequence: Synthetic oligonucleotide
  Target: ATXN1; (+) strand; PAM type: YTN; PAM sequence: CTA
tgttctgggccatgtgctaa

SEQ ID NO: 284204 - DNA, 20 bp, Artificial Sequence
  Description of Artificial Sequence: Synthetic oligonucleotide
  Target: ATXN1; (+) strand; PAM type: YTN; PAM sequence: TTC
tgggccatgtgctaagggct

SEQ ID NO: 284205 - DNA, 20 bp, Artificial Sequence
  Description of Artificial Sequence: Synthetic oligonucleotide
  Target: ATXN1; (+) strand; PAM type: YTN; PAM sequence: CTG
ggccatgtgctaagggcttt

SEQ ID NO: 284206 - DNA, 20 bp, Artificial Sequence
  Description of Artificial Sequence: Synthetic oligonucleotide
  Target: ATXN1; (+) strand; PAM type: YTN; PAM sequence: CTA
agggctttacacacattgcc

SEQ ID NO: 284207 - DNA, 20 bp, Artificial Sequence
  Description of Artificial Sequence: Synthetic oligonucleotide
  Target: ATXN1; (+) strand; PAM type: YTN; PAM sequence: CTT
tacacacattgccccactcc

SEQ ID NO: 284208 - DNA, 20 bp, Artificial Sequence
  Description of Artificial Sequence: Synthetic oligonucleotide
  Target: ATXN1; (+) strand; PAM type: YTN; PAM sequence: TTT
acacacattgccccactcca

SEQ ID NO: 284209 - DNA, 20 bp, Artificial Sequence
  Description of Artificial Sequence: Synthetic oligonucleotide
  Target: ATXN1; (+) strand; PAM type: YTN; PAM sequence: TTA
cacacattgccccactccac

SEQ ID NO: 284210 - DNA, 20 bp, Artificial Sequence
  Description of Artificial Sequence: Synthetic oligonucleotide
  Target: ATXN1; (+) strand; PAM type: YTN; PAM sequence: TTG
ccccactccactgcagtctg

SEQ ID NO: 284211 - DNA, 20 bp, Artificial Sequence
  Description of Artificial Sequence: Synthetic oligonucleotide
  Target: ATXN1; (+) strand; PAM type: YTN; PAM sequence: CTC
cactgcagtctgtgaggtgg

SEQ ID NO: 284212 - DNA, 20 bp, Artificial Sequence
  Description of Artificial Sequence: Synthetic oligonucleotide
  Target: ATXN1; (+) strand; PAM type: YTN; PAM sequence: CTG
cagtctgtgaggtggccagg

SEQ ID NO: 284213 - DNA, 20 bp, Artificial Sequence
  Description of Artificial Sequence: Synthetic oligonucleotide
  Target: ATXN1; (+) strand; PAM type: YTN; PAM sequence: CTG
tgaggtggccaggaatcatg

SEQ ID NO: 284214 - DNA, 20 bp, Artificial Sequence
  Description of Artificial Sequence: Synthetic oligonucleotide
  Target: ATXN1; (+) strand; PAM type: YTN; PAM sequence: TTT
acctctgcattattgacaag

SEQ ID NO: 284215 - DNA, 20 bp, Artificial Sequence
  Description of Artificial Sequence: Synthetic oligonucleotide
  Target: ATXN1; (+) strand; PAM type: YTN; PAM sequence: TTA
cctctgcattattgacaaga

SEQ ID NO: 284216 - DNA, 20 bp, Artificial Sequence
  Description of Artificial Sequence: Synthetic oligonucleotide
  Target: ATXN1; (+) strand; PAM type: YTN; PAM sequence: CTC
tgcattattgacaagaaaac

SEQ ID NO: 284217 - DNA, 20 bp, Artificial Sequence
  Description of Artificial Sequence: Synthetic oligonucleotide
  Target: ATXN1; (+) strand; PAM type: YTN; PAM sequence: CTG
cattattgacaagaaaactg

SEQ ID NO: 284218 - DNA, 20 bp, Artificial Sequence
  Description of Artificial Sequence: Synthetic oligonucleotide
  Target: ATXN1; (+) strand; PAM type: YTN; PAM sequence: TTA
ttgacaagaaaactgacagt

SEQ ID NO: 284219 - DNA, 20 bp, Artificial Sequence
  Description of Artificial Sequence: Synthetic oligonucleotide
  Target: ATXN1; (+) strand; PAM type: YTN; PAM sequence: TTG
acaagaaaactgacagtaaa

SEQ ID NO: 284220 - DNA, 20 bp, Artificial Sequence
  Description of Artificial Sequence: Synthetic oligonucleotide
  Target: ATXN1; (+) strand; PAM type: YTN; PAM sequence: CTG
acagtaaatacagccaacgg

SEQ ID NO: 284221 - DNA, 20 bp, Artificial Sequence
  Description of Artificial Sequence: Synthetic oligonucleotide
  Target: ATXN1; (+) strand; PAM type: YTN; PAM sequence: TTA
aagccagtacttaagccaac

SEQ ID NO: 284222 - DNA, 20 bp, Artificial Sequence
  Description of Artificial Sequence: Synthetic oligonucleotide
  Target: ATXN1; (+) strand; PAM type: YTN; PAM sequence: CTT
aagccaacagttcacagagg

SEQ ID NO: 284223 - DNA, 20 bp, Artificial Sequence
  Description of Artificial Sequence: Synthetic oligonucleotide
  Target: ATXN1; (+) strand; PAM type: YTN; PAM sequence: TTA
agccaacagttcacagaggt

SEQ ID NO: 284224 - DNA, 20 bp, Artificial Sequence
  Description of Artificial Sequence: Synthetic oligonucleotide
  Target: ATXN1; (+) strand; PAM type: YTN; PAM sequence: TTC
acagaggtcatgcttaggat

SEQ ID NO: 284225 - DNA, 20 bp, Artificial Sequence
  Description of Artificial Sequence: Synthetic oligonucleotide
  Target: ATXN1; (+) strand; PAM type: YTN; PAM sequence: CTT
aggattctagtactatacca

SEQ ID NO: 284226 - DNA, 20 bp, Artificial Sequence
  Description of Artificial Sequence: Synthetic oligonucleotide
  Target: ATXN1; (+) strand; PAM type: YTN; PAM sequence: TTA
ggattctagtactataccat

SEQ ID NO: 284227 - DNA, 20 bp, Artificial Sequence
  Description of Artificial Sequence: Synthetic oligonucleotide
  Target: ATXN1; (+) strand; PAM type: YTN; PAM sequence: TTC
tagtactataccatctcttc

SEQ ID NO: 284228 - DNA, 20 bp, Artificial Sequence
  Description of Artificial Sequence: Synthetic oligonucleotide
  Target: ATXN1; (+) strand; PAM type: YTN; PAM sequence: CTA
gtactataccatctcttcaa

SEQ ID NO: 284229 - DNA, 20 bp, Artificial Sequence
  Description of Artificial Sequence: Synthetic oligonucleotide
  Target: ATXN1; (+) strand; PAM type: YTN; PAM sequence: CTA
taccatctcttcaaggctga

SEQ ID NO: 284230 - DNA, 20 bp, Artificial Sequence
  Description of Artificial Sequence: Synthetic oligonucleotide
  Target: ATXN1; (+) strand; PAM type: YTN; PAM sequence: CTC
ttcaaggctgatctttctac

SEQ ID NO: 284231 - DNA, 20 bp, Artificial Sequence
  Description of Artificial Sequence: Synthetic oligonucleotide
  Target: ATXN1; (+) strand; PAM type: YTN; PAM sequence: CTT
caaggctgatctttctacca

SEQ ID NO: 284232 - DNA, 20 bp, Artificial Sequence
  Description of Artificial Sequence: Synthetic oligonucleotide
  Target: ATXN1; (+) strand; PAM type: YTN; PAM sequence: TTC
aaggctgatctttctaccaa

SEQ ID NO: 284233 - DNA, 20 bp, Artificial Sequence
  Description of Artificial Sequence: Synthetic oligonucleotide
  Target: ATXN1; (+) strand; PAM type: YTN; PAM sequence: CTG
atctttctaccaacacttct

SEQ ID NO: 284234 - DNA, 20 bp, Artificial Sequence
  Description of Artificial Sequence: Synthetic oligonucleotide
  Target: ATXN1; (+) strand; PAM type: YTN; PAM sequence: CTT
tctaccaacacttctgtagt

SEQ ID NO: 284235 - DNA, 20 bp, Artificial Sequence
  Description of Artificial Sequence: Synthetic oligonucleotide
  Target: ATXN1; (+) strand; PAM type: YTN; PAM sequence: TTT
ctaccaacacttctgtagtt

SEQ ID NO: 284236 - DNA, 20 bp, Artificial Sequence
  Description of Artificial Sequence: Synthetic oligonucleotide
  Target: ATXN1; (+) strand; PAM type: YTN; PAM sequence: TTC
taccaacacttctgtagtta

SEQ ID NO: 284237 - DNA, 20 bp, Artificial Sequence
  Description of Artificial Sequence: Synthetic oligonucleotide
  Target: ATXN1; (+) strand; PAM type: YTN; PAM sequence: CTA
ccaacacttctgtagttagt

SEQ ID NO: 284238 - DNA, 20 bp, Artificial Sequence
  Description of Artificial Sequence: Synthetic oligonucleotide
  Target: ATXN1; (+) strand; PAM type: YTN; PAM sequence: CTT
ctgtagttagtattaaaaca

SEQ ID NO: 284239 - DNA, 20 bp, Artificial Sequence
  Description of Artificial Sequence: Synthetic oligonucleotide
  Target: ATXN1; (+) strand; PAM type: YTN; PAM sequence: TTC
tgtagttagtattaaaacat

SEQ ID NO: 284240 - DNA, 20 bp, Artificial Sequence
  Description of Artificial Sequence: Synthetic oligonucleotide
  Target: ATXN1; (+) strand; PAM type: YTN; PAM sequence: CTG
tagttagtattaaaacatat

SEQ ID NO: 284241 - DNA, 20 bp, Artificial Sequence
  Description of Artificial Sequence: Synthetic oligonucleotide
  Target: ATXN1; (+) strand; PAM type: YTN; PAM sequence: TTA
gtattaaaacatatcggggc

SEQ ID NO: 284242 - DNA, 20 bp, Artificial Sequence
  Description of Artificial Sequence: Synthetic oligonucleotide
  Target: ATXN1; (+) strand; PAM type: YTN; PAM sequence: TTA
aaacatatcggggctggggc

SEQ ID NO: 284243 - DNA, 20 bp, Artificial Sequence
  Description of Artificial Sequence: Synthetic oligonucleotide
  Target: ATXN1; (+) strand; PAM type: YTN; PAM sequence: CTG
gggcatggtggctcatgcct

SEQ ID NO: 284244 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatcccagcact

SEQ ID NO: 284245 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 284246 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgaggtgggcgg

SEQ ID NO: 284247 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaggtgggcgga

SEQ ID NO: 284248 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggtgggcggat

SEQ ID NO: 284249 - DNA, 20 bp, Artificial Sequence
  Description of Artificial Sequence: Synthetic oligonucleotide
  Target: ATXN1; (+) strand; PAM type: YTN; PAM sequence: CTG
aggtgggcggatcatgaggt

SEQ ID NO: 284250 - DNA, 20 bp, Artificial Sequence
  Description of Artificial Sequence: Synthetic oligonucleotide
  Target: ATXN1; (+) strand; PAM type: YTN; PAM sequence: CTG
gccaacatggtgtaacccca

SEQ ID NO: 284251 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 284252 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 284253 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagccac

SEQ ID NO: 284254 - DNA, 20 bp, Artificial Sequence
  Description of Artificial Sequence: Synthetic oligonucleotide
  Target: ATXN1; (+) strand; PAM type: YTN; PAM sequence: TTA
gccacgcatggtggtgcgtg

SEQ ID NO: 284255 - DNA, 20 bp, Artificial Sequence
  Description of Artificial Sequence: Synthetic oligonucleotide
  Target: ATXN1; (+) strand; PAM type: YTN; PAM sequence: CTA
ctcaggaagctgaggcagga

SEQ ID NO: 284256 - DNA, 20 bp, Artificial Sequence
  Description of Artificial Sequence: Synthetic oligonucleotide
  Target: ATXN1; (+) strand; PAM type: YTN; PAM sequence: CTC
aggaagctgaggcaggagaa

SEQ ID NO: 284257 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcacttgaa

SEQ ID NO: 284258 - DNA, 20 bp, Artificial Sequence
  Description of Artificial Sequence: Synthetic oligonucleotide
  Target: ATXN1; (+) strand; PAM type: YTN; PAM sequence: CTT
gaaccggaaggcagagtttg

SEQ ID NO: 284259 - DNA, 20 bp, Artificial Sequence
  Description of Artificial Sequence: Synthetic oligonucleotide
  Target: ATXN1; (+) strand; PAM type: YTN; PAM sequence: TTG
aaccggaaggcagagtttgc

SEQ ID NO: 284260 - DNA, 20 bp, Artificial Sequence
  Description of Artificial Sequence: Synthetic oligonucleotide
  Target: ATXN1; (+) strand; PAM type: YTN; PAM sequence: TTT
gcagtgagctgagatcatgc

SEQ ID NO: 284261 - DNA, 20 bp, Artificial Sequence
  Description of Artificial Sequence: Synthetic oligonucleotide
  Target: ATXN1; (+) strand; PAM type: YTN; PAM sequence: TTG
cagtgagctgagatcatgcc

SEQ ID NO: 284262 - DNA, 20 bp, Artificial Sequence
  Description of Artificial Sequence: Synthetic oligonucleotide
  Target: ATXN1; (+) strand; PAM type: YTN; PAM sequence: CTG
agatcatgccactgcactcc

SEQ ID NO: 284263 - DNA, 20 bp, Artificial Sequence
  Description of Artificial Sequence: Synthetic oligonucleotide
  Target: ATXN1; (+) strand; PAM type: YTN; PAM sequence: CTG
cactccagcctggtgacaaa

SEQ ID NO: 284264 - DNA, 20 bp, Artificial Sequence
  Description of Artificial Sequence: Synthetic oligonucleotide
  Target: ATXN1; (+) strand; PAM type: YTN; PAM sequence: CTC
cagcctggtgacaaagcaag

SEQ ID NO: 284265 - DNA, 20 bp, Artificial Sequence
  Description of Artificial Sequence: Synthetic oligonucleotide
  Target: ATXN1; (+) strand; PAM type: YTN; PAM sequence: CTG
gtgacaaagcaagactctgt

SEQ ID NO: 284266 - DNA, 20 bp, Artificial Sequence
  Description of Artificial Sequence: Synthetic oligonucleotide
  Target: ATXN1; (+) strand; PAM type: YTN; PAM sequence: CTC
tgtctcaaaaaaaaaaaaag

SEQ ID NO: 284267 - DNA, 20 bp, Artificial Sequence
  Description of Artificial Sequence: Synthetic oligonucleotide
  Target: ATXN1; (+) strand; PAM type: YTN; PAM sequence: CTG
tctcaaaaaaaaaaaaagta

SEQ ID NO: 284268 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaagtatcaa

SEQ ID NO: 284269 - DNA, 20 bp, Artificial Sequence
  Description of Artificial Sequence: Synthetic oligonucleotide
  Target: ATXN1; (+) strand; PAM type: YTN; PAM sequence: CTA
tcacctcatttttcccagag

SEQ ID NO: 284270 - DNA, 20 bp, Artificial Sequence
  Description of Artificial Sequence: Synthetic oligonucleotide
  Target: ATXN1; (+) strand; PAM type: YTN; PAM sequence: CTC
atttttcccagagggttatg

SEQ ID NO: 284271 - DNA, 20 bp, Artificial Sequence
  Description of Artificial Sequence: Synthetic oligonucleotide
  Target: ATXN1; (+) strand; PAM type: YTN; PAM sequence: TTT
ttcccagagggttatgtcac

SEQ ID NO: 284272 - DNA, 20 bp, Artificial Sequence
  Description of Artificial Sequence: Synthetic oligonucleotide
  Target: ATXN1; (+) strand; PAM type: YTN; PAM sequence: TTT
tcccagagggttatgtcacc

SEQ ID NO: 284273 - DNA, 20 bp, Artificial Sequence
  Description of Artificial Sequence: Synthetic oligonucleotide
  Target: ATXN1; (+) strand; PAM type: YTN; PAM sequence: TTT
cccagagggttatgtcacct

SEQ ID NO: 284274 - DNA, 20 bp, Artificial Sequence
  Description of Artificial Sequence: Synthetic oligonucleotide
  Target: ATXN1; (+) strand; PAM type: YTN; PAM sequence: TTC
ccagagggttatgtcaccta

SEQ ID NO: 284275 - DNA, 20 bp, Artificial Sequence
  Description of Artificial Sequence: Synthetic oligonucleotide
  Target: ATXN1; (+) strand; PAM type: YTN; PAM sequence: TTA
tgtcacctagtcttaaaatt

SEQ ID NO: 284276 - DNA, 20 bp, Artificial Sequence
  Description of Artificial Sequence: Synthetic oligonucleotide
  Target: ATXN1; (+) strand; PAM type: YTN; PAM sequence: CTA
gtcttaaaattactattatt

SEQ ID NO: 284277 - DNA, 20 bp, Artificial Sequence
  Description of Artificial Sequence: Synthetic oligonucleotide
  Target: ATXN1; (+) strand; PAM type: YTN; PAM sequence: CTT
aaaattactattatttgttt

SEQ ID NO: 284278 - DNA, 20 bp, Artificial Sequence
  Description of Artificial Sequence: Synthetic oligonucleotide
  Target: ATXN1; (+) strand; PAM type: YTN; PAM sequence: TTA
aaattactattatttgtttt

SEQ ID NO: 284279 - DNA, 20 bp, Artificial Sequence
  Description of Artificial Sequence: Synthetic oligonucleotide
  Target: ATXN1; (+) strand; PAM type: YTN; PAM sequence: TTA
ctattatttgttttggattt

SEQ ID NO: 284280 - DNA, 20 bp, Artificial Sequence
  Description of Artificial Sequence: Synthetic oligonucleotide
  Target: ATXN1; (+) strand; PAM type: YTN; PAM sequence: CTA
ttatttgttttggatttgac

SEQ ID NO: 284281 - DNA, 20 bp, Artificial Sequence
  Description of Artificial Sequence: Synthetic oligonucleotide
  Target: ATXN1; (+) strand; PAM type: YTN; PAM sequence: TTA
tttgttttggatttgactgt

SEQ ID NO: 284282 - DNA, 20 bp, Artificial Sequence
  Description of Artificial Sequence: Synthetic oligonucleotide
  Target: ATXN1; (+) strand; PAM type: YTN; PAM sequence: TTT
gttttggatttgactgtact

SEQ ID NO: 284283 - DNA, 20 bp, Artificial Sequence
  Description of Artificial Sequence: Synthetic oligonucleotide
  Target: ATXN1; (+) strand; PAM type: YTN; PAM sequence: TTG
ttttggatttgactgtactt

SEQ ID NO: 284284 - DNA, 20 bp, Artificial Sequence
  Description of Artificial Sequence: Synthetic oligonucleotide
  Target: ATXN1; (+) strand; PAM type: YTN; PAM sequence: TTT
tggatttgactgtactttga

SEQ ID NO: 284285 - DNA, 20 bp, Artificial Sequence
  Description of Artificial Sequence: Synthetic oligonucleotide
  Target: ATXN1; (+) strand; PAM type: YTN; PAM sequence: TTT
ggatttgactgtactttgat

SEQ ID NO: 284286 - DNA, 20 bp, Artificial Sequence
  Description of Artificial Sequence: Synthetic oligonucleotide
  Target: ATXN1; (+) strand; PAM type: YTN; PAM sequence: TTG
gatttgactgtactttgatt

SEQ ID NO: 284287 - DNA, 20 bp, Artificial Sequence
  Description of Artificial Sequence: Synthetic oligonucleotide
  Target: ATXN1; (+) strand; PAM type: YTN; PAM sequence: TTT
gactgtactttgattttaat

SEQ ID NO: 284288 - DNA, 20 bp, Artificial Sequence
  Description of Artificial Sequence: Synthetic oligonucleotide
  Target: ATXN1; (+) strand; PAM type: YTN; PAM sequence: TTG
actgtactttgattttaatt

SEQ ID NO: 284289 - DNA, 20 bp, Artificial Sequence
  Description of Artificial Sequence: Synthetic oligonucleotide
  Target: ATXN1; (+) strand; PAM type: YTN; PAM sequence: CTG
tactttgattttaattccca

SEQ ID NO: 284290 - DNA, 20 bp, Artificial Sequence
  Description of Artificial Sequence: Synthetic oligonucleotide
  Target: ATXN1; (+) strand; PAM type: YTN; PAM sequence: CTT
tgattttaattcccaagctc

SEQ ID NO: 284291 - DNA, 20 bp, Artificial Sequence
  Description of Artificial Sequence: Synthetic oligonucleotide
  Target: ATXN1; (+) strand; PAM type: YTN; PAM sequence: TTT
gattttaattcccaagctca

SEQ ID NO: 284292 - DNA, 20 bp, Artificial Sequence
  Description of Artificial Sequence: Synthetic oligonucleotide
  Target: ATXN1; (+) strand; PAM type: YTN; PAM sequence: TTG
attttaattcccaagctcaa

SEQ ID NO: 284293 - DNA, 20 bp, Artificial Sequence
  Description of Artificial Sequence: Synthetic oligonucleotide
  Target: ATXN1; (+) strand; PAM type: YTN; PAM sequence: TTT
taattcccaagctcaagtga

SEQ ID NO: 284294 - DNA, 20 bp, Artificial Sequence
  Description of Artificial Sequence: Synthetic oligonucleotide
  Target: ATXN1; (+) strand; PAM type: YTN; PAM sequence: TTT
aattcccaagctcaagtgaa

SEQ ID NO: 284295 - DNA, 20 bp, Artificial Sequence
  Description of Artificial Sequence: Synthetic oligonucleotide
  Target: ATXN1; (+) strand; PAM type: YTN; PAM sequence: TTA
attcccaagctcaagtgaaa

SEQ ID NO: 284296 - DNA, 20 bp, Artificial Sequence
  Description of Artificial Sequence: Synthetic oligonucleotide
  Target: ATXN1; (+) strand; PAM type: YTN; PAM sequence: TTC
ccaagctcaagtgaaaccga

SEQ ID NO: 284297 - DNA, 20 bp, Artificial Sequence
  Description of Artificial Sequence: Synthetic oligonucleotide
  Target: ATXN1; (+) strand; PAM type: YTN; PAM sequence: CTC
aagtgaaaccgacatgttca

SEQ ID NO: 284298 - DNA, 20 bp, Artificial Sequence
  Description of Artificial Sequence: Synthetic oligonucleotide
  Target: ATXN1; (+) strand; PAM type: YTN; PAM sequence: TTC
atatttcaactgagtgtaag

SEQ ID NO: 284299 - DNA, 20 bp, Artificial Sequence
  Description of Artificial Sequence: Synthetic oligonucleotide
  Target: ATXN1; (+) strand; PAM type: YTN; PAM sequence: TTT
caactgagtgtaagttggtg

SEQ ID NO: 284300 - DNA, 20 bp, Artificial Sequence
  Description of Artificial Sequence: Synthetic oligonucleotide
  Target: ATXN1; (+) strand; PAM type: YTN; PAM sequence: TTC
aactgagtgtaagttggtgg

SEQ ID NO: 284301 - DNA, 20 bp, Artificial Sequence
  Description of Artificial Sequence: Synthetic oligonucleotide
  Target: ATXN1; (+) strand; PAM type: YTN; PAM sequence: CTG
agtgtaagttggtggttatt

SEQ ID NO: 284302 - DNA, 20 bp, Artificial Sequence
  Description of Artificial Sequence: Synthetic oligonucleotide
  Target: ATXN1; (+) strand; PAM type: YTN; PAM sequence: TTG
gtggttattttagtaaatta

SEQ ID NO: 284303 - DNA, 20 bp, Artificial Sequence
  Description of Artificial Sequence: Synthetic oligonucleotide
  Target: ATXN1; (+) strand; PAM type: YTN; PAM sequence: TTA
ttttagtaaattaaaaatgc

SEQ ID NO: 284304 - DNA, 20 bp, Artificial Sequence
  Description of Artificial Sequence: Synthetic oligonucleotide
  Target: ATXN1; (+) strand; PAM type: YTN; PAM sequence: TTT
tagtaaattaaaaatgctaa

SEQ ID NO: 284305 - DNA, 20 bp, Artificial Sequence
  Description of Artificial Sequence: Synthetic oligonucleotide
  Target: ATXN1; (+) strand; PAM type: YTN; PAM sequence: TTT
agtaaattaaaaatgctaag

SEQ ID NO: 284306 - DNA, 20 bp, Artificial Sequence
  Description of Artificial Sequence: Synthetic oligonucleotide
  Target: ATXN1; (+) strand; PAM type: YTN; PAM sequence: TTA
gtaaattaaaaatgctaagt

SEQ ID NO: 284307 - DNA, 20 bp, Artificial Sequence
  Description of Artificial Sequence: Synthetic oligonucleotide
  Target: ATXN1; (+) strand; PAM type: YTN; PAM sequence: TTA
aaaatgctaagtaatcccaa

SEQ ID NO: 284308 - DNA, 20 bp, Artificial Sequence
  Description of Artificial Sequence: Synthetic oligonucleotide
  Target: ATXN1; (+) strand; PAM type: YTN; PAM sequence: CTA
agtaatcccaaatccagatg

SEQ ID NO: 284309 - DNA, 20 bp, Artificial Sequence
  Description of Artificial Sequence: Synthetic oligonucleotide
  Target: ATXN1; (+) strand; PAM type: YTN; PAM sequence: CTA
agcagaaacctaaaatccac

SEQ ID NO: 284310 - DNA, 20 bp, Artificial Sequence
  Description of Artificial Sequence: Synthetic oligonucleotide
  Target: ATXN1; (+) strand; PAM type: YTN; PAM sequence: CTA
aaatccacgtcctgcctaag

SEQ ID NO: 284311 - DNA, 20 bp, Artificial Sequence
  Description of Artificial Sequence: Synthetic oligonucleotide
  Target: ATXN1; (+) strand; PAM type: YTN; PAM sequence: CTG
cctaagcggctaaatttcat

SEQ ID NO: 284312 - DNA, 20 bp, Artificial Sequence
  Description of Artificial Sequence: Synthetic oligonucleotide
  Target: ATXN1; (+) strand; PAM type: YTN; PAM sequence: CTA
agcggctaaatttcattaga

SEQ ID NO: 284313 - DNA, 20 bp, Artificial Sequence
  Description of Artificial Sequence: Synthetic oligonucleotide
  Target: ATXN1; (+) strand; PAM type: YTN; PAM sequence: CTA
aatttcattagaaacaagtc

SEQ ID NO: 284314 - DNA, 20 bp, Artificial Sequence
  Description of Artificial Sequence: Synthetic oligonucleotide
  Target: ATXN1; (+) strand; PAM type: YTN; PAM sequence: TTT
cattagaaacaagtcagatg

SEQ ID NO: 284315 - DNA, 20 bp, Artificial Sequence
  Description of Artificial Sequence: Synthetic oligonucleotide
  Target: ATXN1; (+) strand; PAM type: YTN; PAM sequence: TTC
attagaaacaagtcagatga

SEQ ID NO: 284316 - DNA, 20 bp, Artificial Sequence
  Description of Artificial Sequence: Synthetic oligonucleotide
  Target: ATXN1; (+) strand; PAM type: YTN; PAM sequence: TTA
gaaacaagtcagatgataac

SEQ ID NO: 284317 - DNA, 20 bp, Artificial Sequence
  Description of Artificial Sequence: Synthetic oligonucleotide
  Target: ATXN1; (+) strand; PAM type: YTN; PAM sequence: TTC
caaagtaaagatatgaaaat

SEQ ID NO: 284318 - DNA, 20 bp, Artificial Sequence
  Description of Artificial Sequence: Synthetic oligonucleotide
  Target: ATXN1; (+) strand; PAM type: YTN; PAM sequence: TTT
cgatatctaatacagccatg

SEQ ID NO: 284319 - DNA, 20 bp, Artificial Sequence
  Description of Artificial Sequence: Synthetic oligonucleotide
  Target: ATXN1; (+) strand; PAM type: YTN; PAM sequence: TTC
gatatctaatacagccatgt

SEQ ID NO: 284320 - DNA, 20 bp, Artificial Sequence
  Description of Artificial Sequence: Synthetic oligonucleotide
  Target: ATXN1; (+) strand; PAM type: YTN; PAM sequence: CTA
atacagccatgtcttaaaaa

SEQ ID NO: 284321 - DNA, 20 bp, Artificial Sequence
  Description of Artificial Sequence: Synthetic oligonucleotide
  Target: ATXN1; (+) strand; PAM type: YTN; PAM sequence: CTT
aaaaaattcttaaacatgtt

SEQ ID NO: 284322 - DNA, 20 bp, Artificial Sequence
  Description of Artificial Sequence: Synthetic oligonucleotide
  Target: ATXN1; (+) strand; PAM type: YTN; PAM sequence: TTA
aaaaattcttaaacatgttt

SEQ ID NO: 284323 - DNA, 20 bp, Artificial Sequence
  Description of Artificial Sequence: Synthetic oligonucleotide
  Target: ATXN1; (+) strand; PAM type: YTN; PAM sequence: TTC
ttaaacatgtttacctgttc

SEQ ID NO: 284324 - DNA, 20 bp, Artificial Sequence
  Description of Artificial Sequence: Synthetic oligonucleotide
  Target: ATXN1; (+) strand; PAM type: YTN; PAM sequence: CTT
aaacatgtttacctgttcac

SEQ ID NO: 284325 - DNA, 20 bp, Artificial Sequence
  Description of Artificial Sequence: Synthetic oligonucleotide
  Target: ATXN1; (+) strand; PAM type: YTN; PAM sequence: TTA
aacatgtttacctgttcaca

SEQ ID NO: 284326 - DNA, 20 bp, Artificial Sequence
  Description of Artificial Sequence: Synthetic oligonucleotide
  Target: ATXN1; (+) strand; PAM type: YTN; PAM sequence: TTT
acctgttcacaaagtctaca

SEQ ID NO: 284327 - DNA, 20 bp, Artificial Sequence
  Description of Artificial Sequence: Synthetic oligonucleotide
  Target: ATXN1; (+) strand; PAM type: YTN; PAM sequence: TTA
cctgttcacaaagtctacat

SEQ ID NO: 284328 - DNA, 20 bp, Artificial Sequence
  Description of Artificial Sequence: Synthetic oligonucleotide
  Target: ATXN1; (+) strand; PAM type: YTN; PAM sequence: CTG
ttcacaaagtctacatacta

SEQ ID NO: 284329 - DNA, 20 bp, Artificial Sequence
  Description of Artificial Sequence: Synthetic oligonucleotide
  Target: ATXN1; (+) strand; PAM type: YTN; PAM sequence: TTC
acaaagtctacatactaata

SEQ ID NO: 284330 - DNA, 20 bp, Artificial Sequence
  Description of Artificial Sequence: Synthetic oligonucleotide
  Target: ATXN1; (+) strand; PAM type: YTN; PAM sequence: CTA
catactaatacagatcttag

SEQ ID NO: 284331 - DNA, 20 bp, Artificial Sequence
  Description of Artificial Sequence: Synthetic oligonucleotide
  Target: ATXN1; (+) strand; PAM type: YTN; PAM sequence: CTA
atacagatcttagaatcact

SEQ ID NO: 284332 - DNA, 20 bp, Artificial Sequence
  Description of Artificial Sequence: Synthetic oligonucleotide
  Target: ATXN1; (+) strand; PAM type: YTN; PAM sequence: CTT
agaatcactgcaacacaaaa

SEQ ID NO: 284333 - DNA, 20 bp, Artificial Sequence
  Description of Artificial Sequence: Synthetic oligonucleotide
  Target: ATXN1; (+) strand; PAM type: YTN; PAM sequence: TTA
gaatcactgcaacacaaaat

SEQ ID NO: 284334 - DNA, 20 bp, Artificial Sequence
  Description of Artificial Sequence: Synthetic oligonucleotide
  Target: ATXN1; (+) strand; PAM type: YTN; PAM sequence: CTG
caacacaaaatggatatgag

SEQ ID NO: 284335 - DNA, 20 bp, Artificial Sequence
  Description of Artificial Sequence: Synthetic oligonucleotide
  Target: ATXN1; (+) strand; PAM type: YTN; PAM sequence: TTA
tgtatgggtcccacaataac

SEQ ID NO: 284336 - DNA, 20 bp, Artificial Sequence
  Description of Artificial Sequence: Synthetic oligonucleotide
  Target: ATXN1; (+) strand; PAM type: YTN; PAM sequence: CTC
tccttttgtatatgtgtagg

SEQ ID NO: 284337 - DNA, 20 bp, Artificial Sequence
  Description of Artificial Sequence: Synthetic oligonucleotide
  Target: ATXN1; (+) strand; PAM type: YTN; PAM sequence: CTC
cttttgtatatgtgtaggca

SEQ ID NO: 284338 - DNA, 20 bp, Artificial Sequence
  Description of Artificial Sequence: Synthetic oligonucleotide
  Target: ATXN1; (+) strand; PAM type: YTN; PAM sequence: CTT
ttgtatatgtgtaggcattt

SEQ ID NO: 284339 - DNA, 20 bp, Artificial Sequence
  Description of Artificial Sequence: Synthetic oligonucleotide
  Target: ATXN1; (+) strand; PAM type: YTN; PAM sequence: TTT
tgtatatgtgtaggcattta

SEQ ID NO: 284340 - DNA, 20 bp, Artificial Sequence
  Description of Artificial Sequence: Synthetic oligonucleotide
  Target: ATXN1; (+) strand; PAM type: YTN; PAM sequence: TTT
gtatatgtgtaggcatttat

SEQ ID NO: 284341 - DNA, 20 bp, Artificial Sequence
  Description of Artificial Sequence: Synthetic oligonucleotide
  Target: ATXN1; (+) strand; PAM type: YTN; PAM sequence: TTG
tatatgtgtaggcatttatt

SEQ ID NO: 284342 - DNA, 20 bp, Artificial Sequence
  Description of Artificial Sequence: Synthetic oligonucleotide
  Target: ATXN1; (+) strand; PAM type: YTN; PAM sequence: TTT
atttgcactatttttgttat

SEQ ID NO: 284343 - DNA, 20 bp, Artificial Sequence
  Description of Artificial Sequence: Synthetic oligonucleotide
  Target: ATXN1; (+) strand; PAM type: YTN; PAM sequence: TTA
tttgcactatttttgttatg

SEQ ID NO: 284344 - DNA, 20 bp, Artificial Sequence
  Description of Artificial Sequence: Synthetic oligonucleotide
  Target: ATXN1; (+) strand; PAM type: YTN; PAM sequence: TTT
gcactatttttgttatgcct

SEQ ID NO: 284345 - DNA, 20 bp, Artificial Sequence
  Description of Artificial Sequence: Synthetic oligonucleotide
  Target: ATXN1; (+) strand; PAM type: YTN; PAM sequence: TTG
cactatttttgttatgcctc

SEQ ID NO: 284346 - DNA, 20 bp, Artificial Sequence
  Description of Artificial Sequence: Synthetic oligonucleotide
  Target: ATXN1; (+) strand; PAM type: YTN; PAM sequence: CTA
tttttgttatgcctctgcct

SEQ ID NO: 284347 - DNA, 20 bp, Artificial Sequence
  Description of Artificial Sequence: Synthetic oligonucleotide
  Target: ATXN1; (+) strand; PAM type: YTN; PAM sequence: TTT
ttgttatgcctctgcctttg

SEQ ID NO: 284348 - DNA, 20 bp, Artificial Sequence
  Description of Artificial Sequence: Synthetic oligonucleotide
  Target: ATXN1; (+) strand; PAM type: YTN; PAM sequence: TTT
tgttatgcctctgcctttgc

SEQ ID NO: 284349 - DNA, 20 bp, Artificial Sequence
  Description of Artificial Sequence: Synthetic oligonucleotide
  Target: ATXN1; (+) strand; PAM type: YTN; PAM sequence: TTT
gttatgcctctgcctttgca

SEQ ID NO: 284350 - DNA, 20 bp, Artificial Sequence
  Description of Artificial Sequence: Synthetic oligonucleotide
  Target: ATXN1; (+) strand; PAM type: YTN; PAM sequence: TTG
ttatgcctctgcctttgcat

SEQ ID NO: 284351 - DNA, 20 bp, Artificial Sequence
  Description of Artificial Sequence: Synthetic oligonucleotide
  Target: ATXN1; (+) strand; PAM type: YTN; PAM sequence: TTA
tgcctctgcctttgcatatg

SEQ ID NO: 284352 - DNA, 20 bp, Artificial Sequence
  Description of Artificial Sequence: Synthetic oligonucleotide
  Target: ATXN1; (+) strand; PAM type: YTN; PAM sequence: CTC
tgcctttgcatatgacactc

SEQ ID NO: 284353 - DNA, 20 bp, Artificial Sequence
  Description of Artificial Sequence: Synthetic oligonucleotide
  Target: ATXN1; (+) strand; PAM type: YTN; PAM sequence: CTG
cctttgcatatgacactccc

SEQ ID NO: 284354 - DNA, 20 bp, Artificial Sequence
  Description of Artificial Sequence: Synthetic oligonucleotide
  Target: ATXN1; (+) strand; PAM type: YTN; PAM sequence: CTT
tgcatatgacactccctttg

SEQ ID NO: 284355 - DNA, 20 bp, Artificial Sequence
  Description of Artificial Sequence: Synthetic oligonucleotide
  Target: ATXN1; (+) strand; PAM type: YTN; PAM sequence: TTT
gcatatgacactccctttga

SEQ ID NO: 284356 - DNA, 20 bp, Artificial Sequence
  Description of Artificial Sequence: Synthetic oligonucleotide
  Target: ATXN1; (+) strand; PAM type: YTN; PAM sequence: TTG
catatgacactccctttgat

SEQ ID NO: 284357 - DNA, 20 bp, Artificial Sequence
  Description of Artificial Sequence: Synthetic oligonucleotide
  Target: ATXN1; (+) strand; PAM type: YTN; PAM sequence: CTC
cctttgattaacatgctttg

SEQ ID NO: 284358 - DNA, 20 bp, Artificial Sequence
  Description of Artificial Sequence: Synthetic oligonucleotide
  Target: ATXN1; (+) strand; PAM type: YTN; PAM sequence: CTT
tgattaacatgctttgcctc

SEQ ID NO: 284359 - DNA, 20 bp, Artificial Sequence
  Description of Artificial Sequence: Synthetic oligonucleotide
  Target: ATXN1; (+) strand; PAM type: YTN; PAM sequence: TTT
gattaacatgctttgcctct

SEQ ID NO: 284360 - DNA, 20 bp, Artificial Sequence
  Description of Artificial Sequence: Synthetic oligonucleotide
  Target: ATXN1; (+) strand; PAM type: YTN; PAM sequence: TTG
attaacatgctttgcctctc

SEQ ID NO: 284361 - DNA, 20 bp, Artificial Sequence
  Description of Artificial Sequence: Synthetic oligonucleotide
  Target: ATXN1; (+) strand; PAM type: YTN; PAM sequence: TTA
acatgctttgcctctccttg

SEQ ID NO: 284362 - DNA, 20 bp, Artificial Sequence
  Description of Artificial Sequence: Synthetic oligonucleotide
  Target: ATXN1; (+) strand; PAM type: YTN; PAM sequence: CTT
tgcctctccttgccatttag

SEQ ID NO: 284363 - DNA, 20 bp, Artificial Sequence
  Description of Artificial Sequence: Synthetic oligonucleotide
  Target: ATXN1; (+) strand; PAM type: YTN; PAM sequence: TTT
gcctctccttgccatttaga

SEQ ID NO: 284364 - DNA, 20 bp, Artificial Sequence
  Description of Artificial Sequence: Synthetic oligonucleotide
  Target: ATXN1; (+) strand; PAM type: YTN; PAM sequence: TTG
cctctccttgccatttagaa

SEQ ID NO: 284365 - DNA, 20 bp, Artificial Sequence
  Description of Artificial Sequence: Synthetic oligonucleotide
  Target: ATXN1; (+) strand; PAM type: YTN; PAM sequence: CTC
tccttgccatttagaaaatt

SEQ ID NO: 284366 - DNA, 20 bp, Artificial Sequence
  Description of Artificial Sequence: Synthetic oligonucleotide
  Target: ATXN1; (+) strand; PAM type: YTN; PAM sequence: CTC
cttgccatttagaaaattcc

SEQ ID NO: 284367 - DNA, 20 bp, Artificial Sequence
  Description of Artificial Sequence: Synthetic oligonucleotide
  Target: ATXN1; (+) strand; PAM type: YTN; PAM sequence: CTT
gccatttagaaaattcctac

SEQ ID NO: 284368 - DNA, 20 bp, Artificial Sequence
  Description of Artificial Sequence: Synthetic oligonucleotide
  Target: ATXN1; (+) strand; PAM type: YTN; PAM sequence: TTG
ccatttagaaaattcctact

SEQ ID NO: 284369 - DNA, 20 bp, Artificial Sequence
  Description of Artificial Sequence: Synthetic oligonucleotide
  Target: ATXN1; (+) strand; PAM type: YTN; PAM sequence: TTT
agaaaattcctactcatttt

SEQ ID NO: 284370 - DNA, 20 bp, Artificial Sequence
  Description of Artificial Sequence: Synthetic oligonucleotide
  Target: ATXN1; (+) strand; PAM type: YTN; PAM sequence: TTA
gaaaattcctactcattttt

SEQ ID NO: 284371 - DNA, 20 bp, Artificial Sequence
  Description of Artificial Sequence: Synthetic oligonucleotide
  Target: ATXN1; (+) strand; PAM type: YTN; PAM sequence: TTC
ctactcatttttcagctgga

SEQ ID NO: 284372 - DNA, 20 bp, Artificial Sequence
  Description of Artificial Sequence: Synthetic oligonucleotide
  Target: ATXN1; (+) strand; PAM type: YTN; PAM sequence: CTA
ctcatttttcagctggacac

SEQ ID NO: 284373 - DNA, 20 bp, Artificial Sequence
  Description of Artificial Sequence: Synthetic oligonucleotide
  Target: ATXN1; (+) strand; PAM type: YTN; PAM sequence: CTC
atttttcagctggacacagt

SEQ ID NO: 284374 - DNA, 20 bp, Artificial Sequence
  Description of Artificial Sequence: Synthetic oligonucleotide
  Target: ATXN1; (+) strand; PAM type: YTN; PAM sequence: TTT
ttcagctggacacagtggct

SEQ ID NO: 284375 - DNA, 20 bp, Artificial Sequence
  Description of Artificial Sequence: Synthetic oligonucleotide
  Target: ATXN1; (+) strand; PAM type: YTN; PAM sequence: TTT
tcagctggacacagtggctc

SEQ ID NO: 284376 - DNA, 20 bp, Artificial Sequence
  Description of Artificial Sequence: Synthetic oligonucleotide
  Target: ATXN1; (+) strand; PAM type: YTN; PAM sequence: TTT
cagctggacacagtggctca

SEQ ID NO: 284377 - DNA, 20 bp, Artificial Sequence
  Description of Artificial Sequence: Synthetic oligonucleotide
  Target: ATXN1; (+) strand; PAM type: YTN; PAM sequence: TTC
agctggacacagtggctcat

SEQ ID NO: 284378 - DNA, 20 bp, Artificial Sequence
  Description of Artificial Sequence: Synthetic oligonucleotide
  Target: ATXN1; (+) strand; PAM type: YTN; PAM sequence: CTG
gacacagtggctcatgcctg

SEQ ID NO: 284379 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaaatccagcact

SEQ ID NO: 284380 - DNA, 20 bp, Artificial Sequence
  Description of Artificial Sequence: Synthetic oligonucleotide
  Target: ATXN1; (+) strand; PAM type: YTN; PAM sequence: CTG
taaatccagcactttggggg

SEQ ID NO: 284381 - DNA, 20 bp, Artificial Sequence
  Description of Artificial Sequence: Synthetic oligonucleotide
  Target: ATXN1; (+) strand; PAM type: YTN; PAM sequence: CTT
tggggggccaaggcgggagg

SEQ ID NO: 284382 - DNA, 20 bp, Artificial Sequence
  Description of Artificial Sequence: Synthetic oligonucleotide
  Target: ATXN1; (+) strand; PAM type: YTN; PAM sequence: TTT
ggggggccaaggcgggagga

SEQ ID NO: 284383 - DNA, 20 bp, Artificial Sequence
  Description of Artificial Sequence: Synthetic oligonucleotide
  Target: ATXN1; (+) strand; PAM type: YTN; PAM sequence: TTG
gggggccaaggcgggaggat

SEQ ID NO: 284384 - DNA, 20 bp, Artificial Sequence
  Description of Artificial Sequence: Synthetic oligonucleotide
  Target: ATXN1; (+) strand; PAM type: YTN; PAM sequence: CTG
aggtcaggagttcgagacca

SEQ ID NO: 284385 - DNA, 20 bp, Artificial Sequence
  Description of Artificial Sequence: Synthetic oligonucleotide
  Target: ATXN1; (+) strand; PAM type: YTN; PAM sequence: TTC
gagaccagcctggccaacat

SEQ ID NO: 284386 - DNA, 20 bp, Artificial Sequence
  Description of Artificial Sequence: Synthetic oligonucleotide
  Target: ATXN1; (+) strand; PAM type: YTN; PAM sequence: CTG
gccaacatggtgaaacccca

SEQ ID NO: 284387 - DNA, 20 bp, Artificial Sequence
  Description of Artificial Sequence: Synthetic oligonucleotide
  Target: ATXN1; (+) strand; PAM type: YTN; PAM sequence: CTA
tactaaaaaaaaaaactagc

SEQ ID NO: 284388 - DNA, 20 bp, Artificial Sequence
  Description of Artificial Sequence: Synthetic oligonucleotide
  Target: ATXN1; (+) strand; PAM type: YTN; PAM sequence: CTA
aaaaaaaaaactagccaggc

SEQ ID NO: 284389 - DNA, 20 bp, Artificial Sequence
  Description of Artificial Sequence: Synthetic oligonucleotide
  Target: ATXN1; (+) strand; PAM type: YTN; PAM sequence: CTA
gccaggcatggtggtgggcg

SEQ ID NO: 284390 - DNA, 20 bp, Artificial Sequence
  Description of Artificial Sequence: Synthetic oligonucleotide
  Target: ATXN1; (+) strand; PAM type: YTN; PAM sequence: CTG
taatcccagtgacccgggag

SEQ ID NO: 284391 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcgcttgaa

SEQ ID NO: 284392 - DNA, 20 bp, Artificial Sequence
  Description of Artificial Sequence: Synthetic oligonucleotide
  Target: ATXN1; (+) strand; PAM type: YTN; PAM sequence: CTT
gaacctgggaggcagaggtt

SEQ ID NO: 284393 - DNA, 20 bp, Artificial Sequence
  Description of Artificial Sequence: Synthetic oligonucleotide
  Target: ATXN1; (+) strand; PAM type: YTN; PAM sequence: TTG
aacctgggaggcagaggttg

SEQ ID NO: 284394 - DNA, 20 bp, Artificial Sequence
  Description of Artificial Sequence: Synthetic oligonucleotide
  Target: ATXN1; (+) strand; PAM type: YTN; PAM sequence: CTG
ggaggcagaggttgcagtaa

SEQ ID NO: 284395 - DNA, 20 bp, Artificial Sequence
  Description of Artificial Sequence: Synthetic oligonucleotide
  Target: ATXN1; (+) strand; PAM type: YTN; PAM sequence: TTG
cagtaagctgagatcgtgcc

SEQ ID NO: 284396 - DNA, 20 bp, Artificial Sequence
  Description of Artificial Sequence: Synthetic oligonucleotide
  Target: ATXN1; (+) strand; PAM type: YTN; PAM sequence: CTG
agatcgtgccattgcactac

SEQ ID NO: 284397 - DNA, 20 bp, Artificial Sequence
  Description of Artificial Sequence: Synthetic oligonucleotide
  Target: ATXN1; (+) strand; PAM type: YTN; PAM sequence: TTG
cactacagcctgggcatcaa

SEQ ID NO: 284398 - DNA, 20 bp, Artificial Sequence
  Description of Artificial Sequence: Synthetic oligonucleotide
  Target: ATXN1; (+) strand; PAM type: YTN; PAM sequence: CTA
cagcctgggcatcaacagcg

SEQ ID NO: 284399 - DNA, 20 bp, Artificial Sequence
  Description of Artificial Sequence: Synthetic oligonucleotide
  Target: ATXN1; (+) strand; PAM type: YTN; PAM sequence: CTG
ggcatcaacagcggaactct

SEQ ID NO: 284400 - DNA, 20 bp, Artificial Sequence
  Description of Artificial Sequence: Synthetic oligonucleotide
  Target: ATXN1; (+) strand; PAM type: YTN; PAM sequence: CTC
tgtctaaaaaaaaaaaaaaa

SEQ ID NO: 284401 - DNA, 20 bp, Artificial Sequence
  Description of Artificial Sequence: Synthetic oligonucleotide
  Target: ATXN1; (+) strand; PAM type: YTN; PAM sequence: CTG
tctaaaaaaaaaaaaaaaga

SEQ ID NO: 284402 - DNA, 20 bp, Artificial Sequence
  Description of Artificial Sequence: Synthetic oligonucleotide
  Target: ATXN1; (+) strand; PAM type: YTN; PAM sequence: CTA
aaaaaaaaaaaaaagaaaat

SEQ ID NO: 284403 - DNA, 20 bp, Artificial Sequence
  Description of Artificial Sequence: Synthetic oligonucleotide
  Target: ATXN1; (+) strand; PAM type: YTN; PAM sequence: TTC
ctactcatttttcaaggcca

SEQ ID NO: 284404 - DNA, 20 bp, Artificial Sequence
  Description of Artificial Sequence: Synthetic oligonucleotide
  Target: ATXN1; (+) strand; PAM type: YTN; PAM sequence: CTA
ctcatttttcaaggccaacc

SEQ ID NO: 284405 - DNA, 20 bp, Artificial Sequence
  Description of Artificial Sequence: Synthetic oligonucleotide
  Target: ATXN1; (+) strand; PAM type: YTN; PAM sequence: CTC
atttttcaaggccaaccttg

SEQ ID NO: 284406 - DNA, 20 bp, Artificial Sequence
  Description of Artificial Sequence: Synthetic oligonucleotide
  Target: ATXN1; (+) strand; PAM type: YTN; PAM sequence: TTT
ttcaaggccaaccttgagct

SEQ ID NO: 284407 - DNA, 20 bp, Artificial Sequence
  Description of Artificial Sequence: Synthetic oligonucleotide
  Target: ATXN1; (+) strand; PAM type: YTN; PAM sequence: TTT
tcaaggccaaccttgagctt

SEQ ID NO: 284408 - DNA, 20 bp, Artificial Sequence
  Description of Artificial Sequence: Synthetic oligonucleotide
  Target: ATXN1; (+) strand; PAM type: YTN; PAM sequence: TTT
caaggccaaccttgagctta

SEQ ID NO: 284409 - DNA, 20 bp, Artificial Sequence
  Description of Artificial Sequence: Synthetic oligonucleotide
  Target: ATXN1; (+) strand; PAM type: YTN; PAM sequence: TTC
aaggccaaccttgagcttaa

SEQ ID NO: 284410 - DNA, 20 bp, Artificial Sequence
  Description of Artificial Sequence: Synthetic oligonucleotide
  Target: ATXN1; (+) strand; PAM type: YTN; PAM sequence: CTT
gagcttaaatagcttaaatt

SEQ ID NO: 284411 - DNA, 20 bp, Artificial Sequence
  Description of Artificial Sequence: Synthetic oligonucleotide
  Target: ATXN1; (+) strand; PAM type: YTN; PAM sequence: TTG
agcttaaatagcttaaattc

SEQ ID NO: 284412 - DNA, 20 bp, Artificial Sequence
  Description of Artificial Sequence: Synthetic oligonucleotide
  Target: ATXN1; (+) strand; PAM type: YTN; PAM sequence: CTT
aaatagcttaaattccattg

SEQ ID NO: 284413 - DNA, 20 bp, Artificial Sequence
  Description of Artificial Sequence: Synthetic oligonucleotide
  Target: ATXN1; (+) strand; PAM type: YTN; PAM sequence: TTA
aatagcttaaattccattgt

SEQ ID NO: 284414 - DNA, 20 bp, Artificial Sequence
  Description of Artificial Sequence: Synthetic oligonucleotide
  Target: ATXN1; (+) strand; PAM type: YTN; PAM sequence: CTT
aaattccattgtgatgtcat

SEQ ID NO: 284415 - DNA, 20 bp, Artificial Sequence
  Description of Artificial Sequence: Synthetic oligonucleotide
  Target: ATXN1; (+) strand; PAM type: YTN; PAM sequence: TTA
aattccattgtgatgtcatc

SEQ ID NO: 284416 - DNA, 20 bp, Artificial Sequence
  Description of Artificial Sequence: Synthetic oligonucleotide
  Target: ATXN1; (+) strand; PAM type: YTN; PAM sequence: TTC
cattgtgatgtcatcctcat

SEQ ID NO: 284417 - DNA, 20 bp, Artificial Sequence
  Description of Artificial Sequence: Synthetic oligonucleotide
  Target: ATXN1; (+) strand; PAM type: YTN; PAM sequence: TTG
tgatgtcatcctcatctatc

SEQ ID NO: 284418 - DNA, 20 bp, Artificial Sequence
  Description of Artificial Sequence: Synthetic oligonucleotide
  Target: ATXN1; (+) strand; PAM type: YTN; PAM sequence: CTC
atctatcccctaatgttttc

SEQ ID NO: 284419 - DNA, 20 bp, Artificial Sequence
  Description of Artificial Sequence: Synthetic oligonucleotide
  Target: ATXN1; (+) strand; PAM type: YTN; PAM sequence: CTA
tcccctaatgttttctggaa

SEQ ID NO: 284420 - DNA, 20 bp, Artificial Sequence
  Description of Artificial Sequence: Synthetic oligonucleotide
  Target: ATXN1; (+) strand; PAM type: YTN; PAM sequence: CTA
atgttttctggaaatctaag

SEQ ID NO: 284421 - DNA, 20 bp, Artificial Sequence
  Description of Artificial Sequence: Synthetic oligonucleotide
  Target: ATXN1; (+) strand; PAM type: YTN; PAM sequence: TTT
tctggaaatctaagcagaat

SEQ ID NO: 284422 - DNA, 20 bp, Artificial Sequence
  Description of Artificial Sequence: Synthetic oligonucleotide
  Target: ATXN1; (+) strand; PAM type: YTN; PAM sequence: TTT
ctggaaatctaagcagaata

SEQ ID NO: 284423 - DNA, 20 bp, Artificial Sequence
  Description of Artificial Sequence: Synthetic oligonucleotide
  Target: ATXN1; (+) strand; PAM type: YTN; PAM sequence: TTC
tggaaatctaagcagaatag

SEQ ID NO: 284424 - DNA, 20 bp, Artificial Sequence
  Description of Artificial Sequence: Synthetic oligonucleotide
  Target: ATXN1; (+) strand; PAM type: YTN; PAM sequence: CTG
gaaatctaagcagaatagat

SEQ ID NO: 284425 - DNA, 20 bp, Artificial Sequence
  Description of Artificial Sequence: Synthetic oligonucleotide
  Target: ATXN1; (+) strand; PAM type: YTN; PAM sequence: CTA
agcagaatagattctgcctc

SEQ ID NO: 284426 - DNA, 20 bp, Artificial Sequence
  Description of Artificial Sequence: Synthetic oligonucleotide
  Target: ATXN1; (+) strand; PAM type: YTN; PAM sequence: TTC
tgcctcacctacgtttccta

SEQ ID NO: 284427 - DNA, 20 bp, Artificial Sequence
  Description of Artificial Sequence: Synthetic oligonucleotide
  Target: ATXN1; (+) strand; PAM type: YTN; PAM sequence: CTG
cctcacctacgtttcctagc

SEQ ID NO: 284428 - DNA, 20 bp, Artificial Sequence
  Description of Artificial Sequence: Synthetic oligonucleotide
  Target: ATXN1; (+) strand; PAM type: YTN; PAM sequence: CTC
acctacgtttcctagctcag

SEQ ID NO: 284429 - DNA, 20 bp, Artificial Sequence
  Description of Artificial Sequence: Synthetic oligonucleotide
  Target: ATXN1; (+) strand; PAM type: YTN; PAM sequence: CTA
cgtttcctagctcagtgatg

SEQ ID NO: 284430 - DNA, 20 bp, Artificial Sequence
  Description of Artificial Sequence: Synthetic oligonucleotide
  Target: ATXN1; (+) strand; PAM type: YTN; PAM sequence: TTT
cctagctcagtgatggcatc

SEQ ID NO: 284431 - DNA, 20 bp, Artificial Sequence
  Description of Artificial Sequence: Synthetic oligonucleotide
  Target: ATXN1; (+) strand; PAM type: YTN; PAM sequence: TTC
ctagctcagtgatggcatca

SEQ ID NO: 284432 - DNA, 20 bp, Artificial Sequence
  Description of Artificial Sequence: Synthetic oligonucleotide
  Target: ATXN1; (+) strand; PAM type: YTN; PAM sequence: CTA
gctcagtgatggcatcaaca

SEQ ID NO: 284433 - DNA, 20 bp, Artificial Sequence
  Description of Artificial Sequence: Synthetic oligonucleotide
  Target: ATXN1; (+) strand; PAM type: YTN; PAM sequence: CTC
agtgatggcatcaacatcac

SEQ ID NO: 284434 - DNA, 20 bp, Artificial Sequence
  Description of Artificial Sequence: Synthetic oligonucleotide
  Target: ATXN1; (+) strand; PAM type: YTN; PAM sequence: CTC
tgacgtcttcctctcccaaa

SEQ ID NO: 284435 - DNA, 20 bp, Artificial Sequence
  Description of Artificial Sequence: Synthetic oligonucleotide
  Target: ATXN1; (+) strand; PAM type: YTN; PAM sequence: CTG
acgtcttcctctcccaaatt

SEQ ID NO: 284436 - DNA, 20 bp, Artificial Sequence
  Description of Artificial Sequence: Synthetic oligonucleotide
  Target: ATXN1; (+) strand; PAM type: YTN; PAM sequence: CTT
cctctcccaaattatgcccc

SEQ ID NO: 284437 - DNA, 20 bp, Artificial Sequence
  Description of Artificial Sequence: Synthetic oligonucleotide
  Target: ATXN1; (+) strand; PAM type: YTN; PAM sequence: TTC
ctctcccaaattatgcccca

SEQ ID NO: 284438 - DNA, 20 bp, Artificial Sequence
  Description of Artificial Sequence: Synthetic oligonucleotide
  Target: ATXN1; (+) strand; PAM type: YTN; PAM sequence: CTC
tcccaaattatgccccatat

SEQ ID NO: 284439 - DNA, 20 bp, Artificial Sequence
  Description of Artificial Sequence: Synthetic oligonucleotide
  Target: ATXN1; (+) strand; PAM type: YTN; PAM sequence: CTC
ccaaattatgccccatattc

SEQ ID NO: 284440 - DNA, 20 bp, Artificial Sequence
  Description of Artificial Sequence: Synthetic oligonucleotide
  Target: ATXN1; (+) strand; PAM type: YTN; PAM sequence: TTA
tgccccatattcaaccatgc

SEQ ID NO: 284441 - DNA, 20 bp, Artificial Sequence
  Description of Artificial Sequence: Synthetic oligonucleotide
  Target: ATXN1; (+) strand; PAM type: YTN; PAM sequence: TTC
aaccatgcagccatactcct

SEQ ID NO: 284442 - DNA, 20 bp, Artificial Sequence
  Description of Artificial Sequence: Synthetic oligonucleotide
  Target: ATXN1; (+) strand; PAM type: YTN; PAM sequence: CTC
ctcaactccctccgctcctc

SEQ ID NO: 284443 - DNA, 20 bp, Artificial Sequence
  Description of Artificial Sequence: Synthetic oligonucleotide
  Target: ATXN1; (+) strand; PAM type: YTN; PAM sequence: CTC
aactccctccgctcctctcc

SEQ ID NO: 284444 - DNA, 20 bp, Artificial Sequence
  Description of Artificial Sequence: Synthetic oligonucleotide
  Target: ATXN1; (+) strand; PAM type: YTN; PAM sequence: CTC
cctccgctcctctccggcac

SEQ ID NO: 284445 - DNA, 20 bp, Artificial Sequence
  Description of Artificial Sequence: Synthetic oligonucleotide
  Target: ATXN1; (+) strand; PAM type: YTN; PAM sequence: CTC
cgctcctctccggcaccacc

SEQ ID NO: 284446 - DNA, 20 bp, Artificial Sequence
  Description of Artificial Sequence: Synthetic oligonucleotide
  Target: ATXN1; (+) strand; PAM type: YTN; PAM sequence: CTC
ctctccggcaccaccctggc

SEQ ID NO: 284447 - DNA, 20 bp, Artificial Sequence
  Description of Artificial Sequence: Synthetic oligonucleotide
  Target: ATXN1; (+) strand; PAM type: YTN; PAM sequence: CTC
tccggcaccaccctggctca

SEQ ID NO: 284448 - DNA, 20 bp, Artificial Sequence
  Description of Artificial Sequence: Synthetic oligonucleotide
  Target: ATXN1; (+) strand; PAM type: YTN; PAM sequence: CTC
cggcaccaccctggctcatc

SEQ ID NO: 284449 - DNA, 20 bp, Artificial Sequence
  Description of Artificial Sequence: Synthetic oligonucleotide
  Target: ATXN1; (+) strand; PAM type: YTN; PAM sequence: CTG
gctcatctggactctttccc

SEQ ID NO: 284450 - DNA, 20 bp, Artificial Sequence
  Description of Artificial Sequence: Synthetic oligonucleotide
  Target: ATXN1; (+) strand; PAM type: YTN; PAM sequence: CTC
atctggactctttccctggc

SEQ ID NO: 284451 - DNA, 20 bp, Artificial Sequence
  Description of Artificial Sequence: Synthetic oligonucleotide
  Target: ATXN1; (+) strand; PAM type: YTN; PAM sequence: CTG
gactctttccctggccccct

SEQ ID NO: 284452 - DNA, 20 bp, Artificial Sequence
  Description of Artificial Sequence: Synthetic oligonucleotide
  Target: ATXN1; (+) strand; PAM type: YTN; PAM sequence: CTC
tttccctggccccctaacac

SEQ ID NO: 284453 - DNA, 20 bp, Artificial Sequence
  Description of Artificial Sequence: Synthetic oligonucleotide
  Target: ATXN1; (+) strand; PAM type: YTN; PAM sequence: CTT
tccctggccccctaacacgt

SEQ ID NO: 284454 - DNA, 20 bp, Artificial Sequence
  Description of Artificial Sequence: Synthetic oligonucleotide
  Target: ATXN1; (+) strand; PAM type: YTN; PAM sequence: TTT
ccctggccccctaacacgtc

SEQ ID NO: 284455 - DNA, 20 bp, Artificial Sequence
  Description of Artificial Sequence: Synthetic oligonucleotide
  Target: ATXN1; (+) strand; PAM type: YTN; PAM sequence: TTC
cctggccccctaacacgtct

SEQ ID NO: 284456 - DNA, 20 bp, Artificial Sequence
  Description of Artificial Sequence: Synthetic oligonucleotide
  Target: ATXN1; (+) strand; PAM type: YTN; PAM sequence: CTG
gccccctaacacgtctcccc

SEQ ID NO: 284457 - DNA, 20 bp, Artificial Sequence
  Description of Artificial Sequence: Synthetic oligonucleotide
  Target: ATXN1; (+) strand; PAM type: YTN; PAM sequence: CTA
acacgtctccccgcgtccac

SEQ ID NO: 284458 - DNA, 20 bp, Artificial Sequence
  Description of Artificial Sequence: Synthetic oligonucleotide
  Target: ATXN1; (+) strand; PAM type: YTN; PAM sequence: CTC
cccgcgtccaccctgccacc

SEQ ID NO: 284459 - DNA, 20 bp, Artificial Sequence
  Description of Artificial Sequence: Synthetic oligonucleotide
  Target: ATXN1; (+) strand; PAM type: YTN; PAM sequence: CTG
ccaccctactaccttccttg

SEQ ID NO: 284460 - DNA, 20 bp, Artificial Sequence
  Description of Artificial Sequence: Synthetic oligonucleotide
  Target: ATXN1; (+) strand; PAM type: YTN; PAM sequence: CTA
ctaccttccttggctcctgc

SEQ ID NO: 284461 - DNA, 20 bp, Artificial Sequence
  Description of Artificial Sequence: Synthetic oligonucleotide
  Target: ATXN1; (+) strand; PAM type: YTN; PAM sequence: CTA
ccttccttggctcctgccta

SEQ ID NO: 284462 - DNA, 20 bp, Artificial Sequence
  Description of Artificial Sequence: Synthetic oligonucleotide
  Target: ATXN1; (+) strand; PAM type: YTN; PAM sequence: CTT
ccttggctcctgcctaaggc

SEQ ID NO: 284463 - DNA, 20 bp, Artificial Sequence
  Description of Artificial Sequence: Synthetic oligonucleotide
  Target: ATXN1; (+) strand; PAM type: YTN; PAM sequence: TTC
cttggctcctgcctaaggca

SEQ ID NO: 284464 - DNA, 20 bp, Artificial Sequence
  Description of Artificial Sequence: Synthetic oligonucleotide
  Target: ATXN1; (+) strand; PAM type: YTN; PAM sequence: CTT
ggctcctgcctaaggcattg

SEQ ID NO: 284465 - DNA, 20 bp, Artificial Sequence
  Description of Artificial Sequence: Synthetic oligonucleotide
  Target: ATXN1; (+) strand; PAM type: YTN; PAM sequence: TTG
gctcctgcctaaggcattgc

SEQ ID NO: 284466 - DNA, 20 bp, Artificial Sequence
  Description of Artificial Sequence: Synthetic oligonucleotide
  Target: ATXN1; (+) strand; PAM type: YTN; PAM sequence: CTC
ctgcctaaggcattgcagtg

SEQ ID NO: 284467 - DNA, 20 bp, Artificial Sequence
  Description of Artificial Sequence: Synthetic oligonucleotide
  Target: ATXN1; (+) strand; PAM type: YTN; PAM sequence: CTG
cctaaggcattgcagtggct

SEQ ID NO: 284468 - DNA, 20 bp, Artificial Sequence
  Description of Artificial Sequence: Synthetic oligonucleotide
  Target: ATXN1; (+) strand; PAM type: YTN; PAM sequence: CTA
aggcattgcagtggctttcc

SEQ ID NO: 284469 - DNA, 20 bp, Artificial Sequence
  Description of Artificial Sequence: Synthetic oligonucleotide
  Target: ATXN1; (+) strand; PAM type: YTN; PAM sequence: TTG
cagtggctttccatttctaa

SEQ ID NO: 284470 - DNA, 20 bp, Artificial Sequence
  Description of Artificial Sequence: Synthetic oligonucleotide
  Target: ATXN1; (+) strand; PAM type: YTN; PAM sequence: CTT
tccatttctaaacatggccc

SEQ ID NO: 284471 - DNA, 20 bp, Artificial Sequence
  Description of Artificial Sequence: Synthetic oligonucleotide
  Target: ATXN1; (+) strand; PAM type: YTN; PAM sequence: TTT
ccatttctaaacatggcccc

SEQ ID NO: 284472 - DNA, 20 bp, Artificial Sequence
  Description of Artificial Sequence: Synthetic oligonucleotide
  Target: ATXN1; (+) strand; PAM type: YTN; PAM sequence: TTC
catttctaaacatggccccc

SEQ ID NO: 284473 - DNA, 20 bp, Artificial Sequence
  Description of Artificial Sequence: Synthetic oligonucleotide
  Target: ATXN1; (+) strand; PAM type: YTN; PAM sequence: TTT
ctaaacatggcccccaaaac

SEQ ID NO: 284474 - DNA, 20 bp, Artificial Sequence
  Description of Artificial Sequence: Synthetic oligonucleotide
  Target: ATXN1; (+) strand; PAM type: YTN; PAM sequence: TTC
taaacatggcccccaaaacc

SEQ ID NO: 284475 - DNA, 20 bp, Artificial Sequence
  Description of Artificial Sequence: Synthetic oligonucleotide
  Target: ATXN1; (+) strand; PAM type: YTN; PAM sequence: CTA
aacatggcccccaaaacctg

SEQ ID NO: 284476 - DNA, 20 bp, Artificial Sequence
  Description of Artificial Sequence: Synthetic oligonucleotide
  Target: ATXN1; (+) strand; PAM type: YTN; PAM sequence: CTG
cattctcttccaacttgcac

SEQ ID NO: 284477 - DNA, 20 bp, Artificial Sequence
  Description of Artificial Sequence: Synthetic oligonucleotide
  Target: ATXN1; (+) strand; PAM type: YTN; PAM sequence: TTC
tcttccaacttgcactacag

SEQ ID NO: 284478 - DNA, 20 bp, Artificial Sequence
  Description of Artificial Sequence: Synthetic oligonucleotide
  Target: ATXN1; (+) strand; PAM type: YTN; PAM sequence: CTC
ttccaacttgcactacagca

SEQ ID NO: 284479 - DNA, 20 bp, Artificial Sequence
  Description of Artificial Sequence: Synthetic oligonucleotide
  Target: ATXN1; (+) strand; PAM type: YTN; PAM sequence: CTT
ccaacttgcactacagcatg

SEQ ID NO: 284480 - DNA, 20 bp, Artificial Sequence
  Description of Artificial Sequence: Synthetic oligonucleotide
  Target: ATXN1; (+) strand; PAM type: YTN; PAM sequence: TTC
caacttgcactacagcatgg

SEQ ID NO: 284481 - DNA, 20 bp, Artificial Sequence
  Description of Artificial Sequence: Synthetic oligonucleotide
  Target: ATXN1; (+) strand; PAM type: YTN; PAM sequence: CTT
gcactacagcatggctggct

SEQ ID NO: 284482 - DNA, 20 bp, Artificial Sequence
  Description of Artificial Sequence: Synthetic oligonucleotide
  Target: ATXN1; (+) strand; PAM type: YTN; PAM sequence: TTG
cactacagcatggctggctt

SEQ ID NO: 284483 - DNA, 20 bp, Artificial Sequence
  Description of Artificial Sequence: Synthetic oligonucleotide
  Target: ATXN1; (+) strand; PAM type: YTN; PAM sequence: CTA
cagcatggctggcttacttt

SEQ ID NO: 284484 - DNA, 20 bp, Artificial Sequence
  Description of Artificial Sequence: Synthetic oligonucleotide
  Target: ATXN1; (+) strand; PAM type: YTN; PAM sequence: CTG
gcttactttcaattccttaa

SEQ ID NO: 284485 - DNA, 20 bp, Artificial Sequence
  Description of Artificial Sequence: Synthetic oligonucleotide
  Target: ATXN1; (+) strand; PAM type: YTN; PAM sequence: CTT
actttcaattccttaaaagg

SEQ ID NO: 284486 - DNA, 20 bp, Artificial Sequence
  Description of Artificial Sequence: Synthetic oligonucleotide
  Target: ATXN1; (+) strand; PAM type: YTN; PAM sequence: TTA
ctttcaattccttaaaagga

SEQ ID NO: 284487 - DNA, 20 bp, Artificial Sequence
  Description of Artificial Sequence: Synthetic oligonucleotide
  Target: ATXN1; (+) strand; PAM type: YTN; PAM sequence: CTT
tcaattccttaaaaggacct

SEQ ID NO: 284488 - DNA, 20 bp, Artificial Sequence
  Description of Artificial Sequence: Synthetic oligonucleotide
  Target: ATXN1; (+) strand; PAM type: YTN; PAM sequence: TTT
caattccttaaaaggacctt

SEQ ID NO: 284489 - DNA, 20 bp, Artificial Sequence
  Description of Artificial Sequence: Synthetic oligonucleotide
  Target: ATXN1; (+) strand; PAM type: YTN; PAM sequence: TTC
aattccttaaaaggaccttg

SEQ ID NO: 284490 - DNA, 20 bp, Artificial Sequence
  Description of Artificial Sequence: Synthetic oligonucleotide
  Target: ATXN1; (+) strand; PAM type: YTN; PAM sequence: TTC
cttaaaaggaccttgctttc

SEQ ID NO: 284491 - DNA, 20 bp, Artificial Sequence
  Description of Artificial Sequence: Synthetic oligonucleotide
  Target: ATXN1; (+) strand; PAM type: YTN; PAM sequence: CTT
aaaaggaccttgctttccca

SEQ ID NO: 284492 - DNA, 20 bp, Artificial Sequence
  Description of Artificial Sequence: Synthetic oligonucleotide
  Target: ATXN1; (+) strand; PAM type: YTN; PAM sequence: TTA
aaaggaccttgctttcccag

SEQ ID NO: 284493 - DNA, 20 bp, Artificial Sequence
  Description of Artificial Sequence: Synthetic oligonucleotide
  Target: ATXN1; (+) strand; PAM type: YTN; PAM sequence: CTT
gctttcccaggccttaaagc

SEQ ID NO: 284494 - DNA, 20 bp, Artificial Sequence
  Description of Artificial Sequence: Synthetic oligonucleotide
  Target: ATXN1; (+) strand; PAM type: YTN; PAM sequence: TTG
ctttcccaggccttaaagcc

SEQ ID NO: 284495 - DNA, 20 bp, Artificial Sequence
  Description of Artificial Sequence: Synthetic oligonucleotide
  Target: ATXN1; (+) strand; PAM type: YTN; PAM sequence: CTT
tcccaggccttaaagccttt

SEQ ID NO: 284496 - DNA, 20 bp, Artificial Sequence
  Description of Artificial Sequence: Synthetic oligonucleotide
  Target: ATXN1; (+) strand; PAM type: YTN; PAM sequence: TTT
cccaggccttaaagcctttg

SEQ ID NO: 284497 - DNA, 20 bp, Artificial Sequence
  Description of Artificial Sequence: Synthetic oligonucleotide
  Target: ATXN1; (+) strand; PAM type: YTN; PAM sequence: TTC
ccaggccttaaagcctttgc

SEQ ID NO: 284498 - DNA, 20 bp, Artificial Sequence
  Description of Artificial Sequence: Synthetic oligonucleotide
  Target: ATXN1; (+) strand; PAM type: YTN; PAM sequence: CTT
aaagcctttgcacatgactt

SEQ ID NO: 284499 - DNA, 20 bp, Artificial Sequence
  Description of Artificial Sequence: Synthetic oligonucleotide
  Target: ATXN1; (+) strand; PAM type: YTN; PAM sequence: TTA
aagcctttgcacatgacttc

SEQ ID NO: 284500 - DNA, 20 bp, Artificial Sequence
  Description of Artificial Sequence: Synthetic oligonucleotide
  Target: ATXN1; (+) strand; PAM type: YTN; PAM sequence: CTT
tgcacatgacttcctccttg

SEQ ID NO: 284501 - DNA, 20 bp, Artificial Sequence
  Description of Artificial Sequence: Synthetic oligonucleotide
  Target: ATXN1; (+) strand; PAM type: YTN; PAM sequence: TTT
gcacatgacttcctccttgc

SEQ ID NO: 284502 - DNA, 20 bp, Artificial Sequence
  Description of Artificial Sequence: Synthetic oligonucleotide
  Target: ATXN1; (+) strand; PAM type: YTN; PAM sequence: TTG
cacatgacttcctccttgct

SEQ ID NO: 284503 - DNA, 20 bp, Artificial Sequence
  Description of Artificial Sequence: Synthetic oligonucleotide
  Target: ATXN1; (+) strand; PAM type: YTN; PAM sequence: CTT
cctccttgctaagacttctc

SEQ ID NO: 284504 - DNA, 20 bp, Artificial Sequence
  Description of Artificial Sequence: Synthetic oligonucleotide
  Target: ATXN1; (+) strand; PAM type: YTN; PAM sequence: TTC
ctccttgctaagacttctcc

SEQ ID NO: 284505 - DNA, 20 bp, Artificial Sequence
  Description of Artificial Sequence: Synthetic oligonucleotide
  Target: ATXN1; (+) strand; PAM type: YTN; PAM sequence: CTC
cttgctaagacttctcctca

SEQ ID NO: 284506 - DNA, 20 bp, Artificial Sequence
  Description of Artificial Sequence: Synthetic oligonucleotide
  Target: ATXN1; (+) strand; PAM type: YTN; PAM sequence: CTT
gctaagacttctcctcaaat

SEQ ID NO: 284507 - DNA, 20 bp, Artificial Sequence
  Description of Artificial Sequence: Synthetic oligonucleotide
  Target: ATXN1; (+) strand; PAM type: YTN; PAM sequence: TTG
ctaagacttctcctcaaatc

SEQ ID NO: 284508 - DNA, 20 bp, Artificial Sequence
  Description of Artificial Sequence: Synthetic oligonucleotide
  Target: ATXN1; (+) strand; PAM type: YTN; PAM sequence: CTA
agacttctcctcaaatcacc

SEQ ID NO: 284509 - DNA, 20 bp, Artificial Sequence
  Description of Artificial Sequence: Synthetic oligonucleotide
  Target: ATXN1; (+) strand; PAM type: YTN; PAM sequence: CTT
ctcctcaaatcacccacccc

SEQ ID NO: 284510 - DNA, 20 bp, Artificial Sequence
  Description of Artificial Sequence: Synthetic oligonucleotide
  Target: ATXN1; (+) strand; PAM type: YTN; PAM sequence: TTC
tcctcaaatcacccacccct

SEQ ID NO: 284511 - DNA, 20 bp, Artificial Sequence
  Description of Artificial Sequence: Synthetic oligonucleotide
  Target: ATXN1; (+) strand; PAM type: YTN; PAM sequence: CTC
ctcaaatcacccaccccttc

SEQ ID NO: 284512 - DNA, 20 bp, Artificial Sequence
  Description of Artificial Sequence: Synthetic oligonucleotide
  Target: ATXN1; (+) strand; PAM type: YTN; PAM sequence: CTC
aaatcacccaccccttctat

SEQ ID NO: 284513 - DNA, 20 bp, Artificial Sequence
  Description of Artificial Sequence: Synthetic oligonucleotide
  Target: ATXN1; (+) strand; PAM type: YTN; PAM sequence: CTT
ctatcaaatgaccttgtatt

SEQ ID NO: 284514 - DNA, 20 bp, Artificial Sequence
  Description of Artificial Sequence: Synthetic oligonucleotide
  Target: ATXN1; (+) strand; PAM type: YTN; PAM sequence: TTC
tatcaaatgaccttgtattc

SEQ ID NO: 284515 - DNA, 20 bp, Artificial Sequence
  Description of Artificial Sequence: Synthetic oligonucleotide
  Target: ATXN1; (+) strand; PAM type: YTN; PAM sequence: CTA
tcaaatgaccttgtattctt

SEQ ID NO: 284516 - DNA, 20 bp, Artificial Sequence
  Description of Artificial Sequence: Synthetic oligonucleotide
  Target: ATXN1; (+) strand; PAM type: YTN; PAM sequence: CTT
gtattcttttctccttcagc

SEQ ID NO: 284517 - DNA, 20 bp, Artificial Sequence
  Description of Artificial Sequence: Synthetic oligonucleotide
  Target: ATXN1; (+) strand; PAM type: YTN; PAM sequence: TTG
tattcttttctccttcagct

SEQ ID NO: 284518 - DNA, 20 bp, Artificial Sequence
  Description of Artificial Sequence: Synthetic oligonucleotide
  Target: ATXN1; (+) strand; PAM type: YTN; PAM sequence: TTC
ttttctccttcagctctcag

SEQ ID NO: 284519 - DNA, 20 bp, Artificial Sequence
  Description of Artificial Sequence: Synthetic oligonucleotide
  Target: ATXN1; (+) strand; PAM type: YTN; PAM sequence: CTT
ttctccttcagctctcagct

SEQ ID NO: 284520 - DNA, 20 bp, Artificial Sequence
  Description of Artificial Sequence: Synthetic oligonucleotide
  Target: ATXN1; (+) strand; PAM type: YTN; PAM sequence: TTT
tctccttcagctctcagctc

SEQ ID NO: 284521 - DNA, 20 bp, Artificial Sequence
  Description of Artificial Sequence: Synthetic oligonucleotide
  Target: ATXN1; (+) strand; PAM type: YTN; PAM sequence: TTT
ctccttcagctctcagctca

SEQ ID NO: 284522 - DNA, 20 bp, Artificial Sequence
  Description of Artificial Sequence: Synthetic oligonucleotide
  Target: ATXN1; (+) strand; PAM type: YTN; PAM sequence: TTC
tccttcagctctcagctcag

SEQ ID NO: 284523 - DNA, 20 bp, Artificial Sequence
  Description of Artificial Sequence: Synthetic oligonucleotide
  Target: ATXN1; (+) strand; PAM type: YTN; PAM sequence: CTC
cttcagctctcagctcagtc

SEQ ID NO: 284524 - DNA, 20 bp, Artificial Sequence
  Description of Artificial Sequence: Synthetic oligonucleotide
  Target: ATXN1; (+) strand; PAM type: YTN; PAM sequence: CTT
cagctctcagctcagtcctc

SEQ ID NO: 284525 - DNA, 20 bp, Artificial Sequence
  Description of Artificial Sequence: Synthetic oligonucleotide
  Target: ATXN1; (+) strand; PAM type: YTN; PAM sequence: TTC
agctctcagctcagtcctct

SEQ ID NO: 284526 - DNA, 20 bp, Artificial Sequence
  Description of Artificial Sequence: Synthetic oligonucleotide
  Target: ATXN1; (+) strand; PAM type: YTN; PAM sequence: CTC
tcagctcagtcctcttctca

SEQ ID NO: 284527 - DNA, 20 bp, Artificial Sequence
  Description of Artificial Sequence: Synthetic oligonucleotide
  Target: ATXN1; (+) strand; PAM type: YTN; PAM sequence: CTC
agctcagtcctcttctcaag

SEQ ID NO: 284528 - DNA, 20 bp, Artificial Sequence
  Description of Artificial Sequence: Synthetic oligonucleotide
  Target: ATXN1; (+) strand; PAM type: YTN; PAM sequence: CTC
agtcctcttctcaagggaga

SEQ ID NO: 284529 - DNA, 20 bp, Artificial Sequence
  Description of Artificial Sequence: Synthetic oligonucleotide
  Target: ATXN1; (+) strand; PAM type: YTN; PAM sequence: CTC
ttctcaagggagacttcctc

SEQ ID NO: 284530 - DNA, 20 bp, Artificial Sequence
  Description of Artificial Sequence: Synthetic oligonucleotide
  Target: ATXN1; (+) strand; PAM type: YTN; PAM sequence: CTT
ctcaagggagacttcctcag

SEQ ID NO: 284531 - DNA, 20 bp, Artificial Sequence
  Description of Artificial Sequence: Synthetic oligonucleotide
  Target: ATXN1; (+) strand; PAM type: YTN; PAM sequence: TTC
tcaagggagacttcctcagc

SEQ ID NO: 284532 - DNA, 20 bp, Artificial Sequence
  Description of Artificial Sequence: Synthetic oligonucleotide
  Target: ATXN1; (+) strand; PAM type: YTN; PAM sequence: CTC
aagggagacttcctcagcca

SEQ ID NO: 284533 - DNA, 20 bp, Artificial Sequence
  Description of Artificial Sequence: Synthetic oligonucleotide
  Target: ATXN1; (+) strand; PAM type: YTN; PAM sequence: CTT
cctcagccaggtcaccacct

SEQ ID NO: 284534 - DNA, 20 bp, Artificial Sequence
  Description of Artificial Sequence: Synthetic oligonucleotide
  Target: ATXN1; (+) strand; PAM type: YTN; PAM sequence: TTC
ctcagccaggtcaccacctc

SEQ ID NO: 284535 - DNA, 20 bp, Artificial Sequence
  Description of Artificial Sequence: Synthetic oligonucleotide
  Target: ATXN1; (+) strand; PAM type: YTN; PAM sequence: CTC
agccaggtcaccacctccta

SEQ ID NO: 284536 - DNA, 20 bp, Artificial Sequence
  Description of Artificial Sequence: Synthetic oligonucleotide
  Target: ATXN1; (+) strand; PAM type: YTN; PAM sequence: CTC
ctaggacacacttgtataga

SEQ ID NO: 284537 - DNA, 20 bp, Artificial Sequence
  Description of Artificial Sequence: Synthetic oligonucleotide
  Target: ATXN1; (+) strand; PAM type: YTN; PAM sequence: CTA
ggacacacttgtatagaatg

SEQ ID NO: 284538 - DNA, 20 bp, Artificial Sequence
  Description of Artificial Sequence: Synthetic oligonucleotide
  Target: ATXN1; (+) strand; PAM type: YTN; PAM sequence: CTT
gtatagaatgaccctccctg

SEQ ID NO: 284539 - DNA, 20 bp, Artificial Sequence
  Description of Artificial Sequence: Synthetic oligonucleotide
  Target: ATXN1; (+) strand; PAM type: YTN; PAM sequence: TTG
tatagaatgaccctccctgg

SEQ ID NO: 284540 - DNA, 20 bp, Artificial Sequence
  Description of Artificial Sequence: Synthetic oligonucleotide
  Target: ATXN1; (+) strand; PAM type: YTN; PAM sequence: CTC
cctggttatagtagtcattt

SEQ ID NO: 284541 - DNA, 20 bp, Artificial Sequence
  Description of Artificial Sequence: Synthetic oligonucleotide
  Target: ATXN1; (+) strand; PAM type: YTN; PAM sequence: CTG
gttatagtagtcattttgta

SEQ ID NO: 284542 - DNA, 20 bp, Artificial Sequence
  Description of Artificial Sequence: Synthetic oligonucleotide
  Target: ATXN1; (+) strand; PAM type: YTN; PAM sequence: TTA
tagtagtcattttgtaactt

SEQ ID NO: 284543 - DNA, 20 bp, Artificial Sequence
  Description of Artificial Sequence: Synthetic oligonucleotide
  Target: ATXN1; (+) strand; PAM type: YTN; PAM sequence: TTT
tgtaacttttacattttttg

SEQ ID NO: 284544 - DNA, 20 bp, Artificial Sequence
  Description of Artificial Sequence: Synthetic oligonucleotide
  Target: ATXN1; (+) strand; PAM type: YTN; PAM sequence: TTT
gtaacttttacattttttgg

SEQ ID NO: 284545 - DNA, 20 bp, Artificial Sequence
  Description of Artificial Sequence: Synthetic oligonucleotide
  Target: ATXN1; (+) strand; PAM type: YTN; PAM sequence: TTG
taacttttacattttttggt

SEQ ID NO: 284546 - DNA, 20 bp, Artificial Sequence
  Description of Artificial Sequence: Synthetic oligonucleotide
  Target: ATXN1; (+) strand; PAM type: YTN; PAM sequence: CTT
ttacattttttggttgattc

SEQ ID NO: 284547 - DNA, 20 bp, Artificial Sequence
  Description of Artificial Sequence: Synthetic oligonucleotide
  Target: ATXN1; (+) strand; PAM type: YTN; PAM sequence: TTT
tacattttttggttgattca

SEQ ID NO: 284548 - DNA, 20 bp, Artificial Sequence
  Description of Artificial Sequence: Synthetic oligonucleotide
  Target: ATXN1; (+) strand; PAM type: YTN; PAM sequence: TTT
acattttttggttgattcat

SEQ ID NO: 284549 - DNA, 20 bp, Artificial Sequence
  Description of Artificial Sequence: Synthetic oligonucleotide
  Target: ATXN1; (+) strand; PAM type: YTN; PAM sequence: TTA
cattttttggttgattcatt

SEQ ID NO: 284550 - DNA, 20 bp, Artificial Sequence
  Description of Artificial Sequence: Synthetic oligonucleotide
  Target: ATXN1; (+) strand; PAM type: YTN; PAM sequence: TTT
tttggttgattcattgatta

SEQ ID NO: 284551 - DNA, 20 bp, Artificial Sequence
  Description of Artificial Sequence: Synthetic oligonucleotide
  Target: ATXN1; (+) strand; PAM type: YTN; PAM sequence: TTT
ttggttgattcattgattaa

SEQ ID NO: 284552 - DNA, 20 bp, Artificial Sequence
  Description of Artificial Sequence: Synthetic oligonucleotide
  Target: ATXN1; (+) strand; PAM type: YTN; PAM sequence: TTT
tggttgattcattgattaat

SEQ ID NO: 284553 - DNA, 20 bp, Artificial Sequence
  Description of Artificial Sequence: Synthetic oligonucleotide
  Target: ATXN1; (+) strand; PAM type: YTN; PAM sequence: TTT
ggttgattcattgattaatg

SEQ ID NO: 284554 - DNA, 20 bp, Artificial Sequence
  Description of Artificial Sequence: Synthetic oligonucleotide
  Target: ATXN1; (+) strand; PAM type: YTN; PAM sequence: TTG
gttgattcattgattaatgc

SEQ ID NO: 284555 - DNA, 20 bp, Artificial Sequence
  Description of Artificial Sequence: Synthetic oligonucleotide
  Target: ATXN1; (+) strand; PAM type: YTN; PAM sequence: TTG
attcattgattaatgcttgt

SEQ ID NO: 284556 - DNA, 20 bp, Artificial Sequence
  Description of Artificial Sequence: Synthetic oligonucleotide
  Target: ATXN1; (+) strand; PAM type: YTN; PAM sequence: TTC
attgattaatgcttgttttc

SEQ ID NO: 284557 - DNA, 20 bp, Artificial Sequence
  Description of Artificial Sequence: Synthetic oligonucleotide
  Target: ATXN1; (+) strand; PAM type: YTN; PAM sequence: TTG
attaatgcttgttttccccc

SEQ ID NO: 284558 - DNA, 20 bp, Artificial Sequence
  Description of Artificial Sequence: Synthetic oligonucleotide
  Target: ATXN1; (+) strand; PAM type: YTN; PAM sequence: TTA
atgcttgttttcccccacga

SEQ ID NO: 284559 - DNA, 20 bp, Artificial Sequence
  Description of Artificial Sequence: Synthetic oligonucleotide
  Target: ATXN1; (+) strand; PAM type: YTN; PAM sequence: CTT
gttttcccccacgaatcaat

SEQ ID NO: 284560 - DNA, 20 bp, Artificial Sequence
  Description of Artificial Sequence: Synthetic oligonucleotide
  Target: ATXN1; (+) strand; PAM type: YTN; PAM sequence: TTG
ttttcccccacgaatcaata

SEQ ID NO: 284561 - DNA, 20 bp, Artificial Sequence
  Description of Artificial Sequence: Synthetic oligonucleotide
  Target: ATXN1; (+) strand; PAM type: YTN; PAM sequence: TTT
tcccccacgaatcaataaac

SEQ ID NO: 284562 - DNA, 20 bp, Artificial Sequence
  Description of Artificial Sequence: Synthetic oligonucleotide
  Target: ATXN1; (+) strand; PAM type: YTN; PAM sequence: TTT
cccccacgaatcaataaact

SEQ ID NO: 284563 - DNA, 20 bp, Artificial Sequence
  Description of Artificial Sequence: Synthetic oligonucleotide
  Target: ATXN1; (+) strand; PAM type: YTN; PAM sequence: TTC
ccccacgaatcaataaactc

SEQ ID NO: 284564 - DNA, 20 bp, Artificial Sequence
  Description of Artificial Sequence: Synthetic oligonucleotide
  Target: ATXN1; (+) strand; PAM type: YTN; PAM sequence: CTC
cagaaagggagaactgtgtc

SEQ ID NO: 284565 - DNA, 20 bp, Artificial Sequence
  Description of Artificial Sequence: Synthetic oligonucleotide
  Target: ATXN1; (+) strand; PAM type: YTN; PAM sequence: CTG
tgtccactctcacccctcct

SEQ ID NO: 284566 - DNA, 20 bp, Artificial Sequence
  Description of Artificial Sequence: Synthetic oligonucleotide
  Target: ATXN1; (+) strand; PAM type: YTN; PAM sequence: CTC
tcacccctcctttcatcttt

SEQ ID NO: 284567 - DNA, 20 bp, Artificial Sequence
  Description of Artificial Sequence: Synthetic oligonucleotide
  Target: ATXN1; (+) strand; PAM type: YTN; PAM sequence: CTC
acccctcctttcatctttgg

SEQ ID NO: 284568 - DNA, 20 bp, Artificial Sequence
  Description of Artificial Sequence: Synthetic oligonucleotide
  Target: ATXN1; (+) strand; PAM type: YTN; PAM sequence: CTC
ctttcatctttgggattcaa

SEQ ID NO: 284569 - DNA, 20 bp, Artificial Sequence
  Description of Artificial Sequence: Synthetic oligonucleotide
  Target: ATXN1; (+) strand; PAM type: YTN; PAM sequence: CTT
tcatctttgggattcaatgg

SEQ ID NO: 284570 - DNA, 20 bp, Artificial Sequence
  Description of Artificial Sequence: Synthetic oligonucleotide
  Target: ATXN1; (+) strand; PAM type: YTN; PAM sequence: TTT
catctttgggattcaatgga

SEQ ID NO: 284571 - DNA, 20 bp, Artificial Sequence
  Description of Artificial Sequence: Synthetic oligonucleotide
  Target: ATXN1; (+) strand; PAM type: YTN; PAM sequence: TTC
atctttgggattcaatggaa

SEQ ID NO: 284572 - DNA, 20 bp, Artificial Sequence
  Description of Artificial Sequence: Synthetic oligonucleotide
  Target: ATXN1; (+) strand; PAM type: YTN; PAM sequence: CTT
tgggattcaatggaaagctt

SEQ ID NO: 284573 - DNA, 20 bp, Artificial Sequence
  Description of Artificial Sequence: Synthetic oligonucleotide
  Target: ATXN1; (+) strand; PAM type: YTN; PAM sequence: TTT
gggattcaatggaaagcttt

SEQ ID NO: 284574 - DNA, 20 bp, Artificial Sequence
  Description of Artificial Sequence: Synthetic oligonucleotide
  Target: ATXN1; (+) strand; PAM type: YTN; PAM sequence: TTG
ggattcaatggaaagctttg

SEQ ID NO: 284575 - DNA, 20 bp, Artificial Sequence
  Description of Artificial Sequence: Synthetic oligonucleotide
  Target: ATXN1; (+) strand; PAM type: YTN; PAM sequence: TTC
aatggaaagctttgcacatt

SEQ ID NO: 284576 - DNA, 20 bp, Artificial Sequence
  Description of Artificial Sequence: Synthetic oligonucleotide
  Target: ATXN1; (+) strand; PAM type: YTN; PAM sequence: CTT
tgcacattatgggcactcaa

SEQ ID NO: 284577 - DNA, 20 bp, Artificial Sequence
  Description of Artificial Sequence: Synthetic oligonucleotide
  Target: ATXN1; (+) strand; PAM type: YTN; PAM sequence: TTT
gcacattatgggcactcaat

SEQ ID NO: 284578 - DNA, 20 bp, Artificial Sequence
  Description of Artificial Sequence: Synthetic oligonucleotide
  Target: ATXN1; (+) strand; PAM type: YTN; PAM sequence: TTG
cacattatgggcactcaata

SEQ ID NO: 284579 - DNA, 20 bp, Artificial Sequence
  Description of Artificial Sequence: Synthetic oligonucleotide
  Target: ATXN1; (+) strand; PAM type: YTN; PAM sequence: TTA
tgggcactcaataaaatctt

SEQ ID NO: 284580 - DNA, 20 bp, Artificial Sequence
  Description of Artificial Sequence: Synthetic oligonucleotide
  Target: ATXN1; (+) strand; PAM type: YTN; PAM sequence: CTC
aataaaatcttctgagtgaa

SEQ ID NO: 284581 - DNA, 20 bp, Artificial Sequence
  Description of Artificial Sequence: Synthetic oligonucleotide
  Target: ATXN1; (+) strand; PAM type: YTN; PAM sequence: CTT
ctgagtgaataaatgagcca

SEQ ID NO: 284582 - DNA, 20 bp, Artificial Sequence
  Description of Artificial Sequence: Synthetic oligonucleotide
  Target: ATXN1; (+) strand; PAM type: YTN; PAM sequence: TTC
tgagtgaataaatgagccaa

SEQ ID NO: 284583 - DNA, 20 bp, Artificial Sequence
  Description of Artificial Sequence: Synthetic oligonucleotide
  Target: ATXN1; (+) strand; PAM type: YTN; PAM sequence: CTG
agtgaataaatgagccaaag

SEQ ID NO: 284584 - DNA, 20 bp, Artificial Sequence
  Description of Artificial Sequence: Synthetic oligonucleotide
  Target: ATXN1; (+) strand; PAM type: YTN; PAM sequence: CTT
aatcatactgatttaattag

SEQ ID NO: 284585 - DNA, 20 bp, Artificial Sequence
  Description of Artificial Sequence: Synthetic oligonucleotide
  Target: ATXN1; (+) strand; PAM type: YTN; PAM sequence: TTA
atcatactgatttaattagt

SEQ ID NO: 284586 - DNA, 20 bp, Artificial Sequence
  Description of Artificial Sequence: Synthetic oligonucleotide
  Target: ATXN1; (+) strand; PAM type: YTN; PAM sequence: CTG
atttaattagtgttgattgg

SEQ ID NO: 284587 - DNA, 20 bp, Artificial Sequence
  Description of Artificial Sequence: Synthetic oligonucleotide
  Target: ATXN1; (+) strand; PAM type: YTN; PAM sequence: TTT
aattagtgttgattggattc

SEQ ID NO: 284588 - DNA, 20 bp, Artificial Sequence
  Description of Artificial Sequence: Synthetic oligonucleotide
  Target: ATXN1; (+) strand; PAM type: YTN; PAM sequence: TTA
attagtgttgattggattca

SEQ ID NO: 284589 - DNA, 20 bp, Artificial Sequence
  Description of Artificial Sequence: Synthetic oligonucleotide
  Target: ATXN1; (+) strand; PAM type: YTN; PAM sequence: TTA
gtgttgattggattcatctg

SEQ ID NO: 284590 - DNA, 20 bp, Artificial Sequence
  Description of Artificial Sequence: Synthetic oligonucleotide
  Target: ATXN1; (+) strand; PAM type: YTN; PAM sequence: TTG
attggattcatctgtaaatc

SEQ ID NO: 284591 - DNA, 20 bp, Artificial Sequence
  Description of Artificial Sequence: Synthetic oligonucleotide
  Target: ATXN1; (+) strand; PAM type: YTN; PAM sequence: TTG
gattcatctgtaaatcgttt

SEQ ID NO: 284592 - DNA, 20 bp, Artificial Sequence
  Description of Artificial Sequence: Synthetic oligonucleotide
  Target: ATXN1; (+) strand; PAM type: YTN; PAM sequence: TTC
atctgtaaatcgttttccag

SEQ ID NO: 284593 - DNA, 20 bp, Artificial Sequence
  Description of Artificial Sequence: Synthetic oligonucleotide
  Target: ATXN1; (+) strand; PAM type: YTN; PAM sequence: CTG
taaatcgttttccagcacac

SEQ ID NO: 284594 - DNA, 20 bp, Artificial Sequence
  Description of Artificial Sequence: Synthetic oligonucleotide
  Target: ATXN1; (+) strand; PAM type: YTN; PAM sequence: TTT
tccagcacacagagtatgac

SEQ ID NO: 284595 - DNA, 20 bp, Artificial Sequence
  Description of Artificial Sequence: Synthetic oligonucleotide
  Target: ATXN1; (+) strand; PAM type: YTN; PAM sequence: TTT
ccagcacacagagtatgaca

SEQ ID NO: 284596 - DNA, 20 bp, Artificial Sequence
  Description of Artificial Sequence: Synthetic oligonucleotide
  Target: ATXN1; (+) strand; PAM type: YTN; PAM sequence: TTC
cagcacacagagtatgacat

SEQ ID NO: 284597 - DNA, 20 bp, Artificial Sequence
  Description of Artificial Sequence: Synthetic oligonucleotide
  Target: ATXN1; (+) strand; PAM type: YTN; PAM sequence: CTA
cattcctttgggtaacatgc

SEQ ID NO: 284598 - DNA, 20 bp, Artificial Sequence
  Description of Artificial Sequence: Synthetic oligonucleotide
  Target: ATXN1; (+) strand; PAM type: YTN; PAM sequence: TTC
ctttgggtaacatgcaaggc

SEQ ID NO: 284599 - DNA, 20 bp, Artificial Sequence
  Description of Artificial Sequence: Synthetic oligonucleotide
  Target: ATXN1; (+) strand; PAM type: YTN; PAM sequence: CTT
tgggtaacatgcaaggctcc

SEQ ID NO: 284600 - DNA, 20 bp, Artificial Sequence
  Description of Artificial Sequence: Synthetic oligonucleotide
  Target: ATXN1; (+) strand; PAM type: YTN; PAM sequence: TTT
gggtaacatgcaaggctcct

SEQ ID NO: 284601 - DNA, 20 bp, Artificial Sequence
  Description of Artificial Sequence: Synthetic oligonucleotide
  Target: ATXN1; (+) strand; PAM type: YTN; PAM sequence: TTG
ggtaacatgcaaggctcctt

SEQ ID NO: 284602 - DNA, 20 bp, Artificial Sequence
  Description of Artificial Sequence: Synthetic oligonucleotide
  Target: ATXN1; (+) strand; PAM type: YTN; PAM sequence: CTC
cttgagctctgaccccagcc

SEQ ID NO: 284603 - DNA, 20 bp, Artificial Sequence
  Description of Artificial Sequence: Synthetic oligonucleotide
  Target: ATXN1; (+) strand; PAM type: YTN; PAM sequence: CTT
gagctctgaccccagccagc

SEQ ID NO: 284604 - DNA, 20 bp, Artificial Sequence
  Description of Artificial Sequence: Synthetic oligonucleotide
  Target: ATXN1; (+) strand; PAM type: YTN; PAM sequence: TTG
agctctgaccccagccagcc

SEQ ID NO: 284605 - DNA, 20 bp, Artificial Sequence
  Description of Artificial Sequence: Synthetic oligonucleotide
  Target: ATXN1; (+) strand; PAM type: YTN; PAM sequence: CTC
tgaccccagccagccgggtc

SEQ ID NO: 284606 - DNA, 20 bp, Artificial Sequence
  Description of Artificial Sequence: Synthetic oligonucleotide
  Target: ATXN1; (+) strand; PAM type: YTN; PAM sequence: CTG
accccagccagccgggtctc

SEQ ID NO: 284607 - DNA, 20 bp, Artificial Sequence
  Description of Artificial Sequence: Synthetic oligonucleotide
  Target: ATXN1; (+) strand; PAM type: YTN; PAM sequence: CTC
tcctcctgctgcacttgacc

SEQ ID NO: 284608 - DNA, 20 bp, Artificial Sequence
  Description of Artificial Sequence: Synthetic oligonucleotide
  Target: ATXN1; (+) strand; PAM type: YTN; PAM sequence: CTC
ctcctgctgcacttgaccct

SEQ ID NO: 284609 - DNA, 20 bp, Artificial Sequence
  Description of Artificial Sequence: Synthetic oligonucleotide
  Target: ATXN1; (+) strand; PAM type: YTN; PAM sequence: CTC
ctgctgcacttgaccctcag

SEQ ID NO: 284610 - DNA, 20 bp, Artificial Sequence
  Description of Artificial Sequence: Synthetic oligonucleotide
  Target: ATXN1; (+) strand; PAM type: YTN; PAM sequence: CTG
ctgcacttgaccctcagcac

SEQ ID NO: 284611 - DNA, 20 bp, Artificial Sequence
  Description of Artificial Sequence: Synthetic oligonucleotide
  Target: ATXN1; (+) strand; PAM type: YTN; PAM sequence: CTG
cacttgaccctcagcacctc

SEQ ID NO: 284612 - DNA, 20 bp, Artificial Sequence
  Description of Artificial Sequence: Synthetic oligonucleotide
  Target: ATXN1; (+) strand; PAM type: YTN; PAM sequence: CTT
gaccctcagcacctccaagt

SEQ ID NO: 284613 - DNA, 20 bp, Artificial Sequence
  Description of Artificial Sequence: Synthetic oligonucleotide
  Target: ATXN1; (+) strand; PAM type: YTN; PAM sequence: TTG
accctcagcacctccaagtc

SEQ ID NO: 284614 - DNA, 20 bp, Artificial Sequence
  Description of Artificial Sequence: Synthetic oligonucleotide
  Target: ATXN1; (+) strand; PAM type: YTN; PAM sequence: CTC
agcacctccaagtccctccc

SEQ ID NO: 284615 - DNA, 20 bp, Artificial Sequence
  Description of Artificial Sequence: Synthetic oligonucleotide
  Target: ATXN1; (+) strand; PAM type: YTN; PAM sequence: CTC
caagtccctccctgtagctc

SEQ ID NO: 284616 - DNA, 20 bp, Artificial Sequence
  Description of Artificial Sequence: Synthetic oligonucleotide
  Target: ATXN1; (+) strand; PAM type: YTN; PAM sequence: CTC
cctgtagctccctgacccca

SEQ ID NO: 284617 - DNA, 20 bp, Artificial Sequence
  Description of Artificial Sequence: Synthetic oligonucleotide
  Target: ATXN1; (+) strand; PAM type: YTN; PAM sequence: CTG
tagctccctgaccccatctt

SEQ ID NO: 284618 - DNA, 20 bp, Artificial Sequence
  Description of Artificial Sequence: Synthetic oligonucleotide
  Target: ATXN1; (+) strand; PAM type: YTN; PAM sequence: CTC
cctgaccccatcttgtttcc

SEQ ID NO: 284619 - DNA, 20 bp, Artificial Sequence
  Description of Artificial Sequence: Synthetic oligonucleotide
  Target: ATXN1; (+) strand; PAM type: YTN; PAM sequence: CTG
accccatcttgtttccctca

SEQ ID NO: 284620 - DNA, 20 bp, Artificial Sequence
  Description of Artificial Sequence: Synthetic oligonucleotide
  Target: ATXN1; (+) strand; PAM type: YTN; PAM sequence: CTT
gtttccctcatctccacacc

SEQ ID NO: 284621 - DNA, 20 bp, Artificial Sequence
  Description of Artificial Sequence: Synthetic oligonucleotide
  Target: ATXN1; (+) strand; PAM type: YTN; PAM sequence: TTG
tttccctcatctccacaccc

SEQ ID NO: 284622 - DNA, 20 bp, Artificial Sequence
  Description of Artificial Sequence: Synthetic oligonucleotide
  Target: ATXN1; (+) strand; PAM type: YTN; PAM sequence: TTT
ccctcatctccacacccttc

SEQ ID NO: 284623 - DNA, 20 bp, Artificial Sequence
  Description of Artificial Sequence: Synthetic oligonucleotide
  Target: ATXN1; (+) strand; PAM type: YTN; PAM sequence: TTC
cctcatctccacacccttct

SEQ ID NO: 284624 - DNA, 20 bp, Artificial Sequence
  Description of Artificial Sequence: Synthetic oligonucleotide
  Target: ATXN1; (+) strand; PAM type: YTN; PAM sequence: CTC
atctccacacccttctctct

SEQ ID NO: 284625 - DNA, 20 bp, Artificial Sequence
  Description of Artificial Sequence: Synthetic oligonucleotide
  Target: ATXN1; (+) strand; PAM type: YTN; PAM sequence: CTC
cacacccttctctcttctgt

SEQ ID NO: 284626 - DNA, 20 bp, Artificial Sequence
  Description of Artificial Sequence: Synthetic oligonucleotide
  Target: ATXN1; (+) strand; PAM type: YTN; PAM sequence: CTT
ctctcttctgttccccccac

SEQ ID NO: 284627 - DNA, 20 bp, Artificial Sequence
  Description of Artificial Sequence: Synthetic oligonucleotide
  Target: ATXN1; (+) strand; PAM type: YTN; PAM sequence: TTC
tctcttctgttccccccaca

SEQ ID NO: 284628 - DNA, 20 bp, Artificial Sequence
  Description of Artificial Sequence: Synthetic oligonucleotide
  Target: ATXN1; (+) strand; PAM type: YTN; PAM sequence: CTC
tcttctgttccccccacaca

SEQ ID NO: 284629 - DNA, 20 bp, Artificial Sequence
  Description of Artificial Sequence: Synthetic oligonucleotide
  Target: ATXN1; (+) strand; PAM type: YTN; PAM sequence: CTC
ttctgttccccccacacatc

SEQ ID NO: 284630 - DNA, 20 bp, Artificial Sequence
  Description of Artificial Sequence: Synthetic oligonucleotide
  Target: ATXN1; (+) strand; PAM type: YTN; PAM sequence: CTT
ctgttccccccacacatcat

SEQ ID NO: 284631 - DNA, 20 bp, Artificial Sequence
  Description of Artificial Sequence: Synthetic oligonucleotide
  Target: ATXN1; (+) strand; PAM type: YTN; PAM sequence: TTC
tgttccccccacacatcatc

SEQ ID NO: 284632 - DNA, 20 bp, Artificial Sequence
  Description of Artificial Sequence: Synthetic oligonucleotide
  Target: ATXN1; (+) strand; PAM type: YTN; PAM sequence: CTG
ttccccccacacatcatctt

SEQ ID NO: 284633 - DNA, 20 bp, Artificial Sequence
  Description of Artificial Sequence: Synthetic oligonucleotide
  Target: ATXN1; (+) strand; PAM type: YTN; PAM sequence: TTC
cccccacacatcatcttttc

SEQ ID NO: 284634 - DNA, 20 bp, Artificial Sequence
  Description of Artificial Sequence: Synthetic oligonucleotide
  Target: ATXN1; (+) strand; PAM type: YTN; PAM sequence: CTT
ttcaaactcactcagtcttc

SEQ ID NO: 284635 - DNA, 20 bp, Artificial Sequence
  Description of Artificial Sequence: Synthetic oligonucleotide
  Target: ATXN1; (+) strand; PAM type: YTN; PAM sequence: TTT
tcaaactcactcagtcttca

SEQ ID NO: 284636 - DNA, 20 bp, Artificial Sequence
  Description of Artificial Sequence: Synthetic oligonucleotide
  Target: ATXN1; (+) strand; PAM type: YTN; PAM sequence: TTT
caaactcactcagtcttcaa

SEQ ID NO: 284637 - DNA, 20 bp, Artificial Sequence
  Description of Artificial Sequence: Synthetic oligonucleotide
  Target: ATXN1; (+) strand; PAM type: YTN; PAM sequence: TTC
aaactcactcagtcttcaag

SEQ ID NO: 284638 - DNA, 20 bp, Artificial Sequence
  Description of Artificial Sequence: Synthetic oligonucleotide
  Target: ATXN1; (+) strand; PAM type: YTN; PAM sequence: CTC
actcagtcttcaagtctcag

SEQ ID NO: 284639 - DNA, 20 bp, Artificial Sequence
  Description of Artificial Sequence: Synthetic oligonucleotide
  Target: ATXN1; (+) strand; PAM type: YTN; PAM sequence: CTC
agtcttcaagtctcagggct

SEQ ID NO: 284640 - DNA, 20 bp, Artificial Sequence
  Description of Artificial Sequence: Synthetic oligonucleotide
  Target: ATXN1; (+) strand; PAM type: YTN; PAM sequence: CTT
caagtctcagggctggggac

SEQ ID NO: 284641 - DNA, 20 bp, Artificial Sequence
  Description of Artificial Sequence: Synthetic oligonucleotide
  Target: ATXN1; (+) strand; PAM type: YTN; PAM sequence: TTC
aagtctcagggctggggacg

SEQ ID NO: 284642 - DNA, 20 bp, Artificial Sequence
  Description of Artificial Sequence: Synthetic oligonucleotide
  Target: ATXN1; (+) strand; PAM type: YTN; PAM sequence: CTC
agggctggggacgcttctct

SEQ ID NO: 284643 - DNA, 20 bp, Artificial Sequence
  Description of Artificial Sequence: Synthetic oligonucleotide
  Target: ATXN1; (+) strand; PAM type: YTN; PAM sequence: CTG
gggacgcttctctgtgaaaa

SEQ ID NO: 284644 - DNA, 20 bp, Artificial Sequence
  Description of Artificial Sequence: Synthetic oligonucleotide
  Target: ATXN1; (+) strand; PAM type: YTN; PAM sequence: CTT
ctctgtgaaaaactccctga

SEQ ID NO: 284645 - DNA, 20 bp, Artificial Sequence
  Description of Artificial Sequence: Synthetic oligonucleotide
  Target: ATXN1; (+) strand; PAM type: YTN; PAM sequence: TTC
tctgtgaaaaactccctgac

SEQ ID NO: 284646 - DNA, 20 bp, Artificial Sequence
  Description of Artificial Sequence: Synthetic oligonucleotide
  Target: ATXN1; (+) strand; PAM type: YTN; PAM sequence: CTC
tgtgaaaaactccctgacac

SEQ ID NO: 284647 - DNA, 20 bp, Artificial Sequence
  Description of Artificial Sequence: Synthetic oligonucleotide
  Target: ATXN1; (+) strand; PAM type: YTN; PAM sequence: CTG
tgaaaaactccctgacacct

SEQ ID NO: 284648 - DNA, 20 bp, Artificial Sequence
  Description of Artificial Sequence: Synthetic oligonucleotide
  Target: ATXN1; (+) strand; PAM type: YTN; PAM sequence: CTC
cctgacaccttctgggaagt

SEQ ID NO: 284649 - DNA, 20 bp, Artificial Sequence
  Description of Artificial Sequence: Synthetic oligonucleotide
  Target: ATXN1; (+) strand; PAM type: YTN; PAM sequence: CTG
acaccttctgggaagtgggg

SEQ ID NO: 284650 - DNA, 20 bp, Artificial Sequence
  Description of Artificial Sequence: Synthetic oligonucleotide
  Target: ATXN1; (+) strand; PAM type: YTN; PAM sequence: CTT
ctgggaagtgggggcccttt

SEQ ID NO: 284651 - DNA, 20 bp, Artificial Sequence
  Description of Artificial Sequence: Synthetic oligonucleotide
  Target: ATXN1; (+) strand; PAM type: YTN; PAM sequence: TTC
tgggaagtgggggccctttt

SEQ ID NO: 284652 - DNA, 20 bp, Artificial Sequence
  Description of Artificial Sequence: Synthetic oligonucleotide
  Target: ATXN1; (+) strand; PAM type: YTN; PAM sequence: CTG
ggaagtgggggcccttttct

SEQ ID NO: 284653 - DNA, 20 bp, Artificial Sequence
  Description of Artificial Sequence: Synthetic oligonucleotide
  Target: ATXN1; (+) strand; PAM type: YTN; PAM sequence: CTT
ttctctcatttttctacaac

SEQ ID NO: 284654 - DNA, 20 bp, Artificial Sequence
  Description of Artificial Sequence: Synthetic oligonucleotide
  Target: ATXN1; (+) strand; PAM type: YTN; PAM sequence: TTT
tctctcatttttctacaacc

SEQ ID NO: 284655 - DNA, 20 bp, Artificial Sequence
  Description of Artificial Sequence: Synthetic oligonucleotide
  Target: ATXN1; (+) strand; PAM type: YTN; PAM sequence: TTT
ctctcatttttctacaaccc

SEQ ID NO: 284656 - DNA, 20 bp, Artificial Sequence
  Description of Artificial Sequence: Synthetic oligonucleotide
  Target: ATXN1; (+) strand; PAM type: YTN; PAM sequence: TTC
tctcatttttctacaacccc

SEQ ID NO: 284657 - DNA, 20 bp, Artificial Sequence
  Description of Artificial Sequence: Synthetic oligonucleotide
  Target: ATXN1; (+) strand; PAM type: YTN; PAM sequence: CTC
tcatttttctacaacccctg

SEQ ID NO: 284658 - DNA, 20 bp, Artificial Sequence
  Description of Artificial Sequence: Synthetic oligonucleotide
  Target: ATXN1; (+) strand; PAM type: YTN; PAM sequence: CTC
atttttctacaacccctgta

SEQ ID NO: 284659 - DNA, 20 bp, Artificial Sequence
  Description of Artificial Sequence: Synthetic oligonucleotide
  Target: ATXN1; (+) strand; PAM type: YTN; PAM sequence: TTT
ttctacaacccctgtaccta

SEQ ID NO: 284660 - DNA, 20 bp, Artificial Sequence
  Description of Artificial Sequence: Synthetic oligonucleotide
  Target: ATXN1; (+) strand; PAM type: YTN; PAM sequence: TTT
tctacaacccctgtacctat

SEQ ID NO: 284661 - DNA, 20 bp, Artificial Sequence
  Description of Artificial Sequence: Synthetic oligonucleotide
  Target: ATXN1; (+) strand; PAM type: YTN; PAM sequence: TTT
ctacaacccctgtacctatc

SEQ ID NO: 284662 - DNA, 20 bp, Artificial Sequence
  Description of Artificial Sequence: Synthetic oligonucleotide
  Target: ATXN1; (+) strand; PAM type: YTN; PAM sequence: TTC
tacaacccctgtacctatcc

SEQ ID NO: 284663 - DNA, 20 bp, Artificial Sequence
  Description of Artificial Sequence: Synthetic oligonucleotide
  Target: ATXN1; (+) strand; PAM type: YTN; PAM sequence: CTA
caacccctgtacctatccct

SEQ ID NO: 284664 - DNA, 20 bp, Artificial Sequence
  Description of Artificial Sequence: Synthetic oligonucleotide
  Target: ATXN1; (+) strand; PAM type: YTN; PAM sequence: CTG
tacctatccctattaaagca

SEQ ID NO: 284665 - DNA, 20 bp, Artificial Sequence
  Description of Artificial Sequence: Synthetic oligonucleotide
  Target: ATXN1; (+) strand; PAM type: YTN; PAM sequence: CTA
tccctattaaagcaattatc

SEQ ID NO: 284666 - DNA, 20 bp, Artificial Sequence
  Description of Artificial Sequence: Synthetic oligonucleotide
  Target: ATXN1; (+) strand; PAM type: YTN; PAM sequence: CTA
ttaaagcaattatcatattt

SEQ ID NO: 284667 - DNA, 20 bp, Artificial Sequence
  Description of Artificial Sequence: Synthetic oligonucleotide
  Target: ATXN1; (+) strand; PAM type: YTN; PAM sequence: TTA
aagcaattatcatattttcc

SEQ ID NO: 284668 - DNA, 20 bp, Artificial Sequence
  Description of Artificial Sequence: Synthetic oligonucleotide
  Target: ATXN1; (+) strand; PAM type: YTN; PAM sequence: TTA
tcatattttcctgtacttgt

SEQ ID NO: 284669 - DNA, 20 bp, Artificial Sequence
  Description of Artificial Sequence: Synthetic oligonucleotide
  Target: ATXN1; (+) strand; PAM type: YTN; PAM sequence: TTT
tcctgtacttgttccttaac

SEQ ID NO: 284670 - DNA, 20 bp, Artificial Sequence
  Description of Artificial Sequence: Synthetic oligonucleotide
  Target: ATXN1; (+) strand; PAM type: YTN; PAM sequence: TTT
cctgtacttgttccttaacc

SEQ ID NO: 284671 - DNA, 20 bp, Artificial Sequence
  Description of Artificial Sequence: Synthetic oligonucleotide
  Target: ATXN1; (+) strand; PAM type: YTN; PAM sequence: TTC
ctgtacttgttccttaacca

SEQ ID NO: 284672 - DNA, 20 bp, Artificial Sequence
  Description of Artificial Sequence: Synthetic oligonucleotide
  Target: ATXN1; (+) strand; PAM type: YTN; PAM sequence: CTG
tacttgttccttaaccaagt

SEQ ID NO: 284673 - DNA, 20 bp, Artificial Sequence
  Description of Artificial Sequence: Synthetic oligonucleotide
  Target: ATXN1; (+) strand; PAM type: YTN; PAM sequence: CTT
gttccttaaccaagtccatc

SEQ ID NO: 284674 - DNA, 20 bp, Artificial Sequence
  Description of Artificial Sequence: Synthetic oligonucleotide
  Target: ATXN1; (+) strand; PAM type: YTN; PAM sequence: TTG
ttccttaaccaagtccatct

SEQ ID NO: 284675 - DNA, 20 bp, Artificial Sequence
  Description of Artificial Sequence: Synthetic oligonucleotide
  Target: ATXN1; (+) strand; PAM type: YTN; PAM sequence: TTC
cttaaccaagtccatctctc

SEQ ID NO: 284676 - DNA, 20 bp, Artificial Sequence
  Description of Artificial Sequence: Synthetic oligonucleotide
  Target: ATXN1; (+) strand; PAM type: YTN; PAM sequence: CTT
aaccaagtccatctctccca

SEQ ID NO: 284677 - DNA, 20 bp, Artificial Sequence
  Description of Artificial Sequence: Synthetic oligonucleotide
  Target: ATXN1; (+) strand; PAM type: YTN; PAM sequence: TTA
accaagtccatctctcccac

SEQ ID NO: 284678 - DNA, 20 bp, Artificial Sequence
  Description of Artificial Sequence: Synthetic oligonucleotide
  Target: ATXN1; (+) strand; PAM type: YTN; PAM sequence: CTC
tcccaccacaacctaagtcc

SEQ ID NO: 284679 - DNA, 20 bp, Artificial Sequence
  Description of Artificial Sequence: Synthetic oligonucleotide
  Target: ATXN1; (+) strand; PAM type: YTN; PAM sequence: CTC
ccaccacaacctaagtccct

SEQ ID NO: 284680 - DNA, 20 bp, Artificial Sequence
  Description of Artificial Sequence: Synthetic oligonucleotide
  Target: ATXN1; (+) strand; PAM type: YTN; PAM sequence: CTA
agtcccttaaaggcaagaaa

SEQ ID NO: 284681 - DNA, 20 bp, Artificial Sequence
  Description of Artificial Sequence: Synthetic oligonucleotide
  Target: ATXN1; (+) strand; PAM type: YTN; PAM sequence: CTT
aaaggcaagaaagaggtatc

SEQ ID NO: 284682 - DNA, 20 bp, Artificial Sequence
  Description of Artificial Sequence: Synthetic oligonucleotide
  Target: ATXN1; (+) strand; PAM type: YTN; PAM sequence: TTA
aaggcaagaaagaggtatcc

SEQ ID NO: 284683 - DNA, 20 bp, Artificial Sequence
  Description of Artificial Sequence: Synthetic oligonucleotide
  Target: ATXN1; (+) strand; PAM type: YTN; PAM sequence: CTC
atcatagtaccccagagttt

SEQ ID NO: 284684 - DNA, 20 bp, Artificial Sequence
  Description of Artificial Sequence: Synthetic oligonucleotide
  Target: ATXN1; (+) strand; PAM type: YTN; PAM sequence: TTT
cgtacagcagcgtggcacat

SEQ ID NO: 284685 - DNA, 20 bp, Artificial Sequence
  Description of Artificial Sequence: Synthetic oligonucleotide
  Target: ATXN1; (+) strand; PAM type: YTN; PAM sequence: TTC
gtacagcagcgtggcacata

SEQ ID NO: 284686 - DNA, 20 bp, Artificial Sequence
  Description of Artificial Sequence: Synthetic oligonucleotide
  Target: ATXN1; (+) strand; PAM type: YTN; PAM sequence: TTA
acaacaacaaaaaaaagaaa

SEQ ID NO: 284687 - DNA, 20 bp, Artificial Sequence
  Description of Artificial Sequence: Synthetic oligonucleotide
  Target: ATXN1; (+) strand; PAM type: YTN; PAM sequence: TTA
tataatctacatttatatat

SEQ ID NO: 284688 - DNA, 20 bp, Artificial Sequence
  Description of Artificial Sequence: Synthetic oligonucleotide
  Target: ATXN1; (+) strand; PAM type: YTN; PAM sequence: CTA
catttatatattatatatac

SEQ ID NO: 284689 - DNA, 20 bp, Artificial Sequence
  Description of Artificial Sequence: Synthetic oligonucleotide
  Target: ATXN1; (+) strand; PAM type: YTN; PAM sequence: TTT
atatattatatatacatact

SEQ ID NO: 284690 - DNA, 20 bp, Artificial Sequence
  Description of Artificial Sequence: Synthetic oligonucleotide
  Target: ATXN1; (+) strand; PAM type: YTN; PAM sequence: TTA
tatattatatatacatactt

SEQ ID NO: 284691 - DNA, 20 bp, Artificial Sequence
  Description of Artificial Sequence: Synthetic oligonucleotide
  Target: ATXN1; (+) strand; PAM type: YTN; PAM sequence: TTA
tatatacatacttatatatt

SEQ ID NO: 284692 - DNA, 20 bp, Artificial Sequence
  Description of Artificial Sequence: Synthetic oligonucleotide
  Target: ATXN1; (+) strand; PAM type: YTN; PAM sequence: CTT
atatattatatatacatcac

SEQ ID NO: 284693 - DNA, 20 bp, Artificial Sequence
  Description of Artificial Sequence: Synthetic oligonucleotide
  Target: ATXN1; (+) strand; PAM type: YTN; PAM sequence: TTA
tatattatatatacatcaca

SEQ ID NO: 284694 - DNA, 20 bp, Artificial Sequence
  Description of Artificial Sequence: Synthetic oligonucleotide
  Target: ATXN1; (+) strand; PAM type: YTN; PAM sequence: TTA
tatatacatcacacacatac

SEQ ID NO: 284695 - DNA, 20 bp, Artificial Sequence
  Description of Artificial Sequence: Synthetic oligonucleotide
  Target: ATXN1; (+) strand; PAM type: YTN; PAM sequence: TTT
catactgcaaagttccagag

SEQ ID NO: 284696 - DNA, 20 bp, Artificial Sequence
  Description of Artificial Sequence: Synthetic oligonucleotide
  Target: ATXN1; (+) strand; PAM type: YTN; PAM sequence: TTC
atactgcaaagttccagagc

SEQ ID NO: 284697 - DNA, 20 bp, Artificial Sequence
  Description of Artificial Sequence: Synthetic oligonucleotide
  Target: ATXN1; (+) strand; PAM type: YTN; PAM sequence: CTG
caaagttccagagctgggca

SEQ ID NO: 284698 - DNA, 20 bp, Artificial Sequence
  Description of Artificial Sequence: Synthetic oligonucleotide
  Target: ATXN1; (+) strand; PAM type: YTN; PAM sequence: TTC
cagagctgggcatctgaaat

SEQ ID NO: 284699 - DNA, 20 bp, Artificial Sequence
  Description of Artificial Sequence: Synthetic oligonucleotide
  Target: ATXN1; (+) strand; PAM type: YTN; PAM sequence: CTG
ggcatctgaaatatacgatt

SEQ ID NO: 284700 - DNA, 20 bp, Artificial Sequence
  Description of Artificial Sequence: Synthetic oligonucleotide
  Target: ATXN1; (+) strand; PAM type: YTN; PAM sequence: CTG
aaatatacgattaatagaga

SEQ ID NO: 284701 - DNA, 20 bp, Artificial Sequence
  Description of Artificial Sequence: Synthetic oligonucleotide
  Target: ATXN1; (+) strand; PAM type: YTN; PAM sequence: TTA
atagagaatgttattattaa

SEQ ID NO: 284702 - DNA, 20 bp, Artificial Sequence
  Description of Artificial Sequence: Synthetic oligonucleotide
  Target: ATXN1; (+) strand; PAM type: YTN; PAM sequence: TTA
ttattaaatgtggtaaggca

SEQ ID NO: 284703 - DNA, 20 bp, Artificial Sequence
  Description of Artificial Sequence: Synthetic oligonucleotide
  Target: ATXN1; (+) strand; PAM type: YTN; PAM sequence: TTA
ttaaatgtggtaaggcataa

SEQ ID NO: 284704 - DNA, 20 bp, Artificial Sequence
  Description of Artificial Sequence: Synthetic oligonucleotide
  Target: ATXN1; (+) strand; PAM type: YTN; PAM sequence: TTA
aatgtggtaaggcataatga

SEQ ID NO: 284705 - DNA, 20 bp, Artificial Sequence
  Description of Artificial Sequence: Synthetic oligonucleotide
  Target: ATXN1; (+) strand; PAM type: YTN; PAM sequence: TTA
caaattcatctgtgaaacgg

SEQ ID NO: 284706 - DNA, 20 bp, Artificial Sequence
  Description of Artificial Sequence: Synthetic oligonucleotide
  Target: ATXN1; (+) strand; PAM type: YTN; PAM sequence: TTC
atctgtgaaacgggctaata

SEQ ID NO: 284707 - DNA, 20 bp, Artificial Sequence
  Description of Artificial Sequence: Synthetic oligonucleotide
  Target: ATXN1; (+) strand; PAM type: YTN; PAM sequence: CTG
tgaaacgggctaataacacc

SEQ ID NO: 284708 - DNA, 20 bp, Artificial Sequence
  Description of Artificial Sequence: Synthetic oligonucleotide
  Target: ATXN1; (+) strand; PAM type: YTN; PAM sequence: CTA
ataacacctacctcacaggg

SEQ ID NO: 284709 - DNA, 20 bp, Artificial Sequence
  Description of Artificial Sequence: Synthetic oligonucleotide
  Target: ATXN1; (+) strand; PAM type: YTN; PAM sequence: CTA
cctcacagggttgttacgag

SEQ ID NO: 284710 - DNA, 20 bp, Artificial Sequence
  Description of Artificial Sequence: Synthetic oligonucleotide
  Target: ATXN1; (+) strand; PAM type: YTN; PAM sequence: CTC
acagggttgttacgagagtt

SEQ ID NO: 284711 - DNA, 20 bp, Artificial Sequence
  Description of Artificial Sequence: Synthetic oligonucleotide
  Target: ATXN1; (+) strand; PAM type: YTN; PAM sequence: TTG
ttacgagagttaactaagct

SEQ ID NO: 284712 - DNA, 20 bp, Artificial Sequence
  Description of Artificial Sequence: Synthetic oligonucleotide
  Target: ATXN1; (+) strand; PAM type: YTN; PAM sequence: TTA
cgagagttaactaagctaca

SEQ ID NO: 284713 - DNA, 20 bp, Artificial Sequence
  Description of Artificial Sequence: Synthetic oligonucleotide
  Target: ATXN1; (+) strand; PAM type: YTN; PAM sequence: TTA
actaagctacataagtaaaa

SEQ ID NO: 284714 - DNA, 20 bp, Artificial Sequence
  Description of Artificial Sequence: Synthetic oligonucleotide
  Target: ATXN1; (+) strand; PAM type: YTN; PAM sequence: CTA
agctacataagtaaaatgtt

SEQ ID NO: 284715 - DNA, 20 bp, Artificial Sequence
  Description of Artificial Sequence: Synthetic oligonucleotide
  Target: ATXN1; (+) strand; PAM type: YTN; PAM sequence: CTA
cataagtaaaatgtttagca

SEQ ID NO: 284716 - DNA, 20 bp, Artificial Sequence
  Description of Artificial Sequence: Synthetic oligonucleotide
  Target: ATXN1; (+) strand; PAM type: YTN; PAM sequence: TTT
agcacagagctcagtatact

SEQ ID NO: 284717 - DNA, 20 bp, Artificial Sequence
  Description of Artificial Sequence: Synthetic oligonucleotide
  Target: ATXN1; (+) strand; PAM type: YTN; PAM sequence: TTA
gcacagagctcagtatactg

SEQ ID NO: 284718 - DNA, 20 bp, Artificial Sequence
  Description of Artificial Sequence: Synthetic oligonucleotide
  Target: ATXN1; (+) strand; PAM type: YTN; PAM sequence: CTC
agtatactggaagcactcca

SEQ ID NO: 284719 - DNA, 20 bp, Artificial Sequence
  Description of Artificial Sequence: Synthetic oligonucleotide
  Target: ATXN1; (+) strand; PAM type: YTN; PAM sequence: CTG
gaagcactccataaatatta

SEQ ID NO: 284720 - DNA, 20 bp, Artificial Sequence
  Description of Artificial Sequence: Synthetic oligonucleotide
  Target: ATXN1; (+) strand; PAM type: YTN; PAM sequence: CTC
cataaatattaattgtacag

SEQ ID NO: 284721 - DNA, 20 bp, Artificial Sequence
  Description of Artificial Sequence: Synthetic oligonucleotide
  Target: ATXN1; (+) strand; PAM type: YTN; PAM sequence: TTA
attgtacagccattatcact

SEQ ID NO: 284722 - DNA, 20 bp, Artificial Sequence
  Description of Artificial Sequence: Synthetic oligonucleotide
  Target: ATXN1; (+) strand; PAM type: YTN; PAM sequence: TTG
tacagccattatcactatca

SEQ ID NO: 284723 - DNA, 20 bp, Artificial Sequence
  Description of Artificial Sequence: Synthetic oligonucleotide
  Target: ATXN1; (+) strand; PAM type: YTN; PAM sequence: TTA
tcactatcagtattgttagg

SEQ ID NO: 284724 - DNA, 20 bp, Artificial Sequence
  Description of Artificial Sequence: Synthetic oligonucleotide
  Target: ATXN1; (+) strand; PAM type: YTN; PAM sequence: CTA
tcagtattgttagggcaact

SEQ ID NO: 284725 - DNA, 20 bp, Artificial Sequence
  Description of Artificial Sequence: Synthetic oligonucleotide
  Target: ATXN1; (+) strand; PAM type: YTN; PAM sequence: TTG
ttagggcaactaagctgaat

SEQ ID NO: 284726 - DNA, 20 bp, Artificial Sequence
  Description of Artificial Sequence: Synthetic oligonucleotide
  Target: ATXN1; (+) strand; PAM type: YTN; PAM sequence: TTA
gggcaactaagctgaattta

SEQ ID NO: 284727 - DNA, 20 bp, Artificial Sequence
  Description of Artificial Sequence: Synthetic oligonucleotide
  Target: ATXN1; (+) strand; PAM type: YTN; PAM sequence: CTA
agctgaatttacaacttatg

SEQ ID NO: 284728 - DNA, 20 bp, Artificial Sequence
  Description of Artificial Sequence: Synthetic oligonucleotide
  Target: ATXN1; (+) strand; PAM type: YTN; PAM sequence: CTG
aatttacaacttatgggtaa

SEQ ID NO: 284729 - DNA, 20 bp, Artificial Sequence
  Description of Artificial Sequence: Synthetic oligonucleotide
  Target: ATXN1; (+) strand; PAM type: YTN; PAM sequence: TTT
acaacttatgggtaaaatgt

SEQ ID NO: 284730 - DNA, 20 bp, Artificial Sequence
  Description of Artificial Sequence: Synthetic oligonucleotide
  Target: ATXN1; (+) strand; PAM type: YTN; PAM sequence: TTA
caacttatgggtaaaatgta

SEQ ID NO: 284731 - DNA, 20 bp, Artificial Sequence
  Description of Artificial Sequence: Synthetic oligonucleotide
  Target: ATXN1; (+) strand; PAM type: YTN; PAM sequence: CTT
atgggtaaaatgtaacagtt

SEQ ID NO: 284732 - DNA, 20 bp, Artificial Sequence
  Description of Artificial Sequence: Synthetic oligonucleotide
  Target: ATXN1; (+) strand; PAM type: YTN; PAM sequence: TTA
tgggtaaaatgtaacagttt

SEQ ID NO: 284733 - DNA, 20 bp, Artificial Sequence
  Description of Artificial Sequence: Synthetic oligonucleotide
  Target: ATXN1; (+) strand; PAM type: YTN; PAM sequence: TTT
tatttgccagtatctttcat

SEQ ID NO: 284734 - DNA, 20 bp, Artificial Sequence
  Description of Artificial Sequence: Synthetic oligonucleotide
  Target: ATXN1; (+) strand; PAM type: YTN; PAM sequence: TTT
atttgccagtatctttcata

SEQ ID NO: 284735 - DNA, 20 bp, Artificial Sequence
  Description of Artificial Sequence: Synthetic oligonucleotide
  Target: ATXN1; (+) strand; PAM type: YTN; PAM sequence: TTA
tttgccagtatctttcatat

SEQ ID NO: 284736 - DNA, 20 bp, Artificial Sequence
  Description of Artificial Sequence: Synthetic oligonucleotide
  Target: ATXN1; (+) strand; PAM type: YTN; PAM sequence: TTT
gccagtatctttcatattaa

SEQ ID NO: 284737 - DNA, 20 bp, Artificial Sequence
  Description of Artificial Sequence: Synthetic oligonucleotide
  Target: ATXN1; (+) strand; PAM type: YTN; PAM sequence: TTG
ccagtatctttcatattaaa

SEQ ID NO: 284738 - DNA, 20 bp, Artificial Sequence
  Description of Artificial Sequence: Synthetic oligonucleotide
  Target: ATXN1; (+) strand; PAM type: YTN; PAM sequence: CTT
tcatattaaagcattaatta

SEQ ID NO: 284739 - DNA, 20 bp, Artificial Sequence
  Description of Artificial Sequence: Synthetic oligonucleotide
  Target: ATXN1; (+) strand; PAM type: YTN; PAM sequence: TTT
catattaaagcattaattag

SEQ ID NO: 284740 - DNA, 20 bp, Artificial Sequence
  Description of Artificial Sequence: Synthetic oligonucleotide
  Target: ATXN1; (+) strand; PAM type: YTN; PAM sequence: TTC
atattaaagcattaattagc

SEQ ID NO: 284741 - DNA, 20 bp, Artificial Sequence
  Description of Artificial Sequence: Synthetic oligonucleotide
  Target: ATXN1; (+) strand; PAM type: YTN; PAM sequence: TTA
aagcattaattagcattagc

SEQ ID NO: 284742 - DNA, 20 bp, Artificial Sequence
  Description of Artificial Sequence: Synthetic oligonucleotide
  Target: ATXN1; (+) strand; PAM type: YTN; PAM sequence: TTA
attagcattagcatctgtgt

SEQ ID NO: 284743 - DNA, 20 bp, Artificial Sequence
  Description of Artificial Sequence: Synthetic oligonucleotide
  Target: ATXN1; (+) strand; PAM type: YTN; PAM sequence: TTA
gcattagcatctgtgtaaga

SEQ ID NO: 284744 - DNA, 20 bp, Artificial Sequence
  Description of Artificial Sequence: Synthetic oligonucleotide
  Target: ATXN1; (+) strand; PAM type: YTN; PAM sequence: TTA
gcatctgtgtaagaacataa

SEQ ID NO: 284745 - DNA, 20 bp, Artificial Sequence
  Description of Artificial Sequence: Synthetic oligonucleotide
  Target: ATXN1; (+) strand; PAM type: YTN; PAM sequence: CTG
tgtaagaacataaaatgcct

SEQ ID NO: 284746 - DNA, 20 bp, Artificial Sequence
  Description of Artificial Sequence: Synthetic oligonucleotide
  Target: ATXN1; (+) strand; PAM type: YTN; PAM sequence: CTA
gaaaggagctcagaaaatta

SEQ ID NO: 284747 - DNA, 20 bp, Artificial Sequence
  Description of Artificial Sequence: Synthetic oligonucleotide
  Target: ATXN1; (+) strand; PAM type: YTN; PAM sequence: CTC
agaaaattaaggataaagaa

SEQ ID NO: 284748 - DNA, 20 bp, Artificial Sequence
  Description of Artificial Sequence: Synthetic oligonucleotide
  Target: ATXN1; (+) strand; PAM type: YTN; PAM sequence: TTA
aggataaagaagagtcttat

SEQ ID NO: 284749 - DNA, 20 bp, Artificial Sequence
  Description of Artificial Sequence: Synthetic oligonucleotide
  Target: ATXN1; (+) strand; PAM type: YTN; PAM sequence: CTT
atccgttgcaactgaaggac

SEQ ID NO: 284750 - DNA, 20 bp, Artificial Sequence
  Description of Artificial Sequence: Synthetic oligonucleotide
  Target: ATXN1; (+) strand; PAM type: YTN; PAM sequence: TTA
tccgttgcaactgaaggact

SEQ ID NO: 284751 - DNA, 20 bp, Artificial Sequence
  Description of Artificial Sequence: Synthetic oligonucleotide
  Target: ATXN1; (+) strand; PAM type: YTN; PAM sequence: TTG
caactgaaggactaatgatt

SEQ ID NO: 284752 - DNA, 20 bp, Artificial Sequence
  Description of Artificial Sequence: Synthetic oligonucleotide
  Target: ATXN1; (+) strand; PAM type: YTN; PAM sequence: CTG
aaggactaatgattgtttcg

SEQ ID NO: 284753 - DNA, 20 bp, Artificial Sequence
  Description of Artificial Sequence: Synthetic oligonucleotide
  Target: ATXN1; (+) strand; PAM type: YTN; PAM sequence: CTA
atgattgtttcggtaatctg

SEQ ID NO: 284754 - DNA, 20 bp, Artificial Sequence
  Description of Artificial Sequence: Synthetic oligonucleotide
  Target: ATXN1; (+) strand; PAM type: YTN; PAM sequence: TTG
tttcggtaatctgtgatata

SEQ ID NO: 284755 - DNA, 20 bp, Artificial Sequence
  Description of Artificial Sequence: Synthetic oligonucleotide
  Target: ATXN1; (+) strand; PAM type: YTN; PAM sequence: TTT
cggtaatctgtgatatatgt

SEQ ID NO: 284756 - DNA, 20 bp, Artificial Sequence
  Description of Artificial Sequence: Synthetic oligonucleotide
  Target: ATXN1; (+) strand; PAM type: YTN; PAM sequence: TTC
ggtaatctgtgatatatgtg

SEQ ID NO: 284757 - DNA, 20 bp, Artificial Sequence
  Description of Artificial Sequence: Synthetic oligonucleotide
  Target: ATXN1; (+) strand; PAM type: YTN; PAM sequence: CTG
tgatatatgtgtgaaggaag

SEQ ID NO: 284758 - DNA, 20 bp, Artificial Sequence
  Description of Artificial Sequence: Synthetic oligonucleotide
  Target: ATXN1; (+) strand; PAM type: YTN; PAM sequence: TTT
ctgtacaaaaattatctatg

SEQ ID NO: 284759 - DNA, 20 bp, Artificial Sequence
  Description of Artificial Sequence: Synthetic oligonucleotide
  Target: ATXN1; (+) strand; PAM type: YTN; PAM sequence: TTC
tgtacaaaaattatctatga

SEQ ID NO: 284760 - DNA, 20 bp, Artificial Sequence
  Description of Artificial Sequence: Synthetic oligonucleotide
  Target: ATXN1; (+) strand; PAM type: YTN; PAM sequence: CTG
tacaaaaattatctatgaag

SEQ ID NO: 284761 - DNA, 20 bp, Artificial Sequence
  Description of Artificial Sequence: Synthetic oligonucleotide
  Target: ATXN1; (+) strand; PAM type: YTN; PAM sequence: TTA
tctatgaagtctaaatgaca

SEQ ID NO: 284762 - DNA, 20 bp, Artificial Sequence
  Description of Artificial Sequence: Synthetic oligonucleotide
  Target: ATXN1; (+) strand; PAM type: YTN; PAM sequence: CTA
tgaagtctaaatgacagaaa

SEQ ID NO: 284763 - DNA, 20 bp, Artificial Sequence
  Description of Artificial Sequence: Synthetic oligonucleotide
  Target: ATXN1; (+) strand; PAM type: YTN; PAM sequence: CTA
aatgacagaaactacacata

SEQ ID NO: 284764 - DNA, 20 bp, Artificial Sequence
  Description of Artificial Sequence: Synthetic oligonucleotide
  Target: ATXN1; (+) strand; PAM type: YTN; PAM sequence: CTA
cacatatcgccattcaagtg

SEQ ID NO: 284765 - DNA, 20 bp, Artificial Sequence
  Description of Artificial Sequence: Synthetic oligonucleotide
  Target: ATXN1; (+) strand; PAM type: YTN; PAM sequence: TTC
aagtgctgtaaacattgagc

SEQ ID NO: 284766 - DNA, 20 bp, Artificial Sequence
  Description of Artificial Sequence: Synthetic oligonucleotide
  Target: ATXN1; (+) strand; PAM type: YTN; PAM sequence: CTG
taaacattgagctgacgtaa

SEQ ID NO: 284767 - DNA, 20 bp, Artificial Sequence
  Description of Artificial Sequence: Synthetic oligonucleotide
  Target: ATXN1; (+) strand; PAM type: YTN; PAM sequence: TTG
agctgacgtaattataaata

SEQ ID NO: 284768 - DNA, 20 bp, Artificial Sequence
  Description of Artificial Sequence: Synthetic oligonucleotide
  Target: ATXN1; (+) strand; PAM type: YTN; PAM sequence: CTG
acgtaattataaatacttac

SEQ ID NO: 284769 - DNA, 20 bp, Artificial Sequence
  Description of Artificial Sequence: Synthetic oligonucleotide
  Target: ATXN1; (+) strand; PAM type: YTN; PAM sequence: TTA
taaatacttactgtaagcta

SEQ ID NO: 284770 - DNA, 20 bp, Artificial Sequence
  Description of Artificial Sequence: Synthetic oligonucleotide
  Target: ATXN1; (+) strand; PAM type: YTN; PAM sequence: CTT
actgtaagctatttcttttg

SEQ ID NO: 284771 - DNA, 20 bp, Artificial Sequence
  Description of Artificial Sequence: Synthetic oligonucleotide
  Target: ATXN1; (+) strand; PAM type: YTN; PAM sequence: TTA
ctgtaagctatttcttttgc

SEQ ID NO: 284772 - DNA, 20 bp, Artificial Sequence
  Description of Artificial Sequence: Synthetic oligonucleotide
  Target: ATXN1; (+) strand; PAM type: YTN; PAM sequence: CTG
taagctatttcttttgctaa

SEQ ID NO: 284773 - DNA, 20 bp, Artificial Sequence
  Description of Artificial Sequence: Synthetic oligonucleotide
  Target: ATXN1; (+) strand; PAM type: YTN; PAM sequence: CTA
tttcttttgctaaaaaaaaa

SEQ ID NO: 284774 - DNA, 20 bp, Artificial Sequence
  Description of Artificial Sequence: Synthetic oligonucleotide
  Target: ATXN1; (+) strand; PAM type: YTN; PAM sequence: TTT
cttttgctaaaaaaaaaatt

SEQ ID NO: 284775 - DNA, 20 bp, Artificial Sequence
  Description of Artificial Sequence: Synthetic oligonucleotide
  Target: ATXN1; (+) strand; PAM type: YTN; PAM sequence: TTC
ttttgctaaaaaaaaaatta

SEQ ID NO: 284776 - DNA, 20 bp, Artificial Sequence
  Description of Artificial Sequence: Synthetic oligonucleotide
  Target: ATXN1; (+) strand; PAM type: YTN; PAM sequence: CTT
ttgctaaaaaaaaaattaga

SEQ ID NO: 284777 - DNA, 20 bp, Artificial Sequence
  Description of Artificial Sequence: Synthetic oligonucleotide
  Target: ATXN1; (+) strand; PAM type: YTN; PAM sequence: TTT
tgctaaaaaaaaaattagag

SEQ ID NO: 284778 - DNA, 20 bp, Artificial Sequence
  Description of Artificial Sequence: Synthetic oligonucleotide
  Target: ATXN1; (+) strand; PAM type: YTN; PAM sequence: TTT
gctaaaaaaaaaattagaga

SEQ ID NO: 284779 - DNA, 20 bp, Artificial Sequence
  Description of Artificial Sequence: Synthetic oligonucleotide
  Target: ATXN1; (+) strand; PAM type: YTN; PAM sequence: TTG
ctaaaaaaaaaattagagat

SEQ ID NO: 284780 - DNA, 20 bp, Artificial Sequence
  Description of Artificial Sequence: Synthetic oligonucleotide
  Target: ATXN1; (+) strand; PAM type: YTN; PAM sequence: CTA
aaaaaaaaattagagatgca

SEQ ID NO: 284781 - DNA, 20 bp, Artificial Sequence
  Description of Artificial Sequence: Synthetic oligonucleotide
  Target: ATXN1; (+) strand; PAM type: YTN; PAM sequence: TTA
gagatgcatattcatccact

SEQ ID NO: 284782 - DNA, 20 bp, Artificial Sequence
  Description of Artificial Sequence: Synthetic oligonucleotide
  Target: ATXN1; (+) strand; PAM type: YTN; PAM sequence: TTC
atccacttctgttaattact

SEQ ID NO: 284783 - DNA, 20 bp, Artificial Sequence
  Description of Artificial Sequence: Synthetic oligonucleotide
  Target: ATXN1; (+) strand; PAM type: YTN; PAM sequence: CTT
ctgttaattactggacagag

SEQ ID NO: 284784 - DNA, 20 bp, Artificial Sequence
  Description of Artificial Sequence: Synthetic oligonucleotide
  Target: ATXN1; (+) strand; PAM type: YTN; PAM sequence: TTC
tgttaattactggacagagt

SEQ ID NO: 284785 - DNA, 20 bp, Artificial Sequence
  Description of Artificial Sequence: Synthetic oligonucleotide
  Target: ATXN1; (+) strand; PAM type: YTN; PAM sequence: CTG
ttaattactggacagagtaa

SEQ ID NO: 284786 - DNA, 20 bp, Artificial Sequence
  Description of Artificial Sequence: Synthetic oligonucleotide
  Target: ATXN1; (+) strand; PAM type: YTN; PAM sequence: TTA
attactggacagagtaatgt

SEQ ID NO: 284787 - DNA, 20 bp, Artificial Sequence
  Description of Artificial Sequence: Synthetic oligonucleotide
  Target: ATXN1; (+) strand; PAM type: YTN; PAM sequence: TTA
ctggacagagtaatgtgact

SEQ ID NO: 284788 - DNA, 20 bp, Artificial Sequence
  Description of Artificial Sequence: Synthetic oligonucleotide
  Target: ATXN1; (+) strand; PAM type: YTN; PAM sequence: CTG
gacagagtaatgtgacttca

SEQ ID NO: 284789 - DNA, 20 bp, Artificial Sequence
  Description of Artificial Sequence: Synthetic oligonucleotide
  Target: ATXN1; (+) strand; PAM type: YTN; PAM sequence: CTT
cataaataaatactaaggat

SEQ ID NO: 284790 - DNA, 20 bp, Artificial Sequence
  Description of Artificial Sequence: Synthetic oligonucleotide
  Target: ATXN1; (+) strand; PAM type: YTN; PAM sequence: TTC
ataaataaatactaaggatt

SEQ ID NO: 284791 - DNA, 20 bp, Artificial Sequence
  Description of Artificial Sequence: Synthetic oligonucleotide
  Target: ATXN1; (+) strand; PAM type: YTN; PAM sequence: CTA
aggatttgactaatgaatat

SEQ ID NO: 284792 - DNA, 20 bp, Artificial Sequence
  Description of Artificial Sequence: Synthetic oligonucleotide
  Target: ATXN1; (+) strand; PAM type: YTN; PAM sequence: TTT
gactaatgaatatgccataa

SEQ ID NO: 284793 - DNA, 20 bp, Artificial Sequence
  Description of Artificial Sequence: Synthetic oligonucleotide
  Target: ATXN1; (+) strand; PAM type: YTN; PAM sequence: TTG
actaatgaatatgccataaa

SEQ ID NO: 284794 - DNA, 20 bp, Artificial Sequence
  Description of Artificial Sequence: Synthetic oligonucleotide
  Target: ATXN1; (+) strand; PAM type: YTN; PAM sequence: CTA
atgaatatgccataaaatgt

SEQ ID NO: 284795 - DNA, 20 bp, Artificial Sequence
  Description of Artificial Sequence: Synthetic oligonucleotide
  Target: ATXN1; (+) strand; PAM type: YTN; PAM sequence: CTG
aattaatagcaagcacattt

SEQ ID NO: 284796 - DNA, 20 bp, Artificial Sequence
  Description of Artificial Sequence: Synthetic oligonucleotide
  Target: ATXN1; (+) strand; PAM type: YTN; PAM sequence: TTA
atagcaagcacatttcatat

SEQ ID NO: 284797 - DNA, 20 bp, Artificial Sequence
  Description of Artificial Sequence: Synthetic oligonucleotide
  Target: ATXN1; (+) strand; PAM type: YTN; PAM sequence: TTT
catatgtggtctattagatg

SEQ ID NO: 284798 - DNA, 20 bp, Artificial Sequence
  Description of Artificial Sequence: Synthetic oligonucleotide
  Target: ATXN1; (+) strand; PAM type: YTN; PAM sequence: TTC
atatgtggtctattagatgc

SEQ ID NO: 284799 - DNA, 20 bp, Artificial Sequence
  Description of Artificial Sequence: Synthetic oligonucleotide
  Target: ATXN1; (+) strand; PAM type: YTN; PAM sequence: CTA
ttagatgctattctaattta

SEQ ID NO: 284800 - DNA, 20 bp, Artificial Sequence
  Description of Artificial Sequence: Synthetic oligonucleotide
  Target: ATXN1; (+) strand; PAM type: YTN; PAM sequence: TTA
gatgctattctaatttagaa

SEQ ID NO: 284801 - DNA, 20 bp, Artificial Sequence
  Description of Artificial Sequence: Synthetic oligonucleotide
  Target: ATXN1; (+) strand; PAM type: YTN; PAM sequence: CTA
ttctaatttagaattgcaga

SEQ ID NO: 284802 - DNA, 20 bp, Artificial Sequence
  Description of Artificial Sequence: Synthetic oligonucleotide
  Target: ATXN1; (+) strand; PAM type: YTN; PAM sequence: TTC
taatttagaattgcagaaat

SEQ ID NO: 284803 - DNA, 20 bp, Artificial Sequence
  Description of Artificial Sequence: Synthetic oligonucleotide
  Target: ATXN1; (+) strand; PAM type: YTN; PAM sequence: CTA
atttagaattgcagaaattt

SEQ ID NO: 284804 - DNA, 20 bp, Artificial Sequence
  Description of Artificial Sequence: Synthetic oligonucleotide
  Target: ATXN1; (+) strand; PAM type: YTN; PAM sequence: TTT
agaattgcagaaatttaatg

SEQ ID NO: 284805 - DNA, 20 bp, Artificial Sequence
  Description of Artificial Sequence: Synthetic oligonucleotide
  Target: ATXN1; (+) strand; PAM type: YTN; PAM sequence: TTA
gaattgcagaaatttaatga

SEQ ID NO: 284806 - DNA, 20 bp, Artificial Sequence
  Description of Artificial Sequence: Synthetic oligonucleotide
  Target: ATXN1; (+) strand; PAM type: YTN; PAM sequence: TTG
cagaaatttaatgaaataga

SEQ ID NO: 284807 - DNA, 20 bp, Artificial Sequence
  Description of Artificial Sequence: Synthetic oligonucleotide
  Target: ATXN1; (+) strand; PAM type: YTN; PAM sequence: TTT
aatgaaatagactgcaaaca

SEQ ID NO: 284808 - DNA, 20 bp, Artificial Sequence
  Description of Artificial Sequence: Synthetic oligonucleotide
  Target: ATXN1; (+) strand; PAM type: YTN; PAM sequence: TTA
atgaaatagactgcaaacag

SEQ ID NO: 284809 - DNA, 20 bp, Artificial Sequence
  Description of Artificial Sequence: Synthetic oligonucleotide
  Target: ATXN1; (+) strand; PAM type: YTN; PAM sequence: CTG
caaacaggaaaatacaggca

SEQ ID NO: 284810 - DNA, 20 bp, Artificial Sequence
  Description of Artificial Sequence: Synthetic oligonucleotide
  Target: ATXN1; (+) strand; PAM type: YTN; PAM sequence: CTA
ttttgcaatgcactttggaa

SEQ ID NO: 284811 - DNA, 20 bp, Artificial Sequence
  Description of Artificial Sequence: Synthetic oligonucleotide
  Target: ATXN1; (+) strand; PAM type: YTN; PAM sequence: TTT
tgcaatgcactttggaaaaa

SEQ ID NO: 284812 - DNA, 20 bp, Artificial Sequence
  Description of Artificial Sequence: Synthetic oligonucleotide
  Target: ATXN1; (+) strand; PAM type: YTN; PAM sequence: TTT
gcaatgcactttggaaaaaa

SEQ ID NO: 284813 - DNA, 20 bp, Artificial Sequence
  Description of Artificial Sequence: Synthetic oligonucleotide
  Target: ATXN1; (+) strand; PAM type: YTN; PAM sequence: TTG
caatgcactttggaaaaaaa

SEQ ID NO: 284814 - DNA, 20 bp, Artificial Sequence
  Description of Artificial Sequence: Synthetic oligonucleotide
  Target: ATXN1; (+) strand; PAM type: YTN; PAM sequence: CTT
tggaaaaaaaataagaatga

SEQ ID NO: 284815 - DNA, 20 bp, Artificial Sequence
  Description of Artificial Sequence: Synthetic oligonucleotide
  Target: ATXN1; (+) strand; PAM type: YTN; PAM sequence: TTT
ggaaaaaaaataagaatgaa

SEQ ID NO: 284816 - DNA, 20 bp, Artificial Sequence
  Description of Artificial Sequence: Synthetic oligonucleotide
  Target: ATXN1; (+) strand; PAM type: YTN; PAM sequence: TTG
gaaaaaaaataagaatgaat

SEQ ID NO: 284817 - DNA, 20 bp, Artificial Sequence
  Description of Artificial Sequence: Synthetic oligonucleotide
  Target: ATXN1; (+) strand; PAM type: YTN; PAM sequence: TTG
tttacaaatgctaccagtac

SEQ ID NO: 284818 - DNA, 20 bp, Artificial Sequence
  Description of Artificial Sequence: Synthetic oligonucleotide
  Target: ATXN1; (+) strand; PAM type: YTN; PAM sequence: TTT
acaaatgctaccagtacata

SEQ ID NO: 284819 - DNA, 20 bp, Artificial Sequence
  Description of Artificial Sequence: Synthetic oligonucleotide
  Target: ATXN1; (+) strand; PAM type: YTN; PAM sequence: TTA
caaatgctaccagtacatag

SEQ ID NO: 284820 - DNA, 20 bp, Artificial Sequence
  Description of Artificial Sequence: Synthetic oligonucleotide
  Target: ATXN1; (+) strand; PAM type: YTN; PAM sequence: CTA
ccagtacatagttgaacaga

SEQ ID NO: 284821 - DNA, 20 bp, Artificial Sequence
  Description of Artificial Sequence: Synthetic oligonucleotide
  Target: ATXN1; (+) strand; PAM type: YTN; PAM sequence: TTG
aacagaatgaactggtaata

SEQ ID NO: 284822 - DNA, 20 bp, Artificial Sequence
  Description of Artificial Sequence: Synthetic oligonucleotide
  Target: ATXN1; (+) strand; PAM type: YTN; PAM sequence: CTG
gtaatagttattttacgaag

SEQ ID NO: 284823 - DNA, 20 bp, Artificial Sequence
  Description of Artificial Sequence: Synthetic oligonucleotide
  Target: ATXN1; (+) strand; PAM type: YTN; PAM sequence: TTA
ttttacgaagcaaactcata

SEQ ID NO: 284824 - DNA, 20 bp, Artificial Sequence
  Description of Artificial Sequence: Synthetic oligonucleotide
  Target: ATXN1; (+) strand; PAM type: YTN; PAM sequence: TTT
tacgaagcaaactcataatt

SEQ ID NO: 284825 - DNA, 20 bp, Artificial Sequence
  Description of Artificial Sequence: Synthetic oligonucleotide
  Target: ATXN1; (+) strand; PAM type: YTN; PAM sequence: TTT
acgaagcaaactcataattc

SEQ ID NO: 284826 - DNA, 20 bp, Artificial Sequence
  Description of Artificial Sequence: Synthetic oligonucleotide
  Target: ATXN1; (+) strand; PAM type: YTN; PAM sequence: TTA
cgaagcaaactcataattct

SEQ ID NO: 284827 - DNA, 20 bp, Artificial Sequence
  Description of Artificial Sequence: Synthetic oligonucleotide
  Target: ATXN1; (+) strand; PAM type: YTN; PAM sequence: CTC
ataattctgccctatgttgc

SEQ ID NO: 284828 - DNA, 20 bp, Artificial Sequence
  Description of Artificial Sequence: Synthetic oligonucleotide
  Target: ATXN1; (+) strand; PAM type: YTN; PAM sequence: TTC
tgccctatgttgcttttctc

SEQ ID NO: 284829 - DNA, 20 bp, Artificial Sequence
  Description of Artificial Sequence: Synthetic oligonucleotide
  Target: ATXN1; (+) strand; PAM type: YTN; PAM sequence: CTG
ccctatgttgcttttctctt

SEQ ID NO: 284830 - DNA, 20 bp, Artificial Sequence
  Description of Artificial Sequence: Synthetic oligonucleotide
  Target: ATXN1; (+) strand; PAM type: YTN; PAM sequence: CTA
tgttgcttttctcttgcata

SEQ ID NO: 284831 - DNA, 20 bp, Artificial Sequence
  Description of Artificial Sequence: Synthetic oligonucleotide
  Target: ATXN1; (+) strand; PAM type: YTN; PAM sequence: TTG
cttttctcttgcatattggc

SEQ ID NO: 284832 - DNA, 20 bp, Artificial Sequence
  Description of Artificial Sequence: Synthetic oligonucleotide
  Target: ATXN1; (+) strand; PAM type: YTN; PAM sequence: CTT
ttctcttgcatattggccaa

SEQ ID NO: 284833 - DNA, 20 bp, Artificial Sequence
  Description of Artificial Sequence: Synthetic oligonucleotide
  Target: ATXN1; (+) strand; PAM type: YTN; PAM sequence: TTT
tctcttgcatattggccaaa

SEQ ID NO: 284834 - DNA, 20 bp, Artificial Sequence
  Description of Artificial Sequence: Synthetic oligonucleotide
  Target: ATXN1; (+) strand; PAM type: YTN; PAM sequence: TTT
ctcttgcatattggccaaat

SEQ ID NO: 284835 - DNA, 20 bp, Artificial Sequence
  Description of Artificial Sequence: Synthetic oligonucleotide
  Target: ATXN1; (+) strand; PAM type: YTN; PAM sequence: TTC
tcttgcatattggccaaatt

SEQ ID NO: 284836 - DNA, 20 bp, Artificial Sequence
  Description of Artificial Sequence: Synthetic oligonucleotide
  Target: ATXN1; (+) strand; PAM type: YTN; PAM sequence: CTC
ttgcatattggccaaattta

SEQ ID NO: 284837 - DNA, 20 bp, Artificial Sequence
  Description of Artificial Sequence: Synthetic oligonucleotide
  Target: ATXN1; (+) strand; PAM type: YTN; PAM sequence: CTT
gcatattggccaaatttaaa

SEQ ID NO: 284838 - DNA, 20 bp, Artificial Sequence
  Description of Artificial Sequence: Synthetic oligonucleotide
  Target: ATXN1; (+) strand; PAM type: YTN; PAM sequence: TTG
catattggccaaatttaaat

SEQ ID NO: 284839 - DNA, 20 bp, Artificial Sequence
  Description of Artificial Sequence: Synthetic oligonucleotide
  Target: ATXN1; (+) strand; PAM type: YTN; PAM sequence: TTG
gccaaatttaaataatgcat

SEQ ID NO: 284840 - DNA, 20 bp, Artificial Sequence
  Description of Artificial Sequence: Synthetic oligonucleotide
  Target: ATXN1; (+) strand; PAM type: YTN; PAM sequence: TTT
aaataatgcatattagagtt

SEQ ID NO: 284841 - DNA, 20 bp, Artificial Sequence
  Description of Artificial Sequence: Synthetic oligonucleotide
  Target: ATXN1; (+) strand; PAM type: YTN; PAM sequence: TTA
aataatgcatattagagttt

SEQ ID NO: 284842 - DNA, 20 bp, Artificial Sequence
  Description of Artificial Sequence: Synthetic oligonucleotide
  Target: ATXN1; (+) strand; PAM type: YTN; PAM sequence: TTA
gagttttatatattaagtcc

SEQ ID NO: 284843 - DNA, 20 bp, Artificial Sequence
  Description of Artificial Sequence: Synthetic oligonucleotide
  Target: ATXN1; (+) strand; PAM type: YTN; PAM sequence: TTT
tatatattaagtcctactga

SEQ ID NO: 284844 - DNA, 20 bp, Artificial Sequence
  Description of Artificial Sequence: Synthetic oligonucleotide
  Target: ATXN1; (+) strand; PAM type: YTN; PAM sequence: TTT
atatattaagtcctactgaa

SEQ ID NO: 284845 - DNA, 20 bp, Artificial Sequence
  Description of Artificial Sequence: Synthetic oligonucleotide
  Target: ATXN1; (+) strand; PAM type: YTN; PAM sequence: TTA
tatattaagtcctactgaaa

SEQ ID NO: 284846 - DNA, 20 bp, Artificial Sequence
  Description of Artificial Sequence: Synthetic oligonucleotide
  Target: ATXN1; (+) strand; PAM type: YTN; PAM sequence: TTA
agtcctactgaaatataaag

SEQ ID NO: 284847 - DNA, 20 bp, Artificial Sequence
  Description of Artificial Sequence: Synthetic oligonucleotide
  Target: ATXN1; (+) strand; PAM type: YTN; PAM sequence: CTA
ctgaaatataaagtactatc

SEQ ID NO: 284848 - DNA, 20 bp, Artificial Sequence
  Description of Artificial Sequence: Synthetic oligonucleotide
  Target: ATXN1; (+) strand; PAM type: YTN; PAM sequence: CTG
aaatataaagtactatcatt

SEQ ID NO: 284849 - DNA, 20 bp, Artificial Sequence
  Description of Artificial Sequence: Synthetic oligonucleotide
  Target: ATXN1; (+) strand; PAM type: YTN; PAM sequence: CTA
tcattattgcattttgagat

SEQ ID NO: 284850 - DNA, 20 bp, Artificial Sequence
  Description of Artificial Sequence: Synthetic oligonucleotide
  Target: ATXN1; (+) strand; PAM type: YTN; PAM sequence: TTA
ttgcattttgagatttctat

SEQ ID NO: 284851 - DNA, 20 bp, Artificial Sequence
  Description of Artificial Sequence: Synthetic oligonucleotide
  Target: ATXN1; (+) strand; PAM type: YTN; PAM sequence: TTG
cattttgagatttctattct

SEQ ID NO: 284852 - DNA, 20 bp, Artificial Sequence
  Description of Artificial Sequence: Synthetic oligonucleotide
  Target: ATXN1; (+) strand; PAM type: YTN; PAM sequence: TTT
tgagatttctattctcaatt

SEQ ID NO: 284853 - DNA, 20 bp, Artificial Sequence
  Description of Artificial Sequence: Synthetic oligonucleotide
  Target: ATXN1; (+) strand; PAM type: YTN; PAM sequence: TTT
gagatttctattctcaattc

SEQ ID NO: 284854 - DNA, 20 bp, Artificial Sequence
  Description of Artificial Sequence: Synthetic oligonucleotide
  Target: ATXN1; (+) strand; PAM type: YTN; PAM sequence: TTG
agatttctattctcaattca

SEQ ID NO: 284855 - DNA, 20 bp, Artificial Sequence
  Description of Artificial Sequence: Synthetic oligonucleotide
  Target: ATXN1; (+) strand; PAM type: YTN; PAM sequence: TTT
ctattctcaattcacattta

SEQ ID NO: 284856 - DNA, 20 bp, Artificial Sequence
  Description of Artificial Sequence: Synthetic oligonucleotide
  Target: ATXN1; (+) strand; PAM type: YTN; PAM sequence: TTC
tattctcaattcacatttat

SEQ ID NO: 284857 - DNA, 20 bp, Artificial Sequence
  Description of Artificial Sequence: Synthetic oligonucleotide
  Target: ATXN1; (+) strand; PAM type: YTN; PAM sequence: CTA
ttctcaattcacatttatca

SEQ ID NO: 284858 - DNA, 20 bp, Artificial Sequence
  Description of Artificial Sequence: Synthetic oligonucleotide
  Target: ATXN1; (+) strand; PAM type: YTN; PAM sequence: TTC
tcaattcacatttatcactg

SEQ ID NO: 284859 - DNA, 20 bp, Artificial Sequence
  Description of Artificial Sequence: Synthetic oligonucleotide
  Target: ATXN1; (+) strand; PAM type: YTN; PAM sequence: CTC
aattcacatttatcactgat

SEQ ID NO: 284860 - DNA, 20 bp, Artificial Sequence
  Description of Artificial Sequence: Synthetic oligonucleotide
  Target: ATXN1; (+) strand; PAM type: YTN; PAM sequence: TTC
acatttatcactgataaaag

SEQ ID NO: 284861 - DNA, 20 bp, Artificial Sequence
  Description of Artificial Sequence: Synthetic oligonucleotide
  Target: ATXN1; (+) strand; PAM type: YTN; PAM sequence: TTT
atcactgataaaagataaaa

SEQ ID NO: 284862 - DNA, 20 bp, Artificial Sequence
  Description of Artificial Sequence: Synthetic oligonucleotide
  Target: ATXN1; (+) strand; PAM type: YTN; PAM sequence: TTA
tcactgataaaagataaaac

SEQ ID NO: 284863 - DNA, 20 bp, Artificial Sequence
  Description of Artificial Sequence: Synthetic oligonucleotide
  Target: ATXN1; (+) strand; PAM type: YTN; PAM sequence: CTG
ataaaagataaaaccccaaa

SEQ ID NO: 284864 - DNA, 20 bp, Artificial Sequence
  Description of Artificial Sequence: Synthetic oligonucleotide
  Target: ATXN1; (+) strand; PAM type: YTN; PAM sequence: TTT
ttctgattgaggcttttcct

SEQ ID NO: 284865 - DNA, 20 bp, Artificial Sequence
  Description of Artificial Sequence: Synthetic oligonucleotide
  Target: ATXN1; (+) strand; PAM type: YTN; PAM sequence: TTT
tctgattgaggcttttcctc

SEQ ID NO: 284866 - DNA, 20 bp, Artificial Sequence
  Description of Artificial Sequence: Synthetic oligonucleotide
  Target: ATXN1; (+) strand; PAM type: YTN; PAM sequence: TTT
ctgattgaggcttttcctca

SEQ ID NO: 284867 - DNA, 20 bp, Artificial Sequence
  Description of Artificial Sequence: Synthetic oligonucleotide
  Target: ATXN1; (+) strand; PAM type: YTN; PAM sequence: TTC
tgattgaggcttttcctcag

SEQ ID NO: 284868 - DNA, 20 bp, Artificial Sequence
  Description of Artificial Sequence: Synthetic oligonucleotide
  Target: ATXN1; (+) strand; PAM type: YTN; PAM sequence: CTG
attgaggcttttcctcagag

SEQ ID NO: 284869 - DNA, 20 bp, Artificial Sequence
  Description of Artificial Sequence: Synthetic oligonucleotide
  Target: ATXN1; (+) strand; PAM type: YTN; PAM sequence: TTG
aggcttttcctcagagatac

SEQ ID NO: 284870 - DNA, 20 bp, Artificial Sequence
  Description of Artificial Sequence: Synthetic oligonucleotide
  Target: ATXN1; (+) strand; PAM type: YTN; PAM sequence: CTT
ttcctcagagatactagagt

SEQ ID NO: 284871 - DNA, 20 bp, Artificial Sequence
  Description of Artificial Sequence: Synthetic oligonucleotide
  Target: ATXN1; (+) strand; PAM type: YTN; PAM sequence: TTT
tcctcagagatactagagtt

SEQ ID NO: 284872 - DNA, 20 bp, Artificial Sequence
  Description of Artificial Sequence: Synthetic oligonucleotide
  Target: ATXN1; (+) strand; PAM type: YTN; PAM sequence: TTT
cctcagagatactagagttg

SEQ ID NO: 284873 - DNA, 20 bp, Artificial Sequence
  Description of Artificial Sequence: Synthetic oligonucleotide
  Target: ATXN1; (+) strand; PAM type: YTN; PAM sequence: TTC
ctcagagatactagagttgt

SEQ ID NO: 284874 - DNA, 20 bp, Artificial Sequence
  Description of Artificial Sequence: Synthetic oligonucleotide
  Target: ATXN1; (+) strand; PAM type: YTN; PAM sequence: CTC
agagatactagagttgtagg

SEQ ID NO: 284875 - DNA, 20 bp, Artificial Sequence
  Description of Artificial Sequence: Synthetic oligonucleotide
  Target: ATXN1; (+) strand; PAM type: YTN; PAM sequence: CTA
gagttgtaggggaagtataa

SEQ ID NO: 284876 - DNA, 20 bp, Artificial Sequence
  Description of Artificial Sequence: Synthetic oligonucleotide
  Target: ATXN1; (+) strand; PAM type: YTN; PAM sequence: TTG
taggggaagtataaaaatac

SEQ ID NO: 284877 - DNA, 20 bp, Artificial Sequence
  Description of Artificial Sequence: Synthetic oligonucleotide
  Target: ATXN1; (+) strand; PAM type: YTN; PAM sequence: CTA
aattcataacattctttttt

SEQ ID NO: 284878 - DNA, 20 bp, Artificial Sequence
  Description of Artificial Sequence: Synthetic oligonucleotide
  Target: ATXN1; (+) strand; PAM type: YTN; PAM sequence: TTC
ataacattcttttttttttt

SEQ ID NO: 284879 - DNA, 20 bp, Artificial Sequence
  Description of Artificial Sequence: Synthetic oligonucleotide
  Target: ATXN1; (+) strand; PAM type: YTN; PAM sequence: TTC
ttttttttttttctttgaga

SEQ ID NO: 284880 - DNA, 20 bp, Artificial Sequence
  Description of Artificial Sequence: Synthetic oligonucleotide
  Target: ATXN1; (+) strand; PAM type: YTN; PAM sequence: CTT
ttttttttttctttgagaca

SEQ ID NO: 284881 - DNA, 20 bp, Artificial Sequence
  Description of Artificial Sequence: Synthetic oligonucleotide
  Target: ATXN1; (+) strand; PAM type: YTN; PAM sequence: TTT
tttttttttctttgagacaa

SEQ ID NO: 284882 - DNA, 20 bp, Artificial Sequence
  Description of Artificial Sequence: Synthetic oligonucleotide
  Target: ATXN1; (+) strand; PAM type: YTN; PAM sequence: TTT
ttttttttctttgagacaag

SEQ ID NO: 284883 - DNA, 20 bp, Artificial Sequence
  Description of Artificial Sequence: Synthetic oligonucleotide
  Target: ATXN1; (+) strand; PAM type: YTN; PAM sequence: TTT
tttttttctttgagacaagt

SEQ ID NO: 284884 - DNA, 20 bp, Artificial Sequence
  Description of Artificial Sequence: Synthetic oligonucleotide
  Target: ATXN1; (+) strand; PAM type: YTN; PAM sequence: TTT
ttttttctttgagacaagtt

SEQ ID NO: 284885 - DNA, 20 bp, Artificial Sequence
  Description of Artificial Sequence: Synthetic oligonucleotide
  Target: ATXN1; (+) strand; PAM type: YTN; PAM sequence: TTT
tttttctttgagacaagttc

SEQ ID NO: 284886 - DNA, 20 bp, Artificial Sequence
  Description of Artificial Sequence: Synthetic oligonucleotide
  Target: ATXN1; (+) strand; PAM type: YTN; PAM sequence: TTT
ttttctttgagacaagttct

SEQ ID NO: 284887 - DNA, 20 bp, Artificial Sequence
  Description of Artificial Sequence: Synthetic oligonucleotide
  Target: ATXN1; (+) strand; PAM type: YTN; PAM sequence: TTT
tttctttgagacaagttctc

SEQ ID NO: 284888 - DNA, 20 bp, Artificial Sequence
  Description of Artificial Sequence: Synthetic oligonucleotide
  Target: ATXN1; (+) strand; PAM type: YTN; PAM sequence: TTT
ttctttgagacaagttctca

SEQ ID NO: 284889 - DNA, 20 bp, Artificial Sequence
  Description of Artificial Sequence: Synthetic oligonucleotide
  Target: ATXN1; (+) strand; PAM type: YTN; PAM sequence: TTT
tctttgagacaagttctcac

SEQ ID NO: 284890 - DNA, 20 bp, Artificial Sequence
  Description of Artificial Sequence: Synthetic oligonucleotide
  Target: ATXN1; (+) strand; PAM type: YTN; PAM sequence: TTT
ctttgagacaagttctcact

SEQ ID NO: 284891 - DNA, 20 bp, Artificial Sequence
  Description of Artificial Sequence: Synthetic oligonucleotide
  Target: ATXN1; (+) strand; PAM type: YTN; PAM sequence: TTC
tttgagacaagttctcactc

SEQ ID NO: 284892 - DNA, 20 bp, Artificial Sequence
  Description of Artificial Sequence: Synthetic oligonucleotide
  Target: ATXN1; (+) strand; PAM type: YTN; PAM sequence: CTT
tgagacaagttctcactctg

SEQ ID NO: 284893 - DNA, 20 bp, Artificial Sequence
  Description of Artificial Sequence: Synthetic oligonucleotide
  Target: ATXN1; (+) strand; PAM type: YTN; PAM sequence: TTT
gagacaagttctcactctgt

SEQ ID NO: 284894 - DNA, 20 bp, Artificial Sequence
  Description of Artificial Sequence: Synthetic oligonucleotide
  Target: ATXN1; (+) strand; PAM type: YTN; PAM sequence: TTG
agacaagttctcactctgtt

SEQ ID NO: 284895 - DNA, 20 bp, Artificial Sequence
  Description of Artificial Sequence: Synthetic oligonucleotide
  Target: ATXN1; (+) strand; PAM type: YTN; PAM sequence: TTC
tcactctgtttcccaggttg

SEQ ID NO: 284896 - DNA, 20 bp, Artificial Sequence
  Description of Artificial Sequence: Synthetic oligonucleotide
  Target: ATXN1; (+) strand; PAM type: YTN; PAM sequence: CTC
actctgtttcccaggttgga

SEQ ID NO: 284897 - DNA, 20 bp, Artificial Sequence
  Description of Artificial Sequence: Synthetic oligonucleotide
  Target: ATXN1; (+) strand; PAM type: YTN; PAM sequence: CTC
tgtttcccaggttggagtgc

SEQ ID NO: 284898 - DNA, 20 bp, Artificial Sequence
  Description of Artificial Sequence: Synthetic oligonucleotide
  Target: ATXN1; (+) strand; PAM type: YTN; PAM sequence: CTG
tttcccaggttggagtgcag

SEQ ID NO: 284899 - DNA, 20 bp, Artificial Sequence
  Description of Artificial Sequence: Synthetic oligonucleotide
  Target: ATXN1; (+) strand; PAM type: YTN; PAM sequence: TTT
cccaggttggagtgcagtgg

SEQ ID NO: 284900 - DNA, 20 bp, Artificial Sequence
  Description of Artificial Sequence: Synthetic oligonucleotide
  Target: ATXN1; (+) strand; PAM type: YTN; PAM sequence: TTC
ccaggttggagtgcagtggt

SEQ ID NO: 284901 - DNA, 20 bp, Artificial Sequence
  Description of Artificial Sequence: Synthetic oligonucleotide
  Target: ATXN1; (+) strand; PAM type: YTN; PAM sequence: TTG
gagtgcagtggtgtgatgac

SEQ ID NO: 284902 - DNA, 20 bp, Artificial Sequence
  Description of Artificial Sequence: Synthetic oligonucleotide
  Target: ATXN1; (+) strand; PAM type: YTN; PAM sequence: CTC
acttcagcctcaacctctcg

SEQ ID NO: 284903 - DNA, 20 bp, Artificial Sequence
  Description of Artificial Sequence: Synthetic oligonucleotide
  Target: ATXN1; (+) strand; PAM type: YTN; PAM sequence: CTT
cagcctcaacctctcgggct

SEQ ID NO: 284904 - DNA, 20 bp, Artificial Sequence
  Description of Artificial Sequence: Synthetic oligonucleotide
  Target: ATXN1; (+) strand; PAM type: YTN; PAM sequence: TTC
agcctcaacctctcgggctc

SEQ ID NO: 284905 - DNA, 20 bp, Artificial Sequence
  Description of Artificial Sequence: Synthetic oligonucleotide
  Target: ATXN1; (+) strand; PAM type: YTN; PAM sequence: CTC
aacctctcgggctcaggtgg

SEQ ID NO: 284906 - DNA, 20 bp, Artificial Sequence
  Description of Artificial Sequence: Synthetic oligonucleotide
  Target: ATXN1; (+) strand; PAM type: YTN; PAM sequence: CTC
tcgggctcaggtggtcctct

SEQ ID NO: 284907 - DNA, 20 bp, Artificial Sequence
  Description of Artificial Sequence: Synthetic oligonucleotide
  Target: ATXN1; (+) strand; PAM type: YTN; PAM sequence: CTC
gggctcaggtggtcctctca

SEQ ID NO: 284908 - DNA, 20 bp, Artificial Sequence
  Description of Artificial Sequence: Synthetic oligonucleotide
  Target: ATXN1; (+) strand; PAM type: YTN; PAM sequence: CTC
aggtggtcctctcacctcag

SEQ ID NO: 284909 - DNA, 20 bp, Artificial Sequence
  Description of Artificial Sequence: Synthetic oligonucleotide
  Target: ATXN1; (+) strand; PAM type: YTN; PAM sequence: CTC
tcacctcagcctcctgggta

SEQ ID NO: 284910 - DNA, 20 bp, Artificial Sequence
  Description of Artificial Sequence: Synthetic oligonucleotide
  Target: ATXN1; (+) strand; PAM type: YTN; PAM sequence: CTC
acctcagcctcctgggtagc

SEQ ID NO: 284911 - DNA, 20 bp, Artificial Sequence
  Description of Artificial Sequence: Synthetic oligonucleotide
  Target: ATXN1; (+) strand; PAM type: YTN; PAM sequence: CTC
agcctcctgggtagctggga

SEQ ID NO: 284912 - DNA, 20 bp, Artificial Sequence
  Description of Artificial Sequence: Synthetic oligonucleotide
  Target: ATXN1; (+) strand; PAM type: YTN; PAM sequence: CTC
ctgggtagctgggactacag

SEQ ID NO: 284913 - DNA, 20 bp, Artificial Sequence
  Description of Artificial Sequence: Synthetic oligonucleotide
  Target: ATXN1; (+) strand; PAM type: YTN; PAM sequence: CTG
ggtagctgggactacaggca

SEQ ID NO: 284914 - DNA, 20 bp, Artificial Sequence
  Description of Artificial Sequence: Synthetic oligonucleotide
  Target: ATXN1; (+) strand; PAM type: YTN; PAM sequence: CTG
ggactacaggcacacgccac

SEQ ID NO: 284915 - DNA, 20 bp, Artificial Sequence
  Description of Artificial Sequence: Synthetic oligonucleotide
  Target: ATXN1; (+) strand; PAM type: YTN; PAM sequence: CTA
caggcacacgccaccatgcc

SEQ ID NO: 284916 - DNA, 20 bp, Artificial Sequence
  Description of Artificial Sequence: Synthetic oligonucleotide
  Target: ATXN1; (+) strand; PAM type: YTN; PAM sequence: CTG
gctaattttttaattttttt

SEQ ID NO: 284917 - DNA, 20 bp, Artificial Sequence
  Description of Artificial Sequence: Synthetic oligonucleotide
  Target: ATXN1; (+) strand; PAM type: YTN; PAM sequence: CTA
attttttaattttttttttt

SEQ ID NO: 284918 - DNA, 20 bp, Artificial Sequence
  Description of Artificial Sequence: Synthetic oligonucleotide
  Target: ATXN1; (+) strand; PAM type: YTN; PAM sequence: TTT
tttaattttttttttttttt

SEQ ID NO: 284919 - DNA, 20 bp, Artificial Sequence
  Description of Artificial Sequence: Synthetic oligonucleotide
  Target: ATXN1; (+) strand; PAM type: YTN; PAM sequence: TTT
ttaatttttttttttttttg

SEQ ID NO: 284920 - DNA, 20 bp, Artificial Sequence
  Description of Artificial Sequence: Synthetic oligonucleotide
  Target: ATXN1; (+) strand; PAM type: YTN; PAM sequence: TTT
taatttttttttttttttga

SEQ ID NO: 284921 - DNA, 20 bp, Artificial Sequence
  Description of Artificial Sequence: Synthetic oligonucleotide
  Target: ATXN1; (+) strand; PAM type: YTN; PAM sequence: TTT
aatttttttttttttttgaa

SEQ ID NO: 284922 - DNA, 20 bp, Artificial Sequence
  Description of Artificial Sequence: Synthetic oligonucleotide
  Target: ATXN1; (+) strand; PAM type: YTN; PAM sequence: TTA
atttttttttttttttgaaa

SEQ ID NO: 284923 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgaaacata

SEQ ID NO: 284924 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgaaacatag

SEQ ID NO: 284925 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgaaacatagt

SEQ ID NO: 284926 - DNA, 20 bp, Artificial Sequence
  Description of Artificial Sequence: Synthetic oligonucleotide
  Target: ATXN1; (+) strand; PAM type: YTN; PAM sequence: TTT
tttttttttgaaacatagtt

SEQ ID NO: 284927 - DNA, 20 bp, Artificial Sequence
  Description of Artificial Sequence: Synthetic oligonucleotide
  Target: ATXN1; (+) strand; PAM type: YTN; PAM sequence: TTT
ttttttttgaaacatagttt

SEQ ID NO: 284928 - DNA, 20 bp, Artificial Sequence
  Description of Artificial Sequence: Synthetic oligonucleotide
  Target: ATXN1; (+) strand; PAM type: YTN; PAM sequence: TTT
tttttttgaaacatagtttc

SEQ ID NO: 284929 - DNA, 20 bp, Artificial Sequence
  Description of Artificial Sequence: Synthetic oligonucleotide
  Target: ATXN1; (+) strand; PAM type: YTN; PAM sequence: TTT
ttttttgaaacatagtttca

SEQ ID NO: 284930 - DNA, 20 bp, Artificial Sequence
  Description of Artificial Sequence: Synthetic oligonucleotide
  Target: ATXN1; (+) strand; PAM type: YTN; PAM sequence: TTT
tttttgaaacatagtttcac

SEQ ID NO: 284931 - DNA, 20 bp, Artificial Sequence
  Description of Artificial Sequence: Synthetic oligonucleotide
  Target: ATXN1; (+) strand; PAM type: YTN; PAM sequence: TTT
ttttgaaacatagtttcact

SEQ ID NO: 284932 - DNA, 20 bp, Artificial Sequence
  Description of Artificial Sequence: Synthetic oligonucleotide
  Target: ATXN1; (+) strand; PAM type: YTN; PAM sequence: TTT
tttgaaacatagtttcactc

SEQ ID NO: 284933 - DNA, 20 bp, Artificial Sequence
  Description of Artificial Sequence: Synthetic oligonucleotide
  Target: ATXN1; (+) strand; PAM type: YTN; PAM sequence: TTT
ttgaaacatagtttcactcc

SEQ ID NO: 284934 - DNA, 20 bp, Artificial Sequence
  Description of Artificial Sequence: Synthetic oligonucleotide
  Target: ATXN1; (+) strand; PAM type: YTN; PAM sequence: TTT
tgaaacatagtttcactcct

SEQ ID NO: 284935 - DNA, 20 bp, Artificial Sequence
  Description of Artificial Sequence: Synthetic oligonucleotide
  Target: ATXN1; (+) strand; PAM type: YTN; PAM sequence: TTT
gaaacatagtttcactcctg

SEQ ID NO: 284936 - DNA, 20 bp, Artificial Sequence
  Description of Artificial Sequence: Synthetic oligonucleotide
  Target: ATXN1; (+) strand; PAM type: YTN; PAM sequence: TTG
aaacatagtttcactcctgt

SEQ ID NO: 284937 - DNA, 20 bp, Artificial Sequence
  Description of Artificial Sequence: Synthetic oligonucleotide
  Target: ATXN1; (+) strand; PAM type: YTN; PAM sequence: TTT
cactcctgttgcccaggctg

SEQ ID NO: 284938 - DNA, 20 bp, Artificial Sequence
  Description of Artificial Sequence: Synthetic oligonucleotide
  Target: ATXN1; (+) strand; PAM type: YTN; PAM sequence: TTC
actcctgttgcccaggctgg

SEQ ID NO: 284939 - DNA, 20 bp, Artificial Sequence
  Description of Artificial Sequence: Synthetic oligonucleotide
  Target: ATXN1; (+) strand; PAM type: YTN; PAM sequence: CTC
ctgttgcccaggctggagtg

SEQ ID NO: 284940 - DNA, 20 bp, Artificial Sequence
  Description of Artificial Sequence: Synthetic oligonucleotide
  Target: ATXN1; (+) strand; PAM type: YTN; PAM sequence: CTG
ttgcccaggctggagtgcaa

SEQ ID NO: 284941 - DNA, 20 bp, Artificial Sequence
  Description of Artificial Sequence: Synthetic oligonucleotide
  Target: ATXN1; (+) strand; PAM type: YTN; PAM sequence: TTG
cccaggctggagtgcaatgg

SEQ ID NO: 284942 - DNA, 20 bp, Artificial Sequence
  Description of Artificial Sequence: Synthetic oligonucleotide
  Target: ATXN1; (+) strand; PAM type: YTN; PAM sequence: CTG
gagtgcaatggcgcaatctc

SEQ ID NO: 284943 - DNA, 20 bp, Artificial Sequence
  Description of Artificial Sequence: Synthetic oligonucleotide
  Target: ATXN1; (+) strand; PAM type: YTN; PAM sequence: CTC
cactcaccataacctccgcc

SEQ ID NO: 284944 - DNA, 20 bp, Artificial Sequence
  Description of Artificial Sequence: Synthetic oligonucleotide
  Target: ATXN1; (+) strand; PAM type: YTN; PAM sequence: CTC
accataacctccgccttcca

SEQ ID NO: 284945 - DNA, 20 bp, Artificial Sequence
  Description of Artificial Sequence: Synthetic oligonucleotide
  Target: ATXN1; (+) strand; PAM type: YTN; PAM sequence: CTC
cgccttccaggttcaagcaa

SEQ ID NO: 284946 - DNA, 20 bp, Artificial Sequence
  Description of Artificial Sequence: Synthetic oligonucleotide
  Target: ATXN1; (+) strand; PAM type: YTN; PAM sequence: CTT
ccaggttcaagcaattatcc

SEQ ID NO: 284947 - DNA, 20 bp, Artificial Sequence
  Description of Artificial Sequence: Synthetic oligonucleotide
  Target: ATXN1; (+) strand; PAM type: YTN; PAM sequence: TTC
caggttcaagcaattatcct

SEQ ID NO: 284948 - DNA, 20 bp, Artificial Sequence
  Description of Artificial Sequence: Synthetic oligonucleotide
  Target: ATXN1; (+) strand; PAM type: YTN; PAM sequence: TTC
aagcaattatcctgcctcag

SEQ ID NO: 284949 - DNA, 20 bp, Artificial Sequence
  Description of Artificial Sequence: Synthetic oligonucleotide
  Target: ATXN1; (+) strand; PAM type: YTN; PAM sequence: TTA
tcctgcctcagcctcctgag

SEQ ID NO: 284950 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcctgagtagct

SEQ ID NO: 284951 - DNA, 20 bp, Artificial Sequence
  Description of Artificial Sequence: Synthetic oligonucleotide
  Target: ATXN1; (+) strand; PAM type: YTN; PAM sequence: CTC
agcctcctgagtagctggga

SEQ ID NO: 284952 - DNA, 20 bp, Artificial Sequence
  Description of Artificial Sequence: Synthetic oligonucleotide
  Target: ATXN1; (+) strand; PAM type: YTN; PAM sequence: CTC
ctgagtagctgggattacag

SEQ ID NO: 284953 - DNA, 20 bp, Artificial Sequence
  Description of Artificial Sequence: Synthetic oligonucleotide
  Target: ATXN1; (+) strand; PAM type: YTN; PAM sequence: CTG
agtagctgggattacaggca

SEQ ID NO: 284954 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcatgcaccac

SEQ ID NO: 284955 - DNA, 20 bp, Artificial Sequence
  Description of Artificial Sequence: Synthetic oligonucleotide
  Target: ATXN1; (+) strand; PAM type: YTN; PAM sequence: TTA
caggcatgcaccaccacgtc

SEQ ID NO: 284956 - DNA, 20 bp, Artificial Sequence
  Description of Artificial Sequence: Synthetic oligonucleotide
  Target: ATXN1; (+) strand; PAM type: YTN; PAM sequence: CTA
attttgtatttttagtagag

SEQ ID NO: 284957 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagatgg

SEQ ID NO: 284958 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagatggg

SEQ ID NO: 284959 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagatgggg

SEQ ID NO: 284960 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatggggtttct

SEQ ID NO: 284961 - DNA, 20 bp, Artificial Sequence
  Description of Artificial Sequence: Synthetic oligonucleotide
  Target: ATXN1; (+) strand; PAM type: YTN; PAM sequence: TTT
tagtagagatggggtttctc

SEQ ID NO: 284962 - DNA, 20 bp, Artificial Sequence
  Description of Artificial Sequence: Synthetic oligonucleotide
  Target: ATXN1; (+) strand; PAM type: YTN; PAM sequence: TTT
agtagagatggggtttctcc

SEQ ID NO: 284963 - DNA, 20 bp, Artificial Sequence
  Description of Artificial Sequence: Synthetic oligonucleotide
  Target: ATXN1; (+) strand; PAM type: YTN; PAM sequence: TTA
gtagagatggggtttctcca

SEQ ID NO: 284964 - DNA, 20 bp, Artificial Sequence
  Description of Artificial Sequence: Synthetic oligonucleotide
  Target: ATXN1; (+) strand; PAM type: YTN; PAM sequence: TTT
ctccatgttggccaggatgg

SEQ ID NO: 284965 - DNA, 20 bp, Artificial Sequence
  Description of Artificial Sequence: Synthetic oligonucleotide
  Target: ATXN1; (+) strand; PAM type: YTN; PAM sequence: TTC
tccatgttggccaggatggt

SEQ ID NO: 284966 - DNA, 20 bp, Artificial Sequence
  Description of Artificial Sequence: Synthetic oligonucleotide
  Target: ATXN1; (+) strand; PAM type: YTN; PAM sequence: CTC
catgttggccaggatggtct

SEQ ID NO: 284967 - DNA, 20 bp, Artificial Sequence
  Description of Artificial Sequence: Synthetic oligonucleotide
  Target: ATXN1; (+) strand; PAM type: YTN; PAM sequence: TTG
gccaggatggtctcgaccag

SEQ ID NO: 284968 - DNA, 20 bp, Artificial Sequence
  Description of Artificial Sequence: Synthetic oligonucleotide
  Target: ATXN1; (+) strand; PAM type: YTN; PAM sequence: CTC
gaccagcatgtggtctccca

SEQ ID NO: 284969 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgtgattacag

SEQ ID NO: 284970 - DNA, 20 bp, Artificial Sequence
  Description of Artificial Sequence: Synthetic oligonucleotide
  Target: ATXN1; (+) strand; PAM type: YTN; PAM sequence: CTG
tgattacaggcgtgagccac

SEQ ID NO: 284971 - DNA, 20 bp, Artificial Sequence
  Description of Artificial Sequence: Synthetic oligonucleotide
  Target: ATXN1; (+) strand; PAM type: YTN; PAM sequence: TTA
caggcgtgagccactgcgcc

SEQ ID NO: 284972 - DNA, 20 bp, Artificial Sequence
  Description of Artificial Sequence: Synthetic oligonucleotide
  Target: ATXN1; (+) strand; PAM type: YTN; PAM sequence: CTG
cgcccaactatttttttaat

SEQ ID NO: 284973 - DNA, 20 bp, Artificial Sequence
  Description of Artificial Sequence: Synthetic oligonucleotide
  Target: ATXN1; (+) strand; PAM type: YTN; PAM sequence: CTA
tttttttaattttttagtag

SEQ ID NO: 284974 - DNA, 20 bp, Artificial Sequence
  Description of Artificial Sequence: Synthetic oligonucleotide
  Target: ATXN1; (+) strand; PAM type: YTN; PAM sequence: TTT
ttttaattttttagtagaga

SEQ ID NO: 284975 - DNA, 20 bp, Artificial Sequence
  Description of Artificial Sequence: Synthetic oligonucleotide
  Target: ATXN1; (+) strand; PAM type: YTN; PAM sequence: TTT
tttaattttttagtagagac

SEQ ID NO: 284976 - DNA, 20 bp, Artificial Sequence
  Description of Artificial Sequence: Synthetic oligonucleotide
  Target: ATXN1; (+) strand; PAM type: YTN; PAM sequence: TTT
ttaattttttagtagagaca

SEQ ID NO: 284977 - DNA, 20 bp, Artificial Sequence
  Description of Artificial Sequence: Synthetic oligonucleotide
  Target: ATXN1; (+) strand; PAM type: YTN; PAM sequence: TTT
taattttttagtagagacag

SEQ ID NO: 284978 - DNA, 20 bp, Artificial Sequence
  Description of Artificial Sequence: Synthetic oligonucleotide
  Target: ATXN1; (+) strand; PAM type: YTN; PAM sequence: TTT
aattttttagtagagacagg

SEQ ID NO: 284979 - DNA, 20 bp, Artificial Sequence
  Description of Artificial Sequence: Synthetic oligonucleotide
  Target: ATXN1; (+) strand; PAM type: YTN; PAM sequence: TTA
attttttagtagagacaggg

SEQ ID NO: 284980 - DNA, 20 bp, Artificial Sequence
  Description of Artificial Sequence: Synthetic oligonucleotide
  Target: ATXN1; (+) strand; PAM type: YTN; PAM sequence: TTT
tttagtagagacagggtctt

SEQ ID NO: 284981 - DNA, 20 bp, Artificial Sequence
  Description of Artificial Sequence: Synthetic oligonucleotide
  Target: ATXN1; (+) strand; PAM type: YTN; PAM sequence: TTT
ttagtagagacagggtcttg

SEQ ID NO: 284982 - DNA, 20 bp, Artificial Sequence
  Description of Artificial Sequence: Synthetic oligonucleotide
  Target: ATXN1; (+) strand; PAM type: YTN; PAM sequence: TTT
tagtagagacagggtcttgc

SEQ ID NO: 284983 - DNA, 20 bp, Artificial Sequence
  Description of Artificial Sequence: Synthetic oligonucleotide
  Target: ATXN1; (+) strand; PAM type: YTN; PAM sequence: TTT
agtagagacagggtcttgct

SEQ ID NO: 284984 - DNA, 20 bp, Artificial Sequence
  Description of Artificial Sequence: Synthetic oligonucleotide
  Target: ATXN1; (+) strand; PAM type: YTN; PAM sequence: TTA
gtagagacagggtcttgcta

SEQ ID NO: 284985 - DNA, 20 bp, Artificial Sequence
  Description of Artificial Sequence: Synthetic oligonucleotide
  Target: ATXN1; (+) strand; PAM type: YTN; PAM sequence: CTT
gctatgtcgcccaggctgga

SEQ ID NO: 284986 - DNA, 20 bp, Artificial Sequence
  Description of Artificial Sequence: Synthetic oligonucleotide
  Target: ATXN1; (+) strand; PAM type: YTN; PAM sequence: TTG
ctatgtcgcccaggctggac

SEQ ID NO: 284987 - DNA, 20 bp, Artificial Sequence
  Description of Artificial Sequence: Synthetic oligonucleotide
  Target: ATXN1; (+) strand; PAM type: YTN; PAM sequence: CTA
tgtcgcccaggctggactca

SEQ ID NO: 284988 - DNA, 20 bp, Artificial Sequence
  Description of Artificial Sequence: Synthetic oligonucleotide
  Target: ATXN1; (+) strand; PAM type: YTN; PAM sequence: CTG
gactcaaactactggtctcc

SEQ ID NO: 284989 - DNA, 20 bp, Artificial Sequence
  Description of Artificial Sequence: Synthetic oligonucleotide
  Target: ATXN1; (+) strand; PAM type: YTN; PAM sequence: CTC
aaactactggtctccagcaa

SEQ ID NO: 284990 - DNA, 20 bp, Artificial Sequence
  Description of Artificial Sequence: Synthetic oligonucleotide
  Target: ATXN1; (+) strand; PAM type: YTN; PAM sequence: CTA
ctggtctccagcaatcttcc

SEQ ID NO: 284991 - DNA, 20 bp, Artificial Sequence
  Description of Artificial Sequence: Synthetic oligonucleotide
  Target: ATXN1; (+) strand; PAM type: YTN; PAM sequence: CTG
gtctccagcaatcttcccac

SEQ ID NO: 284992 - DNA, 20 bp, Artificial Sequence
  Description of Artificial Sequence: Synthetic oligonucleotide
  Target: ATXN1; (+) strand; PAM type: YTN; PAM sequence: CTC
cagcaatcttcccacctagg

SEQ ID NO: 284993 - DNA, 20 bp, Artificial Sequence
  Description of Artificial Sequence: Synthetic oligonucleotide
  Target: ATXN1; (+) strand; PAM type: YTN; PAM sequence: CTT
cccacctaggcctcccaaag

SEQ ID NO: 284994 - DNA, 20 bp, Artificial Sequence
  Description of Artificial Sequence: Synthetic oligonucleotide
  Target: ATXN1; (+) strand; PAM type: YTN; PAM sequence: TTC
ccacctaggcctcccaaaga

SEQ ID NO: 284995 - DNA, 20 bp, Artificial Sequence
  Description of Artificial Sequence: Synthetic oligonucleotide
  Target: ATXN1; (+) strand; PAM type: YTN; PAM sequence: CTA
ggcctcccaaagaactggga

SEQ ID NO: 284996 - DNA, 20 bp, Artificial Sequence
  Description of Artificial Sequence: Synthetic oligonucleotide
  Target: ATXN1; (+) strand; PAM type: YTN; PAM sequence: CTC
ccaaagaactgggactacag

SEQ ID NO: 284997 - DNA, 20 bp, Artificial Sequence
  Description of Artificial Sequence: Synthetic oligonucleotide
  Target: ATXN1; (+) strand; PAM type: YTN; PAM sequence: CTG
ggactacaggtgtgagccac

SEQ ID NO: 284998 - DNA, 20 bp, Artificial Sequence
  Description of Artificial Sequence: Synthetic oligonucleotide
  Target: ATXN1; (+) strand; PAM type: YTN; PAM sequence: CTA
caggtgtgagccacagtgcc

SEQ ID NO: 284999 - DNA, 20 bp, Artificial Sequence
  Description of Artificial Sequence: Synthetic oligonucleotide
  Target: ATXN1; (+) strand; PAM type: YTN; PAM sequence: CTG
taacctattcatttaccatg

SEQ ID NO: 285000 - DNA, 20 bp, Artificial Sequence
  Description of Artificial Sequence: Synthetic oligonucleotide
  Target: ATXN1; (+) strand; PAM type: YTN; PAM sequence: CTA
ttcatttaccatgagactat

SEQ ID NO: 285001 - DNA, 20 bp, Artificial Sequence
  Description of Artificial Sequence: Synthetic oligonucleotide
  Target: ATXN1; (+) strand; PAM type: YTN; PAM sequence: TTC
atttaccatgagactattaa

SEQ ID NO: 285002 - DNA, 20 bp, Artificial Sequence
  Description of Artificial Sequence: Synthetic oligonucleotide
  Target: ATXN1; (+) strand; PAM type: YTN; PAM sequence: TTT
accatgagactattaaactc

SEQ ID NO: 285003 - DNA, 20 bp, Artificial Sequence
  Description of Artificial Sequence: Synthetic oligonucleotide
  Target: ATXN1; (+) strand; PAM type: YTN; PAM sequence: TTA
ccatgagactattaaactcc

SEQ ID NO: 285004 - DNA, 20 bp, Artificial Sequence
  Description of Artificial Sequence: Synthetic oligonucleotide
  Target: ATXN1; (+) strand; PAM type: YTN; PAM sequence: CTA
ttaaactccttttaaattga

SEQ ID NO: 285005 - DNA, 20 bp, Artificial Sequence
  Description of Artificial Sequence: Synthetic oligonucleotide
  Target: ATXN1; (+) strand; PAM type: YTN; PAM sequence: TTA
aactccttttaaattgaatt

SEQ ID NO: 285006 - DNA, 20 bp, Artificial Sequence
  Description of Artificial Sequence: Synthetic oligonucleotide
  Target: ATXN1; (+) strand; PAM type: YTN; PAM sequence: CTC
cttttaaattgaattataat

SEQ ID NO: 285007 - DNA, 20 bp, Artificial Sequence
  Description of Artificial Sequence: Synthetic oligonucleotide
  Target: ATXN1; (+) strand; PAM type: YTN; PAM sequence: CTT
ttaaattgaattataattct

SEQ ID NO: 285008 - DNA, 20 bp, Artificial Sequence
  Description of Artificial Sequence: Synthetic oligonucleotide
  Target: ATXN1; (+) strand; PAM type: YTN; PAM sequence: TTT
taaattgaattataattcta

SEQ ID NO: 285009 - DNA, 20 bp, Artificial Sequence
  Description of Artificial Sequence: Synthetic oligonucleotide
  Target: ATXN1; (+) strand; PAM type: YTN; PAM sequence: TTT
aaattgaattataattctat

SEQ ID NO: 285010 - DNA, 20 bp, Artificial Sequence
  Description of Artificial Sequence: Synthetic oligonucleotide
  Target: ATXN1; (+) strand; PAM type: YTN; PAM sequence: TTA
aattgaattataattctatt

SEQ ID NO: 285011 - DNA, 20 bp, Artificial Sequence
  Description of Artificial Sequence: Synthetic oligonucleotide
  Target: ATXN1; (+) strand; PAM type: YTN; PAM sequence: TTG
aattataattctattccatg

SEQ ID NO: 285012 - DNA, 20 bp, Artificial Sequence
  Description of Artificial Sequence: Synthetic oligonucleotide
  Target: ATXN1; (+) strand; PAM type: YTN; PAM sequence: TTA
taattctattccatggccac

SEQ ID NO: 285013 - DNA, 20 bp, Artificial Sequence
  Description of Artificial Sequence: Synthetic oligonucleotide
  Target: ATXN1; (+) strand; PAM type: YTN; PAM sequence: TTC
tattccatggccacagctat

SEQ ID NO: 285014 - DNA, 20 bp, Artificial Sequence
  Description of Artificial Sequence: Synthetic oligonucleotide
  Target: ATXN1; (+) strand; PAM type: YTN; PAM sequence: CTA
ttccatggccacagctattg

SEQ ID NO: 285015 - DNA, 20 bp, Artificial Sequence
  Description of Artificial Sequence: Synthetic oligonucleotide
  Target: ATXN1; (+) strand; PAM type: YTN; PAM sequence: TTC
catggccacagctattgacc

SEQ ID NO: 285016 - DNA, 20 bp, Artificial Sequence
  Description of Artificial Sequence: Synthetic oligonucleotide
  Target: ATXN1; (+) strand; PAM type: YTN; PAM sequence: CTA
ttgaccagtttaccctaagt

SEQ ID NO: 285017 - DNA, 20 bp, Artificial Sequence
  Description of Artificial Sequence: Synthetic oligonucleotide
  Target: ATXN1; (+) strand; PAM type: YTN; PAM sequence: TTG
accagtttaccctaagtata

SEQ ID NO: 285018 - DNA, 20 bp, Artificial Sequence
  Description of Artificial Sequence: Synthetic oligonucleotide
  Target: ATXN1; (+) strand; PAM type: YTN; PAM sequence: TTT
accctaagtatatggttctt

SEQ ID NO: 285019 - DNA, 20 bp, Artificial Sequence
  Description of Artificial Sequence: Synthetic oligonucleotide
  Target: ATXN1; (+) strand; PAM type: YTN; PAM sequence: TTA
ccctaagtatatggttcttt

SEQ ID NO: 285020 - DNA, 20 bp, Artificial Sequence
  Description of Artificial Sequence: Synthetic oligonucleotide
  Target: ATXN1; (+) strand; PAM type: YTN; PAM sequence: CTA
agtatatggttctttgcaac

SEQ ID NO: 285021 - DNA, 20 bp, Artificial Sequence
  Description of Artificial Sequence: Synthetic oligonucleotide
  Target: ATXN1; (+) strand; PAM type: YTN; PAM sequence: TTC
tttgcaacataattaaaatg

SEQ ID NO: 285022 - DNA, 20 bp, Artificial Sequence
  Description of Artificial Sequence: Synthetic oligonucleotide
  Target: ATXN1; (+) strand; PAM type: YTN; PAM sequence: CTT
tgcaacataattaaaatgag

SEQ ID NO: 285023 - DNA, 20 bp, Artificial Sequence
  Description of Artificial Sequence: Synthetic oligonucleotide
  Target: ATXN1; (+) strand; PAM type: YTN; PAM sequence: TTT
gcaacataattaaaatgaga

SEQ ID NO: 285024 - DNA, 20 bp, Artificial Sequence
  Description of Artificial Sequence: Synthetic oligonucleotide
  Target: ATXN1; (+) strand; PAM type: YTN; PAM sequence: TTG
caacataattaaaatgagaa

SEQ ID NO: 285025 - DNA, 20 bp, Artificial Sequence
  Description of Artificial Sequence: Synthetic oligonucleotide
  Target: ATXN1; (+) strand; PAM type: YTN; PAM sequence: TTA
aaatgagaaggtagaataga

SEQ ID NO: 285026 - DNA, 20 bp, Artificial Sequence
  Description of Artificial Sequence: Synthetic oligonucleotide
  Target: ATXN1; (+) strand; PAM type: YTN; PAM sequence: CTT
aatttgatcatttttattta

SEQ ID NO: 285027 - DNA, 20 bp, Artificial Sequence
  Description of Artificial Sequence: Synthetic oligonucleotide
  Target: ATXN1; (+) strand; PAM type: YTN; PAM sequence: TTA
atttgatcatttttatttaa

SEQ ID NO: 285028 - DNA, 20 bp, Artificial Sequence
  Description of Artificial Sequence: Synthetic oligonucleotide
  Target: ATXN1; (+) strand; PAM type: YTN; PAM sequence: TTT
gatcatttttatttaaattt

SEQ ID NO: 285029 - DNA, 20 bp, Artificial Sequence
  Description of Artificial Sequence: Synthetic oligonucleotide
  Target: ATXN1; (+) strand; PAM type: YTN; PAM sequence: TTG
atcatttttatttaaattta

SEQ ID NO: 285030 - DNA, 20 bp, Artificial Sequence
  Description of Artificial Sequence: Synthetic oligonucleotide
  Target: ATXN1; (+) strand; PAM type: YTN; PAM sequence: TTT
ttatttaaatttactattaa

SEQ ID NO: 285031 - DNA, 20 bp, Artificial Sequence
  Description of Artificial Sequence: Synthetic oligonucleotide
  Target: ATXN1; (+) strand; PAM type: YTN; PAM sequence: TTT
tatttaaatttactattaat

SEQ ID NO: 285032 - DNA, 20 bp, Artificial Sequence
  Description of Artificial Sequence: Synthetic oligonucleotide
  Target: ATXN1; (+) strand; PAM type: YTN; PAM sequence: TTT
atttaaatttactattaatt

SEQ ID NO: 285033 - DNA, 20 bp, Artificial Sequence
  Description of Artificial Sequence: Synthetic oligonucleotide
  Target: ATXN1; (+) strand; PAM type: YTN; PAM sequence: TTA
tttaaatttactattaattt

SEQ ID NO: 285034 - DNA, 20 bp, Artificial Sequence
  Description of Artificial Sequence: Synthetic oligonucleotide
  Target: ATXN1; (+) strand; PAM type: YTN; PAM sequence: TTT
aaatttactattaatttcat

SEQ ID NO: 285035 - DNA, 20 bp, Artificial Sequence
  Description of Artificial Sequence: Synthetic oligonucleotide
  Target: ATXN1; (+) strand; PAM type: YTN; PAM sequence: TTA
aatttactattaatttcatt

SEQ ID NO: 285036 - DNA, 20 bp, Artificial Sequence
  Description of Artificial Sequence: Synthetic oligonucleotide
  Target: ATXN1; (+) strand; PAM type: YTN; PAM sequence: TTT
actattaatttcattaccat

SEQ ID NO: 285037 - DNA, 20 bp, Artificial Sequence
  Description of Artificial Sequence: Synthetic oligonucleotide
  Target: ATXN1; (+) strand; PAM type: YTN; PAM sequence: TTA
ctattaatttcattaccatg

SEQ ID NO: 285038 - DNA, 20 bp, Artificial Sequence
  Description of Artificial Sequence: Synthetic oligonucleotide
  Target: ATXN1; (+) strand; PAM type: YTN; PAM sequence: CTA
ttaatttcattaccatgatg

SEQ ID NO: 285039 - DNA, 20 bp, Artificial Sequence
  Description of Artificial Sequence: Synthetic oligonucleotide
  Target: ATXN1; (+) strand; PAM type: YTN; PAM sequence: TTA
atttcattaccatgatgctt

SEQ ID NO: 285040 - DNA, 20 bp, Artificial Sequence
  Description of Artificial Sequence: Synthetic oligonucleotide
  Target: ATXN1; (+) strand; PAM type: YTN; PAM sequence: TTT
cattaccatgatgcttatgt

SEQ ID NO: 285041 - DNA, 20 bp, Artificial Sequence
  Description of Artificial Sequence: Synthetic oligonucleotide
  Target: ATXN1; (+) strand; PAM type: YTN; PAM sequence: TTC
attaccatgatgcttatgtt

SEQ ID NO: 285042 - DNA, 20 bp, Artificial Sequence
  Description of Artificial Sequence: Synthetic oligonucleotide
  Target: ATXN1; (+) strand; PAM type: YTN; PAM sequence: TTA
ccatgatgcttatgtttgcg

SEQ ID NO: 285043 - DNA, 20 bp, Artificial Sequence
  Description of Artificial Sequence: Synthetic oligonucleotide
  Target: ATXN1; (+) strand; PAM type: YTN; PAM sequence: CTT
atgtttgcgtcataacatct

SEQ ID NO: 285044 - DNA, 20 bp, Artificial Sequence
  Description of Artificial Sequence: Synthetic oligonucleotide
  Target: ATXN1; (+) strand; PAM type: YTN; PAM sequence: TTA
tgtttgcgtcataacatctg

SEQ ID NO: 285045 - DNA, 20 bp, Artificial Sequence
  Description of Artificial Sequence: Synthetic oligonucleotide
  Target: ATXN1; (+) strand; PAM type: YTN; PAM sequence: TTT
gcgtcataacatctgatgga

SEQ ID NO: 285046 - DNA, 20 bp, Artificial Sequence
  Description of Artificial Sequence: Synthetic oligonucleotide
  Target: ATXN1; (+) strand; PAM type: YTN; PAM sequence: TTG
cgtcataacatctgatggaa

SEQ ID NO: 285047 - DNA, 20 bp, Artificial Sequence
  Description of Artificial Sequence: Synthetic oligonucleotide
  Target: ATXN1; (+) strand; PAM type: YTN; PAM sequence: CTG
atggaatcttagtaatataa

SEQ ID NO: 285048 - DNA, 20 bp, Artificial Sequence
  Description of Artificial Sequence: Synthetic oligonucleotide
  Target: ATXN1; (+) strand; PAM type: YTN; PAM sequence: CTT
agtaatataaggcaaaattc

SEQ ID NO: 285049 - DNA, 20 bp, Artificial Sequence
  Description of Artificial Sequence: Synthetic oligonucleotide
  Target: ATXN1; (+) strand; PAM type: YTN; PAM sequence: TTA
gtaatataaggcaaaattct

SEQ ID NO: 285050 - DNA, 20 bp, Artificial Sequence
  Description of Artificial Sequence: Synthetic oligonucleotide
  Target: ATXN1; (+) strand; PAM type: YTN; PAM sequence: TTC
tttgttcattatgctggtcc

SEQ ID NO: 285051 - DNA, 20 bp, Artificial Sequence
  Description of Artificial Sequence: Synthetic oligonucleotide
  Target: ATXN1; (+) strand; PAM type: YTN; PAM sequence: CTT
tgttcattatgctggtcctt

SEQ ID NO: 285052 - DNA, 20 bp, Artificial Sequence
  Description of Artificial Sequence: Synthetic oligonucleotide
  Target: ATXN1; (+) strand; PAM type: YTN; PAM sequence: TTT
gttcattatgctggtccttc

SEQ ID NO: 285053 - DNA, 20 bp, Artificial Sequence
  Description of Artificial Sequence: Synthetic oligonucleotide
  Target: ATXN1; (+) strand; PAM type: YTN; PAM sequence: TTG
ttcattatgctggtccttca

SEQ ID NO: 285054 - DNA, 20 bp, Artificial Sequence
  Description of Artificial Sequence: Synthetic oligonucleotide
  Target: ATXN1; (+) strand; PAM type: YTN; PAM sequence: TTC
attatgctggtccttcaatc

SEQ ID NO: 285055 - DNA, 20 bp, Artificial Sequence
  Description of Artificial Sequence: Synthetic oligonucleotide
  Target: ATXN1; (+) strand; PAM type: YTN; PAM sequence: TTA
tgctggtccttcaatcaggg

SEQ ID NO: 285056 - DNA, 20 bp, Artificial Sequence
  Description of Artificial Sequence: Synthetic oligonucleotide
  Target: ATXN1; (+) strand; PAM type: YTN; PAM sequence: CTG
gtccttcaatcagggatgtc

SEQ ID NO: 285057 - DNA, 20 bp, Artificial Sequence
  Description of Artificial Sequence: Synthetic oligonucleotide
  Target: ATXN1; (+) strand; PAM type: YTN; PAM sequence: CTT
caatcagggatgtcctcatt

SEQ ID NO: 285058 - DNA, 20 bp, Artificial Sequence
  Description of Artificial Sequence: Synthetic oligonucleotide
  Target: ATXN1; (+) strand; PAM type: YTN; PAM sequence: TTC
aatcagggatgtcctcattc

SEQ ID NO: 285059 - DNA, 20 bp, Artificial Sequence
  Description of Artificial Sequence: Synthetic oligonucleotide
  Target: ATXN1; (+) strand; PAM type: YTN; PAM sequence: CTC
attcattcaagcattgctct

SEQ ID NO: 285060 - DNA, 20 bp, Artificial Sequence
  Description of Artificial Sequence: Synthetic oligonucleotide
  Target: ATXN1; (+) strand; PAM type: YTN; PAM sequence: TTC
attcaagcattgctcttcct

SEQ ID NO: 285061 - DNA, 20 bp, Artificial Sequence
  Description of Artificial Sequence: Synthetic oligonucleotide
  Target: ATXN1; (+) strand; PAM type: YTN; PAM sequence: TTC
aagcattgctcttcctttaa

SEQ ID NO: 285062 - DNA, 20 bp, Artificial Sequence
  Description of Artificial Sequence: Synthetic oligonucleotide
  Target: ATXN1; (+) strand; PAM type: YTN; PAM sequence: TTG
ctcttcctttaagattcagc

SEQ ID NO: 285063 - DNA, 20 bp, Artificial Sequence
  Description of Artificial Sequence: Synthetic oligonucleotide
  Target: ATXN1; (+) strand; PAM type: YTN; PAM sequence: CTC
ttcctttaagattcagctcg

SEQ ID NO: 285064 - DNA, 20 bp, Artificial Sequence
  Description of Artificial Sequence: Synthetic oligonucleotide
  Target: ATXN1; (+) strand; PAM type: YTN; PAM sequence: CTT
cctttaagattcagctcgat

SEQ ID NO: 285065 - DNA, 20 bp, Artificial Sequence
  Description of Artificial Sequence: Synthetic oligonucleotide
  Target: ATXN1; (+) strand; PAM type: YTN; PAM sequence: TTC
ctttaagattcagctcgatg

SEQ ID NO: 285066 - DNA, 20 bp, Artificial Sequence
  Description of Artificial Sequence: Synthetic oligonucleotide
  Target: ATXN1; (+) strand; PAM type: YTN; PAM sequence: CTT
taagattcagctcgatgtca

SEQ ID NO: 285067 - DNA, 20 bp, Artificial Sequence
  Description of Artificial Sequence: Synthetic oligonucleotide
  Target: ATXN1; (+) strand; PAM type: YTN; PAM sequence: TTT
aagattcagctcgatgtcac

SEQ ID NO: 285068 - DNA, 20 bp, Artificial Sequence
  Description of Artificial Sequence: Synthetic oligonucleotide
  Target: ATXN1; (+) strand; PAM type: YTN; PAM sequence: TTA
agattcagctcgatgtcact

SEQ ID NO: 285069 - DNA, 20 bp, Artificial Sequence
  Description of Artificial Sequence: Synthetic oligonucleotide
  Target: ATXN1; (+) strand; PAM type: YTN; PAM sequence: TTC
agctcgatgtcacttccttt

SEQ ID NO: 285070 - DNA, 20 bp, Artificial Sequence
  Description of Artificial Sequence: Synthetic oligonucleotide
  Target: ATXN1; (+) strand; PAM type: YTN; PAM sequence: CTC
gatgtcacttcctttgtgac

SEQ ID NO: 285071 - DNA, 20 bp, Artificial Sequence
  Description of Artificial Sequence: Synthetic oligonucleotide
  Target: ATXN1; (+) strand; PAM type: YTN; PAM sequence: CTT
cctttgtgacatgctcccat

SEQ ID NO: 285072 - DNA, 20 bp, Artificial Sequence
  Description of Artificial Sequence: Synthetic oligonucleotide
  Target: ATXN1; (+) strand; PAM type: YTN; PAM sequence: TTC
ctttgtgacatgctcccata

SEQ ID NO: 285073 - DNA, 20 bp, Artificial Sequence
  Description of Artificial Sequence: Synthetic oligonucleotide
  Target: ATXN1; (+) strand; PAM type: YTN; PAM sequence: CTT
tgtgacatgctcccatacat

SEQ ID NO: 285074 - DNA, 20 bp, Artificial Sequence
  Description of Artificial Sequence: Synthetic oligonucleotide
  Target: ATXN1; (+) strand; PAM type: YTN; PAM sequence: TTT
gtgacatgctcccatacata

SEQ ID NO: 285075 - DNA, 20 bp, Artificial Sequence
  Description of Artificial Sequence: Synthetic oligonucleotide
  Target: ATXN1; (+) strand; PAM type: YTN; PAM sequence: TTG
tgacatgctcccatacatat

SEQ ID NO: 285076 - DNA, 20 bp, Artificial Sequence
  Description of Artificial Sequence: Synthetic oligonucleotide
  Target: ATXN1; (+) strand; PAM type: YTN; PAM sequence: CTC
ccatacatattgtattttcc

SEQ ID NO: 285077 - DNA, 20 bp, Artificial Sequence
  Description of Artificial Sequence: Synthetic oligonucleotide
  Target: ATXN1; (+) strand; PAM type: YTN; PAM sequence: TTG
tattttccctgccgtgtaat

SEQ ID NO: 285078 - DNA, 20 bp, Artificial Sequence
  Description of Artificial Sequence: Synthetic oligonucleotide
  Target: ATXN1; (+) strand; PAM type: YTN; PAM sequence: TTT
tccctgccgtgtaatgatct

SEQ ID NO: 285079 - DNA, 20 bp, Artificial Sequence
  Description of Artificial Sequence: Synthetic oligonucleotide
  Target: ATXN1; (+) strand; PAM type: YTN; PAM sequence: TTT
ccctgccgtgtaatgatctg

SEQ ID NO: 285080 - DNA, 20 bp, Artificial Sequence
  Description of Artificial Sequence: Synthetic oligonucleotide
  Target: ATXN1; (+) strand; PAM type: YTN; PAM sequence: TTC
cctgccgtgtaatgatctgt

SEQ ID NO: 285081 - DNA, 20 bp, Artificial Sequence
  Description of Artificial Sequence: Synthetic oligonucleotide
  Target: ATXN1; (+) strand; PAM type: YTN; PAM sequence: CTG
ccgtgtaatgatctgtctcc

SEQ ID NO: 285082 - DNA, 20 bp, Artificial Sequence
  Description of Artificial Sequence: Synthetic oligonucleotide
  Target: ATXN1; (+) strand; PAM type: YTN; PAM sequence: CTG
tctccctttctagactatga

SEQ ID NO: 285083 - DNA, 20 bp, Artificial Sequence
  Description of Artificial Sequence: Synthetic oligonucleotide
  Target: ATXN1; (+) strand; PAM type: YTN; PAM sequence: CTC
cctttctagactatgagctc

SEQ ID NO: 285084 - DNA, 20 bp, Artificial Sequence
  Description of Artificial Sequence: Synthetic oligonucleotide
  Target: ATXN1; (+) strand; PAM type: YTN; PAM sequence: CTT
tctagactatgagctcctta

SEQ ID NO: 285085 - DNA, 20 bp, Artificial Sequence
  Description of Artificial Sequence: Synthetic oligonucleotide
  Target: ATXN1; (+) strand; PAM type: YTN; PAM sequence: TTT
ctagactatgagctccttag

SEQ ID NO: 285086 - DNA, 20 bp, Artificial Sequence
  Description of Artificial Sequence: Synthetic oligonucleotide
  Target: ATXN1; (+) strand; PAM type: YTN; PAM sequence: TTC
tagactatgagctccttagg

SEQ ID NO: 285087 - DNA, 20 bp, Artificial Sequence
  Description of Artificial Sequence: Synthetic oligonucleotide
  Target: ATXN1; (+) strand; PAM type: YTN; PAM sequence: CTA
gactatgagctccttagggg

SEQ ID NO: 285088 - DNA, 20 bp, Artificial Sequence
  Description of Artificial Sequence: Synthetic oligonucleotide
  Target: ATXN1; (+) strand; PAM type: YTN; PAM sequence: CTA
tgagctccttaggggcccca

SEQ ID NO: 285089 - DNA, 20 bp, Artificial Sequence
  Description of Artificial Sequence: Synthetic oligonucleotide
  Target: ATXN1; (+) strand; PAM type: YTN; PAM sequence: CTC
cttaggggccccagcgaggt

SEQ ID NO: 285090 - DNA, 20 bp, Artificial Sequence
  Description of Artificial Sequence: Synthetic oligonucleotide
  Target: ATXN1; (+) strand; PAM type: YTN; PAM sequence: CTT
aggggccccagcgaggtctc

SEQ ID NO: 285091 - DNA, 20 bp, Artificial Sequence
  Description of Artificial Sequence: Synthetic oligonucleotide
  Target: ATXN1; (+) strand; PAM type: YTN; PAM sequence: TTA
ggggccccagcgaggtctct

SEQ ID NO: 285092 - DNA, 20 bp, Artificial Sequence
  Description of Artificial Sequence: Synthetic oligonucleotide
  Target: ATXN1; (+) strand; PAM type: YTN; PAM sequence: CTC
tgtatttttcataacaaact

SEQ ID NO: 285093 - DNA, 20 bp, Artificial Sequence
  Description of Artificial Sequence: Synthetic oligonucleotide
  Target: ATXN1; (+) strand; PAM type: YTN; PAM sequence: CTG
tatttttcataacaaactgc

SEQ ID NO: 285094 - DNA, 20 bp, Artificial Sequence
  Description of Artificial Sequence: Synthetic oligonucleotide
  Target: ATXN1; (+) strand; PAM type: YTN; PAM sequence: TTT
ttcataacaaactgcacaat

SEQ ID NO: 285095 - DNA, 20 bp, Artificial Sequence
  Description of Artificial Sequence: Synthetic oligonucleotide
  Target: ATXN1; (+) strand; PAM type: YTN; PAM sequence: TTT
tcataacaaactgcacaatt

SEQ ID NO: 285096 - DNA, 20 bp, Artificial Sequence
  Description of Artificial Sequence: Synthetic oligonucleotide
  Target: ATXN1; (+) strand; PAM type: YTN; PAM sequence: TTT
cataacaaactgcacaattc

SEQ ID NO: 285097 - DNA, 20 bp, Artificial Sequence
  Description of Artificial Sequence: Synthetic oligonucleotide
  Target: ATXN1; (+) strand; PAM type: YTN; PAM sequence: TTC
ataacaaactgcacaattct

SEQ ID NO: 285098 - DNA, 20 bp, Artificial Sequence
  Description of Artificial Sequence: Synthetic oligonucleotide
  Target: ATXN1; (+) strand; PAM type: YTN; PAM sequence: CTG
cacaattctttgcacagaat

SEQ ID NO: 285099 - DNA, 20 bp, Artificial Sequence
  Description of Artificial Sequence: Synthetic oligonucleotide
  Target: ATXN1; (+) strand; PAM type: YTN; PAM sequence: TTC
tttgcacagaatatactctc

SEQ ID NO: 285100 - DNA, 20 bp, Artificial Sequence
  Description of Artificial Sequence: Synthetic oligonucleotide
  Target: ATXN1; (+) strand; PAM type: YTN; PAM sequence: CTT
tgcacagaatatactctcag

SEQ ID NO: 285101 - DNA, 20 bp, Artificial Sequence
  Description of Artificial Sequence: Synthetic oligonucleotide
  Target: ATXN1; (+) strand; PAM type: YTN; PAM sequence: TTT
gcacagaatatactctcagt

SEQ ID NO: 285102 - DNA, 20 bp, Artificial Sequence
  Description of Artificial Sequence: Synthetic oligonucleotide
  Target: ATXN1; (+) strand; PAM type: YTN; PAM sequence: TTG
cacagaatatactctcagta

SEQ ID NO: 285103 - DNA, 20 bp, Artificial Sequence
  Description of Artificial Sequence: Synthetic oligonucleotide
  Target: ATXN1; (+) strand; PAM type: YTN; PAM sequence: CTC
tcagtaaacactggtttgat

SEQ ID NO: 285104 - DNA, 20 bp, Artificial Sequence
  Description of Artificial Sequence: Synthetic oligonucleotide
  Target: ATXN1; (+) strand; PAM type: YTN; PAM sequence: CTC
agtaaacactggtttgatgt

SEQ ID NO: 285105 - DNA, 20 bp, Artificial Sequence
  Description of Artificial Sequence: Synthetic oligonucleotide
  Target: ATXN1; (+) strand; PAM type: YTN; PAM sequence: CTG
gtttgatgtgtgggtgaata

SEQ ID NO: 285106 - DNA, 20 bp, Artificial Sequence
  Description of Artificial Sequence: Synthetic oligonucleotide
  Target: ATXN1; (+) strand; PAM type: YTN; PAM sequence: TTT
gatgtgtgggtgaatacaca

SEQ ID NO: 285107 - DNA, 20 bp, Artificial Sequence
  Description of Artificial Sequence: Synthetic oligonucleotide
  Target: ATXN1; (+) strand; PAM type: YTN; PAM sequence: TTG
atgtgtgggtgaatacacac

SEQ ID NO: 285108 - DNA, 20 bp, Artificial Sequence
  Description of Artificial Sequence: Synthetic oligonucleotide
  Target: ATXN1; (+) strand; PAM type: YTN; PAM sequence: CTT
tgatactcttatgactatgg

SEQ ID NO: 285109 - DNA, 20 bp, Artificial Sequence
  Description of Artificial Sequence: Synthetic oligonucleotide
  Target: ATXN1; (+) strand; PAM type: YTN; PAM sequence: TTT
gatactcttatgactatggt

SEQ ID NO: 285110 - DNA, 20 bp, Artificial Sequence
  Description of Artificial Sequence: Synthetic oligonucleotide
  Target: ATXN1; (+) strand; PAM type: YTN; PAM sequence: TTG
atactcttatgactatggtg

SEQ ID NO: 285111 - DNA, 20 bp, Artificial Sequence
  Description of Artificial Sequence: Synthetic oligonucleotide
  Target: ATXN1; (+) strand; PAM type: YTN; PAM sequence: CTC
ttatgactatggtgaaaagg

SEQ ID NO: 285112 - DNA, 20 bp, Artificial Sequence
  Description of Artificial Sequence: Synthetic oligonucleotide
  Target: ATXN1; (+) strand; PAM type: YTN; PAM sequence: CTT
atgactatggtgaaaaggcc

SEQ ID NO: 285113 - DNA, 20 bp, Artificial Sequence
  Description of Artificial Sequence: Synthetic oligonucleotide
  Target: ATXN1; (+) strand; PAM type: YTN; PAM sequence: TTA
tgactatggtgaaaaggcca

SEQ ID NO: 285114 - DNA, 20 bp, Artificial Sequence
  Description of Artificial Sequence: Synthetic oligonucleotide
  Target: ATXN1; (+) strand; PAM type: YTN; PAM sequence: CTA
tggtgaaaaggccactaatt

SEQ ID NO: 285115 - DNA, 20 bp, Artificial Sequence
  Description of Artificial Sequence: Synthetic oligonucleotide
  Target: ATXN1; (+) strand; PAM type: YTN; PAM sequence: CTA
attgtgatttcaacttaaag

SEQ ID NO: 285116 - DNA, 20 bp, Artificial Sequence
  Description of Artificial Sequence: Synthetic oligonucleotide
  Target: ATXN1; (+) strand; PAM type: YTN; PAM sequence: TTG
tgatttcaacttaaaggtta

SEQ ID NO: 285117 - DNA, 20 bp, Artificial Sequence
  Description of Artificial Sequence: Synthetic oligonucleotide
  Target: ATXN1; (+) strand; PAM type: YTN; PAM sequence: TTT
caacttaaaggttaaagcca

SEQ ID NO: 285118 - DNA, 20 bp, Artificial Sequence
  Description of Artificial Sequence: Synthetic oligonucleotide
  Target: ATXN1; (+) strand; PAM type: YTN; PAM sequence: TTC
aacttaaaggttaaagccaa

SEQ ID NO: 285119 - DNA, 20 bp, Artificial Sequence
  Description of Artificial Sequence: Synthetic oligonucleotide
  Target: ATXN1; (+) strand; PAM type: YTN; PAM sequence: CTT
aaaggttaaagccaaaaaaa

SEQ ID NO: 285120 - DNA, 20 bp, Artificial Sequence
  Description of Artificial Sequence: Synthetic oligonucleotide
  Target: ATXN1; (+) strand; PAM type: YTN; PAM sequence: TTA
aaggttaaagccaaaaaaaa

SEQ ID NO: 285121 - DNA, 20 bp, Artificial Sequence
  Description of Artificial Sequence: Synthetic oligonucleotide
  Target: ATXN1; (+) strand; PAM type: YTN; PAM sequence: TTA
aagccaaaaaaaatccattt

SEQ ID NO: 285122 - DNA, 20 bp, Artificial Sequence
  Description of Artificial Sequence: Synthetic oligonucleotide
  Target: ATXN1; (+) strand; PAM type: YTN; PAM sequence: TTT
tttagtgaaatgaaactctt

SEQ ID NO: 285123 - DNA, 20 bp, Artificial Sequence
  Description of Artificial Sequence: Synthetic oligonucleotide
  Target: ATXN1; (+) strand; PAM type: YTN; PAM sequence: TTT
ttagtgaaatgaaactctta

SEQ ID NO: 285124 - DNA, 20 bp, Artificial Sequence
  Description of Artificial Sequence: Synthetic oligonucleotide
  Target: ATXN1; (+) strand; PAM type: YTN; PAM sequence: TTT
tagtgaaatgaaactcttag

SEQ ID NO: 285125 - DNA, 20 bp, Artificial Sequence
  Description of Artificial Sequence: Synthetic oligonucleotide
  Target: ATXN1; (+) strand; PAM type: YTN; PAM sequence: TTT
agtgaaatgaaactcttagc

SEQ ID NO: 285126 - DNA, 20 bp, Artificial Sequence
  Description of Artificial Sequence: Synthetic oligonucleotide
  Target: ATXN1; (+) strand; PAM type: YTN; PAM sequence: TTA
gtgaaatgaaactcttagcg

SEQ ID NO: 285127 - DNA, 20 bp, Artificial Sequence
  Description of Artificial Sequence: Synthetic oligonucleotide
  Target: ATXN1; (+) strand; PAM type: YTN; PAM sequence: CTC
ttagcgttttcacttccaga

SEQ ID NO: 285128 - DNA, 20 bp, Artificial Sequence
  Description of Artificial Sequence: Synthetic oligonucleotide
  Target: ATXN1; (+) strand; PAM type: YTN; PAM sequence: CTT
agcgttttcacttccagatg

SEQ ID NO: 285129 - DNA, 20 bp, Artificial Sequence
  Description of Artificial Sequence: Synthetic oligonucleotide
  Target: ATXN1; (+) strand; PAM type: YTN; PAM sequence: TTA
gcgttttcacttccagatgc

SEQ ID NO: 285130 - DNA, 20 bp, Artificial Sequence
  Description of Artificial Sequence: Synthetic oligonucleotide
  Target: ATXN1; (+) strand; PAM type: YTN; PAM sequence: TTT
tcacttccagatgcatcagc

SEQ ID NO: 285131 - DNA, 20 bp, Artificial Sequence
  Description of Artificial Sequence: Synthetic oligonucleotide
  Target: ATXN1; (+) strand; PAM type: YTN; PAM sequence: TTT
cacttccagatgcatcagca

SEQ ID NO: 285132 - DNA, 20 bp, Artificial Sequence
  Description of Artificial Sequence: Synthetic oligonucleotide
  Target: ATXN1; (+) strand; PAM type: YTN; PAM sequence: TTC
acttccagatgcatcagcat

SEQ ID NO: 285133 - DNA, 20 bp, Artificial Sequence
  Description of Artificial Sequence: Synthetic oligonucleotide
  Target: ATXN1; (+) strand; PAM type: YTN; PAM sequence: CTT
ccagatgcatcagcattaca

SEQ ID NO: 285134 - DNA, 20 bp, Artificial Sequence
  Description of Artificial Sequence: Synthetic oligonucleotide
  Target: ATXN1; (+) strand; PAM type: YTN; PAM sequence: TTC
cagatgcatcagcattacat

SEQ ID NO: 285135 - DNA, 20 bp, Artificial Sequence
  Description of Artificial Sequence: Synthetic oligonucleotide
  Target: ATXN1; (+) strand; PAM type: YTN; PAM sequence: TTA
cataaaagatgttgaaacta

SEQ ID NO: 285136 - DNA, 20 bp, Artificial Sequence
  Description of Artificial Sequence: Synthetic oligonucleotide
  Target: ATXN1; (+) strand; PAM type: YTN; PAM sequence: TTG
aaactattttaaaaaatagt

SEQ ID NO: 285137 - DNA, 20 bp, Artificial Sequence
  Description of Artificial Sequence: Synthetic oligonucleotide
  Target: ATXN1; (+) strand; PAM type: YTN; PAM sequence: CTA
ttttaaaaaatagtcatgct

SEQ ID NO: 285138 - DNA, 20 bp, Artificial Sequence
  Description of Artificial Sequence: Synthetic oligonucleotide
  Target: ATXN1; (+) strand; PAM type: YTN; PAM sequence: TTT
taaaaaatagtcatgctgcg

SEQ ID NO: 285139 - DNA, 20 bp, Artificial Sequence
  Description of Artificial Sequence: Synthetic oligonucleotide
  Target: ATXN1; (+) strand; PAM type: YTN; PAM sequence: TTT
aaaaaatagtcatgctgcgc

SEQ ID NO: 285140 - DNA, 20 bp, Artificial Sequence
  Description of Artificial Sequence: Synthetic oligonucleotide
  Target: ATXN1; (+) strand; PAM type: YTN; PAM sequence: TTA
aaaaatagtcatgctgcgca

SEQ ID NO: 285141 - DNA, 20 bp, Artificial Sequence
  Description of Artificial Sequence: Synthetic oligonucleotide
  Target: ATXN1; (+) strand; PAM type: YTN; PAM sequence: CTG
cgcattttcctgtctgagaa

SEQ ID NO: 285142 - DNA, 20 bp, Artificial Sequence
  Description of Artificial Sequence: Synthetic oligonucleotide
  Target: ATXN1; (+) strand; PAM type: YTN; PAM sequence: TTT
tcctgtctgagaattagact

SEQ ID NO: 285143 - DNA, 20 bp, Artificial Sequence
  Description of Artificial Sequence: Synthetic oligonucleotide
  Target: ATXN1; (+) strand; PAM type: YTN; PAM sequence: TTT
cctgtctgagaattagactg

SEQ ID NO: 285144 - DNA, 20 bp, Artificial Sequence
  Description of Artificial Sequence: Synthetic oligonucleotide
  Target: ATXN1; (+) strand; PAM type: YTN; PAM sequence: TTC
ctgtctgagaattagactga

SEQ ID NO: 285145 - DNA, 20 bp, Artificial Sequence
  Description of Artificial Sequence: Synthetic oligonucleotide
  Target: ATXN1; (+) strand; PAM type: YTN; PAM sequence: CTG
tctgagaattagactgaaaa

SEQ ID NO: 285146 - DNA, 20 bp, Artificial Sequence
  Description of Artificial Sequence: Synthetic oligonucleotide
  Target: ATXN1; (+) strand; PAM type: YTN; PAM sequence: CTG
agaattagactgaaaatacc

SEQ ID NO: 285147 - DNA, 20 bp, Artificial Sequence
  Description of Artificial Sequence: Synthetic oligonucleotide
  Target: ATXN1; (+) strand; PAM type: YTN; PAM sequence: TTA
gactgaaaataccaaattcc

SEQ ID NO: 285148 - DNA, 20 bp, Artificial Sequence
  Description of Artificial Sequence: Synthetic oligonucleotide
  Target: ATXN1; (+) strand; PAM type: YTN; PAM sequence: CTG
aaaataccaaattccccagg

SEQ ID NO: 285149 - DNA, 20 bp, Artificial Sequence
  Description of Artificial Sequence: Synthetic oligonucleotide
  Target: ATXN1; (+) strand; PAM type: YTN; PAM sequence: TTC
cccaggggcccctgggtgtt

SEQ ID NO: 285150 - DNA, 20 bp, Artificial Sequence
  Description of Artificial Sequence: Synthetic oligonucleotide
  Target: ATXN1; (+) strand; PAM type: YTN; PAM sequence: CTG
ggtgttctaaagacaaatgt

SEQ ID NO: 285151 - DNA, 20 bp, Artificial Sequence
  Description of Artificial Sequence: Synthetic oligonucleotide
  Target: ATXN1; (+) strand; PAM type: YTN; PAM sequence: TTC
taaagacaaatgttcagtta

SEQ ID NO: 285152 - DNA, 20 bp, Artificial Sequence
  Description of Artificial Sequence: Synthetic oligonucleotide
  Target: ATXN1; (+) strand; PAM type: YTN; PAM sequence: CTA
aagacaaatgttcagttagc

SEQ ID NO: 285153 - DNA, 20 bp, Artificial Sequence
  Description of Artificial Sequence: Synthetic oligonucleotide
  Target: ATXN1; (+) strand; PAM type: YTN; PAM sequence: TTC
agttagctattgattccatg

SEQ ID NO: 285154 - DNA, 20 bp, Artificial Sequence
  Description of Artificial Sequence: Synthetic oligonucleotide
  Target: ATXN1; (+) strand; PAM type: YTN; PAM sequence: TTA
gctattgattccatgcactc

SEQ ID NO: 285155 - DNA, 20 bp, Artificial Sequence
  Description of Artificial Sequence: Synthetic oligonucleotide
  Target: ATXN1; (+) strand; PAM type: YTN; PAM sequence: CTA
ttgattccatgcactcattt

SEQ ID NO: 285156 - DNA, 20 bp, Artificial Sequence
  Description of Artificial Sequence: Synthetic oligonucleotide
  Target: ATXN1; (+) strand; PAM type: YTN; PAM sequence: TTG
attccatgcactcatttaat

SEQ ID NO: 285157 - DNA, 20 bp, Artificial Sequence
  Description of Artificial Sequence: Synthetic oligonucleotide
  Target: ATXN1; (+) strand; PAM type: YTN; PAM sequence: TTC
catgcactcatttaatggaa

SEQ ID NO: 285158 - DNA, 20 bp, Artificial Sequence
  Description of Artificial Sequence: Synthetic oligonucleotide
  Target: ATXN1; (+) strand; PAM type: YTN; PAM sequence: CTC
atttaatggaaatccggagt

SEQ ID NO: 285159 - DNA, 20 bp, Artificial Sequence
  Description of Artificial Sequence: Synthetic oligonucleotide
  Target: ATXN1; (+) strand; PAM type: YTN; PAM sequence: TTT
aatggaaatccggagtaaga

SEQ ID NO: 285160 - DNA, 20 bp, Artificial Sequence
  Description of Artificial Sequence: Synthetic oligonucleotide
  Target: ATXN1; (+) strand; PAM type: YTN; PAM sequence: TTA
atggaaatccggagtaagac

SEQ ID NO: 285161 - DNA, 20 bp, Artificial Sequence
  Description of Artificial Sequence: Synthetic oligonucleotide
  Target: ATXN1; (+) strand; PAM type: YTN; PAM sequence: CTC
aacctccccaccaccagcct

SEQ ID NO: 285162 - DNA, 20 bp, Artificial Sequence
  Description of Artificial Sequence: Synthetic oligonucleotide
  Target: ATXN1; (+) strand; PAM type: YTN; PAM sequence: CTC
cccaccaccagcctgtcact

SEQ ID NO: 285163 - DNA, 20 bp, Artificial Sequence
  Description of Artificial Sequence: Synthetic oligonucleotide
  Target: ATXN1; (+) strand; PAM type: YTN; PAM sequence: CTG
tcactcattattctgctcag

SEQ ID NO: 285164 - DNA, 20 bp, Artificial Sequence
  Description of Artificial Sequence: Synthetic oligonucleotide
  Target: ATXN1; (+) strand; PAM type: YTN; PAM sequence: CTC
attattctgctcagctgttt

SEQ ID NO: 285165 - DNA, 20 bp, Artificial Sequence
  Description of Artificial Sequence: Synthetic oligonucleotide
  Target: ATXN1; (+) strand; PAM type: YTN; PAM sequence: TTA
ttctgctcagctgtttcaga

SEQ ID NO: 285166 - DNA, 20 bp, Artificial Sequence
  Description of Artificial Sequence: Synthetic oligonucleotide
  Target: ATXN1; (+) strand; PAM type: YTN; PAM sequence: TTC
tgctcagctgtttcagaata

SEQ ID NO: 285167 - DNA, 20 bp, Artificial Sequence
  Description of Artificial Sequence: Synthetic oligonucleotide
  Target: ATXN1; (+) strand; PAM type: YTN; PAM sequence: CTG
ctcagctgtttcagaataag

SEQ ID NO: 285168 - DNA, 20 bp, Artificial Sequence
  Description of Artificial Sequence: Synthetic oligonucleotide
  Target: ATXN1; (+) strand; PAM type: YTN; PAM sequence: CTC
agctgtttcagaataagcga

SEQ ID NO: 285169 - DNA, 20 bp, Artificial Sequence
  Description of Artificial Sequence: Synthetic oligonucleotide
  Target: ATXN1; (+) strand; PAM type: YTN; PAM sequence: CTG
tttcagaataagcgacgact

SEQ ID NO: 285170 - DNA, 20 bp, Artificial Sequence
  Description of Artificial Sequence: Synthetic oligonucleotide
  Target: ATXN1; (+) strand; PAM type: YTN; PAM sequence: TTT
cagaataagcgacgactccc

SEQ ID NO: 285171 - DNA, 20 bp, Artificial Sequence
  Description of Artificial Sequence: Synthetic oligonucleotide
  Target: ATXN1; (+) strand; PAM type: YTN; PAM sequence: TTC
agaataagcgacgactcccg

SEQ ID NO: 285172 - DNA, 20 bp, Artificial Sequence
  Description of Artificial Sequence: Synthetic oligonucleotide
  Target: ATXN1; (+) strand; PAM type: YTN; PAM sequence: CTC
ccgggagagctctgcccccc

SEQ ID NO: 285173 - DNA, 20 bp, Artificial Sequence
  Description of Artificial Sequence: Synthetic oligonucleotide
  Target: ATXN1; (+) strand; PAM type: YTN; PAM sequence: CTC
tgcccccctcccagtactgg

SEQ ID NO: 285174 - DNA, 20 bp, Artificial Sequence
  Description of Artificial Sequence: Synthetic oligonucleotide
  Target: ATXN1; (+) strand; PAM type: YTN; PAM sequence: CTG
cccccctcccagtactggcc

SEQ ID NO: 285175 - DNA, 20 bp, Artificial Sequence
  Description of Artificial Sequence: Synthetic oligonucleotide
  Target: ATXN1; (+) strand; PAM type: YTN; PAM sequence: CTC
ccagtactggccagcacttc

SEQ ID NO: 285176 - DNA, 20 bp, Artificial Sequence
  Description of Artificial Sequence: Synthetic oligonucleotide
  Target: ATXN1; (+) strand; PAM type: YTN; PAM sequence: CTG
gccagcacttcagtgatgat

SEQ ID NO: 285177 - DNA, 20 bp, Artificial Sequence
  Description of Artificial Sequence: Synthetic oligonucleotide
  Target: ATXN1; (+) strand; PAM type: YTN; PAM sequence: CTT
cagtgatgatgaatccgagc

SEQ ID NO: 285178 - DNA, 20 bp, Artificial Sequence
  Description of Artificial Sequence: Synthetic oligonucleotide
  Target: ATXN1; (+) strand; PAM type: YTN; PAM sequence: TTC
agtgatgatgaatccgagca

SEQ ID NO: 285179 - DNA, 20 bp, Artificial Sequence
  Description of Artificial Sequence: Synthetic oligonucleotide
  Target: ATXN1; (+) strand; PAM type: YTN; PAM sequence: TTT
cagtactcaaagcagcagaa

SEQ ID NO: 285180 - DNA, 20 bp, Artificial Sequence
  Description of Artificial Sequence: Synthetic oligonucleotide
  Target: ATXN1; (+) strand; PAM type: YTN; PAM sequence: TTC
agtactcaaagcagcagaac

SEQ ID NO: 285181 - DNA, 20 bp, Artificial Sequence
  Description of Artificial Sequence: Synthetic oligonucleotide
  Target: ATXN1; (+) strand; PAM type: YTN; PAM sequence: CTC
aaagcagcagaacatcagtc

SEQ ID NO: 285182 - DNA, 20 bp, Artificial Sequence
  Description of Artificial Sequence: Synthetic oligonucleotide
  Target: ATXN1; (+) strand; PAM type: YTN; PAM sequence: CTT
acattttccacttccattgt

SEQ ID NO: 285183 - DNA, 20 bp, Artificial Sequence
  Description of Artificial Sequence: Synthetic oligonucleotide
  Target: ATXN1; (+) strand; PAM type: YTN; PAM sequence: TTA
cattttccacttccattgtc

SEQ ID NO: 285184 - DNA, 20 bp, Artificial Sequence
  Description of Artificial Sequence: Synthetic oligonucleotide
  Target: ATXN1; (+) strand; PAM type: YTN; PAM sequence: TTT
tccacttccattgtcattct

SEQ ID NO: 285185 - DNA, 20 bp, Artificial Sequence
  Description of Artificial Sequence: Synthetic oligonucleotide
  Target: ATXN1; (+) strand; PAM type: YTN; PAM sequence: TTT
ccacttccattgtcattctt

SEQ ID NO: 285186 - DNA, 20 bp, Artificial Sequence
  Description of Artificial Sequence: Synthetic oligonucleotide
  Target: ATXN1; (+) strand; PAM type: YTN; PAM sequence: TTC
cacttccattgtcattctta

SEQ ID NO: 285187 - DNA, 20 bp, Artificial Sequence
  Description of Artificial Sequence: Synthetic oligonucleotide
  Target: ATXN1; (+) strand; PAM type: YTN; PAM sequence: CTT
ccattgtcattcttattcct

SEQ ID NO: 285188 - DNA, 20 bp, Artificial Sequence
  Description of Artificial Sequence: Synthetic oligonucleotide
  Target: ATXN1; (+) strand; PAM type: YTN; PAM sequence: TTC
cattgtcattcttattccta

SEQ ID NO: 285189 - DNA, 20 bp, Artificial Sequence
  Description of Artificial Sequence: Synthetic oligonucleotide
  Target: ATXN1; (+) strand; PAM type: YTN; PAM sequence: TTG
tcattcttattcctatatgg

SEQ ID NO: 285190 - DNA, 20 bp, Artificial Sequence
  Description of Artificial Sequence: Synthetic oligonucleotide
  Target: ATXN1; (+) strand; PAM type: YTN; PAM sequence: TTC
ttattcctatatgggcttat

SEQ ID NO: 285191 - DNA, 20 bp, Artificial Sequence
  Description of Artificial Sequence: Synthetic oligonucleotide
  Target: ATXN1; (+) strand; PAM type: YTN; PAM sequence: CTT
attcctatatgggcttattt

SEQ ID NO: 285192 - DNA, 20 bp, Artificial Sequence
  Description of Artificial Sequence: Synthetic oligonucleotide
  Target: ATXN1; (+) strand; PAM type: YTN; PAM sequence: TTA
ttcctatatgggcttatttc

SEQ ID NO: 285193 - DNA, 20 bp, Artificial Sequence
  Description of Artificial Sequence: Synthetic oligonucleotide
  Target: ATXN1; (+) strand; PAM type: YTN; PAM sequence: TTC
ctatatgggcttatttctca

SEQ ID NO: 285194 - DNA, 20 bp, Artificial Sequence
  Description of Artificial Sequence: Synthetic oligonucleotide
  Target: ATXN1; (+) strand; PAM type: YTN; PAM sequence: CTA
tatgggcttatttctcacat

SEQ ID NO: 285195 - DNA, 20 bp, Artificial Sequence
  Description of Artificial Sequence: Synthetic oligonucleotide
  Target: ATXN1; (+) strand; PAM type: YTN; PAM sequence: CTT
atttctcacatatccacctt

SEQ ID NO: 285196 - DNA, 20 bp, Artificial Sequence
  Description of Artificial Sequence: Synthetic oligonucleotide
  Target: ATXN1; (+) strand; PAM type: YTN; PAM sequence: TTA
tttctcacatatccaccttt

SEQ ID NO: 285197 - DNA, 20 bp, Artificial Sequence
  Description of Artificial Sequence: Synthetic oligonucleotide
  Target: ATXN1; (+) strand; PAM type: YTN; PAM sequence: TTT
ctcacatatccacctttgat

SEQ ID NO: 285198 - DNA, 20 bp, Artificial Sequence
  Description of Artificial Sequence: Synthetic oligonucleotide
  Target: ATXN1; (+) strand; PAM type: YTN; PAM sequence: TTC
tcacatatccacctttgatt

SEQ ID NO: 285199 - DNA, 20 bp, Artificial Sequence
  Description of Artificial Sequence: Synthetic oligonucleotide
  Target: ATXN1; (+) strand; PAM type: YTN; PAM sequence: CTC
acatatccacctttgatttt

SEQ ID NO: 285200 - DNA, 20 bp, Artificial Sequence
  Description of Artificial Sequence: Synthetic oligonucleotide
  Target: ATXN1; (+) strand; PAM type: YTN; PAM sequence: CTT
tgatttttcaagatcgaacc

SEQ ID NO: 285201 - DNA, 20 bp, Artificial Sequence
  Description of Artificial Sequence: Synthetic oligonucleotide
  Target: ATXN1; (+) strand; PAM type: YTN; PAM sequence: TTT
gatttttcaagatcgaacct

SEQ ID NO: 285202 - DNA, 20 bp, Artificial Sequence
  Description of Artificial Sequence: Synthetic oligonucleotide
  Target: ATXN1; (+) strand; PAM type: YTN; PAM sequence: TTG
atttttcaagatcgaacctt

SEQ ID NO: 285203 - DNA, 20 bp, Artificial Sequence
  Description of Artificial Sequence: Synthetic oligonucleotide
  Target: ATXN1; (+) strand; PAM type: YTN; PAM sequence: TTT
ttcaagatcgaacctttgaa

SEQ ID NO: 285204 - DNA, 20 bp, Artificial Sequence
  Description of Artificial Sequence: Synthetic oligonucleotide
  Target: ATXN1; (+) strand; PAM type: YTN; PAM sequence: TTT
tcaagatcgaacctttgaaa

SEQ ID NO: 285205 - DNA, 20 bp, Artificial Sequence
  Description of Artificial Sequence: Synthetic oligonucleotide
  Target: ATXN1; (+) strand; PAM type: YTN; PAM sequence: TTT
caagatcgaacctttgaaaa

SEQ ID NO: 285206 - DNA, 20 bp, Artificial Sequence
  Description of Artificial Sequence: Synthetic oligonucleotide
  Target: ATXN1; (+) strand; PAM type: YTN; PAM sequence: TTC
aagatcgaacctttgaaaag

SEQ ID NO: 285207 - DNA, 20 bp, Artificial Sequence
  Description of Artificial Sequence: Synthetic oligonucleotide
  Target: ATXN1; (+) strand; PAM type: YTN; PAM sequence: CTT
tgaaaaggtgagggcctggc

SEQ ID NO: 285208 - DNA, 20 bp, Artificial Sequence
  Description of Artificial Sequence: Synthetic oligonucleotide
  Target: ATXN1; (+) strand; PAM type: YTN; PAM sequence: TTT
gaaaaggtgagggcctggct

SEQ ID NO: 285209 - DNA, 20 bp, Artificial Sequence
  Description of Artificial Sequence: Synthetic oligonucleotide
  Target: ATXN1; (+) strand; PAM type: YTN; PAM sequence: TTG
aaaaggtgagggcctggctg

SEQ ID NO: 285210 - DNA, 20 bp, Artificial Sequence
  Description of Artificial Sequence: Synthetic oligonucleotide
  Target: ATXN1; (+) strand; PAM type: YTN; PAM sequence: CTG
gctgcctaacatattacatc

SEQ ID NO: 285211 - DNA, 20 bp, Artificial Sequence
  Description of Artificial Sequence: Synthetic oligonucleotide
  Target: ATXN1; (+) strand; PAM type: YTN; PAM sequence: CTG
cctaacatattacatcatca

SEQ ID NO: 285212 - DNA, 20 bp, Artificial Sequence
  Description of Artificial Sequence: Synthetic oligonucleotide
  Target: ATXN1; (+) strand; PAM type: YTN; PAM sequence: CTA
acatattacatcatcacgca

SEQ ID NO: 285213 - DNA, 20 bp, Artificial Sequence
  Description of Artificial Sequence: Synthetic oligonucleotide
  Target: ATXN1; (+) strand; PAM type: YTN; PAM sequence: TTA
catcatcacgcatatgccgg

SEQ ID NO: 285214 - DNA, 20 bp, Artificial Sequence
  Description of Artificial Sequence: Synthetic oligonucleotide
  Target: ATXN1; (+) strand; PAM type: YTN; PAM sequence: CTC
ctgcctcactcagaagacca

SEQ ID NO: 285215 - DNA, 20 bp, Artificial Sequence
  Description of Artificial Sequence: Synthetic oligonucleotide
  Target: ATXN1; (+) strand; PAM type: YTN; PAM sequence: CTG
cctcactcagaagaccacgt

SEQ ID NO: 285216 - DNA, 20 bp, Artificial Sequence
  Description of Artificial Sequence: Synthetic oligonucleotide
  Target: ATXN1; (+) strand; PAM type: YTN; PAM sequence: CTC
actcagaagaccacgtgttg

SEQ ID NO: 285217 - DNA, 20 bp, Artificial Sequence
  Description of Artificial Sequence: Synthetic oligonucleotide
  Target: ATXN1; (+) strand; PAM type: YTN; PAM sequence: CTC
agaagaccacgtgttgctca

SEQ ID NO: 285218 - DNA, 20 bp, Artificial Sequence
  Description of Artificial Sequence: Synthetic oligonucleotide
  Target: ATXN1; (+) strand; PAM type: YTN; PAM sequence: TTG
ctcagaaaagaaaggtgggc

SEQ ID NO: 285219 - DNA, 20 bp, Artificial Sequence
  Description of Artificial Sequence: Synthetic oligonucleotide
  Target: ATXN1; (+) strand; PAM type: YTN; PAM sequence: CTC
agaaaagaaaggtgggcacc

SEQ ID NO: 285220 - DNA, 20 bp, Artificial Sequence
  Description of Artificial Sequence: Synthetic oligonucleotide
  Target: ATXN1; (+) strand; PAM type: YTN; PAM sequence: TTT
ctcataatatcctacccagg

SEQ ID NO: 285221 - DNA, 20 bp, Artificial Sequence
  Description of Artificial Sequence: Synthetic oligonucleotide
  Target: ATXN1; (+) strand; PAM type: YTN; PAM sequence: TTC
tcataatatcctacccaggc

SEQ ID NO: 285222 - DNA, 20 bp, Artificial Sequence
  Description of Artificial Sequence: Synthetic oligonucleotide
  Target: ATXN1; (+) strand; PAM type: YTN; PAM sequence: CTC
ataatatcctacccaggccc

SEQ ID NO: 285223 - DNA, 20 bp, Artificial Sequence
  Description of Artificial Sequence: Synthetic oligonucleotide
  Target: ATXN1; (+) strand; PAM type: YTN; PAM sequence: CTA
cccaggcccacagttagacg

SEQ ID NO: 285224 - DNA, 20 bp, Artificial Sequence
  Description of Artificial Sequence: Synthetic oligonucleotide
  Target: ATXN1; (+) strand; PAM type: YTN; PAM sequence: TTA
gacgtattagtcactgttgg

SEQ ID NO: 285225 - DNA, 20 bp, Artificial Sequence
  Description of Artificial Sequence: Synthetic oligonucleotide
  Target: ATXN1; (+) strand; PAM type: YTN; PAM sequence: TTA
gtcactgttgggacaatgaa

SEQ ID NO: 285226 - DNA, 20 bp, Artificial Sequence
  Description of Artificial Sequence: Synthetic oligonucleotide
  Target: ATXN1; (+) strand; PAM type: YTN; PAM sequence: CTG
ttgggacaatgaatatgggt

SEQ ID NO: 285227 - DNA, 20 bp, Artificial Sequence
  Description of Artificial Sequence: Synthetic oligonucleotide
  Target: ATXN1; (+) strand; PAM type: YTN; PAM sequence: TTG
ggacaatgaatatgggtttt

SEQ ID NO: 285228 - DNA, 20 bp, Artificial Sequence
  Description of Artificial Sequence: Synthetic oligonucleotide
  Target: ATXN1; (+) strand; PAM type: YTN; PAM sequence: TTT
tccaagaggtgatcaagcct

SEQ ID NO: 285229 - DNA, 20 bp, Artificial Sequence
  Description of Artificial Sequence: Synthetic oligonucleotide
  Target: ATXN1; (+) strand; PAM type: YTN; PAM sequence: TTT
ccaagaggtgatcaagcctt

SEQ ID NO: 285230 - DNA, 20 bp, Artificial Sequence
  Description of Artificial Sequence: Synthetic oligonucleotide
  Target: ATXN1; (+) strand; PAM type: YTN; PAM sequence: TTC
caagaggtgatcaagccttt

SEQ ID NO: 285231 - DNA, 20 bp, Artificial Sequence
  Description of Artificial Sequence: Synthetic oligonucleotide
  Target: ATXN1; (+) strand; PAM type: YTN; PAM sequence: CTT
tacttgatggattttctttt

SEQ ID NO: 285232 - DNA, 20 bp, Artificial Sequence
  Description of Artificial Sequence: Synthetic oligonucleotide
  Target: ATXN1; (+) strand; PAM type: YTN; PAM sequence: TTT
acttgatggattttcttttc

SEQ ID NO: 285233 - DNA, 20 bp, Artificial Sequence
  Description of Artificial Sequence: Synthetic oligonucleotide
  Target: ATXN1; (+) strand; PAM type: YTN; PAM sequence: TTA
cttgatggattttcttttct

SEQ ID NO: 285234 - DNA, 20 bp, Artificial Sequence
  Description of Artificial Sequence: Synthetic oligonucleotide
  Target: ATXN1; (+) strand; PAM type: YTN; PAM sequence: CTT
gatggattttcttttctcca

SEQ ID NO: 285235 - DNA, 20 bp, Artificial Sequence
  Description of Artificial Sequence: Synthetic oligonucleotide
  Target: ATXN1; (+) strand; PAM type: YTN; PAM sequence: TTG
atggattttcttttctccac

SEQ ID NO: 285236 - DNA, 20 bp, Artificial Sequence
  Description of Artificial Sequence: Synthetic oligonucleotide
  Target: ATXN1; (+) strand; PAM type: YTN; PAM sequence: TTT
tcttttctccacgccccaag

SEQ ID NO: 285237 - DNA, 20 bp, Artificial Sequence
  Description of Artificial Sequence: Synthetic oligonucleotide
  Target: ATXN1; (+) strand; PAM type: YTN; PAM sequence: TTT
cttttctccacgccccaaga

SEQ ID NO: 285238 - DNA, 20 bp, Artificial Sequence
  Description of Artificial Sequence: Synthetic oligonucleotide
  Target: ATXN1; (+) strand; PAM type: YTN; PAM sequence: TTC
ttttctccacgccccaagat

SEQ ID NO: 285239 - DNA, 20 bp, Artificial Sequence
  Description of Artificial Sequence: Synthetic oligonucleotide
  Target: ATXN1; (+) strand; PAM type: YTN; PAM sequence: CTT
ttctccacgccccaagattt

SEQ ID NO: 285240 - DNA, 20 bp, Artificial Sequence
  Description of Artificial Sequence: Synthetic oligonucleotide
  Target: ATXN1; (+) strand; PAM type: YTN; PAM sequence: TTT
tctccacgccccaagatttt

SEQ ID NO: 285241 - DNA, 20 bp, Artificial Sequence
  Description of Artificial Sequence: Synthetic oligonucleotide
  Target: ATXN1; (+) strand; PAM type: YTN; PAM sequence: TTT
ctccacgccccaagattttc

SEQ ID NO: 285242 - DNA, 20 bp, Artificial Sequence
  Description of Artificial Sequence: Synthetic oligonucleotide
  Target: ATXN1; (+) strand; PAM type: YTN; PAM sequence: TTC
tccacgccccaagattttct

SEQ ID NO: 285243 - DNA, 20 bp, Artificial Sequence
  Description of Artificial Sequence: Synthetic oligonucleotide
  Target: ATXN1; (+) strand; PAM type: YTN; PAM sequence: CTC
cacgccccaagattttctag

SEQ ID NO: 285244 - DNA, 20 bp, Artificial Sequence
  Description of Artificial Sequence: Synthetic oligonucleotide
  Target: ATXN1; (+) strand; PAM type: YTN; PAM sequence: TTT
tctaggcttttggtaggaag

SEQ ID NO: 285245 - DNA, 20 bp, Artificial Sequence
  Description of Artificial Sequence: Synthetic oligonucleotide
  Target: ATXN1; (+) strand; PAM type: YTN; PAM sequence: TTT
ctaggcttttggtaggaagc

SEQ ID NO: 285246 - DNA, 20 bp, Artificial Sequence
  Description of Artificial Sequence: Synthetic oligonucleotide
  Target: ATXN1; (+) strand; PAM type: YTN; PAM sequence: TTC
taggcttttggtaggaagca

SEQ ID NO: 285247 - DNA, 20 bp, Artificial Sequence
  Description of Artificial Sequence: Synthetic oligonucleotide
  Target: ATXN1; (+) strand; PAM type: YTN; PAM sequence: CTA
ggcttttggtaggaagcact

SEQ ID NO: 285248 - DNA, 20 bp, Artificial Sequence
  Description of Artificial Sequence: Synthetic oligonucleotide
  Target: ATXN1; (+) strand; PAM type: YTN; PAM sequence: CTT
ttggtaggaagcactataca

SEQ ID NO: 285249 - DNA, 20 bp, Artificial Sequence
  Description of Artificial Sequence: Synthetic oligonucleotide
  Target: ATXN1; (+) strand; PAM type: YTN; PAM sequence: TTT
tggtaggaagcactatacag

SEQ ID NO: 285250 - DNA, 20 bp, Artificial Sequence
  Description of Artificial Sequence: Synthetic oligonucleotide
  Target: ATXN1; (+) strand; PAM type: YTN; PAM sequence: TTT
ggtaggaagcactatacaga

SEQ ID NO: 285251 - DNA, 20 bp, Artificial Sequence
  Description of Artificial Sequence: Synthetic oligonucleotide
  Target: ATXN1; (+) strand; PAM type: YTN; PAM sequence: TTG
gtaggaagcactatacagaa

SEQ ID NO: 285252 - DNA, 20 bp, Artificial Sequence
  Description of Artificial Sequence: Synthetic oligonucleotide
  Target: ATXN1; (+) strand; PAM type: YTN; PAM sequence: CTA
tacagaaagcacccacgtct

SEQ ID NO: 285253 - DNA, 20 bp, Artificial Sequence
  Description of Artificial Sequence: Synthetic oligonucleotide
  Target: ATXN1; (+) strand; PAM type: YTN; PAM sequence: CTC
ctagctgattctgtgtctgg

SEQ ID NO: 285254 - DNA, 20 bp, Artificial Sequence
  Description of Artificial Sequence: Synthetic oligonucleotide
  Target: ATXN1; (+) strand; PAM type: YTN; PAM sequence: CTA
gctgattctgtgtctggagt

SEQ ID NO: 285255 - DNA, 20 bp, Artificial Sequence
  Description of Artificial Sequence: Synthetic oligonucleotide
  Target: ATXN1; (+) strand; PAM type: YTN; PAM sequence: CTG
attctgtgtctggagttggt

SEQ ID NO: 285256 - DNA, 20 bp, Artificial Sequence
  Description of Artificial Sequence: Synthetic oligonucleotide
  Target: ATXN1; (+) strand; PAM type: YTN; PAM sequence: TTC
tgtgtctggagttggttcct

SEQ ID NO: 285257 - DNA, 20 bp, Artificial Sequence
  Description of Artificial Sequence: Synthetic oligonucleotide
  Target: ATXN1; (+) strand; PAM type: YTN; PAM sequence: CTG
tgtctggagttggttccttc

SEQ ID NO: 285258 - DNA, 20 bp, Artificial Sequence
  Description of Artificial Sequence: Synthetic oligonucleotide
  Target: ATXN1; (+) strand; PAM type: YTN; PAM sequence: CTG
gagttggttccttctggtgg

SEQ ID NO: 285259 - DNA, 20 bp, Artificial Sequence
  Description of Artificial Sequence: Synthetic oligonucleotide
  Target: ATXN1; (+) strand; PAM type: YTN; PAM sequence: TTG
gttccttctggtgggttcgt

SEQ ID NO: 285260 - DNA, 20 bp, Artificial Sequence
  Description of Artificial Sequence: Synthetic oligonucleotide
  Target: ATXN1; (+) strand; PAM type: YTN; PAM sequence: TTC
cttctggtgggttcgtggtc

SEQ ID NO: 285261 - DNA, 20 bp, Artificial Sequence
  Description of Artificial Sequence: Synthetic oligonucleotide
  Target: ATXN1; (+) strand; PAM type: YTN; PAM sequence: CTT
ctggtgggttcgtggtctcg

SEQ ID NO: 285262 - DNA, 20 bp, Artificial Sequence
  Description of Artificial Sequence: Synthetic oligonucleotide
  Target: ATXN1; (+) strand; PAM type: YTN; PAM sequence: TTC
tggtgggttcgtggtctcgc

SEQ ID NO: 285263 - DNA, 20 bp, Artificial Sequence
  Description of Artificial Sequence: Synthetic oligonucleotide
  Target: ATXN1; (+) strand; PAM type: YTN; PAM sequence: CTG
gtgggttcgtggtctcgctg

SEQ ID NO: 285264 - DNA, 20 bp, Artificial Sequence
  Description of Artificial Sequence: Synthetic oligonucleotide
  Target: ATXN1; (+) strand; PAM type: YTN; PAM sequence: TTC
gtggtctcgctgacttcaag

SEQ ID NO: 285265 - DNA, 20 bp, Artificial Sequence
  Description of Artificial Sequence: Synthetic oligonucleotide
  Target: ATXN1; (+) strand; PAM type: YTN; PAM sequence: CTC
gctgacttcaagaatggagc

SEQ ID NO: 285266 - DNA, 20 bp, Artificial Sequence
  Description of Artificial Sequence: Synthetic oligonucleotide
  Target: ATXN1; (+) strand; PAM type: YTN; PAM sequence: CTG
acttcaagaatggagccgct

SEQ ID NO: 285267 - DNA, 20 bp, Artificial Sequence
  Description of Artificial Sequence: Synthetic oligonucleotide
  Target: ATXN1; (+) strand; PAM type: YTN; PAM sequence: CTT
caagaatggagccgctaacc

SEQ ID NO: 285268 - DNA, 20 bp, Artificial Sequence
  Description of Artificial Sequence: Synthetic oligonucleotide
  Target: ATXN1; (+) strand; PAM type: YTN; PAM sequence: TTC
aagaatggagccgctaacct

SEQ ID NO: 285269 - DNA, 20 bp, Artificial Sequence
  Description of Artificial Sequence: Synthetic oligonucleotide
  Target: ATXN1; (+) strand; PAM type: YTN; PAM sequence: CTA
acctttgcggtgactgttac

SEQ ID NO: 285270 - DNA, 20 bp, Artificial Sequence
  Description of Artificial Sequence: Synthetic oligonucleotide
  Target: ATXN1; (+) strand; PAM type: YTN; PAM sequence: CTT
tgcggtgactgttacagctc

SEQ ID NO: 285271 - DNA, 20 bp, Artificial Sequence
  Description of Artificial Sequence: Synthetic oligonucleotide
  Target: ATXN1; (+) strand; PAM type: YTN; PAM sequence: TTT
gcggtgactgttacagctct

SEQ ID NO: 285272 - DNA, 20 bp, Artificial Sequence
  Description of Artificial Sequence: Synthetic oligonucleotide
  Target: ATXN1; (+) strand; PAM type: YTN; PAM sequence: TTG
cggtgactgttacagctctt

SEQ ID NO: 285273 - DNA, 20 bp, Artificial Sequence
  Description of Artificial Sequence: Synthetic oligonucleotide
  Target: ATXN1; (+) strand; PAM type: YTN; PAM sequence: CTG
ttacagctcttaaagatggc

SEQ ID NO: 285274 - DNA, 20 bp, Artificial Sequence
  Description of Artificial Sequence: Synthetic oligonucleotide
  Target: ATXN1; (+) strand; PAM type: YTN; PAM sequence: TTA
cagctcttaaagatggcaca

SEQ ID NO: 285275 - DNA, 20 bp, Artificial Sequence
  Description of Artificial Sequence: Synthetic oligonucleotide
  Target: ATXN1; (+) strand; PAM type: YTN; PAM sequence: CTC
ttaaagatggcacagaccca

SEQ ID NO: 285276 - DNA, 20 bp, Artificial Sequence
  Description of Artificial Sequence: Synthetic oligonucleotide
  Target: ATXN1; (+) strand; PAM type: YTN; PAM sequence: CTT
aaagatggcacagacccaaa

SEQ ID NO: 285277 - DNA, 20 bp, Artificial Sequence
  Description of Artificial Sequence: Synthetic oligonucleotide
  Target: ATXN1; (+) strand; PAM type: YTN; PAM sequence: TTA
aagatggcacagacccaaaa

SEQ ID NO: 285278 - DNA, 20 bp, Artificial Sequence
  Description of Artificial Sequence: Synthetic oligonucleotide
  Target: ATXN1; (+) strand; PAM type: YTN; PAM sequence: CTG
aacagcagcaagatttatca

SEQ ID NO: 285279 - DNA, 20 bp, Artificial Sequence
  Description of Artificial Sequence: Synthetic oligonucleotide
  Target: ATXN1; (+) strand; PAM type: YTN; PAM sequence: TTT
atcataaagagtgaaagaac

SEQ ID NO: 285280 - DNA, 20 bp, Artificial Sequence
  Description of Artificial Sequence: Synthetic oligonucleotide
  Target: ATXN1; (+) strand; PAM type: YTN; PAM sequence: TTA
tcataaagagtgaaagaaca

SEQ ID NO: 285281 - DNA, 20 bp, Artificial Sequence
  Description of Artificial Sequence: Synthetic oligonucleotide
  Target: ATXN1; (+) strand; PAM type: YTN; PAM sequence: CTT
ccacagctggaaaagaatct

SEQ ID NO: 285282 - DNA, 20 bp, Artificial Sequence
  Description of Artificial Sequence: Synthetic oligonucleotide
  Target: ATXN1; (+) strand; PAM type: YTN; PAM sequence: TTC
cacagctggaaaagaatctg

SEQ ID NO: 285283 - DNA, 20 bp, Artificial Sequence
  Description of Artificial Sequence: Synthetic oligonucleotide
  Target: ATXN1; (+) strand; PAM type: YTN; PAM sequence: CTG
gaaaagaatctgagcaggtt

SEQ ID NO: 285284 - DNA, 20 bp, Artificial Sequence
  Description of Artificial Sequence: Synthetic oligonucleotide
  Target: ATXN1; (+) strand; PAM type: YTN; PAM sequence: CTG
agcaggttgcactggtggct

SEQ ID NO: 285285 - DNA, 20 bp, Artificial Sequence
  Description of Artificial Sequence: Synthetic oligonucleotide
  Target: ATXN1; (+) strand; PAM type: YTN; PAM sequence: TTG
cactggtggctggtgcgggt

SEQ ID NO: 285286 - DNA, 20 bp, Artificial Sequence
  Description of Artificial Sequence: Synthetic oligonucleotide
  Target: ATXN1; (+) strand; PAM type: YTN; PAM sequence: CTG
gtggctggtgcgggtggggg

SEQ ID NO: 285287 - DNA, 20 bp, Artificial Sequence
  Description of Artificial Sequence: Synthetic oligonucleotide
  Target: ATXN1; (+) strand; PAM type: YTN; PAM sequence: CTG
gtgcgggtgggggtgggggg

SEQ ID NO: 285288 - DNA, 20 bp, Artificial Sequence
  Description of Artificial Sequence: Synthetic oligonucleotide
  Target: ATXN1; (+) strand; PAM type: YTN; PAM sequence: TTG
gggggggcagcttttattcc

SEQ ID NO: 285289 - DNA, 20 bp, Artificial Sequence
  Description of Artificial Sequence: Synthetic oligonucleotide
  Target: ATXN1; (+) strand; PAM type: YTN; PAM sequence: CTT
ttattccattatttttcccg

SEQ ID NO: 285290 - DNA, 20 bp, Artificial Sequence
  Description of Artificial Sequence: Synthetic oligonucleotide
  Target: ATXN1; (+) strand; PAM type: YTN; PAM sequence: TTT
tattccattatttttcccgt

SEQ ID NO: 285291 - DNA, 20 bp, Artificial Sequence
  Description of Artificial Sequence: Synthetic oligonucleotide
  Target: ATXN1; (+) strand; PAM type: YTN; PAM sequence: TTT
attccattatttttcccgtc

SEQ ID NO: 285292 - DNA, 20 bp, Artificial Sequence
  Description of Artificial Sequence: Synthetic oligonucleotide
  Target: ATXN1; (+) strand; PAM type: YTN; PAM sequence: TTA
ttccattatttttcccgtcc

SEQ ID NO: 285293 - DNA, 20 bp, Artificial Sequence
  Description of Artificial Sequence: Synthetic oligonucleotide
  Target: ATXN1; (+) strand; PAM type: YTN; PAM sequence: TTC
cattatttttcccgtccatg

SEQ ID NO: 285294 - DNA, 20 bp, Artificial Sequence
  Description of Artificial Sequence: Synthetic oligonucleotide
  Target: ATXN1; (+) strand; PAM type: YTN; PAM sequence: TTA
tttttcccgtccatgtcctg

SEQ ID NO: 285295 - DNA, 20 bp, Artificial Sequence
  Description of Artificial Sequence: Synthetic oligonucleotide
  Target: ATXN1; (+) strand; PAM type: YTN; PAM sequence: TTT
ttcccgtccatgtcctgttt

SEQ ID NO: 285296 - DNA, 20 bp, Artificial Sequence
  Description of Artificial Sequence: Synthetic oligonucleotide
  Target: ATXN1; (+) strand; PAM type: YTN; PAM sequence: TTT
tcccgtccatgtcctgtttc

SEQ ID NO: 285297 - DNA, 20 bp, Artificial Sequence
  Description of Artificial Sequence: Synthetic oligonucleotide
  Target: ATXN1; (+) strand; PAM type: YTN; PAM sequence: TTT
cccgtccatgtcctgtttct

SEQ ID NO: 285298 - DNA, 20 bp, Artificial Sequence
  Description of Artificial Sequence: Synthetic oligonucleotide
  Target: ATXN1; (+) strand; PAM type: YTN; PAM sequence: TTC
ccgtccatgtcctgtttctg

SEQ ID NO: 285299 - DNA, 20 bp, Artificial Sequence
  Description of Artificial Sequence: Synthetic oligonucleotide
  Target: ATXN1; (+) strand; PAM type: YTN; PAM sequence: CTG
tttctgtcctatcagaacgc

SEQ ID NO: 285300 - DNA, 20 bp, Artificial Sequence
  Description of Artificial Sequence: Synthetic oligonucleotide
  Target: ATXN1; (+) strand; PAM type: YTN; PAM sequence: TTT
ctgtcctatcagaacgccct

SEQ ID NO: 285301 - DNA, 20 bp, Artificial Sequence
  Description of Artificial Sequence: Synthetic oligonucleotide
  Target: ATXN1; (+) strand; PAM type: YTN; PAM sequence: TTC
tgtcctatcagaacgccctt

SEQ ID NO: 285302 - DNA, 20 bp, Artificial Sequence
  Description of Artificial Sequence: Synthetic oligonucleotide
  Target: ATXN1; (+) strand; PAM type: YTN; PAM sequence: CTG
tcctatcagaacgccctttt

SEQ ID NO: 285303 - DNA, 20 bp, Artificial Sequence
  Description of Artificial Sequence: Synthetic oligonucleotide
  Target: ATXN1; (+) strand; PAM type: YTN; PAM sequence: CTA
tcagaacgcccttttctcaa

SEQ ID NO: 285304 - DNA, 20 bp, Artificial Sequence
  Description of Artificial Sequence: Synthetic oligonucleotide
  Target: ATXN1; (+) strand; PAM type: YTN; PAM sequence: CTT
ttctcaatcctccccatgat

SEQ ID NO: 285305 - DNA, 20 bp, Artificial Sequence
  Description of Artificial Sequence: Synthetic oligonucleotide
  Target: ATXN1; (+) strand; PAM type: YTN; PAM sequence: TTT
tctcaatcctccccatgatt

SEQ ID NO: 285306 - DNA, 20 bp, Artificial Sequence
  Description of Artificial Sequence: Synthetic oligonucleotide
  Target: ATXN1; (+) strand; PAM type: YTN; PAM sequence: TTT
ctcaatcctccccatgattg

SEQ ID NO: 285307 - DNA, 20 bp, Artificial Sequence
  Description of Artificial Sequence: Synthetic oligonucleotide
  Target: ATXN1; (+) strand; PAM type: YTN; PAM sequence: TTC
tcaatcctccccatgattgg

SEQ ID NO: 285308 - DNA, 20 bp, Artificial Sequence
  Description of Artificial Sequence: Synthetic oligonucleotide
  Target: ATXN1; (+) strand; PAM type: YTN; PAM sequence: CTC
aatcctccccatgattggtt

SEQ ID NO: 285309 - DNA, 20 bp, Artificial Sequence
  Description of Artificial Sequence: Synthetic oligonucleotide
  Target: ATXN1; (+) strand; PAM type: YTN; PAM sequence: CTC
cccatgattggttactttta

SEQ ID NO: 285310 - DNA, 20 bp, Artificial Sequence
  Description of Artificial Sequence: Synthetic oligonucleotide
  Target: ATXN1; (+) strand; PAM type: YTN; PAM sequence: TTG
gttacttttagaaccctgct

SEQ ID NO: 285311 - DNA, 20 bp, Artificial Sequence
  Description of Artificial Sequence: Synthetic oligonucleotide
  Target: ATXN1; (+) strand; PAM type: YTN; PAM sequence: TTA
cttttagaaccctgctgatt

SEQ ID NO: 285312 - DNA, 20 bp, Artificial Sequence
  Description of Artificial Sequence: Synthetic oligonucleotide
  Target: ATXN1; (+) strand; PAM type: YTN; PAM sequence: CTT
ttagaaccctgctgattggt

SEQ ID NO: 285313 - DNA, 20 bp, Artificial Sequence
  Description of Artificial Sequence: Synthetic oligonucleotide
  Target: ATXN1; (+) strand; PAM type: YTN; PAM sequence: TTT
tagaaccctgctgattggtc

SEQ ID NO: 285314 - DNA, 20 bp, Artificial Sequence
  Description of Artificial Sequence: Synthetic oligonucleotide
  Target: ATXN1; (+) strand; PAM type: YTN; PAM sequence: TTT
agaaccctgctgattggtcc

SEQ ID NO: 285315 - DNA, 20 bp, Artificial Sequence
  Description of Artificial Sequence: Synthetic oligonucleotide
  Target: ATXN1; (+) strand; PAM type: YTN; PAM sequence: TTA
gaaccctgctgattggtcca

SEQ ID NO: 285316 - DNA, 20 bp, Artificial Sequence
  Description of Artificial Sequence: Synthetic oligonucleotide
  Target: ATXN1; (+) strand; PAM type: YTN; PAM sequence: CTG
ctgattggtccattttacaa

SEQ ID NO: 285317 - DNA, 20 bp, Artificial Sequence
  Description of Artificial Sequence: Synthetic oligonucleotide
  Target: ATXN1; (+) strand; PAM type: YTN; PAM sequence: CTG
attggtccattttacaaagt

SEQ ID NO: 285318 - DNA, 20 bp, Artificial Sequence
  Description of Artificial Sequence: Synthetic oligonucleotide
  Target: ATXN1; (+) strand; PAM type: YTN; PAM sequence: TTG
gtccattttacaaagtactg

SEQ ID NO: 285319 - DNA, 20 bp, Artificial Sequence
  Description of Artificial Sequence: Synthetic oligonucleotide
  Target: ATXN1; (+) strand; PAM type: YTN; PAM sequence: TTT
tacaaagtactgattggtgc

SEQ ID NO: 285320 - DNA, 20 bp, Artificial Sequence
  Description of Artificial Sequence: Synthetic oligonucleotide
  Target: ATXN1; (+) strand; PAM type: YTN; PAM sequence: TTT
acaaagtactgattggtgca

SEQ ID NO: 285321 - DNA, 20 bp, Artificial Sequence
  Description of Artificial Sequence: Synthetic oligonucleotide
  Target: ATXN1; (+) strand; PAM type: YTN; PAM sequence: TTA
caaagtactgattggtgcat

SEQ ID NO: 285322 - DNA, 20 bp, Artificial Sequence
  Description of Artificial Sequence: Synthetic oligonucleotide
  Target: ATXN1; (+) strand; PAM type: YTN; PAM sequence: CTG
attggtgcattttacaaatc

SEQ ID NO: 285323 - DNA, 20 bp, Artificial Sequence
  Description of Artificial Sequence: Synthetic oligonucleotide
  Target: ATXN1; (+) strand; PAM type: YTN; PAM sequence: TTG
gtgcattttacaaatctctt

SEQ ID NO: 285324 - DNA, 20 bp, Artificial Sequence
  Description of Artificial Sequence: Synthetic oligonucleotide
  Target: ATXN1; (+) strand; PAM type: YTN; PAM sequence: TTT
tacaaatctcttgctagcta

SEQ ID NO: 285325 - DNA, 20 bp, Artificial Sequence
  Description of Artificial Sequence: Synthetic oligonucleotide
  Target: ATXN1; (+) strand; PAM type: YTN; PAM sequence: TTT
acaaatctcttgctagctac

SEQ ID NO: 285326 - DNA, 20 bp, Artificial Sequence
  Description of Artificial Sequence: Synthetic oligonucleotide
  Target: ATXN1; (+) strand; PAM type: YTN; PAM sequence: TTA
caaatctcttgctagctaca

SEQ ID NO: 285327 - DNA, 20 bp, Artificial Sequence
  Description of Artificial Sequence: Synthetic oligonucleotide
  Target: ATXN1; (+) strand; PAM type: YTN; PAM sequence: CTC
ttgctagctacagagcactg

SEQ ID NO: 285328 - DNA, 20 bp, Artificial Sequence
  Description of Artificial Sequence: Synthetic oligonucleotide
  Target: ATXN1; (+) strand; PAM type: YTN; PAM sequence: CTT
gctagctacagagcactgac

SEQ ID NO: 285329 - DNA, 20 bp, Artificial Sequence
  Description of Artificial Sequence: Synthetic oligonucleotide
  Target: ATXN1; (+) strand; PAM type: YTN; PAM sequence: TTG
ctagctacagagcactgact

SEQ ID NO: 285330 - DNA, 20 bp, Artificial Sequence
  Description of Artificial Sequence: Synthetic oligonucleotide
  Target: ATXN1; (+) strand; PAM type: YTN; PAM sequence: CTA
gctacagagcactgactggt

SEQ ID NO: 285331 - DNA, 20 bp, Artificial Sequence
  Description of Artificial Sequence: Synthetic oligonucleotide
  Target: ATXN1; (+) strand; PAM type: YTN; PAM sequence: CTA
cagagcactgactggtgcat

SEQ ID NO: 285332 - DNA, 20 bp, Artificial Sequence
  Description of Artificial Sequence: Synthetic oligonucleotide
  Target: ATXN1; (+) strand; PAM type: YTN; PAM sequence: CTG
actggtgcatttttacagag

SEQ ID NO: 285333 - DNA, 20 bp, Artificial Sequence
  Description of Artificial Sequence: Synthetic oligonucleotide
  Target: ATXN1; (+) strand; PAM type: YTN; PAM sequence: CTG
gtgcatttttacagagcact

SEQ ID NO: 285334 - DNA, 20 bp, Artificial Sequence
  Description of Artificial Sequence: Synthetic oligonucleotide
  Target: ATXN1; (+) strand; PAM type: YTN; PAM sequence: TTT
ttacagagcactgattggtg

SEQ ID NO: 285335 - DNA, 20 bp, Artificial Sequence
  Description of Artificial Sequence: Synthetic oligonucleotide
  Target: ATXN1; (+) strand; PAM type: YTN; PAM sequence: TTT
tacagagcactgattggtgc

SEQ ID NO: 285336 - DNA, 20 bp, Artificial Sequence
  Description of Artificial Sequence: Synthetic oligonucleotide
  Target: ATXN1; (+) strand; PAM type: YTN; PAM sequence: TTT
acagagcactgattggtgca

SEQ ID NO: 285337 - DNA, 20 bp, Artificial Sequence
  Description of Artificial Sequence: Synthetic oligonucleotide
  Target: ATXN1; (+) strand; PAM type: YTN; PAM sequence: TTA
cagagcactgattggtgcat

SEQ ID NO: 285338 - DNA, 20 bp, Artificial Sequence
  Description of Artificial Sequence: Synthetic oligonucleotide
  Target: ATXN1; (+) strand; PAM type: YTN; PAM sequence: CTG
attggtgcattttacaaacc

SEQ ID NO: 285339 - DNA, 20 bp, Artificial Sequence
  Description of Artificial Sequence: Synthetic oligonucleotide
  Target: ATXN1; (+) strand; PAM type: YTN; PAM sequence: TTG
gtgcattttacaaacctctt

SEQ ID NO: 285340 - DNA, 20 bp, Artificial Sequence
  Description of Artificial Sequence: Synthetic oligonucleotide
  Target: ATXN1; (+) strand; PAM type: YTN; PAM sequence: TTT
tacaaacctcttgctagcta

SEQ ID NO: 285341 - DNA, 20 bp, Artificial Sequence
  Description of Artificial Sequence: Synthetic oligonucleotide
  Target: ATXN1; (+) strand; PAM type: YTN; PAM sequence: TTT
acaaacctcttgctagctac

SEQ ID NO: 285342 - DNA, 20 bp, Artificial Sequence
  Description of Artificial Sequence: Synthetic oligonucleotide
  Target: ATXN1; (+) strand; PAM type: YTN; PAM sequence: TTA
caaacctcttgctagctaca

SEQ ID NO: 285343 - DNA, 20 bp, Artificial Sequence
  Description of Artificial Sequence: Synthetic oligonucleotide
  Target: ATXN1; (+) strand; PAM type: YTN; PAM sequence: CTC
ttgctagctacagagcactg

SEQ ID NO: 285344 - DNA, 20 bp, Artificial Sequence
  Description of Artificial Sequence: Synthetic oligonucleotide
  Target: ATXN1; (+) strand; PAM type: YTN; PAM sequence: CTT
gctagctacagagcactgac

SEQ ID NO: 285345 - DNA, 20 bp, Artificial Sequence
  Description of Artificial Sequence: Synthetic oligonucleotide
  Target: ATXN1; (+) strand; PAM type: YTN; PAM sequence: TTG
ctagctacagagcactgact

SEQ ID NO: 285346 - DNA, 20 bp, Artificial Sequence
  Description of Artificial Sequence: Synthetic oligonucleotide
  Target: ATXN1; (+) strand; PAM type: YTN; PAM sequence: CTA
gctacagagcactgactgct

SEQ ID NO: 285347 - DNA, 20 bp, Artificial Sequence
  Description of Artificial Sequence: Synthetic oligonucleotide
  Target: ATXN1; (+) strand; PAM type: YTN; PAM sequence: CTA
cagagcactgactgctgcat

SEQ ID NO: 285348 - DNA, 20 bp, Artificial Sequence
  Description of Artificial Sequence: Synthetic oligonucleotide
  Target: ATXN1; (+) strand; PAM type: YTN; PAM sequence: CTG
actgctgcattttataatac

SEQ ID NO: 285349 - DNA, 20 bp, Artificial Sequence
  Description of Artificial Sequence: Synthetic oligonucleotide
  Target: ATXN1; (+) strand; PAM type: YTN; PAM sequence: CTG
ctgcattttataataccctt

SEQ ID NO: 285350 - DNA, 20 bp, Artificial Sequence
  Description of Artificial Sequence: Synthetic oligonucleotide
  Target: ATXN1; (+) strand; PAM type: YTN; PAM sequence: CTG
cattttataatacccttgga

SEQ ID NO: 285351 - DNA, 20 bp, Artificial Sequence
  Description of Artificial Sequence: Synthetic oligonucleotide
  Target: ATXN1; (+) strand; PAM type: YTN; PAM sequence: TTT
tataatacccttggaagaca

SEQ ID NO: 285352 - DNA, 20 bp, Artificial Sequence
  Description of Artificial Sequence: Synthetic oligonucleotide
  Target: ATXN1; (+) strand; PAM type: YTN; PAM sequence: TTT
ataatacccttggaagacag

SEQ ID NO: 285353 - DNA, 20 bp, Artificial Sequence
  Description of Artificial Sequence: Synthetic oligonucleotide
  Target: ATXN1; (+) strand; PAM type: YTN; PAM sequence: TTA
taatacccttggaagacaga

SEQ ID NO: 285354 - DNA, 20 bp, Artificial Sequence
  Description of Artificial Sequence: Synthetic oligonucleotide
  Target: ATXN1; (+) strand; PAM type: YTN; PAM sequence: CTT
ggaagacagaaaagttctcc

SEQ ID NO: 285355 - DNA, 20 bp, Artificial Sequence
  Description of Artificial Sequence: Synthetic oligonucleotide
  Target: ATXN1; (+) strand; PAM type: YTN; PAM sequence: TTG
gaagacagaaaagttctcca

SEQ ID NO: 285356 - DNA, 20 bp, Artificial Sequence
  Description of Artificial Sequence: Synthetic oligonucleotide
  Target: ATXN1; (+) strand; PAM type: YTN; PAM sequence: TTC
tccaagtccccactcgaccc

SEQ ID NO: 285357 - DNA, 20 bp, Artificial Sequence
  Description of Artificial Sequence: Synthetic oligonucleotide
  Target: ATXN1; (+) strand; PAM type: YTN; PAM sequence: CTC
caagtccccactcgacccag

SEQ ID NO: 285358 - DNA, 20 bp, Artificial Sequence
  Description of Artificial Sequence: Synthetic oligonucleotide
  Target: ATXN1; (+) strand; PAM type: YTN; PAM sequence: CTC
gacccaggaagtccagctgg

SEQ ID NO: 285359 - DNA, 20 bp, Artificial Sequence
  Description of Artificial Sequence: Synthetic oligonucleotide
  Target: ATXN1; (+) strand; PAM type: YTN; PAM sequence: CTG
gcttcacctctcaattccac

SEQ ID NO: 285360 - DNA, 20 bp, Artificial Sequence
  Description of Artificial Sequence: Synthetic oligonucleotide
  Target: ATXN1; (+) strand; PAM type: YTN; PAM sequence: CTT
cacctctcaattccactcag

SEQ ID NO: 285361 - DNA, 20 bp, Artificial Sequence
  Description of Artificial Sequence: Synthetic oligonucleotide
  Target: ATXN1; (+) strand; PAM type: YTN; PAM sequence: TTC
acctctcaattccactcagt

SEQ ID NO: 285362 - DNA, 20 bp, Artificial Sequence
  Description of Artificial Sequence: Synthetic oligonucleotide
  Target: ATXN1; (+) strand; PAM type: YTN; PAM sequence: CTC
tcaattccactcagtagtta

SEQ ID NO: 285363 - DNA, 20 bp, Artificial Sequence
  Description of Artificial Sequence: Synthetic oligonucleotide
  Target: ATXN1; (+) strand; PAM type: YTN; PAM sequence: CTC
aattccactcagtagttact

SEQ ID NO: 285364 - DNA, 20 bp, Artificial Sequence
  Description of Artificial Sequence: Synthetic oligonucleotide
  Target: ATXN1; (+) strand; PAM type: YTN; PAM sequence: TTC
cactcagtagttactgtcag

SEQ ID NO: 285365 - DNA, 20 bp, Artificial Sequence
  Description of Artificial Sequence: Synthetic oligonucleotide
  Target: ATXN1; (+) strand; PAM type: YTN; PAM sequence: CTC
agtagttactgtcagcctcc

SEQ ID NO: 285366 - DNA, 20 bp, Artificial Sequence
  Description of Artificial Sequence: Synthetic oligonucleotide
  Target: ATXN1; (+) strand; PAM type: YTN; PAM sequence: TTA
ctgtcagcctccccctaaaa

SEQ ID NO: 285367 - DNA, 20 bp, Artificial Sequence
  Description of Artificial Sequence: Synthetic oligonucleotide
  Target: ATXN1; (+) strand; PAM type: YTN; PAM sequence: CTG
tcagcctccccctaaaacct

SEQ ID NO: 285368 - DNA, 20 bp, Artificial Sequence
  Description of Artificial Sequence: Synthetic oligonucleotide
  Target: ATXN1; (+) strand; PAM type: YTN; PAM sequence: CTC
cccctaaaacctccaccact

SEQ ID NO: 285369 - DNA, 20 bp, Artificial Sequence
  Description of Artificial Sequence: Synthetic oligonucleotide
  Target: ATXN1; (+) strand; PAM type: YTN; PAM sequence: CTA
aaacctccaccactcaagga

SEQ ID NO: 285370 - DNA, 20 bp, Artificial Sequence
  Description of Artificial Sequence: Synthetic oligonucleotide
  Target: ATXN1; (+) strand; PAM type: YTN; PAM sequence: CTC
caccactcaaggagcgacac

SEQ ID NO: 285371 - DNA, 20 bp, Artificial Sequence
  Description of Artificial Sequence: Synthetic oligonucleotide
  Target: ATXN1; (+) strand; PAM type: YTN; PAM sequence: CTC
aaggagcgacactgtcagaa

SEQ ID NO: 285372 - DNA, 20 bp, Artificial Sequence
  Description of Artificial Sequence: Synthetic oligonucleotide
  Target: ATXN1; (+) strand; PAM type: YTN; PAM sequence: CTG
tcagaagcagaccttctaat

SEQ ID NO: 285373 - DNA, 20 bp, Artificial Sequence
  Description of Artificial Sequence: Synthetic oligonucleotide
  Target: ATXN1; (+) strand; PAM type: YTN; PAM sequence: CTT
ctaattactcctgtgtgatc

SEQ ID NO: 285374 - DNA, 20 bp, Artificial Sequence
  Description of Artificial Sequence: Synthetic oligonucleotide
  Target: ATXN1; (+) strand; PAM type: YTN; PAM sequence: TTC
taattactcctgtgtgatct

SEQ ID NO: 285375 - DNA, 20 bp, Artificial Sequence
  Description of Artificial Sequence: Synthetic oligonucleotide
  Target: ATXN1; (+) strand; PAM type: YTN; PAM sequence: CTA
attactcctgtgtgatctca

SEQ ID NO: 285376 - DNA, 20 bp, Artificial Sequence
  Description of Artificial Sequence: Synthetic oligonucleotide
  Target: ATXN1; (+) strand; PAM type: YTN; PAM sequence: TTA
ctcctgtgtgatctcaagcc

SEQ ID NO: 285377 - DNA, 20 bp, Artificial Sequence
  Description of Artificial Sequence: Synthetic oligonucleotide
  Target: ATXN1; (+) strand; PAM type: YTN; PAM sequence: CTC
ctgtgtgatctcaagccccc

SEQ ID NO: 285378 - DNA, 20 bp, Artificial Sequence
  Description of Artificial Sequence: Synthetic oligonucleotide
  Target: ATXN1; (+) strand; PAM type: YTN; PAM sequence: CTG
tgtgatctcaagccccctcc

SEQ ID NO: 285379 - DNA, 20 bp, Artificial Sequence
  Description of Artificial Sequence: Synthetic oligonucleotide
  Target: ATXN1; (+) strand; PAM type: YTN; PAM sequence: CTC
aagccccctccctggggact

SEQ ID NO: 285380 - DNA, 20 bp, Artificial Sequence
  Description of Artificial Sequence: Synthetic oligonucleotide
  Target: ATXN1; (+) strand; PAM type: YTN; PAM sequence: CTC
cctggggactatggaaagag

SEQ ID NO: 285381 - DNA, 20 bp, Artificial Sequence
  Description of Artificial Sequence: Synthetic oligonucleotide
  Target: ATXN1; (+) strand; PAM type: YTN; PAM sequence: CTG
gggactatggaaagagaatg

SEQ ID NO: 285382 - DNA, 20 bp, Artificial Sequence
  Description of Artificial Sequence: Synthetic oligonucleotide
  Target: ATXN1; (+) strand; PAM type: YTN; PAM sequence: CTA
tggaaagagaatgttaggaa

SEQ ID NO: 285383 - DNA, 20 bp, Artificial Sequence
  Description of Artificial Sequence: Synthetic oligonucleotide
  Target: ATXN1; (+) strand; PAM type: YTN; PAM sequence: TTA
ggaaatagagatggaaaaaa

SEQ ID NO: 285384 - DNA, 20 bp, Artificial Sequence
  Description of Artificial Sequence: Synthetic oligonucleotide
  Target: ATXN1; (+) strand; PAM type: YTN; PAM sequence: TTC
tgacatgctatcactttaaa

SEQ ID NO: 285385 - DNA, 20 bp, Artificial Sequence
  Description of Artificial Sequence: Synthetic oligonucleotide
  Target: ATXN1; (+) strand; PAM type: YTN; PAM sequence: CTG
acatgctatcactttaaaaa

SEQ ID NO: 285386 - DNA, 20 bp, Artificial Sequence
  Description of Artificial Sequence: Synthetic oligonucleotide
  Target: ATXN1; (+) strand; PAM type: YTN; PAM sequence: CTA
tcactttaaaaatatttcta

SEQ ID NO: 285387 - DNA, 20 bp, Artificial Sequence
  Description of Artificial Sequence: Synthetic oligonucleotide
  Target: ATXN1; (+) strand; PAM type: YTN; PAM sequence: CTT
taaaaatatttctatcatgc

SEQ ID NO: 285388 - DNA, 20 bp, Artificial Sequence
  Description of Artificial Sequence: Synthetic oligonucleotide
  Target: ATXN1; (+) strand; PAM type: YTN; PAM sequence: TTT
aaaaatatttctatcatgca

SEQ ID NO: 285389 - DNA, 20 bp, Artificial Sequence
  Description of Artificial Sequence: Synthetic oligonucleotide
  Target: ATXN1; (+) strand; PAM type: YTN; PAM sequence: TTA
aaaatatttctatcatgcaa

SEQ ID NO: 285390 - DNA, 20 bp, Artificial Sequence
  Description of Artificial Sequence: Synthetic oligonucleotide
  Target: ATXN1; (+) strand; PAM type: YTN; PAM sequence: TTT
ctatcatgcaatgtttgtaa

SEQ ID NO: 285391 - DNA, 20 bp, Artificial Sequence
  Description of Artificial Sequence: Synthetic oligonucleotide
  Target: ATXN1; (+) strand; PAM type: YTN; PAM sequence: TTC
tatcatgcaatgtttgtaac

SEQ ID NO: 285392 - DNA, 20 bp, Artificial Sequence
  Description of Artificial Sequence: Synthetic oligonucleotide
  Target: ATXN1; (+) strand; PAM type: YTN; PAM sequence: CTA
tcatgcaatgtttgtaaccc

SEQ ID NO: 285393 - DNA, 20 bp, Artificial Sequence
  Description of Artificial Sequence: Synthetic oligonucleotide
  Target: ATXN1; (+) strand; PAM type: YTN; PAM sequence: TTT
gtaacccacaaaagaatgca

SEQ ID NO: 285394 - DNA, 20 bp, Artificial Sequence
  Description of Artificial Sequence: Synthetic oligonucleotide
  Target: ATXN1; (+) strand; PAM type: YTN; PAM sequence: TTG
taacccacaaaagaatgcac

SEQ ID NO: 285395 - DNA, 20 bp, Artificial Sequence
  Description of Artificial Sequence: Synthetic oligonucleotide
  Target: ATXN1; (+) strand; PAM type: YTN; PAM sequence: CTA
acatgtacgtaacctgtgaa

SEQ ID NO: 285396 - DNA, 20 bp, Artificial Sequence
  Description of Artificial Sequence: Synthetic oligonucleotide
  Target: ATXN1; (+) strand; PAM type: YTN; PAM sequence: CTG
tgaagcataagaataaaatg

SEQ ID NO: 285397 - DNA, 20 bp, Artificial Sequence
  Description of Artificial Sequence: Synthetic oligonucleotide
  Target: ATXN1; (+) strand; PAM type: YTN; PAM sequence: CTA
tttgagaactagacatttag

SEQ ID NO: 285398 - DNA, 20 bp, Artificial Sequence
  Description of Artificial Sequence: Synthetic oligonucleotide
  Target: ATXN1; (+) strand; PAM type: YTN; PAM sequence: TTT
gagaactagacatttagggg

SEQ ID NO: 285399 - DNA, 20 bp, Artificial Sequence
  Description of Artificial Sequence: Synthetic oligonucleotide
  Target: ATXN1; (+) strand; PAM type: YTN; PAM sequence: TTG
agaactagacatttaggggt

SEQ ID NO: 285400 - DNA, 20 bp, Artificial Sequence
  Description of Artificial Sequence: Synthetic oligonucleotide
  Target: ATXN1; (+) strand; PAM type: YTN; PAM sequence: CTA
gacatttaggggtattttga

SEQ ID NO: 285401 - DNA, 20 bp, Artificial Sequence
  Description of Artificial Sequence: Synthetic oligonucleotide
  Target: ATXN1; (+) strand; PAM type: YTN; PAM sequence: TTT
aggggtattttgatccatct

SEQ ID NO: 285402 - DNA, 20 bp, Artificial Sequence
  Description of Artificial Sequence: Synthetic oligonucleotide
  Target: ATXN1; (+) strand; PAM type: YTN; PAM sequence: TTA
ggggtattttgatccatcta

SEQ ID NO: 285403 - DNA, 20 bp, Artificial Sequence
  Description of Artificial Sequence: Synthetic oligonucleotide
  Target: ATXN1; (+) strand; PAM type: YTN; PAM sequence: TTT
tgatccatctacctatttgc

SEQ ID NO: 285404 - DNA, 20 bp, Artificial Sequence
  Description of Artificial Sequence: Synthetic oligonucleotide
  Target: ATXN1; (+) strand; PAM type: YTN; PAM sequence: TTT
gatccatctacctatttgct

SEQ ID NO: 285405 - DNA, 20 bp, Artificial Sequence
  Description of Artificial Sequence: Synthetic oligonucleotide
  Target: ATXN1; (+) strand; PAM type: YTN; PAM sequence: TTG
atccatctacctatttgcta

SEQ ID NO: 285406 - DNA, 20 bp, Artificial Sequence
  Description of Artificial Sequence: Synthetic oligonucleotide
  Target: ATXN1; (+) strand; PAM type: YTN; PAM sequence: CTA
cctatttgctatttccctaa

SEQ ID NO: 285407 - DNA, 20 bp, Artificial Sequence
  Description of Artificial Sequence: Synthetic oligonucleotide
  Target: ATXN1; (+) strand; PAM type: YTN; PAM sequence: CTA
tttgctatttccctaagcca

SEQ ID NO: 285408 - DNA, 20 bp, Artificial Sequence
  Description of Artificial Sequence: Synthetic oligonucleotide
  Target: ATXN1; (+) strand; PAM type: YTN; PAM sequence: TTT
gctatttccctaagccatcc

SEQ ID NO: 285409 - DNA, 20 bp, Artificial Sequence
  Description of Artificial Sequence: Synthetic oligonucleotide
  Target: ATXN1; (+) strand; PAM type: YTN; PAM sequence: TTG
ctatttccctaagccatcct

SEQ ID NO: 285410 - DNA, 20 bp, Artificial Sequence
  Description of Artificial Sequence: Synthetic oligonucleotide
  Target: ATXN1; (+) strand; PAM type: YTN; PAM sequence: CTA
tttccctaagccatcctcct

SEQ ID NO: 285411 - DNA, 20 bp, Artificial Sequence
  Description of Artificial Sequence: Synthetic oligonucleotide
  Target: ATXN1; (+) strand; PAM type: YTN; PAM sequence: TTT
ccctaagccatcctcctgcc

SEQ ID NO: 285412 - DNA, 20 bp, Artificial Sequence
  Description of Artificial Sequence: Synthetic oligonucleotide
  Target: ATXN1; (+) strand; PAM type: YTN; PAM sequence: TTC
cctaagccatcctcctgcct

SEQ ID NO: 285413 - DNA, 20 bp, Artificial Sequence
  Description of Artificial Sequence: Synthetic oligonucleotide
  Target: ATXN1; (+) strand; PAM type: YTN; PAM sequence: CTA
agccatcctcctgccttctc

SEQ ID NO: 285414 - DNA, 20 bp, Artificial Sequence
  Description of Artificial Sequence: Synthetic oligonucleotide
  Target: ATXN1; (+) strand; PAM type: YTN; PAM sequence: CTC
ctgccttctctccaggggta

SEQ ID NO: 285415 - DNA, 20 bp, Artificial Sequence
  Description of Artificial Sequence: Synthetic oligonucleotide
  Target: ATXN1; (+) strand; PAM type: YTN; PAM sequence: CTG
ccttctctccaggggtaacc

SEQ ID NO: 285416 - DNA, 20 bp, Artificial Sequence
  Description of Artificial Sequence: Synthetic oligonucleotide
  Target: ATXN1; (+) strand; PAM type: YTN; PAM sequence: CTT
ctctccaggggtaaccacta

SEQ ID NO: 285417 - DNA, 20 bp, Artificial Sequence
  Description of Artificial Sequence: Synthetic oligonucleotide
  Target: ATXN1; (+) strand; PAM type: YTN; PAM sequence: TTC
tctccaggggtaaccactat

SEQ ID NO: 285418 - DNA, 20 bp, Artificial Sequence
  Description of Artificial Sequence: Synthetic oligonucleotide
  Target: ATXN1; (+) strand; PAM type: YTN; PAM sequence: CTC
tccaggggtaaccactatct

SEQ ID NO: 285419 - DNA, 20 bp, Artificial Sequence
  Description of Artificial Sequence: Synthetic oligonucleotide
  Target: ATXN1; (+) strand; PAM type: YTN; PAM sequence: CTC
caggggtaaccactatctta

SEQ ID NO: 285420 - DNA, 20 bp, Artificial Sequence
  Description of Artificial Sequence: Synthetic oligonucleotide
  Target: ATXN1; (+) strand; PAM type: YTN; PAM sequence: CTA
tcttaaattttctatctatc

SEQ ID NO: 285421 - DNA, 20 bp, Artificial Sequence
  Description of Artificial Sequence: Synthetic oligonucleotide
  Target: ATXN1; (+) strand; PAM type: YTN; PAM sequence: CTT
aaattttctatctatcactc

SEQ ID NO: 285422 - DNA, 20 bp, Artificial Sequence
  Description of Artificial Sequence: Synthetic oligonucleotide
  Target: ATXN1; (+) strand; PAM type: YTN; PAM sequence: TTA
aattttctatctatcactct

SEQ ID NO: 285423 - DNA, 20 bp, Artificial Sequence
  Description of Artificial Sequence: Synthetic oligonucleotide
  Target: ATXN1; (+) strand; PAM type: YTN; PAM sequence: TTT
tctatctatcactctctaaa

SEQ ID NO: 285424 - DNA, 20 bp, Artificial Sequence
  Description of Artificial Sequence: Synthetic oligonucleotide
  Target: ATXN1; (+) strand; PAM type: YTN; PAM sequence: TTT
ctatctatcactctctaaaa

SEQ ID NO: 285425 - DNA, 20 bp, Artificial Sequence
  Description of Artificial Sequence: Synthetic oligonucleotide
  Target: ATXN1; (+) strand; PAM type: YTN; PAM sequence: TTC
tatctatcactctctaaaat

SEQ ID NO: 285426 - DNA, 20 bp, Artificial Sequence
  Description of Artificial Sequence: Synthetic oligonucleotide
  Target: ATXN1; (+) strand; PAM type: YTN; PAM sequence: CTA
tctatcactctctaaaatac

SEQ ID NO: 285427 - DNA, 20 bp, Artificial Sequence
  Description of Artificial Sequence: Synthetic oligonucleotide
  Target: ATXN1; (+) strand; PAM type: YTN; PAM sequence: CTA
tcactctctaaaatacatag

SEQ ID NO: 285428 - DNA, 20 bp, Artificial Sequence
  Description of Artificial Sequence: Synthetic oligonucleotide
  Target: ATXN1; (+) strand; PAM type: YTN; PAM sequence: CTC
tctaaaatacatagtttaat

SEQ ID NO: 285429 - DNA, 20 bp, Artificial Sequence
  Description of Artificial Sequence: Synthetic oligonucleotide
  Target: ATXN1; (+) strand; PAM type: YTN; PAM sequence: CTC
taaaatacatagtttaattg

SEQ ID NO: 285430 - DNA, 20 bp, Artificial Sequence
  Description of Artificial Sequence: Synthetic oligonucleotide
  Target: ATXN1; (+) strand; PAM type: YTN; PAM sequence: CTA
aaatacatagtttaattgtg

SEQ ID NO: 285431 - DNA, 20 bp, Artificial Sequence
  Description of Artificial Sequence: Synthetic oligonucleotide
  Target: ATXN1; (+) strand; PAM type: YTN; PAM sequence: TTT
aattgtgcttgattttaaac

SEQ ID NO: 285432 - DNA, 20 bp, Artificial Sequence
  Description of Artificial Sequence: Synthetic oligonucleotide
  Target: ATXN1; (+) strand; PAM type: YTN; PAM sequence: TTA
attgtgcttgattttaaact

SEQ ID NO: 285433 - DNA, 20 bp, Artificial Sequence
  Description of Artificial Sequence: Synthetic oligonucleotide
  Target: ATXN1; (+) strand; PAM type: YTN; PAM sequence: TTG
tgcttgattttaaactttat

SEQ ID NO: 285434 - DNA, 20 bp, Artificial Sequence
  Description of Artificial Sequence: Synthetic oligonucleotide
  Target: ATXN1; (+) strand; PAM type: YTN; PAM sequence: CTT
gattttaaactttataatac

SEQ ID NO: 285435 - DNA, 20 bp, Artificial Sequence
  Description of Artificial Sequence: Synthetic oligonucleotide
  Target: ATXN1; (+) strand; PAM type: YTN; PAM sequence: TTG
attttaaactttataatact

SEQ ID NO: 285436 - DNA, 20 bp, Artificial Sequence
  Description of Artificial Sequence: Synthetic oligonucleotide
  Target: ATXN1; (+) strand; PAM type: YTN; PAM sequence: TTT
taaactttataatactatca

SEQ ID NO: 285437 - DNA, 20 bp, Artificial Sequence
  Description of Artificial Sequence: Synthetic oligonucleotide
  Target: ATXN1; (+) strand; PAM type: YTN; PAM sequence: TTT
aaactttataatactatcat

SEQ ID NO: 285438 - DNA, 20 bp, Artificial Sequence
  Description of Artificial Sequence: Synthetic oligonucleotide
  Target: ATXN1; (+) strand; PAM type: YTN; PAM sequence: TTA
aactttataatactatcata

SEQ ID NO: 285439 - DNA, 20 bp, Artificial Sequence
  Description of Artificial Sequence: Synthetic oligonucleotide
  Target: ATXN1; (+) strand; PAM type: YTN; PAM sequence: CTT
tataatactatcatactgta

SEQ ID NO: 285440 - DNA, 20 bp, Artificial Sequence
  Description of Artificial Sequence: Synthetic oligonucleotide
  Target: ATXN1; (+) strand; PAM type: YTN; PAM sequence: TTT
ataatactatcatactgtat

SEQ ID NO: 285441 - DNA, 20 bp, Artificial Sequence
  Description of Artificial Sequence: Synthetic oligonucleotide
  Target: ATXN1; (+) strand; PAM type: YTN; PAM sequence: TTA
taatactatcatactgtata

SEQ ID NO: 285442 - DNA, 20 bp, Artificial Sequence
  Description of Artificial Sequence: Synthetic oligonucleotide
  Target: ATXN1; (+) strand; PAM type: YTN; PAM sequence: CTA
tcatactgtatatagtcttt

SEQ ID NO: 285443 - DNA, 20 bp, Artificial Sequence
  Description of Artificial Sequence: Synthetic oligonucleotide
  Target: ATXN1; (+) strand; PAM type: YTN; PAM sequence: CTG
tatatagtcttttgtgacta

SEQ ID NO: 285444 - DNA, 20 bp, Artificial Sequence
  Description of Artificial Sequence: Synthetic oligonucleotide
  Target: ATXN1; (+) strand; PAM type: YTN; PAM sequence: CTT
ttgtgactagtttttttcac

SEQ ID NO: 285445 - DNA, 20 bp, Artificial Sequence
  Description of Artificial Sequence: Synthetic oligonucleotide
  Target: ATXN1; (+) strand; PAM type: YTN; PAM sequence: TTT
tgtgactagtttttttcaca

SEQ ID NO: 285446 - DNA, 20 bp, Artificial Sequence
  Description of Artificial Sequence: Synthetic oligonucleotide
  Target: ATXN1; (+) strand; PAM type: YTN; PAM sequence: TTT
gtgactagtttttttcacac

SEQ ID NO: 285447 - DNA, 20 bp, Artificial Sequence
  Description of Artificial Sequence: Synthetic oligonucleotide
  Target: ATXN1; (+) strand; PAM type: YTN; PAM sequence: TTG
tgactagtttttttcacaca

SEQ ID NO: 285448 - DNA, 20 bp, Artificial Sequence
  Description of Artificial Sequence: Synthetic oligonucleotide
  Target: ATXN1; (+) strand; PAM type: YTN; PAM sequence: CTA
gtttttttcacacaatattg

SEQ ID NO: 285449 - DNA, 20 bp, Artificial Sequence
  Description of Artificial Sequence: Synthetic oligonucleotide
  Target: ATXN1; (+) strand; PAM type: YTN; PAM sequence: TTT
ttttcacacaatattgtttc

SEQ ID NO: 285450 - DNA, 20 bp, Artificial Sequence
  Description of Artificial Sequence: Synthetic oligonucleotide
  Target: ATXN1; (+) strand; PAM type: YTN; PAM sequence: TTT
tttcacacaatattgtttct

SEQ ID NO: 285451 - DNA, 20 bp, Artificial Sequence
  Description of Artificial Sequence: Synthetic oligonucleotide
  Target: ATXN1; (+) strand; PAM type: YTN; PAM sequence: TTT
ttcacacaatattgtttcta

SEQ ID NO: 285452 - DNA, 20 bp, Artificial Sequence
  Description of Artificial Sequence: Synthetic oligonucleotide
  Target: ATXN1; (+) strand; PAM type: YTN; PAM sequence: TTT
tcacacaatattgtttctaa

SEQ ID NO: 285453 - DNA, 20 bp, Artificial Sequence
  Description of Artificial Sequence: Synthetic oligonucleotide
  Target: ATXN1; (+) strand; PAM type: YTN; PAM sequence: TTT
cacacaatattgtttctaag

SEQ ID NO: 285454 - DNA, 20 bp, Artificial Sequence
  Description of Artificial Sequence: Synthetic oligonucleotide
  Target: ATXN1; (+) strand; PAM type: YTN; PAM sequence: TTC
acacaatattgtttctaaga

SEQ ID NO: 285455 - DNA, 20 bp, Artificial Sequence
  Description of Artificial Sequence: Synthetic oligonucleotide
  Target: ATXN1; (+) strand; PAM type: YTN; PAM sequence: TTG
tttctaagatttagccatgt

SEQ ID NO: 285456 - DNA, 20 bp, Artificial Sequence
  Description of Artificial Sequence: Synthetic oligonucleotide
  Target: ATXN1; (+) strand; PAM type: YTN; PAM sequence: TTT
ctaagatttagccatgttgt

SEQ ID NO: 285457 - DNA, 20 bp, Artificial Sequence
  Description of Artificial Sequence: Synthetic oligonucleotide
  Target: ATXN1; (+) strand; PAM type: YTN; PAM sequence: TTC
taagatttagccatgttgtt

SEQ ID NO: 285458 - DNA, 20 bp, Artificial Sequence
  Description of Artificial Sequence: Synthetic oligonucleotide
  Target: ATXN1; (+) strand; PAM type: YTN; PAM sequence: CTA
agatttagccatgttgttac

SEQ ID NO: 285459 - DNA, 20 bp, Artificial Sequence
  Description of Artificial Sequence: Synthetic oligonucleotide
  Target: ATXN1; (+) strand; PAM type: YTN; PAM sequence: TTT
agccatgttgttacaggtag

SEQ ID NO: 285460 - DNA, 20 bp, Artificial Sequence
  Description of Artificial Sequence: Synthetic oligonucleotide
  Target: ATXN1; (+) strand; PAM type: YTN; PAM sequence: TTA
gccatgttgttacaggtagc

SEQ ID NO: 285461 - DNA, 20 bp, Artificial Sequence
  Description of Artificial Sequence: Synthetic oligonucleotide
  Target: ATXN1; (+) strand; PAM type: YTN; PAM sequence: TTG
ttacaggtagctactatagt

SEQ ID NO: 285462 - DNA, 20 bp, Artificial Sequence
  Description of Artificial Sequence: Synthetic oligonucleotide
  Target: ATXN1; (+) strand; PAM type: YTN; PAM sequence: TTA
caggtagctactatagttcc

SEQ ID NO: 285463 - DNA, 20 bp, Artificial Sequence
  Description of Artificial Sequence: Synthetic oligonucleotide
  Target: ATXN1; (+) strand; PAM type: YTN; PAM sequence: CTA
ctatagttccttcatattca

SEQ ID NO: 285464 - DNA, 20 bp, Artificial Sequence
  Description of Artificial Sequence: Synthetic oligonucleotide
  Target: ATXN1; (+) strand; PAM type: YTN; PAM sequence: CTA
tagttccttcatattcactg

SEQ ID NO: 285465 - DNA, 20 bp, Artificial Sequence
  Description of Artificial Sequence: Synthetic oligonucleotide
  Target: ATXN1; (+) strand; PAM type: YTN; PAM sequence: TTC
cttcatattcactgctgtat

SEQ ID NO: 285466 - DNA, 20 bp, Artificial Sequence
  Description of Artificial Sequence: Synthetic oligonucleotide
  Target: ATXN1; (+) strand; PAM type: YTN; PAM sequence: CTT
catattcactgctgtataat

SEQ ID NO: 285467 - DNA, 20 bp, Artificial Sequence
  Description of Artificial Sequence: Synthetic oligonucleotide
  Target: ATXN1; (+) strand; PAM type: YTN; PAM sequence: TTC
atattcactgctgtataata

SEQ ID NO: 285468 - DNA, 20 bp, Artificial Sequence
  Description of Artificial Sequence: Synthetic oligonucleotide
  Target: ATXN1; (+) strand; PAM type: YTN; PAM sequence: TTC
actgctgtataatattccat

SEQ ID NO: 285469 - DNA, 20 bp, Artificial Sequence
  Description of Artificial Sequence: Synthetic oligonucleotide
  Target: ATXN1; (+) strand; PAM type: YTN; PAM sequence: CTG
ctgtataatattccattctg

SEQ ID NO: 285470 - DNA, 20 bp, Artificial Sequence
  Description of Artificial Sequence: Synthetic oligonucleotide
  Target: ATXN1; (+) strand; PAM type: YTN; PAM sequence: CTG
tataatattccattctgtga

SEQ ID NO: 285471 - DNA, 20 bp, Artificial Sequence
  Description of Artificial Sequence: Synthetic oligonucleotide
  Target: ATXN1; (+) strand; PAM type: YTN; PAM sequence: TTC
cattctgtgaagcaaaaaat

SEQ ID NO: 285472 - DNA, 20 bp, Artificial Sequence
  Description of Artificial Sequence: Synthetic oligonucleotide
  Target: ATXN1; (+) strand; PAM type: YTN; PAM sequence: TTC
tgtgaagcaaaaaattatat

SEQ ID NO: 285473 - DNA, 20 bp, Artificial Sequence
  Description of Artificial Sequence: Synthetic oligonucleotide
  Target: ATXN1; (+) strand; PAM type: YTN; PAM sequence: CTG
tgaagcaaaaaattatatat

SEQ ID NO: 285474 - DNA, 20 bp, Artificial Sequence
  Description of Artificial Sequence: Synthetic oligonucleotide
  Target: ATXN1; (+) strand; PAM type: YTN; PAM sequence: TTA
tatatatgtatgtatgtacg

SEQ ID NO: 285475 - DNA, 20 bp, Artificial Sequence
  Description of Artificial Sequence: Synthetic oligonucleotide
  Target: ATXN1; (+) strand; PAM type: YTN; PAM sequence: TTC
tcaatagactaatatatata

SEQ ID NO: 285476 - DNA, 20 bp, Artificial Sequence
  Description of Artificial Sequence: Synthetic oligonucleotide
  Target: ATXN1; (+) strand; PAM type: YTN; PAM sequence: CTC
aatagactaatatatatata

SEQ ID NO: 285477 - DNA, 20 bp, Artificial Sequence
  Description of Artificial Sequence: Synthetic oligonucleotide
  Target: ATXN1; (+) strand; PAM type: YTN; PAM sequence: CTA
atatatatatatattagtct

SEQ ID NO: 285478 - DNA, 20 bp, Artificial Sequence
  Description of Artificial Sequence: Synthetic oligonucleotide
  Target: ATXN1; (+) strand; PAM type: YTN; PAM sequence: TTA
gtctggagagatagaagcta

SEQ ID NO: 285479 - DNA, 20 bp, Artificial Sequence
  Description of Artificial Sequence: Synthetic oligonucleotide
  Target: ATXN1; (+) strand; PAM type: YTN; PAM sequence: CTG
gagagatagaagctaataca

SEQ ID NO: 285480 - DNA, 20 bp, Artificial Sequence
  Description of Artificial Sequence: Synthetic oligonucleotide
  Target: ATXN1; (+) strand; PAM type: YTN; PAM sequence: CTA
atacatatattagtccaatt

SEQ ID NO: 285481 - DNA, 20 bp, Artificial Sequence
  Description of Artificial Sequence: Synthetic oligonucleotide
  Target: ATXN1; (+) strand; PAM type: YTN; PAM sequence: TTA
gtccaattattatacatatt

SEQ ID NO: 285482 - DNA, 20 bp, Artificial Sequence
  Description of Artificial Sequence: Synthetic oligonucleotide
  Target: ATXN1; (+) strand; PAM type: YTN; PAM sequence: TTA
ttatacatattagtctaatt

SEQ ID NO: 285483 - DNA, 20 bp, Artificial Sequence
  Description of Artificial Sequence: Synthetic oligonucleotide
  Target: ATXN1; (+) strand; PAM type: YTN; PAM sequence: TTA
tacatattagtctaattatt

SEQ ID NO: 285484 - DNA, 20 bp, Artificial Sequence
  Description of Artificial Sequence: Synthetic oligonucleotide
  Target: ATXN1; (+) strand; PAM type: YTN; PAM sequence: TTA
gtctaattattatatattag

SEQ ID NO: 285485 - DNA, 20 bp, Artificial Sequence
  Description of Artificial Sequence: Synthetic oligonucleotide
  Target: ATXN1; (+) strand; PAM type: YTN; PAM sequence: CTA
attattatatattagactaa

SEQ ID NO: 285486 - DNA, 20 bp, Artificial Sequence
  Description of Artificial Sequence: Synthetic oligonucleotide
  Target: ATXN1; (+) strand; PAM type: YTN; PAM sequence: TTA
ttatatattagactaatata

SEQ ID NO: 285487 - DNA, 20 bp, Artificial Sequence
  Description of Artificial Sequence: Synthetic oligonucleotide
  Target: ATXN1; (+) strand; PAM type: YTN; PAM sequence: TTA
tatattagactaatatatgt

SEQ ID NO: 285488 - DNA, 20 bp, Artificial Sequence
  Description of Artificial Sequence: Synthetic oligonucleotide
  Target: ATXN1; (+) strand; PAM type: YTN; PAM sequence: TTA
gactaatatatgtctataga

SEQ ID NO: 285489 - DNA, 20 bp, Artificial Sequence
  Description of Artificial Sequence: Synthetic oligonucleotide
  Target: ATXN1; (+) strand; PAM type: YTN; PAM sequence: CTA
atatatgtctatagagatag

SEQ ID NO: 285490 - DNA, 20 bp, Artificial Sequence
  Description of Artificial Sequence: Synthetic oligonucleotide
  Target: ATXN1; (+) strand; PAM type: YTN; PAM sequence: CTA
tagagatagaagctaatata

SEQ ID NO: 285491 - DNA, 20 bp, Artificial Sequence
  Description of Artificial Sequence: Synthetic oligonucleotide
  Target: ATXN1; (+) strand; PAM type: YTN; PAM sequence: CTA
atatacatattagtcaaatt

SEQ ID NO: 285492 - DNA, 20 bp, Artificial Sequence
  Description of Artificial Sequence: Synthetic oligonucleotide
  Target: ATXN1; (+) strand; PAM type: YTN; PAM sequence: TTA
gtcaaattatacatattagt

SEQ ID NO: 285493 - DNA, 20 bp, Artificial Sequence
  Description of Artificial Sequence: Synthetic oligonucleotide
  Target: ATXN1; (+) strand; PAM type: YTN; PAM sequence: TTA
tacatattagttcaattatt

SEQ ID NO: 285494 - DNA, 20 bp, Artificial Sequence
  Description of Artificial Sequence: Synthetic oligonucleotide
  Target: ATXN1; (+) strand; PAM type: YTN; PAM sequence: TTA
gttcaattattatatattag

SEQ ID NO: 285495 - DNA, 20 bp, Artificial Sequence
  Description of Artificial Sequence: Synthetic oligonucleotide
  Target: ATXN1; (+) strand; PAM type: YTN; PAM sequence: TTC
aattattatatattagacta

SEQ ID NO: 285496 - DNA, 20 bp, Artificial Sequence
  Description of Artificial Sequence: Synthetic oligonucleotide
  Target: ATXN1; (+) strand; PAM type: YTN; PAM sequence: TTA
ttatatattagactaatata

SEQ ID NO: 285497 - DNA, 20 bp, Artificial Sequence
  Description of Artificial Sequence: Synthetic oligonucleotide
  Target: ATXN1; (+) strand; PAM type: YTN; PAM sequence: TTA
tatattagactaatatatat

SEQ ID NO: 285498 - DNA, 20 bp, Artificial Sequence
  Description of Artificial Sequence: Synthetic oligonucleotide
  Target: ATXN1; (+) strand; PAM type: YTN; PAM sequence: TTA
gactaatatatattagtcta

SEQ ID NO: 285499 - DNA, 20 bp, Artificial Sequence
  Description of Artificial Sequence: Synthetic oligonucleotide
  Target: ATXN1; (+) strand; PAM type: YTN; PAM sequence: CTA
atatatattagtctacaggg

SEQ ID NO: 285500 - DNA, 20 bp, Artificial Sequence
  Description of Artificial Sequence: Synthetic oligonucleotide
  Target: ATXN1; (+) strand; PAM type: YTN; PAM sequence: TTA
gtctacagggatagaagcta

SEQ ID NO: 285501 - DNA, 20 bp, Artificial Sequence
  Description of Artificial Sequence: Synthetic oligonucleotide
  Target: ATXN1; (+) strand; PAM type: YTN; PAM sequence: CTA
cagggatagaagctaatata

SEQ ID NO: 285502 - DNA, 20 bp, Artificial Sequence
  Description of Artificial Sequence: Synthetic oligonucleotide
  Target: ATXN1; (+) strand; PAM type: YTN; PAM sequence: CTA
atatatattagtctaattaa

SEQ ID NO: 285503 - DNA, 20 bp, Artificial Sequence
  Description of Artificial Sequence: Synthetic oligonucleotide
  Target: ATXN1; (+) strand; PAM type: YTN; PAM sequence: TTA
gtctaattaatatatatatt

SEQ ID NO: 285504 - DNA, 20 bp, Artificial Sequence
  Description of Artificial Sequence: Synthetic oligonucleotide
  Target: ATXN1; (+) strand; PAM type: YTN; PAM sequence: CTA
attaatatatatattagtct

SEQ ID NO: 285505 - DNA, 20 bp, Artificial Sequence
  Description of Artificial Sequence: Synthetic oligonucleotide
  Target: ATXN1; (+) strand; PAM type: YTN; PAM sequence: TTA
atatatatattagtctaatt

SEQ ID NO: 285506 - DNA, 20 bp, Artificial Sequence
  Description of Artificial Sequence: Synthetic oligonucleotide
  Target: ATXN1; (+) strand; PAM type: YTN; PAM sequence: TTA
gtctaattgtcatatattag

SEQ ID NO: 285507 - DNA, 20 bp, Artificial Sequence
  Description of Artificial Sequence: Synthetic oligonucleotide
  Target: ATXN1; (+) strand; PAM type: YTN; PAM sequence: CTA
attgtcatatattagactaa

SEQ ID NO: 285508 - DNA, 20 bp, Artificial Sequence
  Description of Artificial Sequence: Synthetic oligonucleotide
  Target: ATXN1; (+) strand; PAM type: YTN; PAM sequence: TTG
tcatatattagactaatata

SEQ ID NO: 285509 - DNA, 20 bp, Artificial Sequence
  Description of Artificial Sequence: Synthetic oligonucleotide
  Target: ATXN1; (+) strand; PAM type: YTN; PAM sequence: TTA
gactaatatatatatatatg

SEQ ID NO: 285510 - DNA, 20 bp, Artificial Sequence
  Description of Artificial Sequence: Synthetic oligonucleotide
  Target: ATXN1; (+) strand; PAM type: YTN; PAM sequence: CTA
atatatatatatatgtctgt

SEQ ID NO: 285511 - DNA, 20 bp, Artificial Sequence
  Description of Artificial Sequence: Synthetic oligonucleotide
  Target: ATXN1; (+) strand; PAM type: YTN; PAM sequence: CTG
ttgacgacctttaaaatttt

SEQ ID NO: 285512 - DNA, 20 bp, Artificial Sequence
  Description of Artificial Sequence: Synthetic oligonucleotide
  Target: ATXN1; (+) strand; PAM type: YTN; PAM sequence: TTG
acgacctttaaaattttttc

SEQ ID NO: 285513 - DNA, 20 bp, Artificial Sequence
  Description of Artificial Sequence: Synthetic oligonucleotide
  Target: ATXN1; (+) strand; PAM type: YTN; PAM sequence: CTT
taaaattttttcagcttcgt

SEQ ID NO: 285514 - DNA, 20 bp, Artificial Sequence
  Description of Artificial Sequence: Synthetic oligonucleotide
  Target: ATXN1; (+) strand; PAM type: YTN; PAM sequence: TTT
aaaattttttcagcttcgtt

SEQ ID NO: 285515 - DNA, 20 bp, Artificial Sequence
  Description of Artificial Sequence: Synthetic oligonucleotide
  Target: ATXN1; (+) strand; PAM type: YTN; PAM sequence: TTA
aaattttttcagcttcgttt

SEQ ID NO: 285516 - DNA, 20 bp, Artificial Sequence
  Description of Artificial Sequence: Synthetic oligonucleotide
  Target: ATXN1; (+) strand; PAM type: YTN; PAM sequence: TTT
tttcagcttcgttttttttt

SEQ ID NO: 285517 - DNA, 20 bp, Artificial Sequence
  Description of Artificial Sequence: Synthetic oligonucleotide
  Target: ATXN1; (+) strand; PAM type: YTN; PAM sequence: TTT
ttcagcttcgtttttttttc

SEQ ID NO: 285518 - DNA, 20 bp, Artificial Sequence
  Description of Artificial Sequence: Synthetic oligonucleotide
  Target: ATXN1; (+) strand; PAM type: YTN; PAM sequence: TTT
tcagcttcgtttttttttct

SEQ ID NO: 285519 - DNA, 20 bp, Artificial Sequence
  Description of Artificial Sequence: Synthetic oligonucleotide
  Target: ATXN1; (+) strand; PAM type: YTN; PAM sequence: TTT
cagcttcgtttttttttcta

SEQ ID NO: 285520 - DNA, 20 bp, Artificial Sequence
  Description of Artificial Sequence: Synthetic oligonucleotide
  Target: ATXN1; (+) strand; PAM type: YTN; PAM sequence: TTC
agcttcgtttttttttctat

SEQ ID NO: 285521 - DNA, 20 bp, Artificial Sequence
  Description of Artificial Sequence: Synthetic oligonucleotide
  Target: ATXN1; (+) strand; PAM type: YTN; PAM sequence: CTT
cgtttttttttctattagaa

SEQ ID NO: 285522 - DNA, 20 bp, Artificial Sequence
  Description of Artificial Sequence: Synthetic oligonucleotide
  Target: ATXN1; (+) strand; PAM type: YTN; PAM sequence: TTC
gtttttttttctattagaaa

SEQ ID NO: 285523 - DNA, 20 bp, Artificial Sequence
  Description of Artificial Sequence: Synthetic oligonucleotide
  Target: ATXN1; (+) strand; PAM type: YTN; PAM sequence: TTT
ttttttctattagaaacaat

SEQ ID NO: 285524 - DNA, 20 bp, Artificial Sequence
  Description of Artificial Sequence: Synthetic oligonucleotide
  Target: ATXN1; (+) strand; PAM type: YTN; PAM sequence: TTT
tttttctattagaaacaatg

SEQ ID NO: 285525 - DNA, 20 bp, Artificial Sequence
  Description of Artificial Sequence: Synthetic oligonucleotide
  Target: ATXN1; (+) strand; PAM type: YTN; PAM sequence: TTT
ttttctattagaaacaatgc

SEQ ID NO: 285526 - DNA, 20 bp, Artificial Sequence
  Description of Artificial Sequence: Synthetic oligonucleotide
  Target: ATXN1; (+) strand; PAM type: YTN; PAM sequence: TTT
tttctattagaaacaatgct

SEQ ID NO: 285527 - DNA, 20 bp, Artificial Sequence
  Description of Artificial Sequence: Synthetic oligonucleotide
  Target: ATXN1; (+) strand; PAM type: YTN; PAM sequence: TTT
ttctattagaaacaatgctg

SEQ ID NO: 285528 - DNA, 20 bp, Artificial Sequence
  Description of Artificial Sequence: Synthetic oligonucleotide
  Target: ATXN1; (+) strand; PAM type: YTN; PAM sequence: TTT
tctattagaaacaatgctgt

SEQ ID NO: 285529 - DNA, 20 bp, Artificial Sequence
  Description of Artificial Sequence: Synthetic oligonucleotide
  Target: ATXN1; (+) strand; PAM type: YTN; PAM sequence: TTT
ctattagaaacaatgctgtg

SEQ ID NO: 285530 - DNA, 20 bp, Artificial Sequence
  Description of Artificial Sequence: Synthetic oligonucleotide
  Target: ATXN1; (+) strand; PAM type: YTN; PAM sequence: TTC
tattagaaacaatgctgtgt

SEQ ID NO: 285531 - DNA, 20 bp, Artificial Sequence
  Description of Artificial Sequence: Synthetic oligonucleotide
  Target: ATXN1; (+) strand; PAM type: YTN; PAM sequence: CTA
ttagaaacaatgctgtgtcc

SEQ ID NO: 285532 - DNA, 20 bp, Artificial Sequence
  Description of Artificial Sequence: Synthetic oligonucleotide
  Target: ATXN1; (+) strand; PAM type: YTN; PAM sequence: TTA
gaaacaatgctgtgtccatt

SEQ ID NO: 285533 - DNA, 20 bp, Artificial Sequence
  Description of Artificial Sequence: Synthetic oligonucleotide
  Target: ATXN1; (+) strand; PAM type: YTN; PAM sequence: CTG
tgtccattaggaacaatacc

SEQ ID NO: 285534 - DNA, 20 bp, Artificial Sequence
  Description of Artificial Sequence: Synthetic oligonucleotide
  Target: ATXN1; (+) strand; PAM type: YTN; PAM sequence: TTA
ggaacaatacccatcagcat

SEQ ID NO: 285535 - DNA, 20 bp, Artificial Sequence
  Description of Artificial Sequence: Synthetic oligonucleotide
  Target: ATXN1; (+) strand; PAM type: YTN; PAM sequence: TTT
ccctgggttattgcctagga

SEQ ID NO: 285536 - DNA, 20 bp, Artificial Sequence
  Description of Artificial Sequence: Synthetic oligonucleotide
  Target: ATXN1; (+) strand; PAM type: YTN; PAM sequence: TTC
cctgggttattgcctaggaa

SEQ ID NO: 285537 - DNA, 20 bp, Artificial Sequence
  Description of Artificial Sequence: Synthetic oligonucleotide
  Target: ATXN1; (+) strand; PAM type: YTN; PAM sequence: CTG
ggttattgcctaggaatggg

SEQ ID NO: 285538 - DNA, 20 bp, Artificial Sequence
  Description of Artificial Sequence: Synthetic oligonucleotide
  Target: ATXN1; (+) strand; PAM type: YTN; PAM sequence: TTA
ttgcctaggaatgggtctat

SEQ ID NO: 285539 - DNA, 20 bp, Artificial Sequence
  Description of Artificial Sequence: Synthetic oligonucleotide
  Target: ATXN1; (+) strand; PAM type: YTN; PAM sequence: TTG
cctaggaatgggtctatgaa

SEQ ID NO: 285540 - DNA, 20 bp, Artificial Sequence
  Description of Artificial Sequence: Synthetic oligonucleotide
  Target: ATXN1; (+) strand; PAM type: YTN; PAM sequence: CTA
ggaatgggtctatgaatatt

SEQ ID NO: 285541 - DNA, 20 bp, Artificial Sequence
  Description of Artificial Sequence: Synthetic oligonucleotide
  Target: ATXN1; (+) strand; PAM type: YTN; PAM sequence: CTA
tgaatattcactgttaaaca

SEQ ID NO: 285542 - DNA, 20 bp, Artificial Sequence
  Description of Artificial Sequence: Synthetic oligonucleotide
  Target: ATXN1; (+) strand; PAM type: YTN; PAM sequence: TTC
actgttaaacaatagtgcca

SEQ ID NO: 285543 - DNA, 20 bp, Artificial Sequence
  Description of Artificial Sequence: Synthetic oligonucleotide
  Target: ATXN1; (+) strand; PAM type: YTN; PAM sequence: CTG
ttaaacaatagtgccaaatt

SEQ ID NO: 285544 - DNA, 20 bp, Artificial Sequence
  Description of Artificial Sequence: Synthetic oligonucleotide
  Target: ATXN1; (+) strand; PAM type: YTN; PAM sequence: TTA
aacaatagtgccaaattgct

SEQ ID NO: 285545 - DNA, 20 bp, Artificial Sequence
  Description of Artificial Sequence: Synthetic oligonucleotide
  Target: ATXN1; (+) strand; PAM type: YTN; PAM sequence: TTG
ctttcccaaatgactatatc

SEQ ID NO: 285546 - DNA, 20 bp, Artificial Sequence
  Description of Artificial Sequence: Synthetic oligonucleotide
  Target: ATXN1; (+) strand; PAM type: YTN; PAM sequence: CTT
tcccaaatgactatatcaac

SEQ ID NO: 285547 - DNA, 20 bp, Artificial Sequence
  Description of Artificial Sequence: Synthetic oligonucleotide
  Target: ATXN1; (+) strand; PAM type: YTN; PAM sequence: TTT
cccaaatgactatatcaacc

SEQ ID NO: 285548 - DNA, 20 bp, Artificial Sequence
  Description of Artificial Sequence: Synthetic oligonucleotide
  Target: ATXN1; (+) strand; PAM type: YTN; PAM sequence: TTC
ccaaatgactatatcaacct

SEQ ID NO: 285549 - DNA, 20 bp, Artificial Sequence
  Description of Artificial Sequence: Synthetic oligonucleotide
  Target: ATXN1; (+) strand; PAM type: YTN; PAM sequence: CTA
tatcaacctacactcccacc

SEQ ID NO: 285550 - DNA, 20 bp, Artificial Sequence
  Description of Artificial Sequence: Synthetic oligonucleotide
  Target: ATXN1; (+) strand; PAM type: YTN; PAM sequence: CTA
cactcccaccagcagtgcac

SEQ ID NO: 285551 - DNA, 20 bp, Artificial Sequence
  Description of Artificial Sequence: Synthetic oligonucleotide
  Target: ATXN1; (+) strand; PAM type: YTN; PAM sequence: CTC
ccaccagcagtgcaccccac

SEQ ID NO: 285552 - DNA, 20 bp, Artificial Sequence
  Description of Artificial Sequence: Synthetic oligonucleotide
  Target: ATXN1; (+) strand; PAM type: YTN; PAM sequence: TTT
tttaaaactgataaatcatt

SEQ ID NO: 285553 - DNA, 20 bp, Artificial Sequence
  Description of Artificial Sequence: Synthetic oligonucleotide
  Target: ATXN1; (+) strand; PAM type: YTN; PAM sequence: TTT
ttaaaactgataaatcattt

SEQ ID NO: 285554 - DNA, 20 bp, Artificial Sequence
  Description of Artificial Sequence: Synthetic oligonucleotide
  Target: ATXN1; (+) strand; PAM type: YTN; PAM sequence: TTT
taaaactgataaatcatttc

SEQ ID NO: 285555 - DNA, 20 bp, Artificial Sequence
  Description of Artificial Sequence: Synthetic oligonucleotide
  Target: ATXN1; (+) strand; PAM type: YTN; PAM sequence: TTT
aaaactgataaatcatttca

SEQ ID NO: 285556 - DNA, 20 bp, Artificial Sequence
  Description of Artificial Sequence: Synthetic oligonucleotide
  Target: ATXN1; (+) strand; PAM type: YTN; PAM sequence: TTA
aaactgataaatcatttcag

SEQ ID NO: 285557 - DNA, 20 bp, Artificial Sequence
  Description of Artificial Sequence: Synthetic oligonucleotide
  Target: ATXN1; (+) strand; PAM type: YTN; PAM sequence: CTG
ataaatcatttcagaatcaa

SEQ ID NO: 285558 - DNA, 20 bp, Artificial Sequence
  Description of Artificial Sequence: Synthetic oligonucleotide
  Target: ATXN1; (+) strand; PAM type: YTN; PAM sequence: TTT
cagaatcaagaaagagatct

SEQ ID NO: 285559 - DNA, 20 bp, Artificial Sequence
  Description of Artificial Sequence: Synthetic oligonucleotide
  Target: ATXN1; (+) strand; PAM type: YTN; PAM sequence: TTC
agaatcaagaaagagatcta

SEQ ID NO: 285560 - DNA, 20 bp, Artificial Sequence
  Description of Artificial Sequence: Synthetic oligonucleotide
  Target: ATXN1; (+) strand; PAM type: YTN; PAM sequence: CTA
tttgtgctgaagttggtgtt

SEQ ID NO: 285561 - DNA, 20 bp, Artificial Sequence
  Description of Artificial Sequence: Synthetic oligonucleotide
  Target: ATXN1; (+) strand; PAM type: YTN; PAM sequence: TTT
gtgctgaagttggtgttaca

SEQ ID NO: 285562 - DNA, 20 bp, Artificial Sequence
  Description of Artificial Sequence: Synthetic oligonucleotide
  Target: ATXN1; (+) strand; PAM type: YTN; PAM sequence: TTG
tgctgaagttggtgttacag

SEQ ID NO: 285563 - DNA, 20 bp, Artificial Sequence
  Description of Artificial Sequence: Synthetic oligonucleotide
  Target: ATXN1; (+) strand; PAM type: YTN; PAM sequence: CTG
aagttggtgttacaggctca

SEQ ID NO: 285564 - DNA, 20 bp, Artificial Sequence
  Description of Artificial Sequence: Synthetic oligonucleotide
  Target: ATXN1; (+) strand; PAM type: YTN; PAM sequence: TTG
gtgttacaggctcaaattcc

SEQ ID NO: 285565 - DNA, 20 bp, Artificial Sequence
  Description of Artificial Sequence: Synthetic oligonucleotide
  Target: ATXN1; (+) strand; PAM type: YTN; PAM sequence: TTA
caggctcaaattcctttttt

SEQ ID NO: 285566 - DNA, 20 bp, Artificial Sequence
  Description of Artificial Sequence: Synthetic oligonucleotide
  Target: ATXN1; (+) strand; PAM type: YTN; PAM sequence: CTC
aaattcctttttttcctttt

SEQ ID NO: 285567 - DNA, 20 bp, Artificial Sequence
  Description of Artificial Sequence: Synthetic oligonucleotide
  Target: ATXN1; (+) strand; PAM type: YTN; PAM sequence: TTC
ctttttttcctttttttttt

SEQ ID NO: 285568 - DNA, 20 bp, Artificial Sequence
  Description of Artificial Sequence: Synthetic oligonucleotide
  Target: ATXN1; (+) strand; PAM type: YTN; PAM sequence: CTT
tttttccttttttttttttt

SEQ ID NO: 285569 - DNA, 20 bp, Artificial Sequence
  Description of Artificial Sequence: Synthetic oligonucleotide
  Target: ATXN1; (+) strand; PAM type: YTN; PAM sequence: TTT
ttttccttttttttttttta

SEQ ID NO: 285570 - DNA, 20 bp, Artificial Sequence
  Description of Artificial Sequence: Synthetic oligonucleotide
  Target: ATXN1; (+) strand; PAM type: YTN; PAM sequence: TTT
tttcctttttttttttttat

SEQ ID NO: 285571 - DNA, 20 bp, Artificial Sequence
  Description of Artificial Sequence: Synthetic oligonucleotide
  Target: ATXN1; (+) strand; PAM type: YTN; PAM sequence: TTT
ttcctttttttttttttatt

SEQ ID NO: 285572 - DNA, 20 bp, Artificial Sequence
  Description of Artificial Sequence: Synthetic oligonucleotide
  Target: ATXN1; (+) strand; PAM type: YTN; PAM sequence: TTT
tcctttttttttttttattt

SEQ ID NO: 285573 - DNA, 20 bp, Artificial Sequence
  Description of Artificial Sequence: Synthetic oligonucleotide
  Target: ATXN1; (+) strand; PAM type: YTN; PAM sequence: TTT
cctttttttttttttattta

SEQ ID NO: 285574 - DNA, 20 bp, Artificial Sequence
  Description of Artificial Sequence: Synthetic oligonucleotide
  Target: ATXN1; (+) strand; PAM type: YTN; PAM sequence: TTC
ctttttttttttttatttat

SEQ ID NO: 285575 - DNA, 20 bp, Artificial Sequence
  Description of Artificial Sequence: Synthetic oligonucleotide
  Target: ATXN1; (+) strand; PAM type: YTN; PAM sequence: CTT
tttttttttttatttattta

SEQ ID NO: 285576 - DNA, 20 bp, Artificial Sequence
  Description of Artificial Sequence: Synthetic oligonucleotide
  Target: ATXN1; (+) strand; PAM type: YTN; PAM sequence: TTT
ttttttttttatttatttat

SEQ ID NO: 285577 - DNA, 20 bp, Artificial Sequence
  Description of Artificial Sequence: Synthetic oligonucleotide
  Target: ATXN1; (+) strand; PAM type: YTN; PAM sequence: TTT
tttttttttatttatttatt

SEQ ID NO: 285578 - DNA, 20 bp, Artificial Sequence
  Description of Artificial Sequence: Synthetic oligonucleotide
  Target: ATXN1; (+) strand; PAM type: YTN; PAM sequence: TTT
ttttttttatttatttattt

SEQ ID NO: 285579 - DNA, 20 bp, Artificial Sequence
  Description of Artificial Sequence: Synthetic oligonucleotide
  Target: ATXN1; (+) strand; PAM type: YTN; PAM sequence: TTT
tttttttatttatttatttt

SEQ ID NO: 285580 - DNA, 20 bp, Artificial Sequence
  Description of Artificial Sequence: Synthetic oligonucleotide
  Target: ATXN1; (+) strand; PAM type: YTN; PAM sequence: TTT
ttttttatttatttattttt

SEQ ID NO: 285581 - DNA, 20 bp, Artificial Sequence
  Description of Artificial Sequence: Synthetic oligonucleotide
  Target: ATXN1; (+) strand; PAM type: YTN; PAM sequence: TTT
tttttatttatttatttttt

SEQ ID NO: 285582 - DNA, 20 bp, Artificial Sequence
  Description of Artificial Sequence: Synthetic oligonucleotide
  Target: ATXN1; (+) strand; PAM type: YTN; PAM sequence: TTT
ttttatttatttattttttg

SEQ ID NO: 285583 - DNA, 20 bp, Artificial Sequence
  Description of Artificial Sequence: Synthetic oligonucleotide
  Target: ATXN1; (+) strand; PAM type: YTN; PAM sequence: TTT
tttatttatttattttttga

SEQ ID NO: 285584 - DNA, 20 bp, Artificial Sequence
  Description of Artificial Sequence: Synthetic oligonucleotide
  Target: ATXN1; (+) strand; PAM type: YTN; PAM sequence: TTT
ttatttatttattttttgag

SEQ ID NO: 285585 - DNA, 20 bp, Artificial Sequence
  Description of Artificial Sequence: Synthetic oligonucleotide
  Target: ATXN1; (+) strand; PAM type: YTN; PAM sequence: TTT
tatttatttattttttgaga

SEQ ID NO: 285586 - DNA, 20 bp, Artificial Sequence
  Description of Artificial Sequence: Synthetic oligonucleotide
  Target: ATXN1; (+) strand; PAM type: YTN; PAM sequence: TTT
atttatttattttttgagac

SEQ ID NO: 285587 - DNA, 20 bp, Artificial Sequence
  Description of Artificial Sequence: Synthetic oligonucleotide
  Target: ATXN1; (+) strand; PAM type: YTN; PAM sequence: TTA
tttatttattttttgagacg

SEQ ID NO: 285588 - DNA, 20 bp, Artificial Sequence
  Description of Artificial Sequence: Synthetic oligonucleotide
  Target: ATXN1; (+) strand; PAM type: YTN; PAM sequence: TTT
atttattttttgagacggag

SEQ ID NO: 285589 - DNA, 20 bp, Artificial Sequence
  Description of Artificial Sequence: Synthetic oligonucleotide
  Target: ATXN1; (+) strand; PAM type: YTN; PAM sequence: TTA
tttattttttgagacggagt

SEQ ID NO: 285590 - DNA, 20 bp, Artificial Sequence
  Description of Artificial Sequence: Synthetic oligonucleotide
  Target: ATXN1; (+) strand; PAM type: YTN; PAM sequence: TTT
attttttgagacggagtctc

SEQ ID NO: 285591 - DNA, 20 bp, Artificial Sequence
  Description of Artificial Sequence: Synthetic oligonucleotide
  Target: ATXN1; (+) strand; PAM type: YTN; PAM sequence: TTA
ttttttgagacggagtctca

SEQ ID NO: 285592 - DNA, 20 bp, Artificial Sequence
  Description of Artificial Sequence: Synthetic oligonucleotide
  Target: ATXN1; (+) strand; PAM type: YTN; PAM sequence: TTT
tttgagacggagtctcattc

SEQ ID NO: 285593 - DNA, 20 bp, Artificial Sequence
  Description of Artificial Sequence: Synthetic oligonucleotide
  Target: ATXN1; (+) strand; PAM type: YTN; PAM sequence: TTT
ttgagacggagtctcattct

SEQ ID NO: 285594 - DNA, 20 bp, Artificial Sequence
  Description of Artificial Sequence: Synthetic oligonucleotide
  Target: ATXN1; (+) strand; PAM type: YTN; PAM sequence: TTT
tgagacggagtctcattctg

SEQ ID NO: 285595 - DNA, 20 bp, Artificial Sequence
  Description of Artificial Sequence: Synthetic oligonucleotide
  Target: ATXN1; (+) strand; PAM type: YTN; PAM sequence: TTT
gagacggagtctcattctgt

SEQ ID NO: 285596 - DNA, 20 bp, Artificial Sequence
  Description of Artificial Sequence: Synthetic oligonucleotide
  Target: ATXN1; (+) strand; PAM type: YTN; PAM sequence: TTG
agacggagtctcattctgtc

SEQ ID NO: 285597 - DNA, 20 bp, Artificial Sequence
  Description of Artificial Sequence: Synthetic oligonucleotide
  Target: ATXN1; (+) strand; PAM type: YTN; PAM sequence: CTC
attctgtcgccaggctggag

SEQ ID NO: 285598 - DNA, 20 bp, Artificial Sequence
  Description of Artificial Sequence: Synthetic oligonucleotide
  Target: ATXN1; (+) strand; PAM type: YTN; PAM sequence: TTC
tgtcgccaggctggagtgca

SEQ ID NO: 285599 - DNA, 20 bp, Artificial Sequence
  Description of Artificial Sequence: Synthetic oligonucleotide
  Target: ATXN1; (+) strand; PAM type: YTN; PAM sequence: CTG
tcgccaggctggagtgcagt

SEQ ID NO: 285600 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggcacgatctc

SEQ ID NO: 285601 - DNA, 20 bp, Artificial Sequence
  Description of Artificial Sequence: Synthetic oligonucleotide
  Target: ATXN1; (+) strand; PAM type: YTN; PAM sequence: CTC
ggctcactacagcctccacc

SEQ ID NO: 285602 - DNA, 20 bp, Artificial Sequence
  Description of Artificial Sequence: Synthetic oligonucleotide
  Target: ATXN1; (+) strand; PAM type: YTN; PAM sequence: CTC
actacagcctccacctcctg

SEQ ID NO: 285603 - DNA, 20 bp, Artificial Sequence
  Description of Artificial Sequence: Synthetic oligonucleotide
  Target: ATXN1; (+) strand; PAM type: YTN; PAM sequence: CTA
cagcctccacctcctgggtt

SEQ ID NO: 285604 - DNA, 20 bp, Artificial Sequence
  Description of Artificial Sequence: Synthetic oligonucleotide
  Target: ATXN1; (+) strand; PAM type: YTN; PAM sequence: CTC
cacctcctgggttcaagtga

SEQ ID NO: 285605 - DNA, 20 bp, Artificial Sequence
  Description of Artificial Sequence: Synthetic oligonucleotide
  Target: ATXN1; (+) strand; PAM type: YTN; PAM sequence: CTC
ctgggttcaagtgattctcc

SEQ ID NO: 285606 - DNA, 20 bp, Artificial Sequence
  Description of Artificial Sequence: Synthetic oligonucleotide
  Target: ATXN1; (+) strand; PAM type: YTN; PAM sequence: CTG
ggttcaagtgattctcctgc

SEQ ID NO: 285607 - DNA, 20 bp, Artificial Sequence
  Description of Artificial Sequence: Synthetic oligonucleotide
  Target: ATXN1; (+) strand; PAM type: YTN; PAM sequence: TTC
aagtgattctcctgcctcag

SEQ ID NO: 285608 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcccgag

SEQ ID NO: 285609 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccgagta

SEQ ID NO: 285610 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccgagtatct

SEQ ID NO: 285611 - DNA, 20 bp, Artificial Sequence
  Description of Artificial Sequence: Synthetic oligonucleotide
  Target: ATXN1; (+) strand; PAM type: YTN; PAM sequence: CTC
agcctcccgagtatctggga

SEQ ID NO: 285612 - DNA, 20 bp, Artificial Sequence
  Description of Artificial Sequence: Synthetic oligonucleotide
  Target: ATXN1; (+) strand; PAM type: YTN; PAM sequence: CTC
ccgagtatctgggactacag

SEQ ID NO: 285613 - DNA, 20 bp, Artificial Sequence
  Description of Artificial Sequence: Synthetic oligonucleotide
  Target: ATXN1; (+) strand; PAM type: YTN; PAM sequence: CTG
ggactacaggtgcgcaccac

SEQ ID NO: 285614 - DNA, 20 bp, Artificial Sequence
  Description of Artificial Sequence: Synthetic oligonucleotide
  Target: ATXN1; (+) strand; PAM type: YTN; PAM sequence: CTA
caggtgcgcaccaccacccc

SEQ ID NO: 285615 - DNA, 20 bp, Artificial Sequence
  Description of Artificial Sequence: Synthetic oligonucleotide
  Target: ATXN1; (+) strand; PAM type: YTN; PAM sequence: CTA
atttttgtatttttagaaga

SEQ ID NO: 285616 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagaagagacg

SEQ ID NO: 285617 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagaagagacga

SEQ ID NO: 285618 - DNA, 20 bp, Artificial Sequence
  Description of Artificial Sequence: Synthetic oligonucleotide
  Target: ATXN1; (+) strand; PAM type: YTN; PAM sequence: TTT
gtatttttagaagagacgag

SEQ ID NO: 285619 - DNA, 20 bp, Artificial Sequence
  Description of Artificial Sequence: Synthetic oligonucleotide
  Target: ATXN1; (+) strand; PAM type: YTN; PAM sequence: TTG
tatttttagaagagacgagg

SEQ ID NO: 285620 - DNA, 20 bp, Artificial Sequence
  Description of Artificial Sequence: Synthetic oligonucleotide
  Target: ATXN1; (+) strand; PAM type: YTN; PAM sequence: TTT
ttagaagagacgaggtttca

SEQ ID NO: 285621 - DNA, 20 bp, Artificial Sequence
  Description of Artificial Sequence: Synthetic oligonucleotide
  Target: ATXN1; (+) strand; PAM type: YTN; PAM sequence: TTT
tagaagagacgaggtttcac

SEQ ID NO: 285622 - DNA, 20 bp, Artificial Sequence
  Description of Artificial Sequence: Synthetic oligonucleotide
  Target: ATXN1; (+) strand; PAM type: YTN; PAM sequence: TTT
agaagagacgaggtttcact

SEQ ID NO: 285623 - DNA, 20 bp, Artificial Sequence
  Description of Artificial Sequence: Synthetic oligonucleotide
  Target: ATXN1; (+) strand; PAM type: YTN; PAM sequence: TTA
gaagagacgaggtttcacta

SEQ ID NO: 285624 - DNA, 20 bp, Artificial Sequence
  Description of Artificial Sequence: Synthetic oligonucleotide
  Target: ATXN1; (+) strand; PAM type: YTN; PAM sequence: TTT
cactatgttggccaggacgg

SEQ ID NO: 285625 - DNA, 20 bp, Artificial Sequence
  Description of Artificial Sequence: Synthetic oligonucleotide
  Target: ATXN1; (+) strand; PAM type: YTN; PAM sequence: TTC
actatgttggccaggacggt

SEQ ID NO: 285626 - DNA, 20 bp, Artificial Sequence
  Description of Artificial Sequence: Synthetic oligonucleotide
  Target: ATXN1; (+) strand; PAM type: YTN; PAM sequence: CTA
tgttggccaggacggtctgg

SEQ ID NO: 285627 - DNA, 20 bp, Artificial Sequence
  Description of Artificial Sequence: Synthetic oligonucleotide
  Target: ATXN1; (+) strand; PAM type: YTN; PAM sequence: TTG
gccaggacggtctggatctc

SEQ ID NO: 285628 - DNA, 20 bp, Artificial Sequence
  Description of Artificial Sequence: Synthetic oligonucleotide
  Target: ATXN1; (+) strand; PAM type: YTN; PAM sequence: CTG
gatctcttgacctcgtgatc

SEQ ID NO: 285629 - DNA, 20 bp, Artificial Sequence
  Description of Artificial Sequence: Synthetic oligonucleotide
  Target: ATXN1; (+) strand; PAM type: YTN; PAM sequence: CTC
ttgacctcgtgatccgcctg

SEQ ID NO: 285630 - DNA, 20 bp, Artificial Sequence
  Description of Artificial Sequence: Synthetic oligonucleotide
  Target: ATXN1; (+) strand; PAM type: YTN; PAM sequence: CTT
gacctcgtgatccgcctgcc

SEQ ID NO: 285631 - DNA, 20 bp, Artificial Sequence
  Description of Artificial Sequence: Synthetic oligonucleotide
  Target: ATXN1; (+) strand; PAM type: YTN; PAM sequence: TTG
acctcgtgatccgcctgcct

SEQ ID NO: 285632 - DNA, 20 bp, Artificial Sequence
  Description of Artificial Sequence: Synthetic oligonucleotide
  Target: ATXN1; (+) strand; PAM type: YTN; PAM sequence: CTC
gtgatccgcctgcctcggcc

SEQ ID NO: 285633 - DNA, 20 bp, Artificial Sequence
  Description of Artificial Sequence: Synthetic oligonucleotide
  Target: ATXN1; (+) strand; PAM type: YTN; PAM sequence: CTG
cctcggcctcccaaagtgct

SEQ ID NO: 285634 - DNA, 20 bp, Artificial Sequence
  Description of Artificial Sequence: Synthetic oligonucleotide
  Target: ATXN1; (+) strand; PAM type: YTN; PAM sequence: CTC
ggcctcccaaagtgctggga

SEQ ID NO: 285635 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattacag

SEQ ID NO: 285636 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcgtgagccac

SEQ ID NO: 285637 - DNA, 20 bp, Artificial Sequence
  Description of Artificial Sequence: Synthetic oligonucleotide
  Target: ATXN1; (+) strand; PAM type: YTN; PAM sequence: TTA
caggcgtgagccaccgtgcc

SEQ ID NO: 285638 - DNA, 20 bp, Artificial Sequence
  Description of Artificial Sequence: Synthetic oligonucleotide
  Target: ATXN1; (+) strand; PAM type: YTN; PAM sequence: CTA
caggctcaaattctaaatat

SEQ ID NO: 285639 - DNA, 20 bp, Artificial Sequence
  Description of Artificial Sequence: Synthetic oligonucleotide
  Target: ATXN1; (+) strand; PAM type: YTN; PAM sequence: CTC
aaattctaaatatccataaa

SEQ ID NO: 285640 - DNA, 20 bp, Artificial Sequence
  Description of Artificial Sequence: Synthetic oligonucleotide
  Target: ATXN1; (+) strand; PAM type: YTN; PAM sequence: TTC
taaatatccataaagaaata

SEQ ID NO: 285641 - DNA, 20 bp, Artificial Sequence
  Description of Artificial Sequence: Synthetic oligonucleotide
  Target: ATXN1; (+) strand; PAM type: YTN; PAM sequence: CTA
aatatccataaagaaataag

SEQ ID NO: 285642 - DNA, 20 bp, Artificial Sequence
  Description of Artificial Sequence: Synthetic oligonucleotide
  Target: ATXN1; (+) strand; PAM type: YTN; PAM sequence: CTG
tccctgtctctcacattggt

SEQ ID NO: 285643 - DNA, 20 bp, Artificial Sequence
  Description of Artificial Sequence: Synthetic oligonucleotide
  Target: ATXN1; (+) strand; PAM type: YTN; PAM sequence: CTG
tctctcacattggtgagttt

SEQ ID NO: 285644 - DNA, 20 bp, Artificial Sequence
  Description of Artificial Sequence: Synthetic oligonucleotide
  Target: ATXN1; (+) strand; PAM type: YTN; PAM sequence: CTC
tcacattggtgagtttatac

SEQ ID NO: 285645 - DNA, 20 bp, Artificial Sequence
  Description of Artificial Sequence: Synthetic oligonucleotide
  Target: ATXN1; (+) strand; PAM type: YTN; PAM sequence: CTC
acattggtgagtttatactt

SEQ ID NO: 285646 - DNA, 20 bp, Artificial Sequence
  Description of Artificial Sequence: Synthetic oligonucleotide
  Target: ATXN1; (+) strand; PAM type: YTN; PAM sequence: TTG
gtgagtttatactttgttca

SEQ ID NO: 285647 - DNA, 20 bp, Artificial Sequence
  Description of Artificial Sequence: Synthetic oligonucleotide
  Target: ATXN1; (+) strand; PAM type: YTN; PAM sequence: TTT
atactttgttcagcactaag

SEQ ID NO: 285648 - DNA, 20 bp, Artificial Sequence
  Description of Artificial Sequence: Synthetic oligonucleotide
  Target: ATXN1; (+) strand; PAM type: YTN; PAM sequence: TTA
tactttgttcagcactaagc

SEQ ID NO: 285649 - DNA, 20 bp, Artificial Sequence
  Description of Artificial Sequence: Synthetic oligonucleotide
  Target: ATXN1; (+) strand; PAM type: YTN; PAM sequence: CTT
tgttcagcactaagcataac

SEQ ID NO: 285650 - DNA, 20 bp, Artificial Sequence
  Description of Artificial Sequence: Synthetic oligonucleotide
  Target: ATXN1; (+) strand; PAM type: YTN; PAM sequence: TTT
gttcagcactaagcataaca

SEQ ID NO: 285651 - DNA, 20 bp, Artificial Sequence
  Description of Artificial Sequence: Synthetic oligonucleotide
  Target: ATXN1; (+) strand; PAM type: YTN; PAM sequence: TTG
ttcagcactaagcataacaa

SEQ ID NO: 285652 - DNA, 20 bp, Artificial Sequence
  Description of Artificial Sequence: Synthetic oligonucleotide
  Target: ATXN1; (+) strand; PAM type: YTN; PAM sequence: TTC
agcactaagcataacaaacg

SEQ ID NO: 285653 - DNA, 20 bp, Artificial Sequence
  Description of Artificial Sequence: Synthetic oligonucleotide
  Target: ATXN1; (+) strand; PAM type: YTN; PAM sequence: CTA
agcataacaaacgagagtta

SEQ ID NO: 285654 - DNA, 20 bp, Artificial Sequence
  Description of Artificial Sequence: Synthetic oligonucleotide
  Target: ATXN1; (+) strand; PAM type: YTN; PAM sequence: TTA
cttcgtaagatgacggttac

SEQ ID NO: 285655 - DNA, 20 bp, Artificial Sequence
  Description of Artificial Sequence: Synthetic oligonucleotide
  Target: ATXN1; (+) strand; PAM type: YTN; PAM sequence: CTT
cgtaagatgacggttacttt

SEQ ID NO: 285656 - DNA, 20 bp, Artificial Sequence
  Description of Artificial Sequence: Synthetic oligonucleotide
  Target: ATXN1; (+) strand; PAM type: YTN; PAM sequence: TTC
gtaagatgacggttacttta

SEQ ID NO: 285657 - DNA, 20 bp, Artificial Sequence
  Description of Artificial Sequence: Synthetic oligonucleotide
  Target: ATXN1; (+) strand; PAM type: YTN; PAM sequence: TTA
ctttaccaccttcaaacatg

SEQ ID NO: 285658 - DNA, 20 bp, Artificial Sequence
  Description of Artificial Sequence: Synthetic oligonucleotide
  Target: ATXN1; (+) strand; PAM type: YTN; PAM sequence: CTT
taccaccttcaaacatggca

SEQ ID NO: 285659 - DNA, 20 bp, Artificial Sequence
  Description of Artificial Sequence: Synthetic oligonucleotide
  Target: ATXN1; (+) strand; PAM type: YTN; PAM sequence: TTT
accaccttcaaacatggcat

SEQ ID NO: 285660 - DNA, 20 bp, Artificial Sequence
  Description of Artificial Sequence: Synthetic oligonucleotide
  Target: ATXN1; (+) strand; PAM type: YTN; PAM sequence: TTA
ccaccttcaaacatggcatt

SEQ ID NO: 285661 - DNA, 20 bp, Artificial Sequence
  Description of Artificial Sequence: Synthetic oligonucleotide
  Target: ATXN1; (+) strand; PAM type: YTN; PAM sequence: CTT
caaacatggcattaactaat

SEQ ID NO: 285662 - DNA, 20 bp, Artificial Sequence
  Description of Artificial Sequence: Synthetic oligonucleotide
  Target: ATXN1; (+) strand; PAM type: YTN; PAM sequence: TTC
aaacatggcattaactaatg

SEQ ID NO: 285663 - DNA, 20 bp, Artificial Sequence
  Description of Artificial Sequence: Synthetic oligonucleotide
  Target: ATXN1; (+) strand; PAM type: YTN; PAM sequence: TTA
actaatgacttagattggac

SEQ ID NO: 285664 - DNA, 20 bp, Artificial Sequence
  Description of Artificial Sequence: Synthetic oligonucleotide
  Target: ATXN1; (+) strand; PAM type: YTN; PAM sequence: CTA
atgacttagattggactgag

SEQ ID NO: 285665 - DNA, 20 bp, Artificial Sequence
  Description of Artificial Sequence: Synthetic oligonucleotide
  Target: ATXN1; (+) strand; PAM type: YTN; PAM sequence: CTT
agattggactgagggttaat

SEQ ID NO: 285666 - DNA, 20 bp, Artificial Sequence
  Description of Artificial Sequence: Synthetic oligonucleotide
  Target: ATXN1; (+) strand; PAM type: YTN; PAM sequence: TTA
gattggactgagggttaata

SEQ ID NO: 285667 - DNA, 20 bp, Artificial Sequence
  Description of Artificial Sequence: Synthetic oligonucleotide
  Target: ATXN1; (+) strand; PAM type: YTN; PAM sequence: TTG
gactgagggttaataatttg

SEQ ID NO: 285668 - DNA, 20 bp, Artificial Sequence
  Description of Artificial Sequence: Synthetic oligonucleotide
  Target: ATXN1; (+) strand; PAM type: YTN; PAM sequence: CTG
agggttaataatttgaagac

SEQ ID NO: 285669 - DNA, 20 bp, Artificial Sequence
  Description of Artificial Sequence: Synthetic oligonucleotide
  Target: ATXN1; (+) strand; PAM type: YTN; PAM sequence: TTA
ataatttgaagactccccat

SEQ ID NO: 285670 - DNA, 20 bp, Artificial Sequence
  Description of Artificial Sequence: Synthetic oligonucleotide
  Target: ATXN1; (+) strand; PAM type: YTN; PAM sequence: TTT
gaagactccccatgaccttc

SEQ ID NO: 285671 - DNA, 20 bp, Artificial Sequence
  Description of Artificial Sequence: Synthetic oligonucleotide
  Target: ATXN1; (+) strand; PAM type: YTN; PAM sequence: TTG
aagactccccatgaccttct

SEQ ID NO: 285672 - DNA, 20 bp, Artificial Sequence
  Description of Artificial Sequence: Synthetic oligonucleotide
  Target: ATXN1; (+) strand; PAM type: YTN; PAM sequence: CTC
cccatgaccttctttcctag

SEQ ID NO: 285673 - DNA, 20 bp, Artificial Sequence
  Description of Artificial Sequence: Synthetic oligonucleotide
  Target: ATXN1; (+) strand; PAM type: YTN; PAM sequence: CTT
ctttcctagtcattcaattc

SEQ ID NO: 285674 - DNA, 20 bp, Artificial Sequence
  Description of Artificial Sequence: Synthetic oligonucleotide
  Target: ATXN1; (+) strand; PAM type: YTN; PAM sequence: TTC
tttcctagtcattcaattct

SEQ ID NO: 285675 - DNA, 20 bp, Artificial Sequence
  Description of Artificial Sequence: Synthetic oligonucleotide
  Target: ATXN1; (+) strand; PAM type: YTN; PAM sequence: CTT
tcctagtcattcaattctta

SEQ ID NO: 285676 - DNA, 20 bp, Artificial Sequence
  Description of Artificial Sequence: Synthetic oligonucleotide
  Target: ATXN1; (+) strand; PAM type: YTN; PAM sequence: TTT
cctagtcattcaattcttaa

SEQ ID NO: 285677 - DNA, 20 bp, Artificial Sequence
  Description of Artificial Sequence: Synthetic oligonucleotide
  Target: ATXN1; (+) strand; PAM type: YTN; PAM sequence: TTC
ctagtcattcaattcttaag

SEQ ID NO: 285678 - DNA, 20 bp, Artificial Sequence
  Description of Artificial Sequence: Synthetic oligonucleotide
  Target: ATXN1; (+) strand; PAM type: YTN; PAM sequence: CTA
gtcattcaattcttaagcaa

SEQ ID NO: 285679 - DNA, 20 bp, Artificial Sequence
  Description of Artificial Sequence: Synthetic oligonucleotide
  Target: ATXN1; (+) strand; PAM type: YTN; PAM sequence: TTC
aattcttaagcaaggtggat

SEQ ID NO: 285680 - DNA, 20 bp, Artificial Sequence
  Description of Artificial Sequence: Synthetic oligonucleotide
  Target: ATXN1; (+) strand; PAM type: YTN; PAM sequence: TTC
ttaagcaaggtggataccaa

SEQ ID NO: 285681 - DNA, 20 bp, Artificial Sequence
  Description of Artificial Sequence: Synthetic oligonucleotide
  Target: ATXN1; (+) strand; PAM type: YTN; PAM sequence: CTT
aagcaaggtggataccaaaa

SEQ ID NO: 285682 - DNA, 20 bp, Artificial Sequence
  Description of Artificial Sequence: Synthetic oligonucleotide
  Target: ATXN1; (+) strand; PAM type: YTN; PAM sequence: TTA
agcaaggtggataccaaaag

SEQ ID NO: 285683 - DNA, 20 bp, Artificial Sequence
  Description of Artificial Sequence: Synthetic oligonucleotide
  Target: ATXN1; (+) strand; PAM type: YTN; PAM sequence: CTA
gcgtacatgaagtgccaggg

SEQ ID NO: 285684 - DNA, 20 bp, Artificial Sequence
  Description of Artificial Sequence: Synthetic oligonucleotide
  Target: ATXN1; (+) strand; PAM type: YTN; PAM sequence: CTT
agaacaggaaatcatgtaca

SEQ ID NO: 285685 - DNA, 20 bp, Artificial Sequence
  Description of Artificial Sequence: Synthetic oligonucleotide
  Target: ATXN1; (+) strand; PAM type: YTN; PAM sequence: TTA
gaacaggaaatcatgtacaa

SEQ ID NO: 285686 - DNA, 20 bp, Artificial Sequence
  Description of Artificial Sequence: Synthetic oligonucleotide
  Target: ATXN1; (+) strand; PAM type: YTN; PAM sequence: CTC
aagcttgtgaaattgagaga

SEQ ID NO: 285687 - DNA, 20 bp, Artificial Sequence
  Description of Artificial Sequence: Synthetic oligonucleotide
  Target: ATXN1; (+) strand; PAM type: YTN; PAM sequence: CTT
gtgaaattgagagacttctt

SEQ ID NO: 285688 - DNA, 20 bp, Artificial Sequence
  Description of Artificial Sequence: Synthetic oligonucleotide
  Target: ATXN1; (+) strand; PAM type: YTN; PAM sequence: TTG
tgaaattgagagacttcttt

SEQ ID NO: 285689 - DNA, 20 bp, Artificial Sequence
  Description of Artificial Sequence: Synthetic oligonucleotide
  Target: ATXN1; (+) strand; PAM type: YTN; PAM sequence: TTG
agagacttctttatttcctt

SEQ ID NO: 285690 - DNA, 20 bp, Artificial Sequence
  Description of Artificial Sequence: Synthetic oligonucleotide
  Target: ATXN1; (+) strand; PAM type: YTN; PAM sequence: CTT
ctttatttccttcactatta

SEQ ID NO: 285691 - DNA, 20 bp, Artificial Sequence
  Description of Artificial Sequence: Synthetic oligonucleotide
  Target: ATXN1; (+) strand; PAM type: YTN; PAM sequence: TTC
tttatttccttcactattag

SEQ ID NO: 285692 - DNA, 20 bp, Artificial Sequence
  Description of Artificial Sequence: Synthetic oligonucleotide
  Target: ATXN1; (+) strand; PAM type: YTN; PAM sequence: CTT
tatttccttcactattagaa

SEQ ID NO: 285693 - DNA, 20 bp, Artificial Sequence
  Description of Artificial Sequence: Synthetic oligonucleotide
  Target: ATXN1; (+) strand; PAM type: YTN; PAM sequence: TTT
atttccttcactattagaag

SEQ ID NO: 285694 - DNA, 20 bp, Artificial Sequence
  Description of Artificial Sequence: Synthetic oligonucleotide
  Target: ATXN1; (+) strand; PAM type: YTN; PAM sequence: TTA
tttccttcactattagaagc

SEQ ID NO: 285695 - DNA, 20 bp, Artificial Sequence
  Description of Artificial Sequence: Synthetic oligonucleotide
  Target: ATXN1; (+) strand; PAM type: YTN; PAM sequence: TTT
ccttcactattagaagcaga

SEQ ID NO: 285696 - DNA, 20 bp, Artificial Sequence
  Description of Artificial Sequence: Synthetic oligonucleotide
  Target: ATXN1; (+) strand; PAM type: YTN; PAM sequence: TTC
cttcactattagaagcagag

SEQ ID NO: 285697 - DNA, 20 bp, Artificial Sequence
  Description of Artificial Sequence: Synthetic oligonucleotide
  Target: ATXN1; (+) strand; PAM type: YTN; PAM sequence: CTT
cactattagaagcagaggaa

SEQ ID NO: 285698 - DNA, 20 bp, Artificial Sequence
  Description of Artificial Sequence: Synthetic oligonucleotide
  Target: ATXN1; (+) strand; PAM type: YTN; PAM sequence: TTC
actattagaagcagaggaag

SEQ ID NO: 285699 - DNA, 20 bp, Artificial Sequence
  Description of Artificial Sequence: Synthetic oligonucleotide
  Target: ATXN1; (+) strand; PAM type: YTN; PAM sequence: CTA
ttagaagcagaggaagagag

SEQ ID NO: 285700 - DNA, 20 bp, Artificial Sequence
  Description of Artificial Sequence: Synthetic oligonucleotide
  Target: ATXN1; (+) strand; PAM type: YTN; PAM sequence: TTA
gaagcagaggaagagagggc

SEQ ID NO: 285701 - DNA, 20 bp, Artificial Sequence
  Description of Artificial Sequence: Synthetic oligonucleotide
  Target: ATXN1; (+) strand; PAM type: YTN; PAM sequence: CTG
attagatggggggaaggctt

SEQ ID NO: 285702 - DNA, 20 bp, Artificial Sequence
  Description of Artificial Sequence: Synthetic oligonucleotide
  Target: ATXN1; (+) strand; PAM type: YTN; PAM sequence: TTA
gatggggggaaggcttagct

SEQ ID NO: 285703 - DNA, 20 bp, Artificial Sequence
  Description of Artificial Sequence: Synthetic oligonucleotide
  Target: ATXN1; (+) strand; PAM type: YTN; PAM sequence: CTT
agcttttattttaaaatagc

SEQ ID NO: 285704 - DNA, 20 bp, Artificial Sequence
  Description of Artificial Sequence: Synthetic oligonucleotide
  Target: ATXN1; (+) strand; PAM type: YTN; PAM sequence: TTA
gcttttattttaaaatagca

SEQ ID NO: 285705 - DNA, 20 bp, Artificial Sequence
  Description of Artificial Sequence: Synthetic oligonucleotide
  Target: ATXN1; (+) strand; PAM type: YTN; PAM sequence: CTT
ttattttaaaatagcaaaat

SEQ ID NO: 285706 - DNA, 20 bp, Artificial Sequence
  Description of Artificial Sequence: Synthetic oligonucleotide
  Target: ATXN1; (+) strand; PAM type: YTN; PAM sequence: TTT
tattttaaaatagcaaaatc

SEQ ID NO: 285707 - DNA, 20 bp, Artificial Sequence
  Description of Artificial Sequence: Synthetic oligonucleotide
  Target: ATXN1; (+) strand; PAM type: YTN; PAM sequence: TTT
attttaaaatagcaaaatcg

SEQ ID NO: 285708 - DNA, 20 bp, Artificial Sequence
  Description of Artificial Sequence: Synthetic oligonucleotide
  Target: ATXN1; (+) strand; PAM type: YTN; PAM sequence: TTA
ttttaaaatagcaaaatcga

SEQ ID NO: 285709 - DNA, 20 bp, Artificial Sequence
  Description of Artificial Sequence: Synthetic oligonucleotide
  Target: ATXN1; (+) strand; PAM type: YTN; PAM sequence: TTT
taaaatagcaaaatcgaaaa

SEQ ID NO: 285710 - DNA, 20 bp, Artificial Sequence
  Description of Artificial Sequence: Synthetic oligonucleotide
  Target: ATXN1; (+) strand; PAM type: YTN; PAM sequence: TTT
aaaatagcaaaatcgaaaaa

SEQ ID NO: 285711 - DNA, 20 bp, Artificial Sequence
  Description of Artificial Sequence: Synthetic oligonucleotide
  Target: ATXN1; (+) strand; PAM type: YTN; PAM sequence: TTA
aaatagcaaaatcgaaaaac

SEQ ID NO: 285712 - DNA, 20 bp, Artificial Sequence
  Description of Artificial Sequence: Synthetic oligonucleotide
  Target: ATXN1; (+) strand; PAM type: YTN; PAM sequence: CTT
tgtaattagattttgccaga

SEQ ID NO: 285713 - DNA, 20 bp, Artificial Sequence
  Description of Artificial Sequence: Synthetic oligonucleotide
  Target: ATXN1; (+) strand; PAM type: YTN; PAM sequence: TTT
gtaattagattttgccagac

SEQ ID NO: 285714 - DNA, 20 bp, Artificial Sequence
  Description of Artificial Sequence: Synthetic oligonucleotide
  Target: ATXN1; (+) strand; PAM type: YTN; PAM sequence: TTG
taattagattttgccagact

SEQ ID NO: 285715 - DNA, 20 bp, Artificial Sequence
  Description of Artificial Sequence: Synthetic oligonucleotide
  Target: ATXN1; (+) strand; PAM type: YTN; PAM sequence: TTA
gattttgccagacttaggct

SEQ ID NO: 285716 - DNA, 20 bp, Artificial Sequence
  Description of Artificial Sequence: Synthetic oligonucleotide
  Target: ATXN1; (+) strand; PAM type: YTN; PAM sequence: TTT
tgccagacttaggcttaaag

SEQ ID NO: 285717 - DNA, 20 bp, Artificial Sequence
  Description of Artificial Sequence: Synthetic oligonucleotide
  Target: ATXN1; (+) strand; PAM type: YTN; PAM sequence: TTT
gccagacttaggcttaaagg

SEQ ID NO: 285718 - DNA, 20 bp, Artificial Sequence
  Description of Artificial Sequence: Synthetic oligonucleotide
  Target: ATXN1; (+) strand; PAM type: YTN; PAM sequence: TTG
ccagacttaggcttaaagga

SEQ ID NO: 285719 - DNA, 20 bp, Artificial Sequence
  Description of Artificial Sequence: Synthetic oligonucleotide
  Target: ATXN1; (+) strand; PAM type: YTN; PAM sequence: CTT
aggcttaaaggaaaatgatt

SEQ ID NO: 285720 - DNA, 20 bp, Artificial Sequence
  Description of Artificial Sequence: Synthetic oligonucleotide
  Target: ATXN1; (+) strand; PAM type: YTN; PAM sequence: TTA
ggcttaaaggaaaatgattc

SEQ ID NO: 285721 - DNA, 20 bp, Artificial Sequence
  Description of Artificial Sequence: Synthetic oligonucleotide
  Target: ATXN1; (+) strand; PAM type: YTN; PAM sequence: CTT
aaaggaaaatgattctttcc

SEQ ID NO: 285722 - DNA, 20 bp, Artificial Sequence
  Description of Artificial Sequence: Synthetic oligonucleotide
  Target: ATXN1; (+) strand; PAM type: YTN; PAM sequence: TTA
aaggaaaatgattctttcct

SEQ ID NO: 285723 - DNA, 20 bp, Artificial Sequence
  Description of Artificial Sequence: Synthetic oligonucleotide
  Target: ATXN1; (+) strand; PAM type: YTN; PAM sequence: TTC
tttcctctccaaaagaataa

SEQ ID NO: 285724 - DNA, 20 bp, Artificial Sequence
  Description of Artificial Sequence: Synthetic oligonucleotide
  Target: ATXN1; (+) strand; PAM type: YTN; PAM sequence: CTT
tcctctccaaaagaataagg

SEQ ID NO: 285725 - DNA, 20 bp, Artificial Sequence
  Description of Artificial Sequence: Synthetic oligonucleotide
  Target: ATXN1; (+) strand; PAM type: YTN; PAM sequence: TTT
cctctccaaaagaataaggt

SEQ ID NO: 285726 - DNA, 20 bp, Artificial Sequence
  Description of Artificial Sequence: Synthetic oligonucleotide
  Target: ATXN1; (+) strand; PAM type: YTN; PAM sequence: TTC
ctctccaaaagaataaggtc

SEQ ID NO: 285727 - DNA, 20 bp, Artificial Sequence
  Description of Artificial Sequence: Synthetic oligonucleotide
  Target: ATXN1; (+) strand; PAM type: YTN; PAM sequence: CTC
tccaaaagaataaggtcaga

SEQ ID NO: 285728 - DNA, 20 bp, Artificial Sequence
  Description of Artificial Sequence: Synthetic oligonucleotide
  Target: ATXN1; (+) strand; PAM type: YTN; PAM sequence: CTC
caaaagaataaggtcagagc

SEQ ID NO: 285729 - DNA, 20 bp, Artificial Sequence
  Description of Artificial Sequence: Synthetic oligonucleotide
  Target: ATXN1; (+) strand; PAM type: YTN; PAM sequence: CTA
agactcccaaacctttggtc

SEQ ID NO: 285730 - DNA, 20 bp, Artificial Sequence
  Description of Artificial Sequence: Synthetic oligonucleotide
  Target: ATXN1; (+) strand; PAM type: YTN; PAM sequence: CTC
ccaaacctttggtcctggct

SEQ ID NO: 285731 - DNA, 20 bp, Artificial Sequence
  Description of Artificial Sequence: Synthetic oligonucleotide
  Target: ATXN1; (+) strand; PAM type: YTN; PAM sequence: CTT
tggtcctggctcaaagggtg

SEQ ID NO: 285732 - DNA, 20 bp, Artificial Sequence
  Description of Artificial Sequence: Synthetic oligonucleotide
  Target: ATXN1; (+) strand; PAM type: YTN; PAM sequence: TTT
ggtcctggctcaaagggtga

SEQ ID NO: 285733 - DNA, 20 bp, Artificial Sequence
  Description of Artificial Sequence: Synthetic oligonucleotide
  Target: ATXN1; (+) strand; PAM type: YTN; PAM sequence: TTG
gtcctggctcaaagggtgag

SEQ ID NO: 285734 - DNA, 20 bp, Artificial Sequence
  Description of Artificial Sequence: Synthetic oligonucleotide
  Target: ATXN1; (+) strand; PAM type: YTN; PAM sequence: CTG
gctcaaagggtgagctacga

SEQ ID NO: 285735 - DNA, 20 bp, Artificial Sequence
  Description of Artificial Sequence: Synthetic oligonucleotide
  Target: ATXN1; (+) strand; PAM type: YTN; PAM sequence: CTC
aaagggtgagctacgaatcg

SEQ ID NO: 285736 - DNA, 20 bp, Artificial Sequence
  Description of Artificial Sequence: Synthetic oligonucleotide
  Target: ATXN1; (+) strand; PAM type: YTN; PAM sequence: CTA
cgaatcggcccgttcttcat

SEQ ID NO: 285737 - DNA, 20 bp, Artificial Sequence
  Description of Artificial Sequence: Synthetic oligonucleotide
  Target: ATXN1; (+) strand; PAM type: YTN; PAM sequence: TTC
ttcatcatcctcctacatat

SEQ ID NO: 285738 - DNA, 20 bp, Artificial Sequence
  Description of Artificial Sequence: Synthetic oligonucleotide
  Target: ATXN1; (+) strand; PAM type: YTN; PAM sequence: CTT
catcatcctcctacatatac

SEQ ID NO: 285739 - DNA, 20 bp, Artificial Sequence
  Description of Artificial Sequence: Synthetic oligonucleotide
  Target: ATXN1; (+) strand; PAM type: YTN; PAM sequence: TTC
atcatcctcctacatatacc

SEQ ID NO: 285740 - DNA, 20 bp, Artificial Sequence
  Description of Artificial Sequence: Synthetic oligonucleotide
  Target: ATXN1; (+) strand; PAM type: YTN; PAM sequence: CTC
ctacatatacctatagatct

SEQ ID NO: 285741 - DNA, 20 bp, Artificial Sequence
  Description of Artificial Sequence: Synthetic oligonucleotide
  Target: ATXN1; (+) strand; PAM type: YTN; PAM sequence: CTA
catatacctatagatctgtc

SEQ ID NO: 285742 - DNA, 20 bp, Artificial Sequence
  Description of Artificial Sequence: Synthetic oligonucleotide
  Target: ATXN1; (+) strand; PAM type: YTN; PAM sequence: CTA
tagatctgtctgggcatgag

SEQ ID NO: 285743 - DNA, 20 bp, Artificial Sequence
  Description of Artificial Sequence: Synthetic oligonucleotide
  Target: ATXN1; (+) strand; PAM type: YTN; PAM sequence: CTG
tctgggcatgagtacagaat

SEQ ID NO: 285744 - DNA, 20 bp, Artificial Sequence
  Description of Artificial Sequence: Synthetic oligonucleotide
  Target: ATXN1; (+) strand; PAM type: YTN; PAM sequence: CTG
ggcatgagtacagaattggc

SEQ ID NO: 285745 - DNA, 20 bp, Artificial Sequence
  Description of Artificial Sequence: Synthetic oligonucleotide
  Target: ATXN1; (+) strand; PAM type: YTN; PAM sequence: TTG
gcaaatacagggtatgagaa

SEQ ID NO: 285746 - DNA, 20 bp, Artificial Sequence
  Description of Artificial Sequence: Synthetic oligonucleotide
  Target: ATXN1; (+) strand; PAM type: YTN; PAM sequence: CTG
ttcaaatgttaagaagtgtc

SEQ ID NO: 285747 - DNA, 20 bp, Artificial Sequence
  Description of Artificial Sequence: Synthetic oligonucleotide
  Target: ATXN1; (+) strand; PAM type: YTN; PAM sequence: TTC
aaatgttaagaagtgtcagg

SEQ ID NO: 285748 - DNA, 20 bp, Artificial Sequence
  Description of Artificial Sequence: Synthetic oligonucleotide
  Target: ATXN1; (+) strand; PAM type: YTN; PAM sequence: TTA
agaagtgtcaggaaagcacc

SEQ ID NO: 285749 - DNA, 20 bp, Artificial Sequence
  Description of Artificial Sequence: Synthetic oligonucleotide
  Target: ATXN1; (+) strand; PAM type: YTN; PAM sequence: CTG
acgctgaagttaatctggag

SEQ ID NO: 285750 - DNA, 20 bp, Artificial Sequence
  Description of Artificial Sequence: Synthetic oligonucleotide
  Target: ATXN1; (+) strand; PAM type: YTN; PAM sequence: CTG
aagttaatctggaggggaac

SEQ ID NO: 285751 - DNA, 20 bp, Artificial Sequence
  Description of Artificial Sequence: Synthetic oligonucleotide
  Target: ATXN1; (+) strand; PAM type: YTN; PAM sequence: TTA
atctggaggggaactaattt

SEQ ID NO: 285752 - DNA, 20 bp, Artificial Sequence
  Description of Artificial Sequence: Synthetic oligonucleotide
  Target: ATXN1; (+) strand; PAM type: YTN; PAM sequence: CTG
gaggggaactaatttacctt

SEQ ID NO: 285753 - DNA, 20 bp, Artificial Sequence
  Description of Artificial Sequence: Synthetic oligonucleotide
  Target: ATXN1; (+) strand; PAM type: YTN; PAM sequence: CTA
atttaccttctttaacacaa

SEQ ID NO: 285754 - DNA, 20 bp, Artificial Sequence
  Description of Artificial Sequence: Synthetic oligonucleotide
  Target: ATXN1; (+) strand; PAM type: YTN; PAM sequence: TTT
accttctttaacacaagtgg

SEQ ID NO: 285755 - DNA, 20 bp, Artificial Sequence
  Description of Artificial Sequence: Synthetic oligonucleotide
  Target: ATXN1; (+) strand; PAM type: YTN; PAM sequence: TTA
ccttctttaacacaagtgga

SEQ ID NO: 285756 - DNA, 20 bp, Artificial Sequence
  Description of Artificial Sequence: Synthetic oligonucleotide
  Target: ATXN1; (+) strand; PAM type: YTN; PAM sequence: CTT
ctttaacacaagtggagatg

SEQ ID NO: 285757 - DNA, 20 bp, Artificial Sequence
  Description of Artificial Sequence: Synthetic oligonucleotide
  Target: ATXN1; (+) strand; PAM type: YTN; PAM sequence: TTC
tttaacacaagtggagatga

SEQ ID NO: 285758 - DNA, 20 bp, Artificial Sequence
  Description of Artificial Sequence: Synthetic oligonucleotide
  Target: ATXN1; (+) strand; PAM type: YTN; PAM sequence: CTT
taacacaagtggagatgagg

SEQ ID NO: 285759 - DNA, 20 bp, Artificial Sequence
  Description of Artificial Sequence: Synthetic oligonucleotide
  Target: ATXN1; (+) strand; PAM type: YTN; PAM sequence: TTT
aacacaagtggagatgaggg

SEQ ID NO: 285760 - DNA, 20 bp, Artificial Sequence
  Description of Artificial Sequence: Synthetic oligonucleotide
  Target: ATXN1; (+) strand; PAM type: YTN; PAM sequence: TTA
acacaagtggagatgagggc

SEQ ID NO: 285761 - DNA, 20 bp, Artificial Sequence
  Description of Artificial Sequence: Synthetic oligonucleotide
  Target: ATXN1; (+) strand; PAM type: YTN; PAM sequence: CTG
tgaaacacagtcagtgtgtt

SEQ ID NO: 285762 - DNA, 20 bp, Artificial Sequence
  Description of Artificial Sequence: Synthetic oligonucleotide
  Target: ATXN1; (+) strand; PAM type: YTN; PAM sequence: TTC
tttctccattatggtctctt

SEQ ID NO: 285763 - DNA, 20 bp, Artificial Sequence
  Description of Artificial Sequence: Synthetic oligonucleotide
  Target: ATXN1; (+) strand; PAM type: YTN; PAM sequence: CTT
tctccattatggtctctttc

SEQ ID NO: 285764 - DNA, 20 bp, Artificial Sequence
  Description of Artificial Sequence: Synthetic oligonucleotide
  Target: ATXN1; (+) strand; PAM type: YTN; PAM sequence: TTT
ctccattatggtctctttct

SEQ ID NO: 285765 - DNA, 20 bp, Artificial Sequence
  Description of Artificial Sequence: Synthetic oligonucleotide
  Target: ATXN1; (+) strand; PAM type: YTN; PAM sequence: TTC
tccattatggtctctttctt

SEQ ID NO: 285766 - DNA, 20 bp, Artificial Sequence
  Description of Artificial Sequence: Synthetic oligonucleotide
  Target: ATXN1; (+) strand; PAM type: YTN; PAM sequence: CTC
cattatggtctctttcttac

SEQ ID NO: 285767 - DNA, 20 bp, Artificial Sequence
  Description of Artificial Sequence: Synthetic oligonucleotide
  Target: ATXN1; (+) strand; PAM type: YTN; PAM sequence: TTA
tggtctctttcttactggtt

SEQ ID NO: 285768 - DNA, 20 bp, Artificial Sequence
  Description of Artificial Sequence: Synthetic oligonucleotide
  Target: ATXN1; (+) strand; PAM type: YTN; PAM sequence: CTC
tttcttactggttaactaca

SEQ ID NO: 285769 - DNA, 20 bp, Artificial Sequence
  Description of Artificial Sequence: Synthetic oligonucleotide
  Target: ATXN1; (+) strand; PAM type: YTN; PAM sequence: CTT
tcttactggttaactacaaa

SEQ ID NO: 285770 - DNA, 20 bp, Artificial Sequence
  Description of Artificial Sequence: Synthetic oligonucleotide
  Target: ATXN1; (+) strand; PAM type: YTN; PAM sequence: TTT
cttactggttaactacaaaa

SEQ ID NO: 285771 - DNA, 20 bp, Artificial Sequence
  Description of Artificial Sequence: Synthetic oligonucleotide
  Target: ATXN1; (+) strand; PAM type: YTN; PAM sequence: TTC
ttactggttaactacaaaaa

SEQ ID NO: 285772 - DNA, 20 bp, Artificial Sequence
  Description of Artificial Sequence: Synthetic oligonucleotide
  Target: ATXN1; (+) strand; PAM type: YTN; PAM sequence: CTT
actggttaactacaaaaagc

SEQ ID NO: 285773 - DNA, 20 bp, Artificial Sequence
  Description of Artificial Sequence: Synthetic oligonucleotide
  Target: ATXN1; (+) strand; PAM type: YTN; PAM sequence: TTA
ctggttaactacaaaaagca

SEQ ID NO: 285774 - DNA, 20 bp, Artificial Sequence
  Description of Artificial Sequence: Synthetic oligonucleotide
  Target: ATXN1; (+) strand; PAM type: YTN; PAM sequence: CTG
gttaactacaaaaagcaagg

SEQ ID NO: 285775 - DNA, 20 bp, Artificial Sequence
  Description of Artificial Sequence: Synthetic oligonucleotide
  Target: ATXN1; (+) strand; PAM type: YTN; PAM sequence: TTA
actacaaaaagcaaggaaat

SEQ ID NO: 285776 - DNA, 20 bp, Artificial Sequence
  Description of Artificial Sequence: Synthetic oligonucleotide
  Target: ATXN1; (+) strand; PAM type: YTN; PAM sequence: CTA
caaaaagcaaggaaatggct

SEQ ID NO: 285777 - DNA, 20 bp, Artificial Sequence
  Description of Artificial Sequence: Synthetic oligonucleotide
  Target: ATXN1; (+) strand; PAM type: YTN; PAM sequence: CTG
aaaggcaggcagtgagggga

SEQ ID NO: 285778 - DNA, 20 bp, Artificial Sequence
  Description of Artificial Sequence: Synthetic oligonucleotide
  Target: ATXN1; (+) strand; PAM type: YTN; PAM sequence: CTT
tcacctgtacgaaggatgtc

SEQ ID NO: 285779 - DNA, 20 bp, Artificial Sequence
  Description of Artificial Sequence: Synthetic oligonucleotide
  Target: ATXN1; (+) strand; PAM type: YTN; PAM sequence: TTT
cacctgtacgaaggatgtct

SEQ ID NO: 285780 - DNA, 20 bp, Artificial Sequence
  Description of Artificial Sequence: Synthetic oligonucleotide
  Target: ATXN1; (+) strand; PAM type: YTN; PAM sequence: TTC
acctgtacgaaggatgtctc

SEQ ID NO: 285781 - DNA, 20 bp, Artificial Sequence
  Description of Artificial Sequence: Synthetic oligonucleotide
  Target: ATXN1; (+) strand; PAM type: YTN; PAM sequence: CTG
tacgaaggatgtctctggaa

SEQ ID NO: 285782 - DNA, 20 bp, Artificial Sequence
  Description of Artificial Sequence: Synthetic oligonucleotide
  Target: ATXN1; (+) strand; PAM type: YTN; PAM sequence: CTC
tggaaaacggaatgttgaca

SEQ ID NO: 285783 - DNA, 20 bp, Artificial Sequence
  Description of Artificial Sequence: Synthetic oligonucleotide
  Target: ATXN1; (+) strand; PAM type: YTN; PAM sequence: CTG
gaaaacggaatgttgacaga

SEQ ID NO: 285784 - DNA, 20 bp, Artificial Sequence
  Description of Artificial Sequence: Synthetic oligonucleotide
  Target: ATXN1; (+) strand; PAM type: YTN; PAM sequence: TTG
acagagagtaaacaagcaac

SEQ ID NO: 285785 - DNA, 20 bp, Artificial Sequence
  Description of Artificial Sequence: Synthetic oligonucleotide
  Target: ATXN1; (+) strand; PAM type: YTN; PAM sequence: CTA
ttaatgcctgttaagtcacc

SEQ ID NO: 285786 - DNA, 20 bp, Artificial Sequence
  Description of Artificial Sequence: Synthetic oligonucleotide
  Target: ATXN1; (+) strand; PAM type: YTN; PAM sequence: TTA
atgcctgttaagtcaccttt

SEQ ID NO: 285787 - DNA, 20 bp, Artificial Sequence
  Description of Artificial Sequence: Synthetic oligonucleotide
  Target: ATXN1; (+) strand; PAM type: YTN; PAM sequence: CTG
ttaagtcacctttttgagat

SEQ ID NO: 285788 - DNA, 20 bp, Artificial Sequence
  Description of Artificial Sequence: Synthetic oligonucleotide
  Target: ATXN1; (+) strand; PAM type: YTN; PAM sequence: TTA
agtcacctttttgagatttt

SEQ ID NO: 285789 - DNA, 20 bp, Artificial Sequence
  Description of Artificial Sequence: Synthetic oligonucleotide
  Target: ATXN1; (+) strand; PAM type: YTN; PAM sequence: CTT
tttgagattttttggtgact

SEQ ID NO: 285790 - DNA, 20 bp, Artificial Sequence
  Description of Artificial Sequence: Synthetic oligonucleotide
  Target: ATXN1; (+) strand; PAM type: YTN; PAM sequence: TTT
ttgagattttttggtgacta

SEQ ID NO: 285791 - DNA, 20 bp, Artificial Sequence
  Description of Artificial Sequence: Synthetic oligonucleotide
  Target: ATXN1; (+) strand; PAM type: YTN; PAM sequence: TTT
tgagattttttggtgactat

SEQ ID NO: 285792 - DNA, 20 bp, Artificial Sequence
  Description of Artificial Sequence: Synthetic oligonucleotide
  Target: ATXN1; (+) strand; PAM type: YTN; PAM sequence: TTT
gagattttttggtgactatc

SEQ ID NO: 285793 - DNA, 20 bp, Artificial Sequence
  Description of Artificial Sequence: Synthetic oligonucleotide
  Target: ATXN1; (+) strand; PAM type: YTN; PAM sequence: TTG
agattttttggtgactatca

SEQ ID NO: 285794 - DNA, 20 bp, Artificial Sequence
  Description of Artificial Sequence: Synthetic oligonucleotide
  Target: ATXN1; (+) strand; PAM type: YTN; PAM sequence: TTT
tttggtgactatcagtgaag

SEQ ID NO: 285795 - DNA, 20 bp, Artificial Sequence
  Description of Artificial Sequence: Synthetic oligonucleotide
  Target: ATXN1; (+) strand; PAM type: YTN; PAM sequence: TTT
ttggtgactatcagtgaagt

SEQ ID NO: 285796 - DNA, 20 bp, Artificial Sequence
  Description of Artificial Sequence: Synthetic oligonucleotide
  Target: ATXN1; (+) strand; PAM type: YTN; PAM sequence: TTT
tggtgactatcagtgaagtc

SEQ ID NO: 285797 - DNA, 20 bp, Artificial Sequence
  Description of Artificial Sequence: Synthetic oligonucleotide
  Target: ATXN1; (+) strand; PAM type: YTN; PAM sequence: TTT
ggtgactatcagtgaagtct

SEQ ID NO: 285798 - DNA, 20 bp, Artificial Sequence
  Description of Artificial Sequence: Synthetic oligonucleotide
  Target: ATXN1; (+) strand; PAM type: YTN; PAM sequence: TTG
gtgactatcagtgaagtctt

SEQ ID NO: 285799 - DNA, 20 bp, Artificial Sequence
  Description of Artificial Sequence: Synthetic oligonucleotide
  Target: ATXN1; (+) strand; PAM type: YTN; PAM sequence: CTA
tcagtgaagtcttatgcctc

SEQ ID NO: 285800 - DNA, 20 bp, Artificial Sequence
  Description of Artificial Sequence: Synthetic oligonucleotide
  Target: ATXN1; (+) strand; PAM type: YTN; PAM sequence: CTT
atgcctcttattaaattctc

SEQ ID NO: 285801 - DNA, 20 bp, Artificial Sequence
  Description of Artificial Sequence: Synthetic oligonucleotide
  Target: ATXN1; (+) strand; PAM type: YTN; PAM sequence: TTA
tgcctcttattaaattctca

SEQ ID NO: 285802 - DNA, 20 bp, Artificial Sequence
  Description of Artificial Sequence: Synthetic oligonucleotide
  Target: ATXN1; (+) strand; PAM type: YTN; PAM sequence: CTC
ttattaaattctcacactgt

SEQ ID NO: 285803 - DNA, 20 bp, Artificial Sequence
  Description of Artificial Sequence: Synthetic oligonucleotide
  Target: ATXN1; (+) strand; PAM type: YTN; PAM sequence: CTT
attaaattctcacactgttt

SEQ ID NO: 285804 - DNA, 20 bp, Artificial Sequence
  Description of Artificial Sequence: Synthetic oligonucleotide
  Target: ATXN1; (+) strand; PAM type: YTN; PAM sequence: TTA
ttaaattctcacactgtttt

SEQ ID NO: 285805 - DNA, 20 bp, Artificial Sequence
  Description of Artificial Sequence: Synthetic oligonucleotide
  Target: ATXN1; (+) strand; PAM type: YTN; PAM sequence: TTA
aattctcacactgttttaat

SEQ ID NO: 285806 - DNA, 20 bp, Artificial Sequence
  Description of Artificial Sequence: Synthetic oligonucleotide
  Target: ATXN1; (+) strand; PAM type: YTN; PAM sequence: TTC
tcacactgttttaattaagt

SEQ ID NO: 285807 - DNA, 20 bp, Artificial Sequence
  Description of Artificial Sequence: Synthetic oligonucleotide
  Target: ATXN1; (+) strand; PAM type: YTN; PAM sequence: CTC
acactgttttaattaagtag

SEQ ID NO: 285808 - DNA, 20 bp, Artificial Sequence
  Description of Artificial Sequence: Synthetic oligonucleotide
  Target: ATXN1; (+) strand; PAM type: YTN; PAM sequence: CTG
ttttaattaagtagggcctt

SEQ ID NO: 285809 - DNA, 20 bp, Artificial Sequence
  Description of Artificial Sequence: Synthetic oligonucleotide
  Target: ATXN1; (+) strand; PAM type: YTN; PAM sequence: TTT
taattaagtagggccttatt

SEQ ID NO: 285810 - DNA, 20 bp, Artificial Sequence
  Description of Artificial Sequence: Synthetic oligonucleotide
  Target: ATXN1; (+) strand; PAM type: YTN; PAM sequence: TTT
aattaagtagggccttattt

SEQ ID NO: 285811 - DNA, 20 bp, Artificial Sequence
  Description of Artificial Sequence: Synthetic oligonucleotide
  Target: ATXN1; (+) strand; PAM type: YTN; PAM sequence: TTA
attaagtagggccttatttt

SEQ ID NO: 285812 - DNA, 20 bp, Artificial Sequence
  Description of Artificial Sequence: Synthetic oligonucleotide
  Target: ATXN1; (+) strand; PAM type: YTN; PAM sequence: TTA
agtagggccttattttaatc

SEQ ID NO: 285813 - DNA, 20 bp, Artificial Sequence
  Description of Artificial Sequence: Synthetic oligonucleotide
  Target: ATXN1; (+) strand; PAM type: YTN; PAM sequence: CTT
attttaatcacagtggtggt

SEQ ID NO: 285814 - DNA, 20 bp, Artificial Sequence
  Description of Artificial Sequence: Synthetic oligonucleotide
  Target: ATXN1; (+) strand; PAM type: YTN; PAM sequence: TTA
ttttaatcacagtggtggtg

SEQ ID NO: 285815 - DNA, 20 bp, Artificial Sequence
  Description of Artificial Sequence: Synthetic oligonucleotide
  Target: ATXN1; (+) strand; PAM type: YTN; PAM sequence: TTT
taatcacagtggtggtgcct

SEQ ID NO: 285816 - DNA, 20 bp, Artificial Sequence
  Description of Artificial Sequence: Synthetic oligonucleotide
  Target: ATXN1; (+) strand; PAM type: YTN; PAM sequence: TTT
aatcacagtggtggtgcctt

SEQ ID NO: 285817 - DNA, 20 bp, Artificial Sequence
  Description of Artificial Sequence: Synthetic oligonucleotide
  Target: ATXN1; (+) strand; PAM type: YTN; PAM sequence: TTA
atcacagtggtggtgccttc

SEQ ID NO: 285818 - DNA, 20 bp, Artificial Sequence
  Description of Artificial Sequence: Synthetic oligonucleotide
  Target: ATXN1; (+) strand; PAM type: YTN; PAM sequence: CTT
ctcgttttaagctagtgagc

SEQ ID NO: 285819 - DNA, 20 bp, Artificial Sequence
  Description of Artificial Sequence: Synthetic oligonucleotide
  Target: ATXN1; (+) strand; PAM type: YTN; PAM sequence: TTC
tcgttttaagctagtgagct

SEQ ID NO: 285820 - DNA, 20 bp, Artificial Sequence
  Description of Artificial Sequence: Synthetic oligonucleotide
  Target: ATXN1; (+) strand; PAM type: YTN; PAM sequence: CTC
gttttaagctagtgagctgg

SEQ ID NO: 285821 - DNA, 20 bp, Artificial Sequence
  Description of Artificial Sequence: Synthetic oligonucleotide
  Target: ATXN1; (+) strand; PAM type: YTN; PAM sequence: TTT
taagctagtgagctggaacc

SEQ ID NO: 285822 - DNA, 20 bp, Artificial Sequence
  Description of Artificial Sequence: Synthetic oligonucleotide
  Target: ATXN1; (+) strand; PAM type: YTN; PAM sequence: TTT
aagctagtgagctggaaccc

SEQ ID NO: 285823 - DNA, 20 bp, Artificial Sequence
  Description of Artificial Sequence: Synthetic oligonucleotide
  Target: ATXN1; (+) strand; PAM type: YTN; PAM sequence: TTA
agctagtgagctggaaccca

SEQ ID NO: 285824 - DNA, 20 bp, Artificial Sequence
  Description of Artificial Sequence: Synthetic oligonucleotide
  Target: ATXN1; (+) strand; PAM type: YTN; PAM sequence: CTA
gtgagctggaacccagccag

SEQ ID NO: 285825 - DNA, 20 bp, Artificial Sequence
  Description of Artificial Sequence: Synthetic oligonucleotide
  Target: ATXN1; (+) strand; PAM type: YTN; PAM sequence: CTG
gaacccagccaggcagtgtt

SEQ ID NO: 285826 - DNA, 20 bp, Artificial Sequence
  Description of Artificial Sequence: Synthetic oligonucleotide
  Target: ATXN1; (+) strand; PAM type: YTN; PAM sequence: TTA
aacaggagcgagagactttc

SEQ ID NO: 285827 - DNA, 20 bp, Artificial Sequence
  Description of Artificial Sequence: Synthetic oligonucleotide
  Target: ATXN1; (+) strand; PAM type: YTN; PAM sequence: CTT
tccttcttcgtcaaggaagc

SEQ ID NO: 285828 - DNA, 20 bp, Artificial Sequence
  Description of Artificial Sequence: Synthetic oligonucleotide
  Target: ATXN1; (+) strand; PAM type: YTN; PAM sequence: TTT
ccttcttcgtcaaggaagct

SEQ ID NO: 285829 - DNA, 20 bp, Artificial Sequence
  Description of Artificial Sequence: Synthetic oligonucleotide
  Target: ATXN1; (+) strand; PAM type: YTN; PAM sequence: TTC
cttcttcgtcaaggaagctt

SEQ ID NO: 285830 - DNA, 20 bp, Artificial Sequence
  Description of Artificial Sequence: Synthetic oligonucleotide
  Target: ATXN1; (+) strand; PAM type: YTN; PAM sequence: CTT
cttcgtcaaggaagcttttg

SEQ ID NO: 285831 - DNA, 20 bp, Artificial Sequence
  Description of Artificial Sequence: Synthetic oligonucleotide
  Target: ATXN1; (+) strand; PAM type: YTN; PAM sequence: TTC
ttcgtcaaggaagcttttgc

SEQ ID NO: 285832 - DNA, 20 bp, Artificial Sequence
  Description of Artificial Sequence: Synthetic oligonucleotide
  Target: ATXN1; (+) strand; PAM type: YTN; PAM sequence: CTT
cgtcaaggaagcttttgcag

SEQ ID NO: 285833 - DNA, 20 bp, Artificial Sequence
  Description of Artificial Sequence: Synthetic oligonucleotide
  Target: ATXN1; (+) strand; PAM type: YTN; PAM sequence: TTC
gtcaaggaagcttttgcagc

SEQ ID NO: 285834 - DNA, 20 bp, Artificial Sequence
  Description of Artificial Sequence: Synthetic oligonucleotide
  Target: ATXN1; (+) strand; PAM type: YTN; PAM sequence: CTT
ttgcagccccgttattttgt

SEQ ID NO: 285835 - DNA, 20 bp, Artificial Sequence
  Description of Artificial Sequence: Synthetic oligonucleotide
  Target: ATXN1; (+) strand; PAM type: YTN; PAM sequence: TTT
tgcagccccgttattttgtt

SEQ ID NO: 285836 - DNA, 20 bp, Artificial Sequence
  Description of Artificial Sequence: Synthetic oligonucleotide
  Target: ATXN1; (+) strand; PAM type: YTN; PAM sequence: TTT
gcagccccgttattttgttt

SEQ ID NO: 285837 - DNA, 20 bp, Artificial Sequence
  Description of Artificial Sequence: Synthetic oligonucleotide
  Target: ATXN1; (+) strand; PAM type: YTN; PAM sequence: TTG
cagccccgttattttgtttt

SEQ ID NO: 285838 - DNA, 20 bp, Artificial Sequence
  Description of Artificial Sequence: Synthetic oligonucleotide
  Target: ATXN1; (+) strand; PAM type: YTN; PAM sequence: TTA
ttttgtttttttatttttca

SEQ ID NO: 285839 - DNA, 20 bp, Artificial Sequence
  Description of Artificial Sequence: Synthetic oligonucleotide
  Target: ATXN1; (+) strand; PAM type: YTN; PAM sequence: TTT
tgtttttttatttttcagag

SEQ ID NO: 285840 - DNA, 20 bp, Artificial Sequence
  Description of Artificial Sequence: Synthetic oligonucleotide
  Target: ATXN1; (+) strand; PAM type: YTN; PAM sequence: TTT
gtttttttatttttcagaga

SEQ ID NO: 285841 - DNA, 20 bp, Artificial Sequence
  Description of Artificial Sequence: Synthetic oligonucleotide
  Target: ATXN1; (+) strand; PAM type: YTN; PAM sequence: TTG
tttttttatttttcagagac

SEQ ID NO: 285842 - DNA, 20 bp, Artificial Sequence
  Description of Artificial Sequence: Synthetic oligonucleotide
  Target: ATXN1; (+) strand; PAM type: YTN; PAM sequence: TTT
ttttatttttcagagactga

SEQ ID NO: 285843 - DNA, 20 bp, Artificial Sequence
  Description of Artificial Sequence: Synthetic oligonucleotide
  Target: ATXN1; (+) strand; PAM type: YTN; PAM sequence: TTT
tttatttttcagagactgaa

SEQ ID NO: 285844 - DNA, 20 bp, Artificial Sequence
  Description of Artificial Sequence: Synthetic oligonucleotide
  Target: ATXN1; (+) strand; PAM type: YTN; PAM sequence: TTT
ttatttttcagagactgaat

SEQ ID NO: 285845 - DNA, 20 bp, Artificial Sequence
  Description of Artificial Sequence: Synthetic oligonucleotide
  Target: ATXN1; (+) strand; PAM type: YTN; PAM sequence: TTT
tatttttcagagactgaatc

SEQ ID NO: 285846 - DNA, 20 bp, Artificial Sequence
  Description of Artificial Sequence: Synthetic oligonucleotide
  Target: ATXN1; (+) strand; PAM type: YTN; PAM sequence: TTT
atttttcagagactgaatct

SEQ ID NO: 285847 - DNA, 20 bp, Artificial Sequence
  Description of Artificial Sequence: Synthetic oligonucleotide
  Target: ATXN1; (+) strand; PAM type: YTN; PAM sequence: TTA
tttttcagagactgaatcta

SEQ ID NO: 285848 - DNA, 20 bp, Artificial Sequence
  Description of Artificial Sequence: Synthetic oligonucleotide
  Target: ATXN1; (+) strand; PAM type: YTN; PAM sequence: TTT
ttcagagactgaatctagct

SEQ ID NO: 285849 - DNA, 20 bp, Artificial Sequence
  Description of Artificial Sequence: Synthetic oligonucleotide
  Target: ATXN1; (+) strand; PAM type: YTN; PAM sequence: TTT
tcagagactgaatctagctc

SEQ ID NO: 285850 - DNA, 20 bp, Artificial Sequence
  Description of Artificial Sequence: Synthetic oligonucleotide
  Target: ATXN1; (+) strand; PAM type: YTN; PAM sequence: TTT
cagagactgaatctagctct

SEQ ID NO: 285851 - DNA, 20 bp, Artificial Sequence
  Description of Artificial Sequence: Synthetic oligonucleotide
  Target: ATXN1; (+) strand; PAM type: YTN; PAM sequence: TTC
agagactgaatctagctctg

SEQ ID NO: 285852 - DNA, 20 bp, Artificial Sequence
  Description of Artificial Sequence: Synthetic oligonucleotide
  Target: ATXN1; (+) strand; PAM type: YTN; PAM sequence: CTG
aatctagctctgtcacccag

SEQ ID NO: 285853 - DNA, 20 bp, Artificial Sequence
  Description of Artificial Sequence: Synthetic oligonucleotide
  Target: ATXN1; (+) strand; PAM type: YTN; PAM sequence: CTA
gctctgtcacccaggctgtg

SEQ ID NO: 285854 - DNA, 20 bp, Artificial Sequence
  Description of Artificial Sequence: Synthetic oligonucleotide
  Target: ATXN1; (+) strand; PAM type: YTN; PAM sequence: CTC
tgtcacccaggctgtgcaat

SEQ ID NO: 285855 - DNA, 20 bp, Artificial Sequence
  Description of Artificial Sequence: Synthetic oligonucleotide
  Target: ATXN1; (+) strand; PAM type: YTN; PAM sequence: CTG
tcacccaggctgtgcaatgg

SEQ ID NO: 285856 - DNA, 20 bp, Artificial Sequence
  Description of Artificial Sequence: Synthetic oligonucleotide
  Target: ATXN1; (+) strand; PAM type: YTN; PAM sequence: CTG
tgcaatggcacgatcatagc

SEQ ID NO: 285857 - DNA, 20 bp, Artificial Sequence
  Description of Artificial Sequence: Synthetic oligonucleotide
  Target: ATXN1; (+) strand; PAM type: YTN; PAM sequence: CTC
actgcagcctctaactcctg

SEQ ID NO: 285858 - DNA, 20 bp, Artificial Sequence
  Description of Artificial Sequence: Synthetic oligonucleotide
  Target: ATXN1; (+) strand; PAM type: YTN; PAM sequence: CTG
cagcctctaactcctgggct

SEQ ID NO: 285859 - DNA, 20 bp, Artificial Sequence
  Description of Artificial Sequence: Synthetic oligonucleotide
  Target: ATXN1; (+) strand; PAM type: YTN; PAM sequence: CTC
taactcctgggctcaagcaa

SEQ ID NO: 285860 - DNA, 20 bp, Artificial Sequence
  Description of Artificial Sequence: Synthetic oligonucleotide
  Target: ATXN1; (+) strand; PAM type: YTN; PAM sequence: CTA
actcctgggctcaagcaatc

SEQ ID NO: 285861 - DNA, 20 bp, Artificial Sequence
  Description of Artificial Sequence: Synthetic oligonucleotide
  Target: ATXN1; (+) strand; PAM type: YTN; PAM sequence: CTC
ctgggctcaagcaatcctcc

SEQ ID NO: 285862 - DNA, 20 bp, Artificial Sequence
  Description of Artificial Sequence: Synthetic oligonucleotide
  Target: ATXN1; (+) strand; PAM type: YTN; PAM sequence: CTG
ggctcaagcaatcctcctgc

SEQ ID NO: 285863 - DNA, 20 bp, Artificial Sequence
  Description of Artificial Sequence: Synthetic oligonucleotide
  Target: ATXN1; (+) strand; PAM type: YTN; PAM sequence: CTC
aagcaatcctcctgcctcag

SEQ ID NO: 285864 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctccagagga

SEQ ID NO: 285865 - DNA, 20 bp, Artificial Sequence
  Description of Artificial Sequence: Synthetic oligonucleotide
  Target: ATXN1; (+) strand; PAM type: YTN; PAM sequence: CTG
cctcagcctccagaggagct

SEQ ID NO: 285866 - DNA, 20 bp, Artificial Sequence
  Description of Artificial Sequence: Synthetic oligonucleotide
  Target: ATXN1; (+) strand; PAM type: YTN; PAM sequence: CTC
agcctccagaggagctggga

SEQ ID NO: 285867 - DNA, 20 bp, Artificial Sequence
  Description of Artificial Sequence: Synthetic oligonucleotide
  Target: ATXN1; (+) strand; PAM type: YTN; PAM sequence: CTC
cagaggagctgggactacag

SEQ ID NO: 285868 - DNA, 20 bp, Artificial Sequence
  Description of Artificial Sequence: Synthetic oligonucleotide
  Target: ATXN1; (+) strand; PAM type: YTN; PAM sequence: CTG
ggactacagatgcacgcctc

SEQ ID NO: 285869 - DNA, 20 bp, Artificial Sequence
  Description of Artificial Sequence: Synthetic oligonucleotide
  Target: ATXN1; (+) strand; PAM type: YTN; PAM sequence: CTA
cagatgcacgcctccatgct

SEQ ID NO: 285870 - DNA, 20 bp, Artificial Sequence
  Description of Artificial Sequence: Synthetic oligonucleotide
  Target: ATXN1; (+) strand; PAM type: YTN; PAM sequence: CTC
catgcttggctaatttttac

SEQ ID NO: 285871 - DNA, 20 bp, Artificial Sequence
  Description of Artificial Sequence: Synthetic oligonucleotide
  Target: ATXN1; (+) strand; PAM type: YTN; PAM sequence: CTT
ggctaatttttacttatttt

SEQ ID NO: 285872 - DNA, 20 bp, Artificial Sequence
  Description of Artificial Sequence: Synthetic oligonucleotide
  Target: ATXN1; (+) strand; PAM type: YTN; PAM sequence: TTG
gctaatttttacttattttt

SEQ ID NO: 285873 - DNA, 20 bp, Artificial Sequence
  Description of Artificial Sequence: Synthetic oligonucleotide
  Target: ATXN1; (+) strand; PAM type: YTN; PAM sequence: CTA
atttttacttattttttgta

SEQ ID NO: 285874 - DNA, 20 bp, Artificial Sequence
  Description of Artificial Sequence: Synthetic oligonucleotide
  Target: ATXN1; (+) strand; PAM type: YTN; PAM sequence: TTT
ttacttattttttgtaaaga

SEQ ID NO: 285875 - DNA, 20 bp, Artificial Sequence
  Description of Artificial Sequence: Synthetic oligonucleotide
  Target: ATXN1; (+) strand; PAM type: YTN; PAM sequence: TTT
tacttattttttgtaaagac

SEQ ID NO: 285876 - DNA, 20 bp, Artificial Sequence
  Description of Artificial Sequence: Synthetic oligonucleotide
  Target: ATXN1; (+) strand; PAM type: YTN; PAM sequence: TTT
acttattttttgtaaagacg

SEQ ID NO: 285877 - DNA, 20 bp, Artificial Sequence
  Description of Artificial Sequence: Synthetic oligonucleotide
  Target: ATXN1; (+) strand; PAM type: YTN; PAM sequence: TTA
cttattttttgtaaagacga

SEQ ID NO: 285878 - DNA, 20 bp, Artificial Sequence
  Description of Artificial Sequence: Synthetic oligonucleotide
  Target: ATXN1; (+) strand; PAM type: YTN; PAM sequence: CTT
attttttgtaaagacgaggt

SEQ ID NO: 285879 - DNA, 20 bp, Artificial Sequence
  Description of Artificial Sequence: Synthetic oligonucleotide
  Target: ATXN1; (+) strand; PAM type: YTN; PAM sequence: TTA
ttttttgtaaagacgaggtc

SEQ ID NO: 285880 - DNA, 20 bp, Artificial Sequence
  Description of Artificial Sequence: Synthetic oligonucleotide
  Target: ATXN1; (+) strand; PAM type: YTN; PAM sequence: TTT
tttgtaaagacgaggtctct

SEQ ID NO: 285881 - DNA, 20 bp, Artificial Sequence
  Description of Artificial Sequence: Synthetic oligonucleotide
  Target: ATXN1; (+) strand; PAM type: YTN; PAM sequence: TTT
ttgtaaagacgaggtctcta

SEQ ID NO: 285882 - DNA, 20 bp, Artificial Sequence
  Description of Artificial Sequence: Synthetic oligonucleotide
  Target: ATXN1; (+) strand; PAM type: YTN; PAM sequence: TTT
tgtaaagacgaggtctctat

SEQ ID NO: 285883 - DNA, 20 bp, Artificial Sequence
  Description of Artificial Sequence: Synthetic oligonucleotide
  Target: ATXN1; (+) strand; PAM type: YTN; PAM sequence: TTT
gtaaagacgaggtctctatc

SEQ ID NO: 285884 - DNA, 20 bp, Artificial Sequence
  Description of Artificial Sequence: Synthetic oligonucleotide
  Target: ATXN1; (+) strand; PAM type: YTN; PAM sequence: TTG
taaagacgaggtctctatct

SEQ ID NO: 285885 - DNA, 20 bp, Artificial Sequence
  Description of Artificial Sequence: Synthetic oligonucleotide
  Target: ATXN1; (+) strand; PAM type: YTN; PAM sequence: CTC
tatcttgccaaagctgatct

SEQ ID NO: 285886 - DNA, 20 bp, Artificial Sequence
  Description of Artificial Sequence: Synthetic oligonucleotide
  Target: ATXN1; (+) strand; PAM type: YTN; PAM sequence: CTA
tcttgccaaagctgatcttg

SEQ ID NO: 285887 - DNA, 20 bp, Artificial Sequence
  Description of Artificial Sequence: Synthetic oligonucleotide
  Target: ATXN1; (+) strand; PAM type: YTN; PAM sequence: CTT
gccaaagctgatcttgaact

SEQ ID NO: 285888 - DNA, 20 bp, Artificial Sequence
  Description of Artificial Sequence: Synthetic oligonucleotide
  Target: ATXN1; (+) strand; PAM type: YTN; PAM sequence: TTG
ccaaagctgatcttgaactc

SEQ ID NO: 285889 - DNA, 20 bp, Artificial Sequence
  Description of Artificial Sequence: Synthetic oligonucleotide
  Target: ATXN1; (+) strand; PAM type: YTN; PAM sequence: CTG
atcttgaactcctggcctca

SEQ ID NO: 285890 - DNA, 20 bp, Artificial Sequence
  Description of Artificial Sequence: Synthetic oligonucleotide
  Target: ATXN1; (+) strand; PAM type: YTN; PAM sequence: CTT
gaactcctggcctcaagcaa

SEQ ID NO: 285891 - DNA, 20 bp, Artificial Sequence
  Description of Artificial Sequence: Synthetic oligonucleotide
  Target: ATXN1; (+) strand; PAM type: YTN; PAM sequence: TTG
aactcctggcctcaagcaat

SEQ ID NO: 285892 - DNA, 20 bp, Artificial Sequence
  Description of Artificial Sequence: Synthetic oligonucleotide
  Target: ATXN1; (+) strand; PAM type: YTN; PAM sequence: CTC
ctggcctcaagcaatcctct

SEQ ID NO: 285893 - DNA, 20 bp, Artificial Sequence
  Description of Artificial Sequence: Synthetic oligonucleotide
  Target: ATXN1; (+) strand; PAM type: YTN; PAM sequence: CTG
gcctcaagcaatcctctcat

SEQ ID NO: 285894 - DNA, 20 bp, Artificial Sequence
  Description of Artificial Sequence: Synthetic oligonucleotide
  Target: ATXN1; (+) strand; PAM type: YTN; PAM sequence: CTC
aagcaatcctctcatcttgg

SEQ ID NO: 285895 - DNA, 20 bp, Artificial Sequence
  Description of Artificial Sequence: Synthetic oligonucleotide
  Target: ATXN1; (+) strand; PAM type: YTN; PAM sequence: CTC
tcatcttggcctcccaaagt

SEQ ID NO: 285896 - DNA, 20 bp, Artificial Sequence
  Description of Artificial Sequence: Synthetic oligonucleotide
  Target: ATXN1; (+) strand; PAM type: YTN; PAM sequence: CTC
atcttggcctcccaaagtgc

SEQ ID NO: 285897 - DNA, 20 bp, Artificial Sequence
  Description of Artificial Sequence: Synthetic oligonucleotide
  Target: ATXN1; (+) strand; PAM type: YTN; PAM sequence: CTT
ggcctcccaaagtgctggat

SEQ ID NO: 285898 - DNA, 20 bp, Artificial Sequence
  Description of Artificial Sequence: Synthetic oligonucleotide
  Target: ATXN1; (+) strand; PAM type: YTN; PAM sequence: TTG
gcctcccaaagtgctggata

SEQ ID NO: 285899 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctggataacagg

SEQ ID NO: 285900 - DNA, 20 bp, Artificial Sequence
  Description of Artificial Sequence: Synthetic oligonucleotide
  Target: ATXN1; (+) strand; PAM type: YTN; PAM sequence: CTG
gataacaggtgtggccaccg

SEQ ID NO: 285901 - DNA, 20 bp, Artificial Sequence
  Description of Artificial Sequence: Synthetic oligonucleotide
  Target: ATXN1; (+) strand; PAM type: YTN; PAM sequence: CTC
agacctccttttctccccta

SEQ ID NO: 285902 - DNA, 20 bp, Artificial Sequence
  Description of Artificial Sequence: Synthetic oligonucleotide
  Target: ATXN1; (+) strand; PAM type: YTN; PAM sequence: CTC
cttttctcccctatccaaag

SEQ ID NO: 285903 - DNA, 20 bp, Artificial Sequence
  Description of Artificial Sequence: Synthetic oligonucleotide
  Target: ATXN1; (+) strand; PAM type: YTN; PAM sequence: CTT
ttctcccctatccaaagcct

SEQ ID NO: 285904 - DNA, 20 bp, Artificial Sequence
  Description of Artificial Sequence: Synthetic oligonucleotide
  Target: ATXN1; (+) strand; PAM type: YTN; PAM sequence: TTT
tctcccctatccaaagcctg

SEQ ID NO: 285905 - DNA, 20 bp, Artificial Sequence
  Description of Artificial Sequence: Synthetic oligonucleotide
  Target: ATXN1; (+) strand; PAM type: YTN; PAM sequence: TTT
ctcccctatccaaagcctgg

SEQ ID NO: 285906 - DNA, 20 bp, Artificial Sequence
  Description of Artificial Sequence: Synthetic oligonucleotide
  Target: ATXN1; (+) strand; PAM type: YTN; PAM sequence: TTC
tcccctatccaaagcctggt

SEQ ID NO: 285907 - DNA, 20 bp, Artificial Sequence
  Description of Artificial Sequence: Synthetic oligonucleotide
  Target: ATXN1; (+) strand; PAM type: YTN; PAM sequence: CTC
ccctatccaaagcctggtaa

SEQ ID NO: 285908 - DNA, 20 bp, Artificial Sequence
  Description of Artificial Sequence: Synthetic oligonucleotide
  Target: ATXN1; (+) strand; PAM type: YTN; PAM sequence: CTA
tccaaagcctggtaaacaaa

SEQ ID NO: 285909 - DNA, 20 bp, Artificial Sequence
  Description of Artificial Sequence: Synthetic oligonucleotide
  Target: ATXN1; (+) strand; PAM type: YTN; PAM sequence: CTG
gtaaacaaagtgagctgatt

SEQ ID NO: 285910 - DNA, 20 bp, Artificial Sequence
  Description of Artificial Sequence: Synthetic oligonucleotide
  Target: ATXN1; (+) strand; PAM type: YTN; PAM sequence: CTG
atttgcatatctaaaatcgg

SEQ ID NO: 285911 - DNA, 20 bp, Artificial Sequence
  Description of Artificial Sequence: Synthetic oligonucleotide
  Target: ATXN1; (+) strand; PAM type: YTN; PAM sequence: TTT
gcatatctaaaatcgggtgc

SEQ ID NO: 285912 - DNA, 20 bp, Artificial Sequence
  Description of Artificial Sequence: Synthetic oligonucleotide
  Target: ATXN1; (+) strand; PAM type: YTN; PAM sequence: TTG
catatctaaaatcgggtgct

SEQ ID NO: 285913 - DNA, 20 bp, Artificial Sequence
  Description of Artificial Sequence: Synthetic oligonucleotide
  Target: ATXN1; (+) strand; PAM type: YTN; PAM sequence: CTA
aaatcgggtgctggatgcct

SEQ ID NO: 285914 - DNA, 20 bp, Artificial Sequence
  Description of Artificial Sequence: Synthetic oligonucleotide
  Target: ATXN1; (+) strand; PAM type: YTN; PAM sequence: CTG
gatgcctgcaaatatgatag

SEQ ID NO: 285915 - DNA, 20 bp, Artificial Sequence
  Description of Artificial Sequence: Synthetic oligonucleotide
  Target: ATXN1; (+) strand; PAM type: YTN; PAM sequence: CTG
caaatatgatagggaaatat

SEQ ID NO: 285916 - DNA, 20 bp, Artificial Sequence
  Description of Artificial Sequence: Synthetic oligonucleotide
  Target: ATXN1; (+) strand; PAM type: YTN; PAM sequence: TTT
ggaacctcaggtgaaacccc

SEQ ID NO: 285917 - DNA, 20 bp, Artificial Sequence
  Description of Artificial Sequence: Synthetic oligonucleotide
  Target: ATXN1; (+) strand; PAM type: YTN; PAM sequence: TTG
gaacctcaggtgaaacccca

SEQ ID NO: 285918 - DNA, 20 bp, Artificial Sequence
  Description of Artificial Sequence: Synthetic oligonucleotide
  Target: ATXN1; (+) strand; PAM type: YTN; PAM sequence: CTC
aggtgaaaccccagcaaaaa

SEQ ID NO: 285919 - DNA, 20 bp, Artificial Sequence
  Description of Artificial Sequence: Synthetic oligonucleotide
  Target: ATXN1; (+) strand; PAM type: YTN; PAM sequence: TTA
aaatcatcacatttgaagga

SEQ ID NO: 285920 - DNA, 20 bp, Artificial Sequence
  Description of Artificial Sequence: Synthetic oligonucleotide
  Target: ATXN1; (+) strand; PAM type: YTN; PAM sequence: TTT
gaaggagccctttgtaatgc

SEQ ID NO: 285921 - DNA, 20 bp, Artificial Sequence
  Description of Artificial Sequence: Synthetic oligonucleotide
  Target: ATXN1; (+) strand; PAM type: YTN; PAM sequence: TTG
aaggagccctttgtaatgct

SEQ ID NO: 285922 - DNA, 20 bp, Artificial Sequence
  Description of Artificial Sequence: Synthetic oligonucleotide
  Target: ATXN1; (+) strand; PAM type: YTN; PAM sequence: CTT
tgtaatgctgatatgtaaag

SEQ ID NO: 285923 - DNA, 20 bp, Artificial Sequence
  Description of Artificial Sequence: Synthetic oligonucleotide
  Target: ATXN1; (+) strand; PAM type: YTN; PAM sequence: TTT
gtaatgctgatatgtaaaga

SEQ ID NO: 285924 - DNA, 20 bp, Artificial Sequence
  Description of Artificial Sequence: Synthetic oligonucleotide
  Target: ATXN1; (+) strand; PAM type: YTN; PAM sequence: TTG
taatgctgatatgtaaagat

SEQ ID NO: 285925 - DNA, 20 bp, Artificial Sequence
  Description of Artificial Sequence: Synthetic oligonucleotide
  Target: ATXN1; (+) strand; PAM type: YTN; PAM sequence: CTG
atatgtaaagatcccattaa

SEQ ID NO: 285926 - DNA, 20 bp, Artificial Sequence
  Description of Artificial Sequence: Synthetic oligonucleotide
  Target: ATXN1; (+) strand; PAM type: YTN; PAM sequence: TTA
aaacacagccattctccaca

SEQ ID NO: 285927 - DNA, 20 bp, Artificial Sequence
  Description of Artificial Sequence: Synthetic oligonucleotide
  Target: ATXN1; (+) strand; PAM type: YTN; PAM sequence: TTC
tccacaactacaaaaatctt

SEQ ID NO: 285928 - DNA, 20 bp, Artificial Sequence
  Description of Artificial Sequence: Synthetic oligonucleotide
  Target: ATXN1; (+) strand; PAM type: YTN; PAM sequence: CTC
cacaactacaaaaatctttg

SEQ ID NO: 285929 - DNA, 20 bp, Artificial Sequence
  Description of Artificial Sequence: Synthetic oligonucleotide
  Target: ATXN1; (+) strand; PAM type: YTN; PAM sequence: CTA
caaaaatctttgatttaaaa

SEQ ID NO: 285930 - DNA, 20 bp, Artificial Sequence
  Description of Artificial Sequence: Synthetic oligonucleotide
  Target: ATXN1; (+) strand; PAM type: YTN; PAM sequence: CTT
tgatttaaaaatgactttgg

SEQ ID NO: 285931 - DNA, 20 bp, Artificial Sequence
  Description of Artificial Sequence: Synthetic oligonucleotide
  Target: ATXN1; (+) strand; PAM type: YTN; PAM sequence: TTT
gatttaaaaatgactttgga

SEQ ID NO: 285932 - DNA, 20 bp, Artificial Sequence
  Description of Artificial Sequence: Synthetic oligonucleotide
  Target: ATXN1; (+) strand; PAM type: YTN; PAM sequence: TTG
atttaaaaatgactttggat

SEQ ID NO: 285933 - DNA, 20 bp, Artificial Sequence
  Description of Artificial Sequence: Synthetic oligonucleotide
  Target: ATXN1; (+) strand; PAM type: YTN; PAM sequence: TTT
aaaaatgactttggattcct

SEQ ID NO: 285934 - DNA, 20 bp, Artificial Sequence
  Description of Artificial Sequence: Synthetic oligonucleotide
  Target: ATXN1; (+) strand; PAM type: YTN; PAM sequence: TTA
aaaatgactttggattccta

SEQ ID NO: 285935 - DNA, 20 bp, Artificial Sequence
  Description of Artificial Sequence: Synthetic oligonucleotide
  Target: ATXN1; (+) strand; PAM type: YTN; PAM sequence: CTT
tggattcctatgtcacgtta

SEQ ID NO: 285936 - DNA, 20 bp, Artificial Sequence
  Description of Artificial Sequence: Synthetic oligonucleotide
  Target: ATXN1; (+) strand; PAM type: YTN; PAM sequence: TTT
ggattcctatgtcacgttaa

SEQ ID NO: 285937 - DNA, 20 bp, Artificial Sequence
  Description of Artificial Sequence: Synthetic oligonucleotide
  Target: ATXN1; (+) strand; PAM type: YTN; PAM sequence: TTG
gattcctatgtcacgttaaa

SEQ ID NO: 285938 - DNA, 20 bp, Artificial Sequence
  Description of Artificial Sequence: Synthetic oligonucleotide
  Target: ATXN1; (+) strand; PAM type: YTN; PAM sequence: TTC
ctatgtcacgttaaaagtgt

SEQ ID NO: 285939 - DNA, 20 bp, Artificial Sequence
  Description of Artificial Sequence: Synthetic oligonucleotide
  Target: ATXN1; (+) strand; PAM type: YTN; PAM sequence: CTA
tgtcacgttaaaagtgtgtt

SEQ ID NO: 285940 - DNA, 20 bp, Artificial Sequence
  Description of Artificial Sequence: Synthetic oligonucleotide
  Target: ATXN1; (+) strand; PAM type: YTN; PAM sequence: TTA
aaagtgtgttgggcatttta

SEQ ID NO: 285941 - DNA, 20 bp, Artificial Sequence
  Description of Artificial Sequence: Synthetic oligonucleotide
  Target: ATXN1; (+) strand; PAM type: YTN; PAM sequence: TTG
ggcattttatccagtgactt

SEQ ID NO: 285942 - DNA, 20 bp, Artificial Sequence
  Description of Artificial Sequence: Synthetic oligonucleotide
  Target: ATXN1; (+) strand; PAM type: YTN; PAM sequence: TTT
tatccagtgacttagattat

SEQ ID NO: 285943 - DNA, 20 bp, Artificial Sequence
  Description of Artificial Sequence: Synthetic oligonucleotide
  Target: ATXN1; (+) strand; PAM type: YTN; PAM sequence: TTT
atccagtgacttagattatc

SEQ ID NO: 285944 - DNA, 20 bp, Artificial Sequence
  Description of Artificial Sequence: Synthetic oligonucleotide
  Target: ATXN1; (+) strand; PAM type: YTN; PAM sequence: TTA
tccagtgacttagattatcc

SEQ ID NO: 285945 - DNA, 20 bp, Artificial Sequence
  Description of Artificial Sequence: Synthetic oligonucleotide
  Target: ATXN1; (+) strand; PAM type: YTN; PAM sequence: CTT
agattatcctttcaggagaa

SEQ ID NO: 285946 - DNA, 20 bp, Artificial Sequence
  Description of Artificial Sequence: Synthetic oligonucleotide
  Target: ATXN1; (+) strand; PAM type: YTN; PAM sequence: TTA
gattatcctttcaggagaaa

SEQ ID NO: 285947 - DNA, 20 bp, Artificial Sequence
  Description of Artificial Sequence: Synthetic oligonucleotide
  Target: ATXN1; (+) strand; PAM type: YTN; PAM sequence: TTA
tcctttcaggagaaatactg

SEQ ID NO: 285948 - DNA, 20 bp, Artificial Sequence
  Description of Artificial Sequence: Synthetic oligonucleotide
  Target: ATXN1; (+) strand; PAM type: YTN; PAM sequence: CTT
tcaggagaaatactgtactt

SEQ ID NO: 285949 - DNA, 20 bp, Artificial Sequence
  Description of Artificial Sequence: Synthetic oligonucleotide
  Target: ATXN1; (+) strand; PAM type: YTN; PAM sequence: TTT
caggagaaatactgtacttc

SEQ ID NO: 285950 - DNA, 20 bp, Artificial Sequence
  Description of Artificial Sequence: Synthetic oligonucleotide
  Target: ATXN1; (+) strand; PAM type: YTN; PAM sequence: TTC
aggagaaatactgtacttca

SEQ ID NO: 285951 - DNA, 20 bp, Artificial Sequence
  Description of Artificial Sequence: Synthetic oligonucleotide
  Target: ATXN1; (+) strand; PAM type: YTN; PAM sequence: CTG
tacttcattgtaagtcctta

SEQ ID NO: 285952 - DNA, 20 bp, Artificial Sequence
  Description of Artificial Sequence: Synthetic oligonucleotide
  Target: ATXN1; (+) strand; PAM type: YTN; PAM sequence: CTT
cattgtaagtccttaatgag

SEQ ID NO: 285953 - DNA, 20 bp, Artificial Sequence
  Description of Artificial Sequence: Synthetic oligonucleotide
  Target: ATXN1; (+) strand; PAM type: YTN; PAM sequence: TTC
attgtaagtccttaatgagg

SEQ ID NO: 285954 - DNA, 20 bp, Artificial Sequence
  Description of Artificial Sequence: Synthetic oligonucleotide
  Target: ATXN1; (+) strand; PAM type: YTN; PAM sequence: TTG
taagtccttaatgagggacc

SEQ ID NO: 285955 - DNA, 20 bp, Artificial Sequence
  Description of Artificial Sequence: Synthetic oligonucleotide
  Target: ATXN1; (+) strand; PAM type: YTN; PAM sequence: CTT
aatgagggaccaattagtcc

SEQ ID NO: 285956 - DNA, 20 bp, Artificial Sequence
  Description of Artificial Sequence: Synthetic oligonucleotide
  Target: ATXN1; (+) strand; PAM type: YTN; PAM sequence: TTA
atgagggaccaattagtcct

SEQ ID NO: 285957 - DNA, 20 bp, Artificial Sequence
  Description of Artificial Sequence: Synthetic oligonucleotide
  Target: ATXN1; (+) strand; PAM type: YTN; PAM sequence: TTA
gtccttcccctccacttcaa

SEQ ID NO: 285958 - DNA, 20 bp, Artificial Sequence
  Description of Artificial Sequence: Synthetic oligonucleotide
  Target: ATXN1; (+) strand; PAM type: YTN; PAM sequence: CTT
cccctccacttcaaattcct

SEQ ID NO: 285959 - DNA, 20 bp, Artificial Sequence
  Description of Artificial Sequence: Synthetic oligonucleotide
  Target: ATXN1; (+) strand; PAM type: YTN; PAM sequence: TTC
ccctccacttcaaattcctc

SEQ ID NO: 285960 - DNA, 20 bp, Artificial Sequence
  Description of Artificial Sequence: Synthetic oligonucleotide
  Target: ATXN1; (+) strand; PAM type: YTN; PAM sequence: CTC
cacttcaaattcctctggga

SEQ ID NO: 285961 - DNA, 20 bp, Artificial Sequence
  Description of Artificial Sequence: Synthetic oligonucleotide
  Target: ATXN1; (+) strand; PAM type: YTN; PAM sequence: CTT
caaattcctctgggaaatga

SEQ ID NO: 285962 - DNA, 20 bp, Artificial Sequence
  Description of Artificial Sequence: Synthetic oligonucleotide
  Target: ATXN1; (+) strand; PAM type: YTN; PAM sequence: TTC
aaattcctctgggaaatgag

SEQ ID NO: 285963 - DNA, 20 bp, Artificial Sequence
  Description of Artificial Sequence: Synthetic oligonucleotide
  Target: ATXN1; (+) strand; PAM type: YTN; PAM sequence: TTC
ctctgggaaatgaggtcaga

SEQ ID NO: 285964 - DNA, 20 bp, Artificial Sequence
  Description of Artificial Sequence: Synthetic oligonucleotide
  Target: ATXN1; (+) strand; PAM type: YTN; PAM sequence: CTC
tgggaaatgaggtcagaatc

SEQ ID NO: 285965 - DNA, 20 bp, Artificial Sequence
  Description of Artificial Sequence: Synthetic oligonucleotide
  Target: ATXN1; (+) strand; PAM type: YTN; PAM sequence: CTG
ggaaatgaggtcagaatcca

SEQ ID NO: 285966 - DNA, 20 bp, Artificial Sequence
  Description of Artificial Sequence: Synthetic oligonucleotide
  Target: ATXN1; (+) strand; PAM type: YTN; PAM sequence: CTT
cccacccaaagcacctcatg

SEQ ID NO: 285967 - DNA, 20 bp, Artificial Sequence
  Description of Artificial Sequence: Synthetic oligonucleotide
  Target: ATXN1; (+) strand; PAM type: YTN; PAM sequence: TTC
ccacccaaagcacctcatgg

SEQ ID NO: 285968 - DNA, 20 bp, Artificial Sequence
  Description of Artificial Sequence: Synthetic oligonucleotide
  Target: ATXN1; (+) strand; PAM type: YTN; PAM sequence: CTC
atggaggctgcatcaaatac

SEQ ID NO: 285969 - DNA, 20 bp, Artificial Sequence
  Description of Artificial Sequence: Synthetic oligonucleotide
  Target: ATXN1; (+) strand; PAM type: YTN; PAM sequence: CTG
catcaaatactacagcagca

SEQ ID NO: 285970 - DNA, 20 bp, Artificial Sequence
  Description of Artificial Sequence: Synthetic oligonucleotide
  Target: ATXN1; (+) strand; PAM type: YTN; PAM sequence: CTA
cagcagcatttgtcaaaggg

SEQ ID NO: 285971 - DNA, 20 bp, Artificial Sequence
  Description of Artificial Sequence: Synthetic oligonucleotide
  Target: ATXN1; (+) strand; PAM type: YTN; PAM sequence: TTT
gtcaaaggggagccctttcc

SEQ ID NO: 285972 - DNA, 20 bp, Artificial Sequence
  Description of Artificial Sequence: Synthetic oligonucleotide
  Target: ATXN1; (+) strand; PAM type: YTN; PAM sequence: TTG
tcaaaggggagccctttcca

SEQ ID NO: 285973 - DNA, 20 bp, Artificial Sequence
  Description of Artificial Sequence: Synthetic oligonucleotide
  Target: ATXN1; (+) strand; PAM type: YTN; PAM sequence: CTT
tccaaaggcaagatgggtag

SEQ ID NO: 285974 - DNA, 20 bp, Artificial Sequence
  Description of Artificial Sequence: Synthetic oligonucleotide
  Target: ATXN1; (+) strand; PAM type: YTN; PAM sequence: TTT
ccaaaggcaagatgggtaga

SEQ ID NO: 285975 - DNA, 20 bp, Artificial Sequence
  Description of Artificial Sequence: Synthetic oligonucleotide
  Target: ATXN1; (+) strand; PAM type: YTN; PAM sequence: TTC
caaaggcaagatgggtagaa

SEQ ID NO: 285976 - DNA, 20 bp, Artificial Sequence
  Description of Artificial Sequence: Synthetic oligonucleotide
  Target: ATXN1; (+) strand; PAM type: YTN; PAM sequence: CTT
catcaagggctatgccttcc

SEQ ID NO: 285977 - DNA, 20 bp, Artificial Sequence
  Description of Artificial Sequence: Synthetic oligonucleotide
  Target: ATXN1; (+) strand; PAM type: YTN; PAM sequence: TTC
atcaagggctatgccttcca

SEQ ID NO: 285978 - DNA, 20 bp, Artificial Sequence
  Description of Artificial Sequence: Synthetic oligonucleotide
  Target: ATXN1; (+) strand; PAM type: YTN; PAM sequence: CTA
tgccttccaccgacaggcac

SEQ ID NO: 285979 - DNA, 20 bp, Artificial Sequence
  Description of Artificial Sequence: Synthetic oligonucleotide
  Target: ATXN1; (+) strand; PAM type: YTN; PAM sequence: CTT
ccaccgacaggcacagagca

SEQ ID NO: 285980 - DNA, 20 bp, Artificial Sequence
  Description of Artificial Sequence: Synthetic oligonucleotide
  Target: ATXN1; (+) strand; PAM type: YTN; PAM sequence: TTC
caccgacaggcacagagcac

SEQ ID NO: 285981 - DNA, 20 bp, Artificial Sequence
  Description of Artificial Sequence: Synthetic oligonucleotide
  Target: ATXN1; (+) strand; PAM type: YTN; PAM sequence: CTC
agcatttactataagatctt

SEQ ID NO: 285982 - DNA, 20 bp, Artificial Sequence
  Description of Artificial Sequence: Synthetic oligonucleotide
  Target: ATXN1; (+) strand; PAM type: YTN; PAM sequence: TTT
actataagatcttgcacagg

SEQ ID NO: 285983 - DNA, 20 bp, Artificial Sequence
  Description of Artificial Sequence: Synthetic oligonucleotide
  Target: ATXN1; (+) strand; PAM type: YTN; PAM sequence: TTA
ctataagatcttgcacagga

SEQ ID NO: 285984 - DNA, 20 bp, Artificial Sequence
  Description of Artificial Sequence: Synthetic oligonucleotide
  Target: ATXN1; (+) strand; PAM type: YTN; PAM sequence: CTA
taagatcttgcacaggagct

SEQ ID NO: 285985 - DNA, 20 bp, Artificial Sequence
  Description of Artificial Sequence: Synthetic oligonucleotide
  Target: ATXN1; (+) strand; PAM type: YTN; PAM sequence: CTT
gcacaggagctgttcaaaca

SEQ ID NO: 285986 - DNA, 20 bp, Artificial Sequence
  Description of Artificial Sequence: Synthetic oligonucleotide
  Target: ATXN1; (+) strand; PAM type: YTN; PAM sequence: TTG
cacaggagctgttcaaacaa

SEQ ID NO: 285987 - DNA, 20 bp, Artificial Sequence
  Description of Artificial Sequence: Synthetic oligonucleotide
  Target: ATXN1; (+) strand; PAM type: YTN; PAM sequence: CTG
ttcaaacaagctgaagcaca

SEQ ID NO: 285988 - DNA, 20 bp, Artificial Sequence
  Description of Artificial Sequence: Synthetic oligonucleotide
  Target: ATXN1; (+) strand; PAM type: YTN; PAM sequence: TTC
aaacaagctgaagcacacac

SEQ ID NO: 285989 - DNA, 20 bp, Artificial Sequence
  Description of Artificial Sequence: Synthetic oligonucleotide
  Target: ATXN1; (+) strand; PAM type: YTN; PAM sequence: CTG
aagcacacacccacgaattt

SEQ ID NO: 285990 - DNA, 20 bp, Artificial Sequence
  Description of Artificial Sequence: Synthetic oligonucleotide
  Target: ATXN1; (+) strand; PAM type: YTN; PAM sequence: TTT
catctcagcgactctctctt

SEQ ID NO: 285991 - DNA, 20 bp, Artificial Sequence
  Description of Artificial Sequence: Synthetic oligonucleotide
  Target: ATXN1; (+) strand; PAM type: YTN; PAM sequence: TTC
atctcagcgactctctcttt

SEQ ID NO: 285992 - DNA, 20 bp, Artificial Sequence
  Description of Artificial Sequence: Synthetic oligonucleotide
  Target: ATXN1; (+) strand; PAM type: YTN; PAM sequence: CTC
agcgactctctcttttacct

SEQ ID NO: 285993 - DNA, 20 bp, Artificial Sequence
  Description of Artificial Sequence: Synthetic oligonucleotide
  Target: ATXN1; (+) strand; PAM type: YTN; PAM sequence: CTC
tctcttttacctgctgccac

SEQ ID NO: 285994 - DNA, 20 bp, Artificial Sequence
  Description of Artificial Sequence: Synthetic oligonucleotide
  Target: ATXN1; (+) strand; PAM type: YTN; PAM sequence: CTC
tcttttacctgctgccacag

SEQ ID NO: 285995 - DNA, 20 bp, Artificial Sequence
  Description of Artificial Sequence: Synthetic oligonucleotide
  Target: ATXN1; (+) strand; PAM type: YTN; PAM sequence: CTC
ttttacctgctgccacaggg

SEQ ID NO: 285996 - DNA, 20 bp, Artificial Sequence
  Description of Artificial Sequence: Synthetic oligonucleotide
  Target: ATXN1; (+) strand; PAM type: YTN; PAM sequence: CTT
ttacctgctgccacagggac

SEQ ID NO: 285997 - DNA, 20 bp, Artificial Sequence
  Description of Artificial Sequence: Synthetic oligonucleotide
  Target: ATXN1; (+) strand; PAM type: YTN; PAM sequence: TTT
tacctgctgccacagggaca

SEQ ID NO: 285998 - DNA, 20 bp, Artificial Sequence
  Description of Artificial Sequence: Synthetic oligonucleotide
  Target: ATXN1; (+) strand; PAM type: YTN; PAM sequence: TTT
acctgctgccacagggacag

SEQ ID NO: 285999 - DNA, 20 bp, Artificial Sequence
  Description of Artificial Sequence: Synthetic oligonucleotide
  Target: ATXN1; (+) strand; PAM type: YTN; PAM sequence: TTA
cctgctgccacagggacagc

SEQ ID NO: 286000 - DNA, 20 bp, Artificial Sequence
  Description of Artificial Sequence: Synthetic oligonucleotide
  Target: ATXN1; (+) strand; PAM type: YTN; PAM sequence: CTG
ctgccacagggacagccttc

SEQ ID NO: 286001 - DNA, 20 bp, Artificial Sequence
  Description of Artificial Sequence: Synthetic oligonucleotide
  Target: ATXN1; (+) strand; PAM type: YTN; PAM sequence: CTG
ccacagggacagccttcctg

SEQ ID NO: 286002 - DNA, 20 bp, Artificial Sequence
  Description of Artificial Sequence: Synthetic oligonucleotide
  Target: ATXN1; (+) strand; PAM type: YTN; PAM sequence: CTT
cctgctccctgattgggtgt

SEQ ID NO: 286003 - DNA, 20 bp, Artificial Sequence
  Description of Artificial Sequence: Synthetic oligonucleotide
  Target: ATXN1; (+) strand; PAM type: YTN; PAM sequence: TTC
ctgctccctgattgggtgtc

SEQ ID NO: 286004 - DNA, 20 bp, Artificial Sequence
  Description of Artificial Sequence: Synthetic oligonucleotide
  Target: ATXN1; (+) strand; PAM type: YTN; PAM sequence: CTG
ctccctgattgggtgtctcg

SEQ ID NO: 286005 - DNA, 20 bp, Artificial Sequence
  Description of Artificial Sequence: Synthetic oligonucleotide
  Target: ATXN1; (+) strand; PAM type: YTN; PAM sequence: CTC
cctgattgggtgtctcgctg

SEQ ID NO: 286006 - DNA, 20 bp, Artificial Sequence
  Description of Artificial Sequence: Synthetic oligonucleotide
  Target: ATXN1; (+) strand; PAM type: YTN; PAM sequence: CTG
attgggtgtctcgctggctg

SEQ ID NO: 286007 - DNA, 20 bp, Artificial Sequence
  Description of Artificial Sequence: Synthetic oligonucleotide
  Target: ATXN1; (+) strand; PAM type: YTN; PAM sequence: TTG
ggtgtctcgctggctgtgca

SEQ ID NO: 286008 - DNA, 20 bp, Artificial Sequence
  Description of Artificial Sequence: Synthetic oligonucleotide
  Target: ATXN1; (+) strand; PAM type: YTN; PAM sequence: CTC
gctggctgtgcactcacctg

SEQ ID NO: 286009 - DNA, 20 bp, Artificial Sequence
  Description of Artificial Sequence: Synthetic oligonucleotide
  Target: ATXN1; (+) strand; PAM type: YTN; PAM sequence: CTG
gctgtgcactcacctgcagg

SEQ ID NO: 286010 - DNA, 20 bp, Artificial Sequence
  Description of Artificial Sequence: Synthetic oligonucleotide
  Target: ATXN1; (+) strand; PAM type: YTN; PAM sequence: CTG
tgcactcacctgcagggcgc

SEQ ID NO: 286011 - DNA, 20 bp, Artificial Sequence
  Description of Artificial Sequence: Synthetic oligonucleotide
  Target: ATXN1; (+) strand; PAM type: YTN; PAM sequence: CTC
acctgcagggcgcagggtgt

SEQ ID NO: 286012 - DNA, 20 bp, Artificial Sequence
  Description of Artificial Sequence: Synthetic oligonucleotide
  Target: ATXN1; (+) strand; PAM type: YTN; PAM sequence: CTG
cagggcgcagggtgtcccac

SEQ ID NO: 286013 - DNA, 20 bp, Artificial Sequence
  Description of Artificial Sequence: Synthetic oligonucleotide
  Target: ATXN1; (+) strand; PAM type: YTN; PAM sequence: CTG
catccccctcctgctccatc

SEQ ID NO: 286014 - DNA, 20 bp, Artificial Sequence
  Description of Artificial Sequence: Synthetic oligonucleotide
  Target: ATXN1; (+) strand; PAM type: YTN; PAM sequence: CTC
ctgctccatctgcatcatgc

SEQ ID NO: 286015 - DNA, 20 bp, Artificial Sequence
  Description of Artificial Sequence: Synthetic oligonucleotide
  Target: ATXN1; (+) strand; PAM type: YTN; PAM sequence: CTG
ctccatctgcatcatgcact

SEQ ID NO: 286016 - DNA, 20 bp, Artificial Sequence
  Description of Artificial Sequence: Synthetic oligonucleotide
  Target: ATXN1; (+) strand; PAM type: YTN; PAM sequence: CTC
catctgcatcatgcactcag

SEQ ID NO: 286017 - DNA, 20 bp, Artificial Sequence
  Description of Artificial Sequence: Synthetic oligonucleotide
  Target: ATXN1; (+) strand; PAM type: YTN; PAM sequence: CTG
catcatgcactcagagggga

SEQ ID NO: 286018 - DNA, 20 bp, Artificial Sequence
  Description of Artificial Sequence: Synthetic oligonucleotide
  Target: ATXN1; (+) strand; PAM type: YTN; PAM sequence: CTC
agaggggagtgccactgctc

SEQ ID NO: 286019 - DNA, 20 bp, Artificial Sequence
  Description of Artificial Sequence: Synthetic oligonucleotide
  Target: ATXN1; (+) strand; PAM type: YTN; PAM sequence: CTG
ctctgggtcaccagcctgct

SEQ ID NO: 286020 - DNA, 20 bp, Artificial Sequence
  Description of Artificial Sequence: Synthetic oligonucleotide
  Target: ATXN1; (+) strand; PAM type: YTN; PAM sequence: CTC
tgggtcaccagcctgctctg

SEQ ID NO: 286021 - DNA, 20 bp, Artificial Sequence
  Description of Artificial Sequence: Synthetic oligonucleotide
  Target: ATXN1; (+) strand; PAM type: YTN; PAM sequence: CTG
ggtcaccagcctgctctggc

SEQ ID NO: 286022 - DNA, 20 bp, Artificial Sequence
  Description of Artificial Sequence: Synthetic oligonucleotide
  Target: ATXN1; (+) strand; PAM type: YTN; PAM sequence: CTG
ctctggctctgccgcagcct

SEQ ID NO: 286023 - DNA, 20 bp, Artificial Sequence
  Description of Artificial Sequence: Synthetic oligonucleotide
  Target: ATXN1; (+) strand; PAM type: YTN; PAM sequence: CTC
tggctctgccgcagcctccc

SEQ ID NO: 286024 - DNA, 20 bp, Artificial Sequence
  Description of Artificial Sequence: Synthetic oligonucleotide
  Target: ATXN1; (+) strand; PAM type: YTN; PAM sequence: CTG
gctctgccgcagcctcccag

SEQ ID NO: 286025 - DNA, 20 bp, Artificial Sequence
  Description of Artificial Sequence: Synthetic oligonucleotide
  Target: ATXN1; (+) strand; PAM type: YTN; PAM sequence: CTC
tgccgcagcctcccagggga

SEQ ID NO: 286026 - DNA, 20 bp, Artificial Sequence
  Description of Artificial Sequence: Synthetic oligonucleotide
  Target: ATXN1; (+) strand; PAM type: YTN; PAM sequence: CTG
ccgcagcctcccaggggatt

SEQ ID NO: 286027 - DNA, 20 bp, Artificial Sequence
  Description of Artificial Sequence: Synthetic oligonucleotide
  Target: ATXN1; (+) strand; PAM type: YTN; PAM sequence: CTC
ccaggggattgagctcctac

SEQ ID NO: 286028 - DNA, 20 bp, Artificial Sequence
  Description of Artificial Sequence: Synthetic oligonucleotide
  Target: ATXN1; (+) strand; PAM type: YTN; PAM sequence: TTG
agctcctactccttccacta

SEQ ID NO: 286029 - DNA, 20 bp, Artificial Sequence
  Description of Artificial Sequence: Synthetic oligonucleotide
  Target: ATXN1; (+) strand; PAM type: YTN; PAM sequence: CTC
ctactccttccactagaagc

SEQ ID NO: 286030 - DNA, 20 bp, Artificial Sequence
  Description of Artificial Sequence: Synthetic oligonucleotide
  Target: ATXN1; (+) strand; PAM type: YTN; PAM sequence: CTA
ctccttccactagaagcatg

SEQ ID NO: 286031 - DNA, 20 bp, Artificial Sequence
  Description of Artificial Sequence: Synthetic oligonucleotide
  Target: ATXN1; (+) strand; PAM type: YTN; PAM sequence: CTC
cttccactagaagcatggtg

SEQ ID NO: 286032 - DNA, 20 bp, Artificial Sequence
  Description of Artificial Sequence: Synthetic oligonucleotide
  Target: ATXN1; (+) strand; PAM type: YTN; PAM sequence: CTT
ccactagaagcatggtgagc

SEQ ID NO: 286033 - DNA, 20 bp, Artificial Sequence
  Description of Artificial Sequence: Synthetic oligonucleotide
  Target: ATXN1; (+) strand; PAM type: YTN; PAM sequence: TTC
cactagaagcatggtgagca

SEQ ID NO: 286034 - DNA, 20 bp, Artificial Sequence
  Description of Artificial Sequence: Synthetic oligonucleotide
  Target: ATXN1; (+) strand; PAM type: YTN; PAM sequence: CTA
gaagcatggtgagcaaatta

SEQ ID NO: 286035 - DNA, 20 bp, Artificial Sequence
  Description of Artificial Sequence: Synthetic oligonucleotide
  Target: ATXN1; (+) strand; PAM type: YTN; PAM sequence: TTA
gaggttataaacacctccgg

SEQ ID NO: 286036 - DNA, 20 bp, Artificial Sequence
  Description of Artificial Sequence: Synthetic oligonucleotide
  Target: ATXN1; (+) strand; PAM type: YTN; PAM sequence: TTA
taaacacctccggtggaagg

SEQ ID NO: 286037 - DNA, 20 bp, Artificial Sequence
  Description of Artificial Sequence: Synthetic oligonucleotide
  Target: ATXN1; (+) strand; PAM type: YTN; PAM sequence: CTC
cggtggaaggaggagaattc

SEQ ID NO: 286038 - DNA, 20 bp, Artificial Sequence
  Description of Artificial Sequence: Synthetic oligonucleotide
  Target: ATXN1; (+) strand; PAM type: YTN; PAM sequence: TTC
ctttgggctttgtaagggaa

SEQ ID NO: 286039 - DNA, 20 bp, Artificial Sequence
  Description of Artificial Sequence: Synthetic oligonucleotide
  Target: ATXN1; (+) strand; PAM type: YTN; PAM sequence: CTT
tgggctttgtaagggaacct

SEQ ID NO: 286040 - DNA, 20 bp, Artificial Sequence
  Description of Artificial Sequence: Synthetic oligonucleotide
  Target: ATXN1; (+) strand; PAM type: YTN; PAM sequence: TTT
gggctttgtaagggaacctc

SEQ ID NO: 286041 - DNA, 20 bp, Artificial Sequence
  Description of Artificial Sequence: Synthetic oligonucleotide
  Target: ATXN1; (+) strand; PAM type: YTN; PAM sequence: TTG
ggctttgtaagggaacctcg

SEQ ID NO: 286042 - DNA, 20 bp, Artificial Sequence
  Description of Artificial Sequence: Synthetic oligonucleotide
  Target: ATXN1; (+) strand; PAM type: YTN; PAM sequence: CTT
tgtaagggaacctcgtcagc

SEQ ID NO: 286043 - DNA, 20 bp, Artificial Sequence
  Description of Artificial Sequence: Synthetic oligonucleotide
  Target: ATXN1; (+) strand; PAM type: YTN; PAM sequence: TTT
gtaagggaacctcgtcagcc

SEQ ID NO: 286044 - DNA, 20 bp, Artificial Sequence
  Description of Artificial Sequence: Synthetic oligonucleotide
  Target: ATXN1; (+) strand; PAM type: YTN; PAM sequence: TTG
taagggaacctcgtcagccg

SEQ ID NO: 286045 - DNA, 20 bp, Artificial Sequence
  Description of Artificial Sequence: Synthetic oligonucleotide
  Target: ATXN1; (+) strand; PAM type: YTN; PAM sequence: CTC
gtcagccgcaagaatctccg

SEQ ID NO: 286046 - DNA, 20 bp, Artificial Sequence
  Description of Artificial Sequence: Synthetic oligonucleotide
  Target: ATXN1; (+) strand; PAM type: YTN; PAM sequence: CTC
cggggtataagacataggta

SEQ ID NO: 286047 - DNA, 20 bp, Artificial Sequence
  Description of Artificial Sequence: Synthetic oligonucleotide
  Target: ATXN1; (+) strand; PAM type: YTN; PAM sequence: CTC
acccttgccccttggccctg

SEQ ID NO: 286048 - DNA, 20 bp, Artificial Sequence
  Description of Artificial Sequence: Synthetic oligonucleotide
  Target: ATXN1; (+) strand; PAM type: YTN; PAM sequence: CTT
gccccttggccctgttgggc

SEQ ID NO: 286049 - DNA, 20 bp, Artificial Sequence
  Description of Artificial Sequence: Synthetic oligonucleotide
  Target: ATXN1; (+) strand; PAM type: YTN; PAM sequence: TTG
ccccttggccctgttgggca

SEQ ID NO: 286050 - DNA, 20 bp, Artificial Sequence
  Description of Artificial Sequence: Synthetic oligonucleotide
  Target: ATXN1; (+) strand; PAM type: YTN; PAM sequence: CTT
ggccctgttgggcatatgtg

SEQ ID NO: 286051 - DNA, 20 bp, Artificial Sequence
  Description of Artificial Sequence: Synthetic oligonucleotide
  Target: ATXN1; (+) strand; PAM type: YTN; PAM sequence: TTG
gccctgttgggcatatgtgg

SEQ ID NO: 286052 - DNA, 20 bp, Artificial Sequence
  Description of Artificial Sequence: Synthetic oligonucleotide
  Target: ATXN1; (+) strand; PAM type: YTN; PAM sequence: CTG
ttgggcatatgtggaccaca

SEQ ID NO: 286053 - DNA, 20 bp, Artificial Sequence
  Description of Artificial Sequence: Synthetic oligonucleotide
  Target: ATXN1; (+) strand; PAM type: YTN; PAM sequence: TTG
ggcatatgtggaccacacct

SEQ ID NO: 286054 - DNA, 20 bp, Artificial Sequence
  Description of Artificial Sequence: Synthetic oligonucleotide
  Target: ATXN1; (+) strand; PAM type: YTN; PAM sequence: CTT
tttctgcccacaattatggc

SEQ ID NO: 286055 - DNA, 20 bp, Artificial Sequence
  Description of Artificial Sequence: Synthetic oligonucleotide
  Target: ATXN1; (+) strand; PAM type: YTN; PAM sequence: TTT
ttctgcccacaattatggca

SEQ ID NO: 286056 - DNA, 20 bp, Artificial Sequence
  Description of Artificial Sequence: Synthetic oligonucleotide
  Target: ATXN1; (+) strand; PAM type: YTN; PAM sequence: TTT
tctgcccacaattatggcag

SEQ ID NO: 286057 - DNA, 20 bp, Artificial Sequence
  Description of Artificial Sequence: Synthetic oligonucleotide
  Target: ATXN1; (+) strand; PAM type: YTN; PAM sequence: TTT
ctgcccacaattatggcaga

SEQ ID NO: 286058 - DNA, 20 bp, Artificial Sequence
  Description of Artificial Sequence: Synthetic oligonucleotide
  Target: ATXN1; (+) strand; PAM type: YTN; PAM sequence: TTC
tgcccacaattatggcagaa

SEQ ID NO: 286059 - DNA, 20 bp, Artificial Sequence
  Description of Artificial Sequence: Synthetic oligonucleotide
  Target: ATXN1; (+) strand; PAM type: YTN; PAM sequence: CTG
cccacaattatggcagaaat

SEQ ID NO: 286060 - DNA, 20 bp, Artificial Sequence
  Description of Artificial Sequence: Synthetic oligonucleotide
  Target: ATXN1; (+) strand; PAM type: YTN; PAM sequence: TTA
tggcagaaatgcccatccag

SEQ ID NO: 286061 - DNA, 20 bp, Artificial Sequence
  Description of Artificial Sequence: Synthetic oligonucleotide
  Target: ATXN1; (+) strand; PAM type: YTN; PAM sequence: CTG
cttcacatgttcgaagaatg

SEQ ID NO: 286062 - DNA, 20 bp, Artificial Sequence
  Description of Artificial Sequence: Synthetic oligonucleotide
  Target: ATXN1; (+) strand; PAM type: YTN; PAM sequence: CTT
cacatgttcgaagaatgcct

SEQ ID NO: 286063 - DNA, 20 bp, Artificial Sequence
  Description of Artificial Sequence: Synthetic oligonucleotide
  Target: ATXN1; (+) strand; PAM type: YTN; PAM sequence: TTC
acatgttcgaagaatgcctc

SEQ ID NO: 286064 - DNA, 20 bp, Artificial Sequence
  Description of Artificial Sequence: Synthetic oligonucleotide
  Target: ATXN1; (+) strand; PAM type: YTN; PAM sequence: TTC
gaagaatgcctcacatggtt

SEQ ID NO: 286065 - DNA, 20 bp, Artificial Sequence
  Description of Artificial Sequence: Synthetic oligonucleotide
  Target: ATXN1; (+) strand; PAM type: YTN; PAM sequence: CTC
acatggttgagaatactgct

SEQ ID NO: 286066 - DNA, 20 bp, Artificial Sequence
  Description of Artificial Sequence: Synthetic oligonucleotide
  Target: ATXN1; (+) strand; PAM type: YTN; PAM sequence: TTG
agaatactgctggtcctcaa

SEQ ID NO: 286067 - DNA, 20 bp, Artificial Sequence
  Description of Artificial Sequence: Synthetic oligonucleotide
  Target: ATXN1; (+) strand; PAM type: YTN; PAM sequence: CTG
ctggtcctcaacaagcagca

SEQ ID NO: 286068 - DNA, 20 bp, Artificial Sequence
  Description of Artificial Sequence: Synthetic oligonucleotide
  Target: ATXN1; (+) strand; PAM type: YTN; PAM sequence: CTG
gtcctcaacaagcagcataa

SEQ ID NO: 286069 - DNA, 20 bp, Artificial Sequence
  Description of Artificial Sequence: Synthetic oligonucleotide
  Target: ATXN1; (+) strand; PAM type: YTN; PAM sequence: CTC
aacaagcagcataaatctat

SEQ ID NO: 286070 - DNA, 20 bp, Artificial Sequence
  Description of Artificial Sequence: Synthetic oligonucleotide
  Target: ATXN1; (+) strand; PAM type: YTN; PAM sequence: CTA
ttttttttttttttttgaga

SEQ ID NO: 286071 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgagacag

SEQ ID NO: 286072 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgagacaga

SEQ ID NO: 286073 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgagacagag

SEQ ID NO: 286074 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgagacagagt

SEQ ID NO: 286075 - DNA, 20 bp, Artificial Sequence
  Description of Artificial Sequence: Synthetic oligonucleotide
  Target: ATXN1; (+) strand; PAM type: YTN; PAM sequence: TTT
tttttttttgagacagagtc

SEQ ID NO: 286076 - DNA, 20 bp, Artificial Sequence
  Description of Artificial Sequence: Synthetic oligonucleotide
  Target: ATXN1; (+) strand; PAM type: YTN; PAM sequence: TTT
ttttttttgagacagagtct

SEQ ID NO: 286077 - DNA, 20 bp, Artificial Sequence
  Description of Artificial Sequence: Synthetic oligonucleotide
  Target: ATXN1; (+) strand; PAM type: YTN; PAM sequence: TTT
tttttttgagacagagtctt

SEQ ID NO: 286078 - DNA, 20 bp, Artificial Sequence
  Description of Artificial Sequence: Synthetic oligonucleotide
  Target: ATXN1; (+) strand; PAM type: YTN; PAM sequence: TTT
ttttttgagacagagtcttg

SEQ ID NO: 286079 - DNA, 20 bp, Artificial Sequence
  Description of Artificial Sequence: Synthetic oligonucleotide
  Target: ATXN1; (+) strand; PAM type: YTN; PAM sequence: TTT
tttttgagacagagtcttgc

SEQ ID NO: 286080 - DNA, 20 bp, Artificial Sequence
  Description of Artificial Sequence: Synthetic oligonucleotide
  Target: ATXN1; (+) strand; PAM type: YTN; PAM sequence: TTT
ttttgagacagagtcttgct

SEQ ID NO: 286081 - DNA, 20 bp, Artificial Sequence
  Description of Artificial Sequence: Synthetic oligonucleotide
  Target: ATXN1; (+) strand; PAM type: YTN; PAM sequence: TTT
tttgagacagagtcttgctc

SEQ ID NO: 286082 - DNA, 20 bp, Artificial Sequence
  Description of Artificial Sequence: Synthetic oligonucleotide
  Target: ATXN1; (+) strand; PAM type: YTN; PAM sequence: TTT
ttgagacagagtcttgctct

SEQ ID NO: 286083 - DNA, 20 bp, Artificial Sequence
  Description of Artificial Sequence: Synthetic oligonucleotide
  Target: ATXN1; (+) strand; PAM type: YTN; PAM sequence: TTT
tgagacagagtcttgctctg

SEQ ID NO: 286084 - DNA, 20 bp, Artificial Sequence
  Description of Artificial Sequence: Synthetic oligonucleotide
  Target: ATXN1; (+) strand; PAM type: YTN; PAM sequence: TTT
gagacagagtcttgctctgt

SEQ ID NO: 286085 - DNA, 20 bp, Artificial Sequence
  Description of Artificial Sequence: Synthetic oligonucleotide
  Target: ATXN1; (+) strand; PAM type: YTN; PAM sequence: TTG
agacagagtcttgctctgtc

SEQ ID NO: 286086 - DNA, 20 bp, Artificial Sequence
  Description of Artificial Sequence: Synthetic oligonucleotide
  Target: ATXN1; (+) strand; PAM type: YTN; PAM sequence: CTT
gctctgtcacccaggctgga

SEQ ID NO: 286087 - DNA, 20 bp, Artificial Sequence
  Description of Artificial Sequence: Synthetic oligonucleotide
  Target: ATXN1; (+) strand; PAM type: YTN; PAM sequence: TTG
ctctgtcacccaggctggag

SEQ ID NO: 286088 - DNA, 20 bp, Artificial Sequence
  Description of Artificial Sequence: Synthetic oligonucleotide
  Target: ATXN1; (+) strand; PAM type: YTN; PAM sequence: CTC
tgtcacccaggctggagtgc

SEQ ID NO: 286089 - DNA, 20 bp, Artificial Sequence
  Description of Artificial Sequence: Synthetic oligonucleotide
  Target: ATXN1; (+) strand; PAM type: YTN; PAM sequence: CTG
tcacccaggctggagtgcag

SEQ ID NO: 286090 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggcgcaatctt

SEQ ID NO: 286091 - DNA, 20 bp, Artificial Sequence
  Description of Artificial Sequence: Synthetic oligonucleotide
  Target: ATXN1; (+) strand; PAM type: YTN; PAM sequence: CTT
ggctcactgcagcctctacc

SEQ ID NO: 286092 - DNA, 20 bp, Artificial Sequence
  Description of Artificial Sequence: Synthetic oligonucleotide
  Target: ATXN1; (+) strand; PAM type: YTN; PAM sequence: TTG
gctcactgcagcctctacct

SEQ ID NO: 286093 - DNA, 20 bp, Artificial Sequence
  Description of Artificial Sequence: Synthetic oligonucleotide
  Target: ATXN1; (+) strand; PAM type: YTN; PAM sequence: CTC
actgcagcctctacctctca

SEQ ID NO: 286094 - DNA, 20 bp, Artificial Sequence
  Description of Artificial Sequence: Synthetic oligonucleotide
  Target: ATXN1; (+) strand; PAM type: YTN; PAM sequence: CTG
cagcctctacctctcagatt

SEQ ID NO: 286095 - DNA, 20 bp, Artificial Sequence
  Description of Artificial Sequence: Synthetic oligonucleotide
  Target: ATXN1; (+) strand; PAM type: YTN; PAM sequence: CTC
tacctctcagattctagcga

SEQ ID NO: 286096 - DNA, 20 bp, Artificial Sequence
  Description of Artificial Sequence: Synthetic oligonucleotide
  Target: ATXN1; (+) strand; PAM type: YTN; PAM sequence: CTA
cctctcagattctagcgatt

SEQ ID NO: 286097 - DNA, 20 bp, Artificial Sequence
  Description of Artificial Sequence: Synthetic oligonucleotide
  Target: ATXN1; (+) strand; PAM type: YTN; PAM sequence: CTC
tcagattctagcgattctcc

SEQ ID NO: 286098 - DNA, 20 bp, Artificial Sequence
  Description of Artificial Sequence: Synthetic oligonucleotide
  Target: ATXN1; (+) strand; PAM type: YTN; PAM sequence: CTC
agattctagcgattctcctg

SEQ ID NO: 286099 - DNA, 20 bp, Artificial Sequence
  Description of Artificial Sequence: Synthetic oligonucleotide
  Target: ATXN1; (+) strand; PAM type: YTN; PAM sequence: TTC
tagcgattctcctgcctctg

SEQ ID NO: 286100 - DNA, 20 bp, Artificial Sequence
  Description of Artificial Sequence: Synthetic oligonucleotide
  Target: ATXN1; (+) strand; PAM type: YTN; PAM sequence: CTA
gcgattctcctgcctctgcc

SEQ ID NO: 286101 - DNA, 20 bp, Artificial Sequence
  Description of Artificial Sequence: Synthetic oligonucleotide
  Target: ATXN1; (+) strand; PAM type: YTN; PAM sequence: TTC
tcctgcctctgcctccccag

SEQ ID NO: 286102 - DNA, 20 bp, Artificial Sequence
  Description of Artificial Sequence: Synthetic oligonucleotide
  Target: ATXN1; (+) strand; PAM type: YTN; PAM sequence: CTC
ctgcctctgcctccccagta

SEQ ID NO: 286103 - DNA, 20 bp, Artificial Sequence
  Description of Artificial Sequence: Synthetic oligonucleotide
  Target: ATXN1; (+) strand; PAM type: YTN; PAM sequence: CTG
cctctgcctccccagtagct

SEQ ID NO: 286104 - DNA, 20 bp, Artificial Sequence
  Description of Artificial Sequence: Synthetic oligonucleotide
  Target: ATXN1; (+) strand; PAM type: YTN; PAM sequence: CTC
tgcctccccagtagctgggc

SEQ ID NO: 286105 - DNA, 20 bp, Artificial Sequence
  Description of Artificial Sequence: Synthetic oligonucleotide
  Target: ATXN1; (+) strand; PAM type: YTN; PAM sequence: CTG
cctccccagtagctgggctt

SEQ ID NO: 286106 - DNA, 20 bp, Artificial Sequence
  Description of Artificial Sequence: Synthetic oligonucleotide
  Target: ATXN1; (+) strand; PAM type: YTN; PAM sequence: CTC
cccagtagctgggcttccag

SEQ ID NO: 286107 - DNA, 20 bp, Artificial Sequence
  Description of Artificial Sequence: Synthetic oligonucleotide
  Target: ATXN1; (+) strand; PAM type: YTN; PAM sequence: CTG
ggcttccaggcacatgccac

SEQ ID NO: 286108 - DNA, 20 bp, Artificial Sequence
  Description of Artificial Sequence: Synthetic oligonucleotide
  Target: ATXN1; (+) strand; PAM type: YTN; PAM sequence: CTT
ccaggcacatgccaccacac

SEQ ID NO: 286109 - DNA, 20 bp, Artificial Sequence
  Description of Artificial Sequence: Synthetic oligonucleotide
  Target: ATXN1; (+) strand; PAM type: YTN; PAM sequence: TTC
caggcacatgccaccacact

SEQ ID NO: 286110 - DNA, 20 bp, Artificial Sequence
  Description of Artificial Sequence: Synthetic oligonucleotide
  Target: ATXN1; (+) strand; PAM type: YTN; PAM sequence: CTT
ggctatttttttgtattttc

SEQ ID NO: 286111 - DNA, 20 bp, Artificial Sequence
  Description of Artificial Sequence: Synthetic oligonucleotide
  Target: ATXN1; (+) strand; PAM type: YTN; PAM sequence: TTG
gctatttttttgtattttca

SEQ ID NO: 286112 - DNA, 20 bp, Artificial Sequence
  Description of Artificial Sequence: Synthetic oligonucleotide
  Target: ATXN1; (+) strand; PAM type: YTN; PAM sequence: CTA
tttttttgtattttcagtcg

SEQ ID NO: 286113 - DNA, 20 bp, Artificial Sequence
  Description of Artificial Sequence: Synthetic oligonucleotide
  Target: ATXN1; (+) strand; PAM type: YTN; PAM sequence: TTT
ttttgtattttcagtcgaga

SEQ ID NO: 286114 - DNA, 20 bp, Artificial Sequence
  Description of Artificial Sequence: Synthetic oligonucleotide
  Target: ATXN1; (+) strand; PAM type: YTN; PAM sequence: TTT
tttgtattttcagtcgagac

SEQ ID NO: 286115 - DNA, 20 bp, Artificial Sequence
  Description of Artificial Sequence: Synthetic oligonucleotide
  Target: ATXN1; (+) strand; PAM type: YTN; PAM sequence: TTT
ttgtattttcagtcgagacg

SEQ ID NO: 286116 - DNA, 20 bp, Artificial Sequence
  Description of Artificial Sequence: Synthetic oligonucleotide
  Target: ATXN1; (+) strand; PAM type: YTN; PAM sequence: TTT
tgtattttcagtcgagacgg

SEQ ID NO: 286117 - DNA, 20 bp, Artificial Sequence
  Description of Artificial Sequence: Synthetic oligonucleotide
  Target: ATXN1; (+) strand; PAM type: YTN; PAM sequence: TTT
gtattttcagtcgagacggg

SEQ ID NO: 286118 - DNA, 20 bp, Artificial Sequence
  Description of Artificial Sequence: Synthetic oligonucleotide
  Target: ATXN1; (+) strand; PAM type: YTN; PAM sequence: TTG
tattttcagtcgagacgggg

SEQ ID NO: 286119 - DNA, 20 bp, Artificial Sequence
  Description of Artificial Sequence: Synthetic oligonucleotide
  Target: ATXN1; (+) strand; PAM type: YTN; PAM sequence: TTT
tcagtcgagacggggtttca

SEQ ID NO: 286120 - DNA, 20 bp, Artificial Sequence
  Description of Artificial Sequence: Synthetic oligonucleotide
  Target: ATXN1; (+) strand; PAM type: YTN; PAM sequence: TTT
cagtcgagacggggtttcac

SEQ ID NO: 286121 - DNA, 20 bp, Artificial Sequence
  Description of Artificial Sequence: Synthetic oligonucleotide
  Target: ATXN1; (+) strand; PAM type: YTN; PAM sequence: TTC
agtcgagacggggtttcacc

SEQ ID NO: 286122 - DNA, 20 bp, Artificial Sequence
  Description of Artificial Sequence: Synthetic oligonucleotide
  Target: ATXN1; (+) strand; PAM type: YTN; PAM sequence: TTT
caccatgttggttaggctga

SEQ ID NO: 286123 - DNA, 20 bp, Artificial Sequence
  Description of Artificial Sequence: Synthetic oligonucleotide
  Target: ATXN1; (+) strand; PAM type: YTN; PAM sequence: TTC
accatgttggttaggctgat

SEQ ID NO: 286124 - DNA, 20 bp, Artificial Sequence
  Description of Artificial Sequence: Synthetic oligonucleotide
  Target: ATXN1; (+) strand; PAM type: YTN; PAM sequence: TTG
gttaggctgatctcaaactc

SEQ ID NO: 286125 - DNA, 20 bp, Artificial Sequence
  Description of Artificial Sequence: Synthetic oligonucleotide
  Target: ATXN1; (+) strand; PAM type: YTN; PAM sequence: TTA
ggctgatctcaaactcccga

SEQ ID NO: 286126 - DNA, 20 bp, Artificial Sequence
  Description of Artificial Sequence: Synthetic oligonucleotide
  Target: ATXN1; (+) strand; PAM type: YTN; PAM sequence: CTG
atctcaaactcccgacctca

SEQ ID NO: 286127 - DNA, 20 bp, Artificial Sequence
  Description of Artificial Sequence: Synthetic oligonucleotide
  Target: ATXN1; (+) strand; PAM type: YTN; PAM sequence: CTC
aaactcccgacctcaggtga

SEQ ID NO: 286128 - DNA, 20 bp, Artificial Sequence
  Description of Artificial Sequence: Synthetic oligonucleotide
  Target: ATXN1; (+) strand; PAM type: YTN; PAM sequence: CTC
ccgacctcaggtgatccacc

SEQ ID NO: 286129 - DNA, 20 bp, Artificial Sequence
  Description of Artificial Sequence: Synthetic oligonucleotide
  Target: ATXN1; (+) strand; PAM type: YTN; PAM sequence: CTC
aggtgatccacccgcctcgg

SEQ ID NO: 286130 - DNA, 20 bp, Artificial Sequence
  Description of Artificial Sequence: Synthetic oligonucleotide
  Target: ATXN1; (+) strand; PAM type: YTN; PAM sequence: CTC
ggcctcccaaggtgctggga

SEQ ID NO: 286131 - DNA, 20 bp, Artificial Sequence
  Description of Artificial Sequence: Synthetic oligonucleotide
  Target: ATXN1; (+) strand; PAM type: YTN; PAM sequence: CTC
ccaaggtgctgggatttgca

SEQ ID NO: 286132 - DNA, 20 bp, Artificial Sequence
  Description of Artificial Sequence: Synthetic oligonucleotide
  Target: ATXN1; (+) strand; PAM type: YTN; PAM sequence: CTG
ggatttgcaggcgtgagcca

SEQ ID NO: 286133 - DNA, 20 bp, Artificial Sequence
  Description of Artificial Sequence: Synthetic oligonucleotide
  Target: ATXN1; (+) strand; PAM type: YTN; PAM sequence: TTT
gcaggcgtgagccaccatgc

SEQ ID NO: 286134 - DNA, 20 bp, Artificial Sequence
  Description of Artificial Sequence: Synthetic oligonucleotide
  Target: ATXN1; (+) strand; PAM type: YTN; PAM sequence: TTG
caggcgtgagccaccatgcc

SEQ ID NO: 286135 - DNA, 20 bp, Artificial Sequence
  Description of Artificial Sequence: Synthetic oligonucleotide
  Target: ATXN1; (+) strand; PAM type: YTN; PAM sequence: CTG
gcctaaaactattcttgatg

SEQ ID NO: 286136 - DNA, 20 bp, Artificial Sequence
  Description of Artificial Sequence: Synthetic oligonucleotide
  Target: ATXN1; (+) strand; PAM type: YTN; PAM sequence: CTA
aaactattcttgatgtaagg

SEQ ID NO: 286137 - DNA, 20 bp, Artificial Sequence
  Description of Artificial Sequence: Synthetic oligonucleotide
  Target: ATXN1; (+) strand; PAM type: YTN; PAM sequence: CTA
ttcttgatgtaaggagaaac

SEQ ID NO: 286138 - DNA, 20 bp, Artificial Sequence
  Description of Artificial Sequence: Synthetic oligonucleotide
  Target: ATXN1; (+) strand; PAM type: YTN; PAM sequence: TTC
ttgatgtaaggagaaacata

SEQ ID NO: 286139 - DNA, 20 bp, Artificial Sequence
  Description of Artificial Sequence: Synthetic oligonucleotide
  Target: ATXN1; (+) strand; PAM type: YTN; PAM sequence: CTT
gatgtaaggagaaacatatt

SEQ ID NO: 286140 - DNA, 20 bp, Artificial Sequence
  Description of Artificial Sequence: Synthetic oligonucleotide
  Target: ATXN1; (+) strand; PAM type: YTN; PAM sequence: TTG
atgtaaggagaaacatattc

SEQ ID NO: 286141 - DNA, 20 bp, Artificial Sequence
  Description of Artificial Sequence: Synthetic oligonucleotide
  Target: ATXN1; (+) strand; PAM type: YTN; PAM sequence: TTC
ctaaatgctaaaggcagtgc

SEQ ID NO: 286142 - DNA, 20 bp, Artificial Sequence
  Description of Artificial Sequence: Synthetic oligonucleotide
  Target: ATXN1; (+) strand; PAM type: YTN; PAM sequence: CTA
aatgctaaaggcagtgctgc

SEQ ID NO: 286143 - DNA, 20 bp, Artificial Sequence
  Description of Artificial Sequence: Synthetic oligonucleotide
  Target: ATXN1; (+) strand; PAM type: YTN; PAM sequence: CTA
aaggcagtgctgccaaatcc

SEQ ID NO: 286144 - DNA, 20 bp, Artificial Sequence
  Description of Artificial Sequence: Synthetic oligonucleotide
  Target: ATXN1; (+) strand; PAM type: YTN; PAM sequence: CTG
ccaaatccatggctcccagc

SEQ ID NO: 286145 - DNA, 20 bp, Artificial Sequence
  Description of Artificial Sequence: Synthetic oligonucleotide
  Target: ATXN1; (+) strand; PAM type: YTN; PAM sequence: CTC
ccagcataggctaaagtttt

SEQ ID NO: 286146 - DNA, 20 bp, Artificial Sequence
  Description of Artificial Sequence: Synthetic oligonucleotide
  Target: ATXN1; (+) strand; PAM type: YTN; PAM sequence: CTA
aagttttattaggagaccag

SEQ ID NO: 286147 - DNA, 20 bp, Artificial Sequence
  Description of Artificial Sequence: Synthetic oligonucleotide
  Target: ATXN1; (+) strand; PAM type: YTN; PAM sequence: TTT
tattaggagaccaggagtgc

SEQ ID NO: 286148 - DNA, 20 bp, Artificial Sequence
  Description of Artificial Sequence: Synthetic oligonucleotide
  Target: ATXN1; (+) strand; PAM type: YTN; PAM sequence: TTT
attaggagaccaggagtgca

SEQ ID NO: 286149 - DNA, 20 bp, Artificial Sequence
  Description of Artificial Sequence: Synthetic oligonucleotide
  Target: ATXN1; (+) strand; PAM type: YTN; PAM sequence: TTA
ttaggagaccaggagtgcac

SEQ ID NO: 286150 - DNA, 20 bp, Artificial Sequence
  Description of Artificial Sequence: Synthetic oligonucleotide
  Target: ATXN1; (+) strand; PAM type: YTN; PAM sequence: TTA
ggagaccaggagtgcacaca

SEQ ID NO: 286151 - DNA, 20 bp, Artificial Sequence
  Description of Artificial Sequence: Synthetic oligonucleotide
  Target: ATXN1; (+) strand; PAM type: YTN; PAM sequence: CTC
tggccagggacagcaaagaa

SEQ ID NO: 286152 - DNA, 20 bp, Artificial Sequence
  Description of Artificial Sequence: Synthetic oligonucleotide
  Target: ATXN1; (+) strand; PAM type: YTN; PAM sequence: CTG
gccagggacagcaaagaaag

SEQ ID NO: 286153 - DNA, 20 bp, Artificial Sequence
  Description of Artificial Sequence: Synthetic oligonucleotide
  Target: ATXN1; (+) strand; PAM type: YTN; PAM sequence: CTG
agtcctacaacactgctgga

SEQ ID NO: 286154 - DNA, 20 bp, Artificial Sequence
  Description of Artificial Sequence: Synthetic oligonucleotide
  Target: ATXN1; (+) strand; PAM type: YTN; PAM sequence: CTA
caacactgctggaaggagaa

SEQ ID NO: 286155 - DNA, 20 bp, Artificial Sequence
  Description of Artificial Sequence: Synthetic oligonucleotide
  Target: ATXN1; (+) strand; PAM type: YTN; PAM sequence: CTG
ctggaaggagaagccaacag

SEQ ID NO: 286156 - DNA, 20 bp, Artificial Sequence
  Description of Artificial Sequence: Synthetic oligonucleotide
  Target: ATXN1; (+) strand; PAM type: YTN; PAM sequence: CTG
gaaggagaagccaacagtct

SEQ ID NO: 286157 - DNA, 20 bp, Artificial Sequence
  Description of Artificial Sequence: Synthetic oligonucleotide
  Target: ATXN1; (+) strand; PAM type: YTN; PAM sequence: CTA
ggatttaaaaaaaaaaagaa

SEQ ID NO: 286158 - DNA, 20 bp, Artificial Sequence
  Description of Artificial Sequence: Synthetic oligonucleotide
  Target: ATXN1; (+) strand; PAM type: YTN; PAM sequence: TTT
aaaaaaaaaaagaagctgag

SEQ ID NO: 286159 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaaaagaagctgagt

SEQ ID NO: 286160 - DNA, 20 bp, Artificial Sequence
  Description of Artificial Sequence: Synthetic oligonucleotide
  Target: ATXN1; (+) strand; PAM type: YTN; PAM sequence: CTG
agtctgccattaagaatgaa

SEQ ID NO: 286161 - DNA, 20 bp, Artificial Sequence
  Description of Artificial Sequence: Synthetic oligonucleotide
  Target: ATXN1; (+) strand; PAM type: YTN; PAM sequence: CTG
ccattaagaatgaagtaaat

SEQ ID NO: 286162 - DNA, 20 bp, Artificial Sequence
  Description of Artificial Sequence: Synthetic oligonucleotide
  Target: ATXN1; (+) strand; PAM type: YTN; PAM sequence: TTA
agaatgaagtaaattgctaa

SEQ ID NO: 286163 - DNA, 20 bp, Artificial Sequence
  Description of Artificial Sequence: Synthetic oligonucleotide
  Target: ATXN1; (+) strand; PAM type: YTN; PAM sequence: TTG
ctaacacagatttttaatgt

SEQ ID NO: 286164 - DNA, 20 bp, Artificial Sequence
  Description of Artificial Sequence: Synthetic oligonucleotide
  Target: ATXN1; (+) strand; PAM type: YTN; PAM sequence: CTA
acacagatttttaatgttct

SEQ ID NO: 286165 - DNA, 20 bp, Artificial Sequence
  Description of Artificial Sequence: Synthetic oligonucleotide
  Target: ATXN1; (+) strand; PAM type: YTN; PAM sequence: TTT
ttaatgttcttacacacaca

SEQ ID NO: 286166 - DNA, 20 bp, Artificial Sequence
  Description of Artificial Sequence: Synthetic oligonucleotide
  Target: ATXN1; (+) strand; PAM type: YTN; PAM sequence: TTT
taatgttcttacacacacac

SEQ ID NO: 286167 - DNA, 20 bp, Artificial Sequence
  Description of Artificial Sequence: Synthetic oligonucleotide
  Target: ATXN1; (+) strand; PAM type: YTN; PAM sequence: TTT
aatgttcttacacacacaca

SEQ ID NO: 286168 - DNA, 20 bp, Artificial Sequence
  Description of Artificial Sequence: Synthetic oligonucleotide
  Target: ATXN1; (+) strand; PAM type: YTN; PAM sequence: TTA
atgttcttacacacacacaa

SEQ ID NO: 286169 - DNA, 20 bp, Artificial Sequence
  Description of Artificial Sequence: Synthetic oligonucleotide
  Target: ATXN1; (+) strand; PAM type: YTN; PAM sequence: TTC
ttacacacacacaaaatgat

SEQ ID NO: 286170 - DNA, 20 bp, Artificial Sequence
  Description of Artificial Sequence: Synthetic oligonucleotide
  Target: ATXN1; (+) strand; PAM type: YTN; PAM sequence: CTT
acacacacacaaaatgataa

SEQ ID NO: 286171 - DNA, 20 bp, Artificial Sequence
  Description of Artificial Sequence: Synthetic oligonucleotide
  Target: ATXN1; (+) strand; PAM type: YTN; PAM sequence: TTA
cacacacacaaaatgataaa

SEQ ID NO: 286172 - DNA, 20 bp, Artificial Sequence
  Description of Artificial Sequence: Synthetic oligonucleotide
  Target: ATXN1; (+) strand; PAM type: YTN; PAM sequence: CTG
gtgaggtgatgaatatatta

SEQ ID NO: 286173 - DNA, 20 bp, Artificial Sequence
  Description of Artificial Sequence: Synthetic oligonucleotide
  Target: ATXN1; (+) strand; PAM type: YTN; PAM sequence: TTA
actagcttgattgaatcttg

SEQ ID NO: 286174 - DNA, 20 bp, Artificial Sequence
  Description of Artificial Sequence: Synthetic oligonucleotide
  Target: ATXN1; (+) strand; PAM type: YTN; PAM sequence: CTA
gcttgattgaatcttgttat

SEQ ID NO: 286175 - DNA, 20 bp, Artificial Sequence
  Description of Artificial Sequence: Synthetic oligonucleotide
  Target: ATXN1; (+) strand; PAM type: YTN; PAM sequence: CTT
gattgaatcttgttataatg

SEQ ID NO: 286176 - DNA, 20 bp, Artificial Sequence
  Description of Artificial Sequence: Synthetic oligonucleotide
  Target: ATXN1; (+) strand; PAM type: YTN; PAM sequence: TTG
attgaatcttgttataatgt

SEQ ID NO: 286177 - DNA, 20 bp, Artificial Sequence
  Description of Artificial Sequence: Synthetic oligonucleotide
  Target: ATXN1; (+) strand; PAM type: YTN; PAM sequence: TTG
aatcttgttataatgtatgc

SEQ ID NO: 286178 - DNA, 20 bp, Artificial Sequence
  Description of Artificial Sequence: Synthetic oligonucleotide
  Target: ATXN1; (+) strand; PAM type: YTN; PAM sequence: CTT
gttataatgtatgcattata

SEQ ID NO: 286179 - DNA, 20 bp, Artificial Sequence
  Description of Artificial Sequence: Synthetic oligonucleotide
  Target: ATXN1; (+) strand; PAM type: YTN; PAM sequence: TTG
ttataatgtatgcattataa

SEQ ID NO: 286180 - DNA, 20 bp, Artificial Sequence
  Description of Artificial Sequence: Synthetic oligonucleotide
  Target: ATXN1; (+) strand; PAM type: YTN; PAM sequence: TTA
taatgtatgcattataaaaa

SEQ ID NO: 286181 - DNA, 20 bp, Artificial Sequence
  Description of Artificial Sequence: Synthetic oligonucleotide
  Target: ATXN1; (+) strand; PAM type: YTN; PAM sequence: TTA
taaaaacatcacactgtacc

SEQ ID NO: 286182 - DNA, 20 bp, Artificial Sequence
  Description of Artificial Sequence: Synthetic oligonucleotide
  Target: ATXN1; (+) strand; PAM type: YTN; PAM sequence: CTG
taccccataaatatacataa

SEQ ID NO: 286183 - DNA, 20 bp, Artificial Sequence
  Description of Artificial Sequence: Synthetic oligonucleotide
  Target: ATXN1; (+) strand; PAM type: YTN; PAM sequence: TTA
ttgcctataaatataaaaag

SEQ ID NO: 286184 - DNA, 20 bp, Artificial Sequence
  Description of Artificial Sequence: Synthetic oligonucleotide
  Target: ATXN1; (+) strand; PAM type: YTN; PAM sequence: TTG
cctataaatataaaaagtta

SEQ ID NO: 286185 - DNA, 20 bp, Artificial Sequence
  Description of Artificial Sequence: Synthetic oligonucleotide
  Target: ATXN1; (+) strand; PAM type: YTN; PAM sequence: CTA
taaatataaaaagttaaaac

SEQ ID NO: 286186 - DNA, 20 bp, Artificial Sequence
  Description of Artificial Sequence: Synthetic oligonucleotide
  Target: ATXN1; (+) strand; PAM type: YTN; PAM sequence: TTA
aaacaaaaaattaaagaaat

SEQ ID NO: 286187 - DNA, 20 bp, Artificial Sequence
  Description of Artificial Sequence: Synthetic oligonucleotide
  Target: ATXN1; (+) strand; PAM type: YTN; PAM sequence: TTA
aagaaataaatggtgaagac

SEQ ID NO: 286188 - DNA, 20 bp, Artificial Sequence
  Description of Artificial Sequence: Synthetic oligonucleotide
  Target: ATXN1; (+) strand; PAM type: YTN; PAM sequence: TTT
tttaaaaaatgaatgatgct

SEQ ID NO: 286189 - DNA, 20 bp, Artificial Sequence
  Description of Artificial Sequence: Synthetic oligonucleotide
  Target: ATXN1; (+) strand; PAM type: YTN; PAM sequence: TTT
ttaaaaaatgaatgatgctt

SEQ ID NO: 286190 - DNA, 20 bp, Artificial Sequence
  Description of Artificial Sequence: Synthetic oligonucleotide
  Target: ATXN1; (+) strand; PAM type: YTN; PAM sequence: TTT
taaaaaatgaatgatgcttt

SEQ ID NO: 286191 - DNA, 20 bp, Artificial Sequence
  Description of Artificial Sequence: Synthetic oligonucleotide
  Target: ATXN1; (+) strand; PAM type: YTN; PAM sequence: TTT
aaaaaatgaatgatgctttc

SEQ ID NO: 286192 - DNA, 20 bp, Artificial Sequence
  Description of Artificial Sequence: Synthetic oligonucleotide
  Target: ATXN1; (+) strand; PAM type: YTN; PAM sequence: TTA
aaaaatgaatgatgctttca

SEQ ID NO: 286193 - DNA, 20 bp, Artificial Sequence
  Description of Artificial Sequence: Synthetic oligonucleotide
  Target: ATXN1; (+) strand; PAM type: YTN; PAM sequence: CTT
tcatgcatgctacatagctt

SEQ ID NO: 286194 - DNA, 20 bp, Artificial Sequence
  Description of Artificial Sequence: Synthetic oligonucleotide
  Target: ATXN1; (+) strand; PAM type: YTN; PAM sequence: TTT
catgcatgctacatagcttg

SEQ ID NO: 286195 - DNA, 20 bp, Artificial Sequence
  Description of Artificial Sequence: Synthetic oligonucleotide
  Target: ATXN1; (+) strand; PAM type: YTN; PAM sequence: TTC
atgcatgctacatagcttgt

SEQ ID NO: 286196 - DNA, 20 bp, Artificial Sequence
  Description of Artificial Sequence: Synthetic oligonucleotide
  Target: ATXN1; (+) strand; PAM type: YTN; PAM sequence: CTA
catagcttgtcacaacctgc

SEQ ID NO: 286197 - DNA, 20 bp, Artificial Sequence
  Description of Artificial Sequence: Synthetic oligonucleotide
  Target: ATXN1; (+) strand; PAM type: YTN; PAM sequence: CTT
gtcacaacctgccggaacgg

SEQ ID NO: 286198 - DNA, 20 bp, Artificial Sequence
  Description of Artificial Sequence: Synthetic oligonucleotide
  Target: ATXN1; (+) strand; PAM type: YTN; PAM sequence: TTG
tcacaacctgccggaacggg

SEQ ID NO: 286199 - DNA, 20 bp, Artificial Sequence
  Description of Artificial Sequence: Synthetic oligonucleotide
  Target: ATXN1; (+) strand; PAM type: YTN; PAM sequence: CTG
ccggaacgggttgccaatgt

SEQ ID NO: 286200 - DNA, 20 bp, Artificial Sequence
  Description of Artificial Sequence: Synthetic oligonucleotide
  Target: ATXN1; (+) strand; PAM type: YTN; PAM sequence: TTG
ccaatgtgacatgcttttaa

SEQ ID NO: 286201 - DNA, 20 bp, Artificial Sequence
  Description of Artificial Sequence: Synthetic oligonucleotide
  Target: ATXN1; (+) strand; PAM type: YTN; PAM sequence: CTT
ttaagatcacagccctccag

SEQ ID NO: 286202 - DNA, 20 bp, Artificial Sequence
  Description of Artificial Sequence: Synthetic oligonucleotide
  Target: ATXN1; (+) strand; PAM type: YTN; PAM sequence: TTT
taagatcacagccctccagc

SEQ ID NO: 286203 - DNA, 20 bp, Artificial Sequence
  Description of Artificial Sequence: Synthetic oligonucleotide
  Target: ATXN1; (+) strand; PAM type: YTN; PAM sequence: TTT
aagatcacagccctccagca

SEQ ID NO: 286204 - DNA, 20 bp, Artificial Sequence
  Description of Artificial Sequence: Synthetic oligonucleotide
  Target: ATXN1; (+) strand; PAM type: YTN; PAM sequence: TTA
agatcacagccctccagcaa

SEQ ID NO: 286205 - DNA, 20 bp, Artificial Sequence
  Description of Artificial Sequence: Synthetic oligonucleotide
  Target: ATXN1; (+) strand; PAM type: YTN; PAM sequence: CTC
cagcaacacattgatacctg

SEQ ID NO: 286206 - DNA, 20 bp, Artificial Sequence
  Description of Artificial Sequence: Synthetic oligonucleotide
  Target: ATXN1; (+) strand; PAM type: YTN; PAM sequence: TTG
atacctgaaactccataatt

SEQ ID NO: 286207 - DNA, 20 bp, Artificial Sequence
  Description of Artificial Sequence: Synthetic oligonucleotide
  Target: ATXN1; (+) strand; PAM type: YTN; PAM sequence: CTG
aaactccataattaagagtt

SEQ ID NO: 286208 - DNA, 20 bp, Artificial Sequence
  Description of Artificial Sequence: Synthetic oligonucleotide
  Target: ATXN1; (+) strand; PAM type: YTN; PAM sequence: CTC
cataattaagagttatttcc

SEQ ID NO: 286209 - DNA, 20 bp, Artificial Sequence
  Description of Artificial Sequence: Synthetic oligonucleotide
  Target: ATXN1; (+) strand; PAM type: YTN; PAM sequence: TTA
agagttatttccttttgttt

SEQ ID NO: 286210 - DNA, 20 bp, Artificial Sequence
  Description of Artificial Sequence: Synthetic oligonucleotide
  Target: ATXN1; (+) strand; PAM type: YTN; PAM sequence: TTA
tttccttttgtttaaagatg

SEQ ID NO: 286211 - DNA, 20 bp, Artificial Sequence
  Description of Artificial Sequence: Synthetic oligonucleotide
  Target: ATXN1; (+) strand; PAM type: YTN; PAM sequence: TTT
ccttttgtttaaagatgttt

SEQ ID NO: 286212 - DNA, 20 bp, Artificial Sequence
  Description of Artificial Sequence: Synthetic oligonucleotide
  Target: ATXN1; (+) strand; PAM type: YTN; PAM sequence: TTC
cttttgtttaaagatgtttt

SEQ ID NO: 286213 - DNA, 20 bp, Artificial Sequence
  Description of Artificial Sequence: Synthetic oligonucleotide
  Target: ATXN1; (+) strand; PAM type: YTN; PAM sequence: CTT
ttgtttaaagatgttttctc

SEQ ID NO: 286214 - DNA, 20 bp, Artificial Sequence
  Description of Artificial Sequence: Synthetic oligonucleotide
  Target: ATXN1; (+) strand; PAM type: YTN; PAM sequence: TTT
tgtttaaagatgttttctct

SEQ ID NO: 286215 - DNA, 20 bp, Artificial Sequence
  Description of Artificial Sequence: Synthetic oligonucleotide
  Target: ATXN1; (+) strand; PAM type: YTN; PAM sequence: TTT
gtttaaagatgttttctctt

SEQ ID NO: 286216 - DNA, 20 bp, Artificial Sequence
  Description of Artificial Sequence: Synthetic oligonucleotide
  Target: ATXN1; (+) strand; PAM type: YTN; PAM sequence: TTG
tttaaagatgttttctcttt

SEQ ID NO: 286217 - DNA, 20 bp, Artificial Sequence
  Description of Artificial Sequence: Synthetic oligonucleotide
  Target: ATXN1; (+) strand; PAM type: YTN; PAM sequence: TTT
aaagatgttttctcttttga

SEQ ID NO: 286218 - DNA, 20 bp, Artificial Sequence
  Description of Artificial Sequence: Synthetic oligonucleotide
  Target: ATXN1; (+) strand; PAM type: YTN; PAM sequence: TTA
aagatgttttctcttttgaa

SEQ ID NO: 286219 - DNA, 20 bp, Artificial Sequence
  Description of Artificial Sequence: Synthetic oligonucleotide
  Target: ATXN1; (+) strand; PAM type: YTN; PAM sequence: TTT
tctcttttgaaatttcagta

SEQ ID NO: 286220 - DNA, 20 bp, Artificial Sequence
  Description of Artificial Sequence: Synthetic oligonucleotide
  Target: ATXN1; (+) strand; PAM type: YTN; PAM sequence: TTT
ctcttttgaaatttcagtat

SEQ ID NO: 286221 - DNA, 20 bp, Artificial Sequence
  Description of Artificial Sequence: Synthetic oligonucleotide
  Target: ATXN1; (+) strand; PAM type: YTN; PAM sequence: TTC
tcttttgaaatttcagtata

SEQ ID NO: 286222 - DNA, 20 bp, Artificial Sequence
  Description of Artificial Sequence: Synthetic oligonucleotide
  Target: ATXN1; (+) strand; PAM type: YTN; PAM sequence: CTC
ttttgaaatttcagtataat

SEQ ID NO: 286223 - DNA, 20 bp, Artificial Sequence
  Description of Artificial Sequence: Synthetic oligonucleotide
  Target: ATXN1; (+) strand; PAM type: YTN; PAM sequence: CTT
ttgaaatttcagtataatat

SEQ ID NO: 286224 - DNA, 20 bp, Artificial Sequence
  Description of Artificial Sequence: Synthetic oligonucleotide
  Target: ATXN1; (+) strand; PAM type: YTN; PAM sequence: TTT
tgaaatttcagtataatatg

SEQ ID NO: 286225 - DNA, 20 bp, Artificial Sequence
  Description of Artificial Sequence: Synthetic oligonucleotide
  Target: ATXN1; (+) strand; PAM type: YTN; PAM sequence: TTT
gaaatttcagtataatatgc

SEQ ID NO: 286226 - DNA, 20 bp, Artificial Sequence
  Description of Artificial Sequence: Synthetic oligonucleotide
  Target: ATXN1; (+) strand; PAM type: YTN; PAM sequence: TTG
aaatttcagtataatatgct

SEQ ID NO: 286227 - DNA, 20 bp, Artificial Sequence
  Description of Artificial Sequence: Synthetic oligonucleotide
  Target: ATXN1; (+) strand; PAM type: YTN; PAM sequence: TTT
cagtataatatgctactttg

SEQ ID NO: 286228 - DNA, 20 bp, Artificial Sequence
  Description of Artificial Sequence: Synthetic oligonucleotide
  Target: ATXN1; (+) strand; PAM type: YTN; PAM sequence: TTC
agtataatatgctactttgg

SEQ ID NO: 286229 - DNA, 20 bp, Artificial Sequence
  Description of Artificial Sequence: Synthetic oligonucleotide
  Target: ATXN1; (+) strand; PAM type: YTN; PAM sequence: CTA
ctttggaagtggtatatcca

SEQ ID NO: 286230 - DNA, 20 bp, Artificial Sequence
  Description of Artificial Sequence: Synthetic oligonucleotide
  Target: ATXN1; (+) strand; PAM type: YTN; PAM sequence: CTT
tggaagtggtatatccagat

SEQ ID NO: 286231 - DNA, 20 bp, Artificial Sequence
  Description of Artificial Sequence: Synthetic oligonucleotide
  Target: ATXN1; (+) strand; PAM type: YTN; PAM sequence: TTT
ggaagtggtatatccagatc

SEQ ID NO: 286232 - DNA, 20 bp, Artificial Sequence
  Description of Artificial Sequence: Synthetic oligonucleotide
  Target: ATXN1; (+) strand; PAM type: YTN; PAM sequence: TTG
gaagtggtatatccagatct

SEQ ID NO: 286233 - DNA, 20 bp, Artificial Sequence
  Description of Artificial Sequence: Synthetic oligonucleotide
  Target: ATXN1; (+) strand; PAM type: YTN; PAM sequence: CTC
caaaatatatgcatatgcat

SEQ ID NO: 286234 - DNA, 20 bp, Artificial Sequence
  Description of Artificial Sequence: Synthetic oligonucleotide
  Target: ATXN1; (+) strand; PAM type: YTN; PAM sequence: TTT
taaaatcaaagccgagtatt

SEQ ID NO: 286235 - DNA, 20 bp, Artificial Sequence
  Description of Artificial Sequence: Synthetic oligonucleotide
  Target: ATXN1; (+) strand; PAM type: YTN; PAM sequence: TTT
aaaatcaaagccgagtattg

SEQ ID NO: 286236 - DNA, 20 bp, Artificial Sequence
  Description of Artificial Sequence: Synthetic oligonucleotide
  Target: ATXN1; (+) strand; PAM type: YTN; PAM sequence: TTA
aaatcaaagccgagtattga

SEQ ID NO: 286237 - DNA, 20 bp, Artificial Sequence
  Description of Artificial Sequence: Synthetic oligonucleotide
  Target: ATXN1; (+) strand; PAM type: YTN; PAM sequence: TTG
atcctaactttaccactttc

SEQ ID NO: 286238 - DNA, 20 bp, Artificial Sequence
  Description of Artificial Sequence: Synthetic oligonucleotide
  Target: ATXN1; (+) strand; PAM type: YTN; PAM sequence: CTA
actttaccactttccagctc

SEQ ID NO: 286239 - DNA, 20 bp, Artificial Sequence
  Description of Artificial Sequence: Synthetic oligonucleotide
  Target: ATXN1; (+) strand; PAM type: YTN; PAM sequence: CTT
taccactttccagctctgtc

SEQ ID NO: 286240 - DNA, 20 bp, Artificial Sequence
  Description of Artificial Sequence: Synthetic oligonucleotide
  Target: ATXN1; (+) strand; PAM type: YTN; PAM sequence: TTT
accactttccagctctgtca

SEQ ID NO: 286241 - DNA, 20 bp, Artificial Sequence
  Description of Artificial Sequence: Synthetic oligonucleotide
  Target: ATXN1; (+) strand; PAM type: YTN; PAM sequence: TTA
ccactttccagctctgtcac

SEQ ID NO: 286242 - DNA, 20 bp, Artificial Sequence
  Description of Artificial Sequence: Synthetic oligonucleotide
  Target: ATXN1; (+) strand; PAM type: YTN; PAM sequence: CTT
tccagctctgtcactttgag

SEQ ID NO: 286243 - DNA, 20 bp, Artificial Sequence
  Description of Artificial Sequence: Synthetic oligonucleotide
  Target: ATXN1; (+) strand; PAM type: YTN; PAM sequence: TTT
ccagctctgtcactttgagg

SEQ ID NO: 286244 - DNA, 20 bp, Artificial Sequence
  Description of Artificial Sequence: Synthetic oligonucleotide
  Target: ATXN1; (+) strand; PAM type: YTN; PAM sequence: TTC
cagctctgtcactttgagga

SEQ ID NO: 286245 - DNA, 20 bp, Artificial Sequence
  Description of Artificial Sequence: Synthetic oligonucleotide
  Target: ATXN1; (+) strand; PAM type: YTN; PAM sequence: CTC
tgtcactttgaggaaattat

SEQ ID NO: 286246 - DNA, 20 bp, Artificial Sequence
  Description of Artificial Sequence: Synthetic oligonucleotide
  Target: ATXN1; (+) strand; PAM type: YTN; PAM sequence: CTG
tcactttgaggaaattattt

SEQ ID NO: 286247 - DNA, 20 bp, Artificial Sequence
  Description of Artificial Sequence: Synthetic oligonucleotide
  Target: ATXN1; (+) strand; PAM type: YTN; PAM sequence: CTT
tgaggaaattatttactggc

SEQ ID NO: 286248 - DNA, 20 bp, Artificial Sequence
  Description of Artificial Sequence: Synthetic oligonucleotide
  Target: ATXN1; (+) strand; PAM type: YTN; PAM sequence: TTT
gaggaaattatttactggct

SEQ ID NO: 286249 - DNA, 20 bp, Artificial Sequence
  Description of Artificial Sequence: Synthetic oligonucleotide
  Target: ATXN1; (+) strand; PAM type: YTN; PAM sequence: TTG
aggaaattatttactggctt

SEQ ID NO: 286250 - DNA, 20 bp, Artificial Sequence
  Description of Artificial Sequence: Synthetic oligonucleotide
  Target: ATXN1; (+) strand; PAM type: YTN; PAM sequence: TTA
tttactggcttgaccctcaa

SEQ ID NO: 286251 - DNA, 20 bp, Artificial Sequence
  Description of Artificial Sequence: Synthetic oligonucleotide
  Target: ATXN1; (+) strand; PAM type: YTN; PAM sequence: TTT
actggcttgaccctcaagtt

SEQ ID NO: 286252 - DNA, 20 bp, Artificial Sequence
  Description of Artificial Sequence: Synthetic oligonucleotide
  Target: ATXN1; (+) strand; PAM type: YTN; PAM sequence: TTA
ctggcttgaccctcaagttc

SEQ ID NO: 286253 - DNA, 20 bp, Artificial Sequence
  Description of Artificial Sequence: Synthetic oligonucleotide
  Target: ATXN1; (+) strand; PAM type: YTN; PAM sequence: CTG
gcttgaccctcaagttcatc

SEQ ID NO: 286254 - DNA, 20 bp, Artificial Sequence
  Description of Artificial Sequence: Synthetic oligonucleotide
  Target: ATXN1; (+) strand; PAM type: YTN; PAM sequence: CTT
gaccctcaagttcatccgct

SEQ ID NO: 286255 - DNA, 20 bp, Artificial Sequence
  Description of Artificial Sequence: Synthetic oligonucleotide
  Target: ATXN1; (+) strand; PAM type: YTN; PAM sequence: TTG
accctcaagttcatccgctg

SEQ ID NO: 286256 - DNA, 20 bp, Artificial Sequence
  Description of Artificial Sequence: Synthetic oligonucleotide
  Target: ATXN1; (+) strand; PAM type: YTN; PAM sequence: CTC
aagttcatccgctgtaaaag

SEQ ID NO: 286257 - DNA, 20 bp, Artificial Sequence
  Description of Artificial Sequence: Synthetic oligonucleotide
  Target: ATXN1; (+) strand; PAM type: YTN; PAM sequence: TTC
atccgctgtaaaaggagtca

SEQ ID NO: 286258 - DNA, 20 bp, Artificial Sequence
  Description of Artificial Sequence: Synthetic oligonucleotide
  Target: ATXN1; (+) strand; PAM type: YTN; PAM sequence: CTG
taaaaggagtcactaacgct

SEQ ID NO: 286259 - DNA, 20 bp, Artificial Sequence
  Description of Artificial Sequence: Synthetic oligonucleotide
  Target: ATXN1; (+) strand; PAM type: YTN; PAM sequence: CTA
acgcttgtctcagaaggttg

SEQ ID NO: 286260 - DNA, 20 bp, Artificial Sequence
  Description of Artificial Sequence: Synthetic oligonucleotide
  Target: ATXN1; (+) strand; PAM type: YTN; PAM sequence: CTT
gtctcagaaggttgttacgt

SEQ ID NO: 286261 - DNA, 20 bp, Artificial Sequence
  Description of Artificial Sequence: Synthetic oligonucleotide
  Target: ATXN1; (+) strand; PAM type: YTN; PAM sequence: TTG
tctcagaaggttgttacgta

SEQ ID NO: 286262 - DNA, 20 bp, Artificial Sequence
  Description of Artificial Sequence: Synthetic oligonucleotide
  Target: ATXN1; (+) strand; PAM type: YTN; PAM sequence: CTC
agaaggttgttacgtatata

SEQ ID NO: 286263 - DNA, 20 bp, Artificial Sequence
  Description of Artificial Sequence: Synthetic oligonucleotide
  Target: ATXN1; (+) strand; PAM type: YTN; PAM sequence: TTG
ttacgtatataaaactacgc

SEQ ID NO: 286264 - DNA, 20 bp, Artificial Sequence
  Description of Artificial Sequence: Synthetic oligonucleotide
  Target: ATXN1; (+) strand; PAM type: YTN; PAM sequence: TTA
cgtatataaaactacgcggc

SEQ ID NO: 286265 - DNA, 20 bp, Artificial Sequence
  Description of Artificial Sequence: Synthetic oligonucleotide
  Target: ATXN1; (+) strand; PAM type: YTN; PAM sequence: CTA
cgcggcccagaccacaccca

SEQ ID NO: 286266 - DNA, 20 bp, Artificial Sequence
  Description of Artificial Sequence: Synthetic oligonucleotide
  Target: ATXN1; (+) strand; PAM type: YTN; PAM sequence: CTC
ggacactggttttcccctct

SEQ ID NO: 286267 - DNA, 20 bp, Artificial Sequence
  Description of Artificial Sequence: Synthetic oligonucleotide
  Target: ATXN1; (+) strand; PAM type: YTN; PAM sequence: CTG
gttttcccctctctttctac

SEQ ID NO: 286268 - DNA, 20 bp, Artificial Sequence
  Description of Artificial Sequence: Synthetic oligonucleotide
  Target: ATXN1; (+) strand; PAM type: YTN; PAM sequence: TTT
tcccctctctttctacacag

SEQ ID NO: 286269 - DNA, 20 bp, Artificial Sequence
  Description of Artificial Sequence: Synthetic oligonucleotide
  Target: ATXN1; (+) strand; PAM type: YTN; PAM sequence: TTT
cccctctctttctacacagc

SEQ ID NO: 286270 - DNA, 20 bp, Artificial Sequence
  Description of Artificial Sequence: Synthetic oligonucleotide
  Target: ATXN1; (+) strand; PAM type: YTN; PAM sequence: TTC
ccctctctttctacacagca

SEQ ID NO: 286271 - DNA, 20 bp, Artificial Sequence
  Description of Artificial Sequence: Synthetic oligonucleotide
  Target: ATXN1; (+) strand; PAM type: YTN; PAM sequence: CTC
tctttctacacagcaggtca

SEQ ID NO: 286272 - DNA, 20 bp, Artificial Sequence
  Description of Artificial Sequence: Synthetic oligonucleotide
  Target: ATXN1; (+) strand; PAM type: YTN; PAM sequence: CTC
tttctacacagcaggtcata

SEQ ID NO: 286273 - DNA, 20 bp, Artificial Sequence
  Description of Artificial Sequence: Synthetic oligonucleotide
  Target: ATXN1; (+) strand; PAM type: YTN; PAM sequence: CTT
tctacacagcaggtcataag

SEQ ID NO: 286274 - DNA, 20 bp, Artificial Sequence
  Description of Artificial Sequence: Synthetic oligonucleotide
  Target: ATXN1; (+) strand; PAM type: YTN; PAM sequence: TTT
ctacacagcaggtcataaga

SEQ ID NO: 286275 - DNA, 20 bp, Artificial Sequence
  Description of Artificial Sequence: Synthetic oligonucleotide
  Target: ATXN1; (+) strand; PAM type: YTN; PAM sequence: TTC
tacacagcaggtcataagaa

SEQ ID NO: 286276 - DNA, 20 bp, Artificial Sequence
  Description of Artificial Sequence: Synthetic oligonucleotide
  Target: ATXN1; (+) strand; PAM type: YTN; PAM sequence: CTA
cacagcaggtcataagaagt

SEQ ID NO: 286277 - DNA, 20 bp, Artificial Sequence
  Description of Artificial Sequence: Synthetic oligonucleotide
  Target: ATXN1; (+) strand; PAM type: YTN; PAM sequence: CTC
aaggatgctggcttcctggt

SEQ ID NO: 286278 - DNA, 20 bp, Artificial Sequence
  Description of Artificial Sequence: Synthetic oligonucleotide
  Target: ATXN1; (+) strand; PAM type: YTN; PAM sequence: CTG
gcttcctggtgtggaatgat

SEQ ID NO: 286279 - DNA, 20 bp, Artificial Sequence
  Description of Artificial Sequence: Synthetic oligonucleotide
  Target: ATXN1; (+) strand; PAM type: YTN; PAM sequence: CTT
cctggtgtggaatgataagg

SEQ ID NO: 286280 - DNA, 20 bp, Artificial Sequence
  Description of Artificial Sequence: Synthetic oligonucleotide
  Target: ATXN1; (+) strand; PAM type: YTN; PAM sequence: TTC
ctggtgtggaatgataaggc

SEQ ID NO: 286281 - DNA, 20 bp, Artificial Sequence
  Description of Artificial Sequence: Synthetic oligonucleotide
  Target: ATXN1; (+) strand; PAM type: YTN; PAM sequence: CTG
gtgtggaatgataaggcggc

SEQ ID NO: 286282 - DNA, 20 bp, Artificial Sequence
  Description of Artificial Sequence: Synthetic oligonucleotide
  Target: ATXN1; (+) strand; PAM type: YTN; PAM sequence: CTG
gagtgggggtggcaggagaa

SEQ ID NO: 286283 - DNA, 20 bp, Artificial Sequence
  Description of Artificial Sequence: Synthetic oligonucleotide
  Target: ATXN1; (+) strand; PAM type: YTN; PAM sequence: CTG
ggccccatgacagaacctgt

SEQ ID NO: 286284 - DNA, 20 bp, Artificial Sequence
  Description of Artificial Sequence: Synthetic oligonucleotide
  Target: ATXN1; (+) strand; PAM type: YTN; PAM sequence: CTG
tttcacaaatgtggtgaggg

SEQ ID NO: 286285 - DNA, 20 bp, Artificial Sequence
  Description of Artificial Sequence: Synthetic oligonucleotide
  Target: ATXN1; (+) strand; PAM type: YTN; PAM sequence: TTT
cacaaatgtggtgaggggag

SEQ ID NO: 286286 - DNA, 20 bp, Artificial Sequence
  Description of Artificial Sequence: Synthetic oligonucleotide
  Target: ATXN1; (+) strand; PAM type: YTN; PAM sequence: TTC
acaaatgtggtgaggggagc

SEQ ID NO: 286287 - DNA, 20 bp, Artificial Sequence
  Description of Artificial Sequence: Synthetic oligonucleotide
  Target: ATXN1; (+) strand; PAM type: YTN; PAM sequence: CTC
tgctccagtgcacaaaaagg

SEQ ID NO: 286288 - DNA, 20 bp, Artificial Sequence
  Description of Artificial Sequence: Synthetic oligonucleotide
  Target: ATXN1; (+) strand; PAM type: YTN; PAM sequence: CTG
ctccagtgcacaaaaaggct

SEQ ID NO: 286289 - DNA, 20 bp, Artificial Sequence
  Description of Artificial Sequence: Synthetic oligonucleotide
  Target: ATXN1; (+) strand; PAM type: YTN; PAM sequence: CTC
cagtgcacaaaaaggctgca

SEQ ID NO: 286290 - DNA, 20 bp, Artificial Sequence
  Description of Artificial Sequence: Synthetic oligonucleotide
  Target: ATXN1; (+) strand; PAM type: YTN; PAM sequence: CTG
caggctgacaccattttgca

SEQ ID NO: 286291 - DNA, 20 bp, Artificial Sequence
  Description of Artificial Sequence: Synthetic oligonucleotide
  Target: ATXN1; (+) strand; PAM type: YTN; PAM sequence: CTG
acaccattttgcagtgttca

SEQ ID NO: 286292 - DNA, 20 bp, Artificial Sequence
  Description of Artificial Sequence: Synthetic oligonucleotide
  Target: ATXN1; (+) strand; PAM type: YTN; PAM sequence: TTT
tgcagtgttcactggcaagg

SEQ ID NO: 286293 - DNA, 20 bp, Artificial Sequence
  Description of Artificial Sequence: Synthetic oligonucleotide
  Target: ATXN1; (+) strand; PAM type: YTN; PAM sequence: TTT
gcagtgttcactggcaaggc

SEQ ID NO: 286294 - DNA, 20 bp, Artificial Sequence
  Description of Artificial Sequence: Synthetic oligonucleotide
  Target: ATXN1; (+) strand; PAM type: YTN; PAM sequence: TTG
cagtgttcactggcaaggct

SEQ ID NO: 286295 - DNA, 20 bp, Artificial Sequence
  Description of Artificial Sequence: Synthetic oligonucleotide
  Target: ATXN1; (+) strand; PAM type: YTN; PAM sequence: TTC
actggcaaggctgctgacat

SEQ ID NO: 286296 - DNA, 20 bp, Artificial Sequence
  Description of Artificial Sequence: Synthetic oligonucleotide
  Target: ATXN1; (+) strand; PAM type: YTN; PAM sequence: CTG
gcaaggctgctgacatagaa

SEQ ID NO: 286297 - DNA, 20 bp, Artificial Sequence
  Description of Artificial Sequence: Synthetic oligonucleotide
  Target: ATXN1; (+) strand; PAM type: YTN; PAM sequence: CTG
ctgacatagaaactggcctc

SEQ ID NO: 286298 - DNA, 20 bp, Artificial Sequence
  Description of Artificial Sequence: Synthetic oligonucleotide
  Target: ATXN1; (+) strand; PAM type: YTN; PAM sequence: CTG
acatagaaactggcctccgt

SEQ ID NO: 286299 - DNA, 20 bp, Artificial Sequence
  Description of Artificial Sequence: Synthetic oligonucleotide
  Target: ATXN1; (+) strand; PAM type: YTN; PAM sequence: CTG
gcctccgtcaaaaagtcaca

SEQ ID NO: 286300 - DNA, 20 bp, Artificial Sequence
  Description of Artificial Sequence: Synthetic oligonucleotide
  Target: ATXN1; (+) strand; PAM type: YTN; PAM sequence: CTC
cgtcaaaaagtcacacctct

SEQ ID NO: 286301 - DNA, 20 bp, Artificial Sequence
  Description of Artificial Sequence: Synthetic oligonucleotide
  Target: ATXN1; (+) strand; PAM type: YTN; PAM sequence: CTC
tccttttcctggcttggtgt

SEQ ID NO: 286302 - DNA, 20 bp, Artificial Sequence
  Description of Artificial Sequence: Synthetic oligonucleotide
  Target: ATXN1; (+) strand; PAM type: YTN; PAM sequence: CTC
cttttcctggcttggtgtcc

SEQ ID NO: 286303 - DNA, 20 bp, Artificial Sequence
  Description of Artificial Sequence: Synthetic oligonucleotide
  Target: ATXN1; (+) strand; PAM type: YTN; PAM sequence: CTT
ttcctggcttggtgtccagc

SEQ ID NO: 286304 - DNA, 20 bp, Artificial Sequence
  Description of Artificial Sequence: Synthetic oligonucleotide
  Target: ATXN1; (+) strand; PAM type: YTN; PAM sequence: TTT
tcctggcttggtgtccagct

SEQ ID NO: 286305 - DNA, 20 bp, Artificial Sequence
  Description of Artificial Sequence: Synthetic oligonucleotide
  Target: ATXN1; (+) strand; PAM type: YTN; PAM sequence: TTT
cctggcttggtgtccagctg

SEQ ID NO: 286306 - DNA, 20 bp, Artificial Sequence
  Description of Artificial Sequence: Synthetic oligonucleotide
  Target: ATXN1; (+) strand; PAM type: YTN; PAM sequence: TTC
ctggcttggtgtccagctga

SEQ ID NO: 286307 - DNA, 20 bp, Artificial Sequence
  Description of Artificial Sequence: Synthetic oligonucleotide
  Target: ATXN1; (+) strand; PAM type: YTN; PAM sequence: CTG
gcttggtgtccagctgaaaa

SEQ ID NO: 286308 - DNA, 20 bp, Artificial Sequence
  Description of Artificial Sequence: Synthetic oligonucleotide
  Target: ATXN1; (+) strand; PAM type: YTN; PAM sequence: CTT
ggtgtccagctgaaaagagg

SEQ ID NO: 286309 - DNA, 20 bp, Artificial Sequence
  Description of Artificial Sequence: Synthetic oligonucleotide
  Target: ATXN1; (+) strand; PAM type: YTN; PAM sequence: TTG
gtgtccagctgaaaagagga

SEQ ID NO: 286310 - DNA, 20 bp, Artificial Sequence
  Description of Artificial Sequence: Synthetic oligonucleotide
  Target: ATXN1; (+) strand; PAM type: YTN; PAM sequence: CTG
aaaagaggaggggttcatgt

SEQ ID NO: 286311 - DNA, 20 bp, Artificial Sequence
  Description of Artificial Sequence: Synthetic oligonucleotide
  Target: ATXN1; (+) strand; PAM type: YTN; PAM sequence: TTC
atgtgcatctggacagcttt

SEQ ID NO: 286312 - DNA, 20 bp, Artificial Sequence
  Description of Artificial Sequence: Synthetic oligonucleotide
  Target: ATXN1; (+) strand; PAM type: YTN; PAM sequence: CTG
gacagctttaccccaagggc

SEQ ID NO: 286313 - DNA, 20 bp, Artificial Sequence
  Description of Artificial Sequence: Synthetic oligonucleotide
  Target: ATXN1; (+) strand; PAM type: YTN; PAM sequence: CTT
taccccaagggcacctgcaa

SEQ ID NO: 286314 - DNA, 20 bp, Artificial Sequence
  Description of Artificial Sequence: Synthetic oligonucleotide
  Target: ATXN1; (+) strand; PAM type: YTN; PAM sequence: TTT
accccaagggcacctgcaag

SEQ ID NO: 286315 - DNA, 20 bp, Artificial Sequence
  Description of Artificial Sequence: Synthetic oligonucleotide
  Target: ATXN1; (+) strand; PAM type: YTN; PAM sequence: TTA
ccccaagggcacctgcaagg

SEQ ID NO: 286316 - DNA, 20 bp, Artificial Sequence
  Description of Artificial Sequence: Synthetic oligonucleotide
  Target: ATXN1; (+) strand; PAM type: YTN; PAM sequence: CTG
caaggtagtaggagcagatg

SEQ ID NO: 286317 - DNA, 20 bp, Artificial Sequence
  Description of Artificial Sequence: Synthetic oligonucleotide
  Target: ATXN1; (+) strand; PAM type: YTN; PAM sequence: CTA
tggccagatgacagggggac

SEQ ID NO: 286318 - DNA, 20 bp, Artificial Sequence
  Description of Artificial Sequence: Synthetic oligonucleotide
  Target: ATXN1; (+) strand; PAM type: YTN; PAM sequence: CTA
atgcagcttccaacttgctg

SEQ ID NO: 286319 - DNA, 20 bp, Artificial Sequence
  Description of Artificial Sequence: Synthetic oligonucleotide
  Target: ATXN1; (+) strand; PAM type: YTN; PAM sequence: CTT
ccaacttgctggtgcccagc

SEQ ID NO: 286320 - DNA, 20 bp, Artificial Sequence
  Description of Artificial Sequence: Synthetic oligonucleotide
  Target: ATXN1; (+) strand; PAM type: YTN; PAM sequence: TTC
caacttgctggtgcccagcc

SEQ ID NO: 286321 - DNA, 20 bp, Artificial Sequence
  Description of Artificial Sequence: Synthetic oligonucleotide
  Target: ATXN1; (+) strand; PAM type: YTN; PAM sequence: CTT
gctggtgcccagccagaccc

SEQ ID NO: 286322 - DNA, 20 bp, Artificial Sequence
  Description of Artificial Sequence: Synthetic oligonucleotide
  Target: ATXN1; (+) strand; PAM type: YTN; PAM sequence: TTG
ctggtgcccagccagacccc

SEQ ID NO: 286323 - DNA, 20 bp, Artificial Sequence
  Description of Artificial Sequence: Synthetic oligonucleotide
  Target: ATXN1; (+) strand; PAM type: YTN; PAM sequence: CTG
gtgcccagccagaccccact

SEQ ID NO: 286324 - DNA, 20 bp, Artificial Sequence
  Description of Artificial Sequence: Synthetic oligonucleotide
  Target: ATXN1; (+) strand; PAM type: YTN; PAM sequence: CTG
atttggagactttcctgcca

SEQ ID NO: 286325 - DNA, 20 bp, Artificial Sequence
  Description of Artificial Sequence: Synthetic oligonucleotide
  Target: ATXN1; (+) strand; PAM type: YTN; PAM sequence: TTT
ggagactttcctgccaactt

SEQ ID NO: 286326 - DNA, 20 bp, Artificial Sequence
  Description of Artificial Sequence: Synthetic oligonucleotide
  Target: ATXN1; (+) strand; PAM type: YTN; PAM sequence: TTG
gagactttcctgccaacttg

SEQ ID NO: 286327 - DNA, 20 bp, Artificial Sequence
  Description of Artificial Sequence: Synthetic oligonucleotide
  Target: ATXN1; (+) strand; PAM type: YTN; PAM sequence: CTT
tcctgccaacttgccaaaaa

SEQ ID NO: 286328 - DNA, 20 bp, Artificial Sequence
  Description of Artificial Sequence: Synthetic oligonucleotide
  Target: ATXN1; (+) strand; PAM type: YTN; PAM sequence: TTT
cctgccaacttgccaaaaac

SEQ ID NO: 286329 - DNA, 20 bp, Artificial Sequence
  Description of Artificial Sequence: Synthetic oligonucleotide
  Target: ATXN1; (+) strand; PAM type: YTN; PAM sequence: TTC
ctgccaacttgccaaaaact

SEQ ID NO: 286330 - DNA, 20 bp, Artificial Sequence
  Description of Artificial Sequence: Synthetic oligonucleotide
  Target: ATXN1; (+) strand; PAM type: YTN; PAM sequence: CTG
ccaacttgccaaaaactgat

SEQ ID NO: 286331 - DNA, 20 bp, Artificial Sequence
  Description of Artificial Sequence: Synthetic oligonucleotide
  Target: ATXN1; (+) strand; PAM type: YTN; PAM sequence: CTT
gccaaaaactgatctgacac

SEQ ID NO: 286332 - DNA, 20 bp, Artificial Sequence
  Description of Artificial Sequence: Synthetic oligonucleotide
  Target: ATXN1; (+) strand; PAM type: YTN; PAM sequence: TTG
ccaaaaactgatctgacacc

SEQ ID NO: 286333 - DNA, 20 bp, Artificial Sequence
  Description of Artificial Sequence: Synthetic oligonucleotide
  Target: ATXN1; (+) strand; PAM type: YTN; PAM sequence: CTG
atctgacacccaatggtgtc

SEQ ID NO: 286334 - DNA, 20 bp, Artificial Sequence
  Description of Artificial Sequence: Synthetic oligonucleotide
  Target: ATXN1; (+) strand; PAM type: YTN; PAM sequence: CTG
acacccaatggtgtcaccaa

SEQ ID NO: 286335 - DNA, 20 bp, Artificial Sequence
  Description of Artificial Sequence: Synthetic oligonucleotide
  Target: ATXN1; (+) strand; PAM type: YTN; PAM sequence: TTT
tcttttcctatgcatcagta

SEQ ID NO: 286336 - DNA, 20 bp, Artificial Sequence
  Description of Artificial Sequence: Synthetic oligonucleotide
  Target: ATXN1; (+) strand; PAM type: YTN; PAM sequence: TTT
cttttcctatgcatcagtac

SEQ ID NO: 286337 - DNA, 20 bp, Artificial Sequence
  Description of Artificial Sequence: Synthetic oligonucleotide
  Target: ATXN1; (+) strand; PAM type: YTN; PAM sequence: TTC
ttttcctatgcatcagtacc

SEQ ID NO: 286338 - DNA, 20 bp, Artificial Sequence
  Description of Artificial Sequence: Synthetic oligonucleotide
  Target: ATXN1; (+) strand; PAM type: YTN; PAM sequence: CTT
ttcctatgcatcagtacctc

SEQ ID NO: 286339 - DNA, 20 bp, Artificial Sequence
  Description of Artificial Sequence: Synthetic oligonucleotide
  Target: ATXN1; (+) strand; PAM type: YTN; PAM sequence: TTT
tcctatgcatcagtacctcc

SEQ ID NO: 286340 - DNA, 20 bp, Artificial Sequence
  Description of Artificial Sequence: Synthetic oligonucleotide
  Target: ATXN1; (+) strand; PAM type: YTN; PAM sequence: TTT
cctatgcatcagtacctcca

SEQ ID NO: 286341 - DNA, 20 bp, Artificial Sequence
  Description of Artificial Sequence: Synthetic oligonucleotide
  Target: ATXN1; (+) strand; PAM type: YTN; PAM sequence: TTC
ctatgcatcagtacctccac

SEQ ID NO: 286342 - DNA, 20 bp, Artificial Sequence
  Description of Artificial Sequence: Synthetic oligonucleotide
  Target: ATXN1; (+) strand; PAM type: YTN; PAM sequence: CTA
tgcatcagtacctccacacc

SEQ ID NO: 286343 - DNA, 20 bp, Artificial Sequence
  Description of Artificial Sequence: Synthetic oligonucleotide
  Target: ATXN1; (+) strand; PAM type: YTN; PAM sequence: CTC
cacacccagggatcagtctt

SEQ ID NO: 286344 - DNA, 20 bp, Artificial Sequence
  Description of Artificial Sequence: Synthetic oligonucleotide
  Target: ATXN1; (+) strand; PAM type: YTN; PAM sequence: CTT
ccttcacctcactctaaagg

SEQ ID NO: 286345 - DNA, 20 bp, Artificial Sequence
  Description of Artificial Sequence: Synthetic oligonucleotide
  Target: ATXN1; (+) strand; PAM type: YTN; PAM sequence: TTC
cttcacctcactctaaaggg

SEQ ID NO: 286346 - DNA, 20 bp, Artificial Sequence
  Description of Artificial Sequence: Synthetic oligonucleotide
  Target: ATXN1; (+) strand; PAM type: YTN; PAM sequence: CTT
cacctcactctaaagggcca

SEQ ID NO: 286347 - DNA, 20 bp, Artificial Sequence
  Description of Artificial Sequence: Synthetic oligonucleotide
  Target: ATXN1; (+) strand; PAM type: YTN; PAM sequence: TTC
acctcactctaaagggccag

SEQ ID NO: 286348 - DNA, 20 bp, Artificial Sequence
  Description of Artificial Sequence: Synthetic oligonucleotide
  Target: ATXN1; (+) strand; PAM type: YTN; PAM sequence: CTC
actctaaagggccagccatc

SEQ ID NO: 286349 - DNA, 20 bp, Artificial Sequence
  Description of Artificial Sequence: Synthetic oligonucleotide
  Target: ATXN1; (+) strand; PAM type: YTN; PAM sequence: CTC
taaagggccagccatcattg

SEQ ID NO: 286350 - DNA, 20 bp, Artificial Sequence
  Description of Artificial Sequence: Synthetic oligonucleotide
  Target: ATXN1; (+) strand; PAM type: YTN; PAM sequence: CTA
aagggccagccatcattgcc

SEQ ID NO: 286351 - DNA, 20 bp, Artificial Sequence
  Description of Artificial Sequence: Synthetic oligonucleotide
  Target: ATXN1; (+) strand; PAM type: YTN; PAM sequence: TTG
ccttccaaggtatgaaccaa

SEQ ID NO: 286352 - DNA, 20 bp, Artificial Sequence
  Description of Artificial Sequence: Synthetic oligonucleotide
  Target: ATXN1; (+) strand; PAM type: YTN; PAM sequence: CTT
ccaaggtatgaaccaagaaa

SEQ ID NO: 286353 - DNA, 20 bp, Artificial Sequence
  Description of Artificial Sequence: Synthetic oligonucleotide
  Target: ATXN1; (+) strand; PAM type: YTN; PAM sequence: TTC
caaggtatgaaccaagaaat

SEQ ID NO: 286354 - DNA, 20 bp, Artificial Sequence
  Description of Artificial Sequence: Synthetic oligonucleotide
  Target: ATXN1; (+) strand; PAM type: YTN; PAM sequence: CTC
actcaggtgaacaggccaca

SEQ ID NO: 286355 - DNA, 20 bp, Artificial Sequence
  Description of Artificial Sequence: Synthetic oligonucleotide
  Target: ATXN1; (+) strand; PAM type: YTN; PAM sequence: CTC
aggtgaacaggccacagagg

SEQ ID NO: 286356 - DNA, 20 bp, Artificial Sequence
  Description of Artificial Sequence: Synthetic oligonucleotide
  Target: ATXN1; (+) strand; PAM type: YTN; PAM sequence: CTA
aaagtgctggccctatagca

SEQ ID NO: 286357 - DNA, 20 bp, Artificial Sequence
  Description of Artificial Sequence: Synthetic oligonucleotide
  Target: ATXN1; (+) strand; PAM type: YTN; PAM sequence: CTG
gccctatagcagcctcatgc

SEQ ID NO: 286358 - DNA, 20 bp, Artificial Sequence
  Description of Artificial Sequence: Synthetic oligonucleotide
  Target: ATXN1; (+) strand; PAM type: YTN; PAM sequence: CTA
tagcagcctcatgcaaaaac

SEQ ID NO: 286359 - DNA, 20 bp, Artificial Sequence
  Description of Artificial Sequence: Synthetic oligonucleotide
  Target: ATXN1; (+) strand; PAM type: YTN; PAM sequence: CTC
atgcaaaaacagatttgtgc

SEQ ID NO: 286360 - DNA, 20 bp, Artificial Sequence
  Description of Artificial Sequence: Synthetic oligonucleotide
  Target: ATXN1; (+) strand; PAM type: YTN; PAM sequence: TTT
gtgcactgagaagacttttg

SEQ ID NO: 286361 - DNA, 20 bp, Artificial Sequence
  Description of Artificial Sequence: Synthetic oligonucleotide
  Target: ATXN1; (+) strand; PAM type: YTN; PAM sequence: TTG
tgcactgagaagacttttga

SEQ ID NO: 286362 - DNA, 20 bp, Artificial Sequence
  Description of Artificial Sequence: Synthetic oligonucleotide
  Target: ATXN1; (+) strand; PAM type: YTN; PAM sequence: CTG
agaagacttttgaaatttga

SEQ ID NO: 286363 - DNA, 20 bp, Artificial Sequence
  Description of Artificial Sequence: Synthetic oligonucleotide
  Target: ATXN1; (+) strand; PAM type: YTN; PAM sequence: CTT
ttgaaatttgaaaggccgct

SEQ ID NO: 286364 - DNA, 20 bp, Artificial Sequence
  Description of Artificial Sequence: Synthetic oligonucleotide
  Target: ATXN1; (+) strand; PAM type: YTN; PAM sequence: TTT
tgaaatttgaaaggccgcta

SEQ ID NO: 286365 - DNA, 20 bp, Artificial Sequence
  Description of Artificial Sequence: Synthetic oligonucleotide
  Target: ATXN1; (+) strand; PAM type: YTN; PAM sequence: TTT
gaaatttgaaaggccgctac

SEQ ID NO: 286366 - DNA, 20 bp, Artificial Sequence
  Description of Artificial Sequence: Synthetic oligonucleotide
  Target: ATXN1; (+) strand; PAM type: YTN; PAM sequence: TTG
aaatttgaaaggccgctact

SEQ ID NO: 286367 - DNA, 20 bp, Artificial Sequence
  Description of Artificial Sequence: Synthetic oligonucleotide
  Target: ATXN1; (+) strand; PAM type: YTN; PAM sequence: TTT
gaaaggccgctactaagaag

SEQ ID NO: 286368 - DNA, 20 bp, Artificial Sequence
  Description of Artificial Sequence: Synthetic oligonucleotide
  Target: ATXN1; (+) strand; PAM type: YTN; PAM sequence: TTG
aaaggccgctactaagaaga

SEQ ID NO: 286369 - DNA, 20 bp, Artificial Sequence
  Description of Artificial Sequence: Synthetic oligonucleotide
  Target: ATXN1; (+) strand; PAM type: YTN; PAM sequence: CTA
ctaagaagataaaccctcca

SEQ ID NO: 286370 - DNA, 20 bp, Artificial Sequence
  Description of Artificial Sequence: Synthetic oligonucleotide
  Target: ATXN1; (+) strand; PAM type: YTN; PAM sequence: CTA
agaagataaaccctccaaag

SEQ ID NO: 286371 - DNA, 20 bp, Artificial Sequence
  Description of Artificial Sequence: Synthetic oligonucleotide
  Target: ATXN1; (+) strand; PAM type: YTN; PAM sequence: CTC
caaagatttccttctatcat

SEQ ID NO: 286372 - DNA, 20 bp, Artificial Sequence
  Description of Artificial Sequence: Synthetic oligonucleotide
  Target: ATXN1; (+) strand; PAM type: YTN; PAM sequence: TTT
ccttctatcattgttattca

SEQ ID NO: 286373 - DNA, 20 bp, Artificial Sequence
  Description of Artificial Sequence: Synthetic oligonucleotide
  Target: ATXN1; (+) strand; PAM type: YTN; PAM sequence: TTC
cttctatcattgttattcat

SEQ ID NO: 286374 - DNA, 20 bp, Artificial Sequence
  Description of Artificial Sequence: Synthetic oligonucleotide
  Target: ATXN1; (+) strand; PAM type: YTN; PAM sequence: CTT
ctatcattgttattcattaa

SEQ ID NO: 286375 - DNA, 20 bp, Artificial Sequence
  Description of Artificial Sequence: Synthetic oligonucleotide
  Target: ATXN1; (+) strand; PAM type: YTN; PAM sequence: TTC
tatcattgttattcattaaa

SEQ ID NO: 286376 - DNA, 20 bp, Artificial Sequence
  Description of Artificial Sequence: Synthetic oligonucleotide
  Target: ATXN1; (+) strand; PAM type: YTN; PAM sequence: CTA
tcattgttattcattaaaaa

SEQ ID NO: 286377 - DNA, 20 bp, Artificial Sequence
  Description of Artificial Sequence: Synthetic oligonucleotide
  Target: ATXN1; (+) strand; PAM type: YTN; PAM sequence: TTG
ttattcattaaaaaaaaaac

SEQ ID NO: 286378 - DNA, 20 bp, Artificial Sequence
  Description of Artificial Sequence: Synthetic oligonucleotide
  Target: ATXN1; (+) strand; PAM type: YTN; PAM sequence: TTA
ttcattaaaaaaaaaacaag

SEQ ID NO: 286379 - DNA, 20 bp, Artificial Sequence
  Description of Artificial Sequence: Synthetic oligonucleotide
  Target: ATXN1; (+) strand; PAM type: YTN; PAM sequence: TTC
attaaaaaaaaaacaagctt

SEQ ID NO: 286380 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaaacaagcttaggc

SEQ ID NO: 286381 - DNA, 20 bp, Artificial Sequence
  Description of Artificial Sequence: Synthetic oligonucleotide
  Target: ATXN1; (+) strand; PAM type: YTN; PAM sequence: CTT
aggccgggcatggtggctca

SEQ ID NO: 286382 - DNA, 20 bp, Artificial Sequence
  Description of Artificial Sequence: Synthetic oligonucleotide
  Target: ATXN1; (+) strand; PAM type: YTN; PAM sequence: TTA
ggccgggcatggtggctcac

SEQ ID NO: 286383 - DNA, 20 bp, Artificial Sequence
  Description of Artificial Sequence: Synthetic oligonucleotide
  Target: ATXN1; (+) strand; PAM type: YTN; PAM sequence: CTC
acacctgtaatcccagcatt

SEQ ID NO: 286384 - DNA, 20 bp, Artificial Sequence
  Description of Artificial Sequence: Synthetic oligonucleotide
  Target: ATXN1; (+) strand; PAM type: YTN; PAM sequence: CTG
taatcccagcattttgggag

SEQ ID NO: 286385 - DNA, 20 bp, Artificial Sequence
  Description of Artificial Sequence: Synthetic oligonucleotide
  Target: ATXN1; (+) strand; PAM type: YTN; PAM sequence: TTT
tgggaggctgaggcgagcgg

SEQ ID NO: 286386 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaggcgagcgga

SEQ ID NO: 286387 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcgagcggat

SEQ ID NO: 286388 - DNA, 20 bp, Artificial Sequence
  Description of Artificial Sequence: Synthetic oligonucleotide
  Target: ATXN1; (+) strand; PAM type: YTN; PAM sequence: CTG
aggcgagcggatcatgaggt

SEQ ID NO: 286389 - DNA, 20 bp, Artificial Sequence
  Description of Artificial Sequence: Synthetic oligonucleotide
  Target: ATXN1; (+) strand; PAM type: YTN; PAM sequence: CTG
gccaacatgctgaaaccttg

SEQ ID NO: 286390 - DNA, 20 bp, Artificial Sequence
  Description of Artificial Sequence: Synthetic oligonucleotide
  Target: ATXN1; (+) strand; PAM type: YTN; PAM sequence: CTG
aaaccttgtctctactaaaa

SEQ ID NO: 286391 - DNA, 20 bp, Artificial Sequence
  Description of Artificial Sequence: Synthetic oligonucleotide
  Target: ATXN1; (+) strand; PAM type: YTN; PAM sequence: CTT
gtctctactaaaaatacaaa

SEQ ID NO: 286392 - DNA, 20 bp, Artificial Sequence
  Description of Artificial Sequence: Synthetic oligonucleotide
  Target: ATXN1; (+) strand; PAM type: YTN; PAM sequence: TTG
tctctactaaaaatacaaaa

SEQ ID NO: 286393 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 286394 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 286395 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagctgg

SEQ ID NO: 286396 - DNA, 20 bp, Artificial Sequence
  Description of Artificial Sequence: Synthetic oligonucleotide
  Target: ATXN1; (+) strand; PAM type: YTN; PAM sequence: TTA
gctgggtatggtggcacgtg

SEQ ID NO: 286397 - DNA, 20 bp, Artificial Sequence
  Description of Artificial Sequence: Synthetic oligonucleotide
  Target: ATXN1; (+) strand; PAM type: YTN; PAM sequence: CTG
ggtatggtggcacgtgcctg

SEQ ID NO: 286398 - DNA, 20 bp, Artificial Sequence
  Description of Artificial Sequence: Synthetic oligonucleotide
  Target: ATXN1; (+) strand; PAM type: YTN; PAM sequence: CTG
taatcccagctactcaggag

SEQ ID NO: 286399 - DNA, 20 bp, Artificial Sequence
  Description of Artificial Sequence: Synthetic oligonucleotide
  Target: ATXN1; (+) strand; PAM type: YTN; PAM sequence: CTA
ctcaggagggtgagacagga

SEQ ID NO: 286400 - DNA, 20 bp, Artificial Sequence
  Description of Artificial Sequence: Synthetic oligonucleotide
  Target: ATXN1; (+) strand; PAM type: YTN; PAM sequence: CTC
aggagggtgagacaggagaa

SEQ ID NO: 286401 - DNA, 20 bp, Artificial Sequence
  Description of Artificial Sequence: Synthetic oligonucleotide
  Target: ATXN1; (+) strand; PAM type: YTN; PAM sequence: CTT
gaaccagggagtcagaggtt

SEQ ID NO: 286402 - DNA, 20 bp, Artificial Sequence
  Description of Artificial Sequence: Synthetic oligonucleotide
  Target: ATXN1; (+) strand; PAM type: YTN; PAM sequence: TTG
aaccagggagtcagaggttg

SEQ ID NO: 286403 - DNA, 20 bp, Artificial Sequence
  Description of Artificial Sequence: Synthetic oligonucleotide
  Target: ATXN1; (+) strand; PAM type: YTN; PAM sequence: TTG
cagtgagcagagatcgcgcc

SEQ ID NO: 286404 - DNA, 20 bp, Artificial Sequence
  Description of Artificial Sequence: Synthetic oligonucleotide
  Target: ATXN1; (+) strand; PAM type: YTN; PAM sequence: CTG
cactccagcctggtgacaga

SEQ ID NO: 286405 - DNA, 20 bp, Artificial Sequence
  Description of Artificial Sequence: Synthetic oligonucleotide
  Target: ATXN1; (+) strand; PAM type: YTN; PAM sequence: CTC
cagcctggtgacagagtgaa

SEQ ID NO: 286406 - DNA, 20 bp, Artificial Sequence
  Description of Artificial Sequence: Synthetic oligonucleotide
  Target: ATXN1; (+) strand; PAM type: YTN; PAM sequence: CTG
gtgacagagtgaaactccgt

SEQ ID NO: 286407 - DNA, 20 bp, Artificial Sequence
  Description of Artificial Sequence: Synthetic oligonucleotide
  Target: ATXN1; (+) strand; PAM type: YTN; PAM sequence: CTC
cgtctcaaaaaaaaaaaaaa

SEQ ID NO: 286408 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaagctta

SEQ ID NO: 286409 - DNA, 20 bp, Artificial Sequence
  Description of Artificial Sequence: Synthetic oligonucleotide
  Target: ATXN1; (+) strand; PAM type: YTN; PAM sequence: CTT
aacttgaatgaatgggaaca

SEQ ID NO: 286410 - DNA, 20 bp, Artificial Sequence
  Description of Artificial Sequence: Synthetic oligonucleotide
  Target: ATXN1; (+) strand; PAM type: YTN; PAM sequence: TTA
acttgaatgaatgggaacaa

SEQ ID NO: 286411 - DNA, 20 bp, Artificial Sequence
  Description of Artificial Sequence: Synthetic oligonucleotide
  Target: ATXN1; (+) strand; PAM type: YTN; PAM sequence: CTT
gaatgaatgggaacaagagg

SEQ ID NO: 286412 - DNA, 20 bp, Artificial Sequence
  Description of Artificial Sequence: Synthetic oligonucleotide
  Target: ATXN1; (+) strand; PAM type: YTN; PAM sequence: TTG
aatgaatgggaacaagaggg

SEQ ID NO: 286413 - DNA, 20 bp, Artificial Sequence
  Description of Artificial Sequence: Synthetic oligonucleotide
  Target: ATXN1; (+) strand; PAM type: YTN; PAM sequence: TTA
tttaaaaaataataaacagt

SEQ ID NO: 286414 - DNA, 20 bp, Artificial Sequence
  Description of Artificial Sequence: Synthetic oligonucleotide
  Target: ATXN1; (+) strand; PAM type: YTN; PAM sequence: TTT
aaaaaataataaacagtaac

SEQ ID NO: 286415 - DNA, 20 bp, Artificial Sequence
  Description of Artificial Sequence: Synthetic oligonucleotide
  Target: ATXN1; (+) strand; PAM type: YTN; PAM sequence: TTA
aaaaataataaacagtaaca

SEQ ID NO: 286416 - DNA, 20 bp, Artificial Sequence
  Description of Artificial Sequence: Synthetic oligonucleotide
  Target: ATXN1; (+) strand; PAM type: YTN; PAM sequence: CTA
tcacacctaaaggtgacatt

SEQ ID NO: 286417 - DNA, 20 bp, Artificial Sequence
  Description of Artificial Sequence: Synthetic oligonucleotide
  Target: ATXN1; (+) strand; PAM type: YTN; PAM sequence: CTA
aaggtgacattatctagaaa

SEQ ID NO: 286418 - DNA, 20 bp, Artificial Sequence
  Description of Artificial Sequence: Synthetic oligonucleotide
  Target: ATXN1; (+) strand; PAM type: YTN; PAM sequence: TTA
tctagaaacattaacatgtc

SEQ ID NO: 286419 - DNA, 20 bp, Artificial Sequence
  Description of Artificial Sequence: Synthetic oligonucleotide
  Target: ATXN1; (+) strand; PAM type: YTN; PAM sequence: CTA
gaaacattaacatgtcaaga

SEQ ID NO: 286420 - DNA, 20 bp, Artificial Sequence
  Description of Artificial Sequence: Synthetic oligonucleotide
  Target: ATXN1; (+) strand; PAM type: YTN; PAM sequence: TTA
acatgtcaagacatcagccc

SEQ ID NO: 286421 - DNA, 20 bp, Artificial Sequence
  Description of Artificial Sequence: Synthetic oligonucleotide
  Target: ATXN1; (+) strand; PAM type: YTN; PAM sequence: CTT
ctgttccttctgttccccca

SEQ ID NO: 286422 - DNA, 20 bp, Artificial Sequence
  Description of Artificial Sequence: Synthetic oligonucleotide
  Target: ATXN1; (+) strand; PAM type: YTN; PAM sequence: TTC
tgttccttctgttcccccaa

SEQ ID NO: 286423 - DNA, 20 bp, Artificial Sequence
  Description of Artificial Sequence: Synthetic oligonucleotide
  Target: ATXN1; (+) strand; PAM type: YTN; PAM sequence: CTG
ttccttctgttcccccaaga

SEQ ID NO: 286424 - DNA, 20 bp, Artificial Sequence
  Description of Artificial Sequence: Synthetic oligonucleotide
  Target: ATXN1; (+) strand; PAM type: YTN; PAM sequence: TTC
cttctgttcccccaagaggc

SEQ ID NO: 286425 - DNA, 20 bp, Artificial Sequence
  Description of Artificial Sequence: Synthetic oligonucleotide
  Target: ATXN1; (+) strand; PAM type: YTN; PAM sequence: CTT
ctgttcccccaagaggccta

SEQ ID NO: 286426 - DNA, 20 bp, Artificial Sequence
  Description of Artificial Sequence: Synthetic oligonucleotide
  Target: ATXN1; (+) strand; PAM type: YTN; PAM sequence: TTC
tgttcccccaagaggcctat

SEQ ID NO: 286427 - DNA, 20 bp, Artificial Sequence
  Description of Artificial Sequence: Synthetic oligonucleotide
  Target: ATXN1; (+) strand; PAM type: YTN; PAM sequence: CTG
ttcccccaagaggcctattt

SEQ ID NO: 286428 - DNA, 20 bp, Artificial Sequence
  Description of Artificial Sequence: Synthetic oligonucleotide
  Target: ATXN1; (+) strand; PAM type: YTN; PAM sequence: TTC
ccccaagaggcctatttgga

SEQ ID NO: 286429 - DNA, 20 bp, Artificial Sequence
  Description of Artificial Sequence: Synthetic oligonucleotide
  Target: ATXN1; (+) strand; PAM type: YTN; PAM sequence: CTA
tttggagcaccagcaaaatg

SEQ ID NO: 286430 - DNA, 20 bp, Artificial Sequence
  Description of Artificial Sequence: Synthetic oligonucleotide
  Target: ATXN1; (+) strand; PAM type: YTN; PAM sequence: TTT
ggagcaccagcaaaatgcat

SEQ ID NO: 286431 - DNA, 20 bp, Artificial Sequence
  Description of Artificial Sequence: Synthetic oligonucleotide
  Target: ATXN1; (+) strand; PAM type: YTN; PAM sequence: TTG
gagcaccagcaaaatgcatt

SEQ ID NO: 286432 - DNA, 20 bp, Artificial Sequence
  Description of Artificial Sequence: Synthetic oligonucleotide
  Target: ATXN1; (+) strand; PAM type: YTN; PAM sequence: TTT
ggaggatcactaaatctaac

SEQ ID NO: 286433 - DNA, 20 bp, Artificial Sequence
  Description of Artificial Sequence: Synthetic oligonucleotide
  Target: ATXN1; (+) strand; PAM type: YTN; PAM sequence: TTG
gaggatcactaaatctaaca

SEQ ID NO: 286434 - DNA, 20 bp, Artificial Sequence
  Description of Artificial Sequence: Synthetic oligonucleotide
  Target: ATXN1; (+) strand; PAM type: YTN; PAM sequence: CTA
aatctaacagtgttcactgc

SEQ ID NO: 286435 - DNA, 20 bp, Artificial Sequence
  Description of Artificial Sequence: Synthetic oligonucleotide
  Target: ATXN1; (+) strand; PAM type: YTN; PAM sequence: CTA
acagtgttcactgctgtagt

SEQ ID NO: 286436 - DNA, 20 bp, Artificial Sequence
  Description of Artificial Sequence: Synthetic oligonucleotide
  Target: ATXN1; (+) strand; PAM type: YTN; PAM sequence: TTC
actgctgtagtgttatgaga

SEQ ID NO: 286437 - DNA, 20 bp, Artificial Sequence
  Description of Artificial Sequence: Synthetic oligonucleotide
  Target: ATXN1; (+) strand; PAM type: YTN; PAM sequence: CTG
ctgtagtgttatgagagtgt

SEQ ID NO: 286438 - DNA, 20 bp, Artificial Sequence
  Description of Artificial Sequence: Synthetic oligonucleotide
  Target: ATXN1; (+) strand; PAM type: YTN; PAM sequence: CTG
tagtgttatgagagtgtttc

SEQ ID NO: 286439 - DNA, 20 bp, Artificial Sequence
  Description of Artificial Sequence: Synthetic oligonucleotide
  Target: ATXN1; (+) strand; PAM type: YTN; PAM sequence: TTA
tgagagtgtttcactttcag

SEQ ID NO: 286440 - DNA, 20 bp, Artificial Sequence
  Description of Artificial Sequence: Synthetic oligonucleotide
  Target: ATXN1; (+) strand; PAM type: YTN; PAM sequence: TTT
cactttcaggaaatttcaaa

SEQ ID NO: 286441 - DNA, 20 bp, Artificial Sequence
  Description of Artificial Sequence: Synthetic oligonucleotide
  Target: ATXN1; (+) strand; PAM type: YTN; PAM sequence: TTC
actttcaggaaatttcaaaa

SEQ ID NO: 286442 - DNA, 20 bp, Artificial Sequence
  Description of Artificial Sequence: Synthetic oligonucleotide
  Target: ATXN1; (+) strand; PAM type: YTN; PAM sequence: CTT
tcaggaaatttcaaaaggga

SEQ ID NO: 286443 - DNA, 20 bp, Artificial Sequence
  Description of Artificial Sequence: Synthetic oligonucleotide
  Target: ATXN1; (+) strand; PAM type: YTN; PAM sequence: TTT
caggaaatttcaaaagggaa

SEQ ID NO: 286444 - DNA, 20 bp, Artificial Sequence
  Description of Artificial Sequence: Synthetic oligonucleotide
  Target: ATXN1; (+) strand; PAM type: YTN; PAM sequence: TTC
aggaaatttcaaaagggaaa

SEQ ID NO: 286445 - DNA, 20 bp, Artificial Sequence
  Description of Artificial Sequence: Synthetic oligonucleotide
  Target: ATXN1; (+) strand; PAM type: YTN; PAM sequence: TTT
caaaagggaaaggtgggaaa

SEQ ID NO: 286446 - DNA, 20 bp, Artificial Sequence
  Description of Artificial Sequence: Synthetic oligonucleotide
  Target: ATXN1; (+) strand; PAM type: YTN; PAM sequence: TTC
aaaagggaaaggtgggaaac

SEQ ID NO: 286447 - DNA, 20 bp, Artificial Sequence
  Description of Artificial Sequence: Synthetic oligonucleotide
  Target: ATXN1; (+) strand; PAM type: YTN; PAM sequence: CTA
catggaaatctcacatgtgg

SEQ ID NO: 286448 - DNA, 20 bp, Artificial Sequence
  Description of Artificial Sequence: Synthetic oligonucleotide
  Target: ATXN1; (+) strand; PAM type: YTN; PAM sequence: CTC
acatgtggttcattgcgtct

SEQ ID NO: 286449 - DNA, 20 bp, Artificial Sequence
  Description of Artificial Sequence: Synthetic oligonucleotide
  Target: ATXN1; (+) strand; PAM type: YTN; PAM sequence: TTC
attgcgtcttttttcttaca

SEQ ID NO: 286450 - DNA, 20 bp, Artificial Sequence
  Description of Artificial Sequence: Synthetic oligonucleotide
  Target: ATXN1; (+) strand; PAM type: YTN; PAM sequence: TTG
cgtcttttttcttacacagc

SEQ ID NO: 286451 - DNA, 20 bp, Artificial Sequence
  Description of Artificial Sequence: Synthetic oligonucleotide
  Target: ATXN1; (+) strand; PAM type: YTN; PAM sequence: CTT
ttttcttacacagctgccat

SEQ ID NO: 286452 - DNA, 20 bp, Artificial Sequence
  Description of Artificial Sequence: Synthetic oligonucleotide
  Target: ATXN1; (+) strand; PAM type: YTN; PAM sequence: TTT
tttcttacacagctgccatt

SEQ ID NO: 286453 - DNA, 20 bp, Artificial Sequence
  Description of Artificial Sequence: Synthetic oligonucleotide
  Target: ATXN1; (+) strand; PAM type: YTN; PAM sequence: TTT
ttcttacacagctgccatta

SEQ ID NO: 286454 - DNA, 20 bp, Artificial Sequence
  Description of Artificial Sequence: Synthetic oligonucleotide
  Target: ATXN1; (+) strand; PAM type: YTN; PAM sequence: TTT
tcttacacagctgccattat

SEQ ID NO: 286455 - DNA, 20 bp, Artificial Sequence
  Description of Artificial Sequence: Synthetic oligonucleotide
  Target: ATXN1; (+) strand; PAM type: YTN; PAM sequence: TTT
cttacacagctgccattata

SEQ ID NO: 286456 - DNA, 20 bp, Artificial Sequence
  Description of Artificial Sequence: Synthetic oligonucleotide
  Target: ATXN1; (+) strand; PAM type: YTN; PAM sequence: TTC
ttacacagctgccattatat

SEQ ID NO: 286457 - DNA, 20 bp, Artificial Sequence
  Description of Artificial Sequence: Synthetic oligonucleotide
  Target: ATXN1; (+) strand; PAM type: YTN; PAM sequence: CTT
acacagctgccattatataa

SEQ ID NO: 286458 - DNA, 20 bp, Artificial Sequence
  Description of Artificial Sequence: Synthetic oligonucleotide
  Target: ATXN1; (+) strand; PAM type: YTN; PAM sequence: TTA
cacagctgccattatataat

SEQ ID NO: 286459 - DNA, 20 bp, Artificial Sequence
  Description of Artificial Sequence: Synthetic oligonucleotide
  Target: ATXN1; (+) strand; PAM type: YTN; PAM sequence: CTG
ccattatataattcttggcc

SEQ ID NO: 286460 - DNA, 20 bp, Artificial Sequence
  Description of Artificial Sequence: Synthetic oligonucleotide
  Target: ATXN1; (+) strand; PAM type: YTN; PAM sequence: TTA
tataattcttggccattgtt

SEQ ID NO: 286461 - DNA, 20 bp, Artificial Sequence
  Description of Artificial Sequence: Synthetic oligonucleotide
  Target: ATXN1; (+) strand; PAM type: YTN; PAM sequence: TTC
ttggccattgttttttattt

SEQ ID NO: 286462 - DNA, 20 bp, Artificial Sequence
  Description of Artificial Sequence: Synthetic oligonucleotide
  Target: ATXN1; (+) strand; PAM type: YTN; PAM sequence: CTT
ggccattgttttttatttaa

SEQ ID NO: 286463 - DNA, 20 bp, Artificial Sequence
  Description of Artificial Sequence: Synthetic oligonucleotide
  Target: ATXN1; (+) strand; PAM type: YTN; PAM sequence: TTG
gccattgttttttatttaat

SEQ ID NO: 286464 - DNA, 20 bp, Artificial Sequence
  Description of Artificial Sequence: Synthetic oligonucleotide
  Target: ATXN1; (+) strand; PAM type: YTN; PAM sequence: TTG
ttttttatttaataattaag

SEQ ID NO: 286465 - DNA, 20 bp, Artificial Sequence
  Description of Artificial Sequence: Synthetic oligonucleotide
  Target: ATXN1; (+) strand; PAM type: YTN; PAM sequence: TTT
tttatttaataattaagatg

SEQ ID NO: 286466 - DNA, 20 bp, Artificial Sequence
  Description of Artificial Sequence: Synthetic oligonucleotide
  Target: ATXN1; (+) strand; PAM type: YTN; PAM sequence: TTT
ttatttaataattaagatga

SEQ ID NO: 286467 - DNA, 20 bp, Artificial Sequence
  Description of Artificial Sequence: Synthetic oligonucleotide
  Target: ATXN1; (+) strand; PAM type: YTN; PAM sequence: TTT
tatttaataattaagatgaa

SEQ ID NO: 286468 - DNA, 20 bp, Artificial Sequence
  Description of Artificial Sequence: Synthetic oligonucleotide
  Target: ATXN1; (+) strand; PAM type: YTN; PAM sequence: TTT
atttaataattaagatgaat

SEQ ID NO: 286469 - DNA, 20 bp, Artificial Sequence
  Description of Artificial Sequence: Synthetic oligonucleotide
  Target: ATXN1; (+) strand; PAM type: YTN; PAM sequence: TTA
tttaataattaagatgaata

SEQ ID NO: 286470 - DNA, 20 bp, Artificial Sequence
  Description of Artificial Sequence: Synthetic oligonucleotide
  Target: ATXN1; (+) strand; PAM type: YTN; PAM sequence: TTT
aataattaagatgaataatc

SEQ ID NO: 286471 - DNA, 20 bp, Artificial Sequence
  Description of Artificial Sequence: Synthetic oligonucleotide
  Target: ATXN1; (+) strand; PAM type: YTN; PAM sequence: TTA
ataattaagatgaataatct

SEQ ID NO: 286472 - DNA, 20 bp, Artificial Sequence
  Description of Artificial Sequence: Synthetic oligonucleotide
  Target: ATXN1; (+) strand; PAM type: YTN; PAM sequence: TTA
agatgaataatcttggggtc

SEQ ID NO: 286473 - DNA, 20 bp, Artificial Sequence
  Description of Artificial Sequence: Synthetic oligonucleotide
  Target: ATXN1; (+) strand; PAM type: YTN; PAM sequence: CTT
ggggtcatccattgtatatg

SEQ ID NO: 286474 - DNA, 20 bp, Artificial Sequence
  Description of Artificial Sequence: Synthetic oligonucleotide
  Target: ATXN1; (+) strand; PAM type: YTN; PAM sequence: TTG
gggtcatccattgtatatgt

SEQ ID NO: 286475 - DNA, 20 bp, Artificial Sequence
  Description of Artificial Sequence: Synthetic oligonucleotide
  Target: ATXN1; (+) strand; PAM type: YTN; PAM sequence: TTG
tatatgtatctgtggtaggt

SEQ ID NO: 286476 - DNA, 20 bp, Artificial Sequence
  Description of Artificial Sequence: Synthetic oligonucleotide
  Target: ATXN1; (+) strand; PAM type: YTN; PAM sequence: CTG
tggtaggtttaaaaattcca

SEQ ID NO: 286477 - DNA, 20 bp, Artificial Sequence
  Description of Artificial Sequence: Synthetic oligonucleotide
  Target: ATXN1; (+) strand; PAM type: YTN; PAM sequence: TTT
aaaaattccagttgaccttt

SEQ ID NO: 286478 - DNA, 20 bp, Artificial Sequence
  Description of Artificial Sequence: Synthetic oligonucleotide
  Target: ATXN1; (+) strand; PAM type: YTN; PAM sequence: TTA
aaaattccagttgacctttc

SEQ ID NO: 286479 - DNA, 20 bp, Artificial Sequence
  Description of Artificial Sequence: Synthetic oligonucleotide
  Target: ATXN1; (+) strand; PAM type: YTN; PAM sequence: TTC
cagttgacctttccctagcc

SEQ ID NO: 286480 - DNA, 20 bp, Artificial Sequence
  Description of Artificial Sequence: Synthetic oligonucleotide
  Target: ATXN1; (+) strand; PAM type: YTN; PAM sequence: TTG
acctttccctagcccccagt

SEQ ID NO: 286481 - DNA, 20 bp, Artificial Sequence
  Description of Artificial Sequence: Synthetic oligonucleotide
  Target: ATXN1; (+) strand; PAM type: YTN; PAM sequence: CTT
tccctagcccccagtatact

SEQ ID NO: 286482 - DNA, 20 bp, Artificial Sequence
  Description of Artificial Sequence: Synthetic oligonucleotide
  Target: ATXN1; (+) strand; PAM type: YTN; PAM sequence: TTT
ccctagcccccagtatactt

SEQ ID NO: 286483 - DNA, 20 bp, Artificial Sequence
  Description of Artificial Sequence: Synthetic oligonucleotide
  Target: ATXN1; (+) strand; PAM type: YTN; PAM sequence: TTC
cctagcccccagtatacttt

SEQ ID NO: 286484 - DNA, 20 bp, Artificial Sequence
  Description of Artificial Sequence: Synthetic oligonucleotide
  Target: ATXN1; (+) strand; PAM type: YTN; PAM sequence: CTA
gcccccagtatacttttggg

SEQ ID NO: 286485 - DNA, 20 bp, Artificial Sequence
  Description of Artificial Sequence: Synthetic oligonucleotide
  Target: ATXN1; (+) strand; PAM type: YTN; PAM sequence: CTT
ttgggctacttcctccctaa

SEQ ID NO: 286486 - DNA, 20 bp, Artificial Sequence
  Description of Artificial Sequence: Synthetic oligonucleotide
  Target: ATXN1; (+) strand; PAM type: YTN; PAM sequence: TTT
tgggctacttcctccctaag

SEQ ID NO: 286487 - DNA, 20 bp, Artificial Sequence
  Description of Artificial Sequence: Synthetic oligonucleotide
  Target: ATXN1; (+) strand; PAM type: YTN; PAM sequence: TTT
gggctacttcctccctaaga

SEQ ID NO: 286488 - DNA, 20 bp, Artificial Sequence
  Description of Artificial Sequence: Synthetic oligonucleotide
  Target: ATXN1; (+) strand; PAM type: YTN; PAM sequence: TTG
ggctacttcctccctaagat

SEQ ID NO: 286489 - DNA, 20 bp, Artificial Sequence
  Description of Artificial Sequence: Synthetic oligonucleotide
  Target: ATXN1; (+) strand; PAM type: YTN; PAM sequence: CTA
cttcctccctaagatgagct

SEQ ID NO: 286490 - DNA, 20 bp, Artificial Sequence
  Description of Artificial Sequence: Synthetic oligonucleotide
  Target: ATXN1; (+) strand; PAM type: YTN; PAM sequence: CTT
cctccctaagatgagctatg

SEQ ID NO: 286491 - DNA, 20 bp, Artificial Sequence
  Description of Artificial Sequence: Synthetic oligonucleotide
  Target: ATXN1; (+) strand; PAM type: YTN; PAM sequence: TTC
ctccctaagatgagctatgt

SEQ ID NO: 286492 - DNA, 20 bp, Artificial Sequence
  Description of Artificial Sequence: Synthetic oligonucleotide
  Target: ATXN1; (+) strand; PAM type: YTN; PAM sequence: CTC
cctaagatgagctatgtgca

SEQ ID NO: 286493 - DNA, 20 bp, Artificial Sequence
  Description of Artificial Sequence: Synthetic oligonucleotide
  Target: ATXN1; (+) strand; PAM type: YTN; PAM sequence: CTA
agatgagctatgtgcacaca

SEQ ID NO: 286494 - DNA, 20 bp, Artificial Sequence
  Description of Artificial Sequence: Synthetic oligonucleotide
  Target: ATXN1; (+) strand; PAM type: YTN; PAM sequence: CTA
tgtgcacacatgtggcacaa

SEQ ID NO: 286495 - DNA, 20 bp, Artificial Sequence
  Description of Artificial Sequence: Synthetic oligonucleotide
  Target: ATXN1; (+) strand; PAM type: YTN; PAM sequence: TTT
taatactatctaagcaaaac

SEQ ID NO: 286496 - DNA, 20 bp, Artificial Sequence
  Description of Artificial Sequence: Synthetic oligonucleotide
  Target: ATXN1; (+) strand; PAM type: YTN; PAM sequence: TTT
aatactatctaagcaaaacc

SEQ ID NO: 286497 - DNA, 20 bp, Artificial Sequence
  Description of Artificial Sequence: Synthetic oligonucleotide
  Target: ATXN1; (+) strand; PAM type: YTN; PAM sequence: TTA
atactatctaagcaaaacca

SEQ ID NO: 286498 - DNA, 20 bp, Artificial Sequence
  Description of Artificial Sequence: Synthetic oligonucleotide
  Target: ATXN1; (+) strand; PAM type: YTN; PAM sequence: CTA
tctaagcaaaaccacaaacc

SEQ ID NO: 286499 - DNA, 20 bp, Artificial Sequence
  Description of Artificial Sequence: Synthetic oligonucleotide
  Target: ATXN1; (+) strand; PAM type: YTN; PAM sequence: CTA
agcaaaaccacaaaccaata

SEQ ID NO: 286500 - DNA, 20 bp, Artificial Sequence
  Description of Artificial Sequence: Synthetic oligonucleotide
  Target: ATXN1; (+) strand; PAM type: YTN; PAM sequence: CTT
ctcaaagccaaaggaaatga

SEQ ID NO: 286501 - DNA, 20 bp, Artificial Sequence
  Description of Artificial Sequence: Synthetic oligonucleotide
  Target: ATXN1; (+) strand; PAM type: YTN; PAM sequence: TTC
tcaaagccaaaggaaatgat

SEQ ID NO: 286502 - DNA, 20 bp, Artificial Sequence
  Description of Artificial Sequence: Synthetic oligonucleotide
  Target: ATXN1; (+) strand; PAM type: YTN; PAM sequence: CTC
aaagccaaaggaaatgattt

SEQ ID NO: 286503 - DNA, 20 bp, Artificial Sequence
  Description of Artificial Sequence: Synthetic oligonucleotide
  Target: ATXN1; (+) strand; PAM type: YTN; PAM sequence: TTT
tggagcaacacatcactgat

SEQ ID NO: 286504 - DNA, 20 bp, Artificial Sequence
  Description of Artificial Sequence: Synthetic oligonucleotide
  Target: ATXN1; (+) strand; PAM type: YTN; PAM sequence: TTT
ggagcaacacatcactgatt

SEQ ID NO: 286505 - DNA, 20 bp, Artificial Sequence
  Description of Artificial Sequence: Synthetic oligonucleotide
  Target: ATXN1; (+) strand; PAM type: YTN; PAM sequence: TTG
gagcaacacatcactgatta

SEQ ID NO: 286506 - DNA, 20 bp, Artificial Sequence
  Description of Artificial Sequence: Synthetic oligonucleotide
  Target: ATXN1; (+) strand; PAM type: YTN; PAM sequence: CTG
attacattccattaatacag

SEQ ID NO: 286507 - DNA, 20 bp, Artificial Sequence
  Description of Artificial Sequence: Synthetic oligonucleotide
  Target: ATXN1; (+) strand; PAM type: YTN; PAM sequence: TTA
cattccattaatacagataa

SEQ ID NO: 286508 - DNA, 20 bp, Artificial Sequence
  Description of Artificial Sequence: Synthetic oligonucleotide
  Target: ATXN1; (+) strand; PAM type: YTN; PAM sequence: TTC
cattaatacagataattaaa

SEQ ID NO: 286509 - DNA, 20 bp, Artificial Sequence
  Description of Artificial Sequence: Synthetic oligonucleotide
  Target: ATXN1; (+) strand; PAM type: YTN; PAM sequence: TTA
atacagataattaaaagttg

SEQ ID NO: 286510 - DNA, 20 bp, Artificial Sequence
  Description of Artificial Sequence: Synthetic oligonucleotide
  Target: ATXN1; (+) strand; PAM type: YTN; PAM sequence: TTA
aaagttgactgtataataat

SEQ ID NO: 286511 - DNA, 20 bp, Artificial Sequence
  Description of Artificial Sequence: Synthetic oligonucleotide
  Target: ATXN1; (+) strand; PAM type: YTN; PAM sequence: TTG
actgtataataatgttaaat

SEQ ID NO: 286512 - DNA, 20 bp, Artificial Sequence
  Description of Artificial Sequence: Synthetic oligonucleotide
  Target: ATXN1; (+) strand; PAM type: YTN; PAM sequence: CTG
tataataatgttaaatagca

SEQ ID NO: 286513 - DNA, 20 bp, Artificial Sequence
  Description of Artificial Sequence: Synthetic oligonucleotide
  Target: ATXN1; (+) strand; PAM type: YTN; PAM sequence: TTA
aatagcaggcataacttttt

SEQ ID NO: 286514 - DNA, 20 bp, Artificial Sequence
  Description of Artificial Sequence: Synthetic oligonucleotide
  Target: ATXN1; (+) strand; PAM type: YTN; PAM sequence: CTT
tttttgaaaatttctccgtg

SEQ ID NO: 286515 - DNA, 20 bp, Artificial Sequence
  Description of Artificial Sequence: Synthetic oligonucleotide
  Target: ATXN1; (+) strand; PAM type: YTN; PAM sequence: TTT
ttttgaaaatttctccgtga

SEQ ID NO: 286516 - DNA, 20 bp, Artificial Sequence
  Description of Artificial Sequence: Synthetic oligonucleotide
  Target: ATXN1; (+) strand; PAM type: YTN; PAM sequence: TTT
tttgaaaatttctccgtgat

SEQ ID NO: 286517 - DNA, 20 bp, Artificial Sequence
  Description of Artificial Sequence: Synthetic oligonucleotide
  Target: ATXN1; (+) strand; PAM type: YTN; PAM sequence: TTT
ttgaaaatttctccgtgata

SEQ ID NO: 286518 - DNA, 20 bp, Artificial Sequence
  Description of Artificial Sequence: Synthetic oligonucleotide
  Target: ATXN1; (+) strand; PAM type: YTN; PAM sequence: TTT
tgaaaatttctccgtgatat

SEQ ID NO: 286519 - DNA, 20 bp, Artificial Sequence
  Description of Artificial Sequence: Synthetic oligonucleotide
  Target: ATXN1; (+) strand; PAM type: YTN; PAM sequence: TTT
gaaaatttctccgtgatatt

SEQ ID NO: 286520 - DNA, 20 bp, Artificial Sequence
  Description of Artificial Sequence: Synthetic oligonucleotide
  Target: ATXN1; (+) strand; PAM type: YTN; PAM sequence: TTG
aaaatttctccgtgatatta

SEQ ID NO: 286521 - DNA, 20 bp, Artificial Sequence
  Description of Artificial Sequence: Synthetic oligonucleotide
  Target: ATXN1; (+) strand; PAM type: YTN; PAM sequence: TTT
ctccgtgatattagctatgc

SEQ ID NO: 286522 - DNA, 20 bp, Artificial Sequence
  Description of Artificial Sequence: Synthetic oligonucleotide
  Target: ATXN1; (+) strand; PAM type: YTN; PAM sequence: TTC
tccgtgatattagctatgca

SEQ ID NO: 286523 - DNA, 20 bp, Artificial Sequence
  Description of Artificial Sequence: Synthetic oligonucleotide
  Target: ATXN1; (+) strand; PAM type: YTN; PAM sequence: CTC
cgtgatattagctatgcaaa

SEQ ID NO: 286524 - DNA, 20 bp, Artificial Sequence
  Description of Artificial Sequence: Synthetic oligonucleotide
  Target: ATXN1; (+) strand; PAM type: YTN; PAM sequence: TTA
gctatgcaaaaacactgact

SEQ ID NO: 286525 - DNA, 20 bp, Artificial Sequence
  Description of Artificial Sequence: Synthetic oligonucleotide
  Target: ATXN1; (+) strand; PAM type: YTN; PAM sequence: CTA
tgcaaaaacactgactgaat

SEQ ID NO: 286526 - DNA, 20 bp, Artificial Sequence
  Description of Artificial Sequence: Synthetic oligonucleotide
  Target: ATXN1; (+) strand; PAM type: YTN; PAM sequence: CTG
actgaatgttcaatgctaat

SEQ ID NO: 286527 - DNA, 20 bp, Artificial Sequence
  Description of Artificial Sequence: Synthetic oligonucleotide
  Target: ATXN1; (+) strand; PAM type: YTN; PAM sequence: CTG
aatgttcaatgctaatcaaa

SEQ ID NO: 286528 - DNA, 20 bp, Artificial Sequence
  Description of Artificial Sequence: Synthetic oligonucleotide
  Target: ATXN1; (+) strand; PAM type: YTN; PAM sequence: TTC
aatgctaatcaaattcatct

SEQ ID NO: 286529 - DNA, 20 bp, Artificial Sequence
  Description of Artificial Sequence: Synthetic oligonucleotide
  Target: ATXN1; (+) strand; PAM type: YTN; PAM sequence: CTA
atcaaattcatctcctctta

SEQ ID NO: 286530 - DNA, 20 bp, Artificial Sequence
  Description of Artificial Sequence: Synthetic oligonucleotide
  Target: ATXN1; (+) strand; PAM type: YTN; PAM sequence: TTC
atctcctcttaagagcagcg

SEQ ID NO: 286531 - DNA, 20 bp, Artificial Sequence
  Description of Artificial Sequence: Synthetic oligonucleotide
  Target: ATXN1; (+) strand; PAM type: YTN; PAM sequence: CTC
ctcttaagagcagcgtataa

SEQ ID NO: 286532 - DNA, 20 bp, Artificial Sequence
  Description of Artificial Sequence: Synthetic oligonucleotide
  Target: ATXN1; (+) strand; PAM type: YTN; PAM sequence: CTC
ttaagagcagcgtataataa

SEQ ID NO: 286533 - DNA, 20 bp, Artificial Sequence
  Description of Artificial Sequence: Synthetic oligonucleotide
  Target: ATXN1; (+) strand; PAM type: YTN; PAM sequence: CTT
aagagcagcgtataataaat

SEQ ID NO: 286534 - DNA, 20 bp, Artificial Sequence
  Description of Artificial Sequence: Synthetic oligonucleotide
  Target: ATXN1; (+) strand; PAM type: YTN; PAM sequence: TTA
agagcagcgtataataaatg

SEQ ID NO: 286535 - DNA, 20 bp, Artificial Sequence
  Description of Artificial Sequence: Synthetic oligonucleotide
  Target: ATXN1; (+) strand; PAM type: YTN; PAM sequence: CTA
aaaggaatgctttgaacaga

SEQ ID NO: 286536 - DNA, 20 bp, Artificial Sequence
  Description of Artificial Sequence: Synthetic oligonucleotide
  Target: ATXN1; (+) strand; PAM type: YTN; PAM sequence: CTT
tgaacagaatgcttcactat

SEQ ID NO: 286537 - DNA, 20 bp, Artificial Sequence
  Description of Artificial Sequence: Synthetic oligonucleotide
  Target: ATXN1; (+) strand; PAM type: YTN; PAM sequence: TTT
gaacagaatgcttcactatt

SEQ ID NO: 286538 - DNA, 20 bp, Artificial Sequence
  Description of Artificial Sequence: Synthetic oligonucleotide
  Target: ATXN1; (+) strand; PAM type: YTN; PAM sequence: TTG
aacagaatgcttcactattg

SEQ ID NO: 286539 - DNA, 20 bp, Artificial Sequence
  Description of Artificial Sequence: Synthetic oligonucleotide
  Target: ATXN1; (+) strand; PAM type: YTN; PAM sequence: CTT
cactattgtctgattattct

SEQ ID NO: 286540 - DNA, 20 bp, Artificial Sequence
  Description of Artificial Sequence: Synthetic oligonucleotide
  Target: ATXN1; (+) strand; PAM type: YTN; PAM sequence: TTC
actattgtctgattattcta

SEQ ID NO: 286541 - DNA, 20 bp, Artificial Sequence
  Description of Artificial Sequence: Synthetic oligonucleotide
  Target: ATXN1; (+) strand; PAM type: YTN; PAM sequence: CTA
ttgtctgattattctaaatt

SEQ ID NO: 286542 - DNA, 20 bp, Artificial Sequence
  Description of Artificial Sequence: Synthetic oligonucleotide
  Target: ATXN1; (+) strand; PAM type: YTN; PAM sequence: TTG
tctgattattctaaatttaa

SEQ ID NO: 286543 - DNA, 20 bp, Artificial Sequence
  Description of Artificial Sequence: Synthetic oligonucleotide
  Target: ATXN1; (+) strand; PAM type: YTN; PAM sequence: CTG
attattctaaatttaaaact

SEQ ID NO: 286544 - DNA, 20 bp, Artificial Sequence
  Description of Artificial Sequence: Synthetic oligonucleotide
  Target: ATXN1; (+) strand; PAM type: YTN; PAM sequence: TTA
ttctaaatttaaaactccaa

SEQ ID NO: 286545 - DNA, 20 bp, Artificial Sequence
  Description of Artificial Sequence: Synthetic oligonucleotide
  Target: ATXN1; (+) strand; PAM type: YTN; PAM sequence: TTC
taaatttaaaactccaacaa

SEQ ID NO: 286546 - DNA, 20 bp, Artificial Sequence
  Description of Artificial Sequence: Synthetic oligonucleotide
  Target: ATXN1; (+) strand; PAM type: YTN; PAM sequence: CTA
aatttaaaactccaacaaag

SEQ ID NO: 286547 - DNA, 20 bp, Artificial Sequence
  Description of Artificial Sequence: Synthetic oligonucleotide
  Target: ATXN1; (+) strand; PAM type: YTN; PAM sequence: TTT
aaaactccaacaaaggaaag

SEQ ID NO: 286548 - DNA, 20 bp, Artificial Sequence
  Description of Artificial Sequence: Synthetic oligonucleotide
  Target: ATXN1; (+) strand; PAM type: YTN; PAM sequence: TTA
aaactccaacaaaggaaagg

SEQ ID NO: 286549 - DNA, 20 bp, Artificial Sequence
  Description of Artificial Sequence: Synthetic oligonucleotide
  Target: ATXN1; (+) strand; PAM type: YTN; PAM sequence: CTC
caacaaaggaaaggattatt

SEQ ID NO: 286550 - DNA, 20 bp, Artificial Sequence
  Description of Artificial Sequence: Synthetic oligonucleotide
  Target: ATXN1; (+) strand; PAM type: YTN; PAM sequence: TTA
ttcttctaaggttcaagatt

SEQ ID NO: 286551 - DNA, 20 bp, Artificial Sequence
  Description of Artificial Sequence: Synthetic oligonucleotide
  Target: ATXN1; (+) strand; PAM type: YTN; PAM sequence: TTC
ttctaaggttcaagattcgt

SEQ ID NO: 286552 - DNA, 20 bp, Artificial Sequence
  Description of Artificial Sequence: Synthetic oligonucleotide
  Target: ATXN1; (+) strand; PAM type: YTN; PAM sequence: CTT
ctaaggttcaagattcgtga

SEQ ID NO: 286553 - DNA, 20 bp, Artificial Sequence
  Description of Artificial Sequence: Synthetic oligonucleotide
  Target: ATXN1; (+) strand; PAM type: YTN; PAM sequence: TTC
taaggttcaagattcgtgag

SEQ ID NO: 286554 - DNA, 20 bp, Artificial Sequence
  Description of Artificial Sequence: Synthetic oligonucleotide
  Target: ATXN1; (+) strand; PAM type: YTN; PAM sequence: CTA
aggttcaagattcgtgagga

SEQ ID NO: 286555 - DNA, 20 bp, Artificial Sequence
  Description of Artificial Sequence: Synthetic oligonucleotide
  Target: ATXN1; (+) strand; PAM type: YTN; PAM sequence: TTC
aagattcgtgaggatttggt

SEQ ID NO: 286556 - DNA, 20 bp, Artificial Sequence
  Description of Artificial Sequence: Synthetic oligonucleotide
  Target: ATXN1; (+) strand; PAM type: YTN; PAM sequence: TTC
gtgaggatttggtaacgaaa

SEQ ID NO: 286557 - DNA, 20 bp, Artificial Sequence
  Description of Artificial Sequence: Synthetic oligonucleotide
  Target: ATXN1; (+) strand; PAM type: YTN; PAM sequence: TTT
ggtaacgaaattccttaagg

SEQ ID NO: 286558 - DNA, 20 bp, Artificial Sequence
  Description of Artificial Sequence: Synthetic oligonucleotide
  Target: ATXN1; (+) strand; PAM type: YTN; PAM sequence: TTG
gtaacgaaattccttaagga

SEQ ID NO: 286559 - DNA, 20 bp, Artificial Sequence
  Description of Artificial Sequence: Synthetic oligonucleotide
  Target: ATXN1; (+) strand; PAM type: YTN; PAM sequence: TTC
cttaaggacagcaaattaaa

SEQ ID NO: 286560 - DNA, 20 bp, Artificial Sequence
  Description of Artificial Sequence: Synthetic oligonucleotide
  Target: ATXN1; (+) strand; PAM type: YTN; PAM sequence: CTT
aaggacagcaaattaaaaaa

SEQ ID NO: 286561 - DNA, 20 bp, Artificial Sequence
  Description of Artificial Sequence: Synthetic oligonucleotide
  Target: ATXN1; (+) strand; PAM type: YTN; PAM sequence: TTA
aggacagcaaattaaaaaat

SEQ ID NO: 286562 - DNA, 20 bp, Artificial Sequence
  Description of Artificial Sequence: Synthetic oligonucleotide
  Target: ATXN1; (+) strand; PAM type: YTN; PAM sequence: TTA
aaaaattgctatctacaagc

SEQ ID NO: 286563 - DNA, 20 bp, Artificial Sequence
  Description of Artificial Sequence: Synthetic oligonucleotide
  Target: ATXN1; (+) strand; PAM type: YTN; PAM sequence: TTG
ctatctacaagctgccacta

SEQ ID NO: 286564 - DNA, 20 bp, Artificial Sequence
  Description of Artificial Sequence: Synthetic oligonucleotide
  Target: ATXN1; (+) strand; PAM type: YTN; PAM sequence: CTA
tctacaagctgccactattt

SEQ ID NO: 286565 - DNA, 20 bp, Artificial Sequence
  Description of Artificial Sequence: Synthetic oligonucleotide
  Target: ATXN1; (+) strand; PAM type: YTN; PAM sequence: CTA
caagctgccactattttatg

SEQ ID NO: 286566 - DNA, 20 bp, Artificial Sequence
  Description of Artificial Sequence: Synthetic oligonucleotide
  Target: ATXN1; (+) strand; PAM type: YTN; PAM sequence: CTG
ccactattttatgtctgtat

SEQ ID NO: 286567 - DNA, 20 bp, Artificial Sequence
  Description of Artificial Sequence: Synthetic oligonucleotide
  Target: ATXN1; (+) strand; PAM type: YTN; PAM sequence: CTA
ttttatgtctgtatagtgtt

SEQ ID NO: 286568 - DNA, 20 bp, Artificial Sequence
  Description of Artificial Sequence: Synthetic oligonucleotide
  Target: ATXN1; (+) strand; PAM type: YTN; PAM sequence: TTT
tatgtctgtatagtgtttta

SEQ ID NO: 286569 - DNA, 20 bp, Artificial Sequence
  Description of Artificial Sequence: Synthetic oligonucleotide
  Target: ATXN1; (+) strand; PAM type: YTN; PAM sequence: TTT
atgtctgtatagtgttttaa

SEQ ID NO: 286570 - DNA, 20 bp, Artificial Sequence
  Description of Artificial Sequence: Synthetic oligonucleotide
  Target: ATXN1; (+) strand; PAM type: YTN; PAM sequence: TTA
tgtctgtatagtgttttaaa

SEQ ID NO: 286571 - DNA, 20 bp, Artificial Sequence
  Description of Artificial Sequence: Synthetic oligonucleotide
  Target: ATXN1; (+) strand; PAM type: YTN; PAM sequence: CTG
tatagtgttttaaaatcaaa

SEQ ID NO: 286572 - DNA, 20 bp, Artificial Sequence
  Description of Artificial Sequence: Synthetic oligonucleotide
  Target: ATXN1; (+) strand; PAM type: YTN; PAM sequence: TTT
taaaatcaaagtcactaccc

SEQ ID NO: 286573 - DNA, 20 bp, Artificial Sequence
  Description of Artificial Sequence: Synthetic oligonucleotide
  Target: ATXN1; (+) strand; PAM type: YTN; PAM sequence: TTT
aaaatcaaagtcactaccca

SEQ ID NO: 286574 - DNA, 20 bp, Artificial Sequence
  Description of Artificial Sequence: Synthetic oligonucleotide
  Target: ATXN1; (+) strand; PAM type: YTN; PAM sequence: TTA
aaatcaaagtcactacccat

SEQ ID NO: 286575 - DNA, 20 bp, Artificial Sequence
  Description of Artificial Sequence: Synthetic oligonucleotide
  Target: ATXN1; (+) strand; PAM type: YTN; PAM sequence: CTA
cccattcaacaacaaatgtt

SEQ ID NO: 286576 - DNA, 20 bp, Artificial Sequence
  Description of Artificial Sequence: Synthetic oligonucleotide
  Target: ATXN1; (+) strand; PAM type: YTN; PAM sequence: TTC
aacaacaaatgtttgtttgg

SEQ ID NO: 286577 - DNA, 20 bp, Artificial Sequence
  Description of Artificial Sequence: Synthetic oligonucleotide
  Target: ATXN1; (+) strand; PAM type: YTN; PAM sequence: TTT
gtttggaataaatgaatgaa

SEQ ID NO: 286578 - DNA, 20 bp, Artificial Sequence
  Description of Artificial Sequence: Synthetic oligonucleotide
  Target: ATXN1; (+) strand; PAM type: YTN; PAM sequence: TTG
tttggaataaatgaatgaaa

SEQ ID NO: 286579 - DNA, 20 bp, Artificial Sequence
  Description of Artificial Sequence: Synthetic oligonucleotide
  Target: ATXN1; (+) strand; PAM type: YTN; PAM sequence: TTT
ggaataaatgaatgaaagaa

SEQ ID NO: 286580 - DNA, 20 bp, Artificial Sequence
  Description of Artificial Sequence: Synthetic oligonucleotide
  Target: ATXN1; (+) strand; PAM type: YTN; PAM sequence: TTG
gaataaatgaatgaaagaaa

SEQ ID NO: 286581 - DNA, 20 bp, Artificial Sequence
  Description of Artificial Sequence: Synthetic oligonucleotide
  Target: ATXN1; (+) strand; PAM type: YTN; PAM sequence: CTC
aaaatactttacaagtttaa

SEQ ID NO: 286582 - DNA, 20 bp, Artificial Sequence
  Description of Artificial Sequence: Synthetic oligonucleotide
  Target: ATXN1; (+) strand; PAM type: YTN; PAM sequence: CTT
tacaagtttaatcacctata

SEQ ID NO: 286583 - DNA, 20 bp, Artificial Sequence
  Description of Artificial Sequence: Synthetic oligonucleotide
  Target: ATXN1; (+) strand; PAM type: YTN; PAM sequence: TTT
acaagtttaatcacctataa

SEQ ID NO: 286584 - DNA, 20 bp, Artificial Sequence
  Description of Artificial Sequence: Synthetic oligonucleotide
  Target: ATXN1; (+) strand; PAM type: YTN; PAM sequence: TTA
caagtttaatcacctataag

SEQ ID NO: 286585 - DNA, 20 bp, Artificial Sequence
  Description of Artificial Sequence: Synthetic oligonucleotide
  Target: ATXN1; (+) strand; PAM type: YTN; PAM sequence: TTT
aatcacctataagttatgaa

SEQ ID NO: 286586 - DNA, 20 bp, Artificial Sequence
  Description of Artificial Sequence: Synthetic oligonucleotide
  Target: ATXN1; (+) strand; PAM type: YTN; PAM sequence: TTA
atcacctataagttatgaat

SEQ ID NO: 286587 - DNA, 20 bp, Artificial Sequence
  Description of Artificial Sequence: Synthetic oligonucleotide
  Target: ATXN1; (+) strand; PAM type: YTN; PAM sequence: CTA
taagttatgaattaggcagc

SEQ ID NO: 286588 - DNA, 20 bp, Artificial Sequence
  Description of Artificial Sequence: Synthetic oligonucleotide
  Target: ATXN1; (+) strand; PAM type: YTN; PAM sequence: TTA
tgaattaggcagcaacttca

SEQ ID NO: 286589 - DNA, 20 bp, Artificial Sequence
  Description of Artificial Sequence: Synthetic oligonucleotide
  Target: ATXN1; (+) strand; PAM type: YTN; PAM sequence: TTA
ggcagcaacttcaatcattc

SEQ ID NO: 286590 - DNA, 20 bp, Artificial Sequence
  Description of Artificial Sequence: Synthetic oligonucleotide
  Target: ATXN1; (+) strand; PAM type: YTN; PAM sequence: CTT
caatcattcccaaatgattg

SEQ ID NO: 286591 - DNA, 20 bp, Artificial Sequence
  Description of Artificial Sequence: Synthetic oligonucleotide
  Target: ATXN1; (+) strand; PAM type: YTN; PAM sequence: TTC
aatcattcccaaatgattga

SEQ ID NO: 286592 - DNA, 20 bp, Artificial Sequence
  Description of Artificial Sequence: Synthetic oligonucleotide
  Target: ATXN1; (+) strand; PAM type: YTN; PAM sequence: TTC
ccaaatgattgaatcattta

SEQ ID NO: 286593 - DNA, 20 bp, Artificial Sequence
  Description of Artificial Sequence: Synthetic oligonucleotide
  Target: ATXN1; (+) strand; PAM type: YTN; PAM sequence: TTG
aatcatttacctcgctgggg

SEQ ID NO: 286594 - DNA, 20 bp, Artificial Sequence
  Description of Artificial Sequence: Synthetic oligonucleotide
  Target: ATXN1; (+) strand; PAM type: YTN; PAM sequence: TTT
acctcgctggggtaaggtat

SEQ ID NO: 286595 - DNA, 20 bp, Artificial Sequence
  Description of Artificial Sequence: Synthetic oligonucleotide
  Target: ATXN1; (+) strand; PAM type: YTN; PAM sequence: TTA
cctcgctggggtaaggtata

SEQ ID NO: 286596 - DNA, 20 bp, Artificial Sequence
  Description of Artificial Sequence: Synthetic oligonucleotide
  Target: ATXN1; (+) strand; PAM type: YTN; PAM sequence: CTC
gctggggtaaggtatatgtc

SEQ ID NO: 286597 - DNA, 20 bp, Artificial Sequence
  Description of Artificial Sequence: Synthetic oligonucleotide
  Target: ATXN1; (+) strand; PAM type: YTN; PAM sequence: CTG
gggtaaggtatatgtctggc

SEQ ID NO: 286598 - DNA, 20 bp, Artificial Sequence
  Description of Artificial Sequence: Synthetic oligonucleotide
  Target: ATXN1; (+) strand; PAM type: YTN; PAM sequence: CTG
gcaagccaaagccagaacta

SEQ ID NO: 286599 - DNA, 20 bp, Artificial Sequence
  Description of Artificial Sequence: Synthetic oligonucleotide
  Target: ATXN1; (+) strand; PAM type: YTN; PAM sequence: CTA
gaaactcaagtaattccttt

SEQ ID NO: 286600 - DNA, 20 bp, Artificial Sequence
  Description of Artificial Sequence: Synthetic oligonucleotide
  Target: ATXN1; (+) strand; PAM type: YTN; PAM sequence: CTC
aagtaattcctttgattctt

SEQ ID NO: 286601 - DNA, 20 bp, Artificial Sequence
  Description of Artificial Sequence: Synthetic oligonucleotide
  Target: ATXN1; (+) strand; PAM type: YTN; PAM sequence: TTC
ctttgattcttagaaaatga

SEQ ID NO: 286602 - DNA, 20 bp, Artificial Sequence
  Description of Artificial Sequence: Synthetic oligonucleotide
  Target: ATXN1; (+) strand; PAM type: YTN; PAM sequence: CTT
tgattcttagaaaatgacgc

SEQ ID NO: 286603 - DNA, 20 bp, Artificial Sequence
  Description of Artificial Sequence: Synthetic oligonucleotide
  Target: ATXN1; (+) strand; PAM type: YTN; PAM sequence: TTT
gattcttagaaaatgacgca

SEQ ID NO: 286604 - DNA, 20 bp, Artificial Sequence
  Description of Artificial Sequence: Synthetic oligonucleotide
  Target: ATXN1; (+) strand; PAM type: YTN; PAM sequence: TTG
attcttagaaaatgacgcag

SEQ ID NO: 286605 - DNA, 20 bp, Artificial Sequence
  Description of Artificial Sequence: Synthetic oligonucleotide
  Target: ATXN1; (+) strand; PAM type: YTN; PAM sequence: TTC
ttagaaaatgacgcagttgt

SEQ ID NO: 286606 - DNA, 20 bp, Artificial Sequence
  Description of Artificial Sequence: Synthetic oligonucleotide
  Target: ATXN1; (+) strand; PAM type: YTN; PAM sequence: CTT
agaaaatgacgcagttgtta

SEQ ID NO: 286607 - DNA, 20 bp, Artificial Sequence
  Description of Artificial Sequence: Synthetic oligonucleotide
  Target: ATXN1; (+) strand; PAM type: YTN; PAM sequence: TTA
gaaaatgacgcagttgttag

SEQ ID NO: 286608 - DNA, 20 bp, Artificial Sequence
  Description of Artificial Sequence: Synthetic oligonucleotide
  Target: ATXN1; (+) strand; PAM type: YTN; PAM sequence: TTG
ttagagctggttgcctgctg

SEQ ID NO: 286609 - DNA, 20 bp, Artificial Sequence
  Description of Artificial Sequence: Synthetic oligonucleotide
  Target: ATXN1; (+) strand; PAM type: YTN; PAM sequence: TTA
gagctggttgcctgctgcag

SEQ ID NO: 286610 - DNA, 20 bp, Artificial Sequence
  Description of Artificial Sequence: Synthetic oligonucleotide
  Target: ATXN1; (+) strand; PAM type: YTN; PAM sequence: CTG
gttgcctgctgcagttgtct

SEQ ID NO: 286611 - DNA, 20 bp, Artificial Sequence
  Description of Artificial Sequence: Synthetic oligonucleotide
  Target: ATXN1; (+) strand; PAM type: YTN; PAM sequence: TTG
cctgctgcagttgtcttcct

SEQ ID NO: 286612 - DNA, 20 bp, Artificial Sequence
  Description of Artificial Sequence: Synthetic oligonucleotide
  Target: ATXN1; (+) strand; PAM type: YTN; PAM sequence: CTG
ctgcagttgtcttcctgtgt

SEQ ID NO: 286613 - DNA, 20 bp, Artificial Sequence
  Description of Artificial Sequence: Synthetic oligonucleotide
  Target: ATXN1; (+) strand; PAM type: YTN; PAM sequence: CTG
cagttgtcttcctgtgtact

SEQ ID NO: 286614 - DNA, 20 bp, Artificial Sequence
  Description of Artificial Sequence: Synthetic oligonucleotide
  Target: ATXN1; (+) strand; PAM type: YTN; PAM sequence: TTG
tcttcctgtgtactctcaat

SEQ ID NO: 286615 - DNA, 20 bp, Artificial Sequence
  Description of Artificial Sequence: Synthetic oligonucleotide
  Target: ATXN1; (+) strand; PAM type: YTN; PAM sequence: CTT
cctgtgtactctcaatacaa

SEQ ID NO: 286616 - DNA, 20 bp, Artificial Sequence
  Description of Artificial Sequence: Synthetic oligonucleotide
  Target: ATXN1; (+) strand; PAM type: YTN; PAM sequence: TTC
ctgtgtactctcaatacaat

SEQ ID NO: 286617 - DNA, 20 bp, Artificial Sequence
  Description of Artificial Sequence: Synthetic oligonucleotide
  Target: ATXN1; (+) strand; PAM type: YTN; PAM sequence: CTG
tgtactctcaatacaatttg

SEQ ID NO: 286618 - DNA, 20 bp, Artificial Sequence
  Description of Artificial Sequence: Synthetic oligonucleotide
  Target: ATXN1; (+) strand; PAM type: YTN; PAM sequence: CTC
tcaatacaatttggaaggca

SEQ ID NO: 286619 - DNA, 20 bp, Artificial Sequence
  Description of Artificial Sequence: Synthetic oligonucleotide
  Target: ATXN1; (+) strand; PAM type: YTN; PAM sequence: CTC
aatacaatttggaaggcatg

SEQ ID NO: 286620 - DNA, 20 bp, Artificial Sequence
  Description of Artificial Sequence: Synthetic oligonucleotide
  Target: ATXN1; (+) strand; PAM type: YTN; PAM sequence: TTT
ggaaggcatgttatctaggc

SEQ ID NO: 286621 - DNA, 20 bp, Artificial Sequence
  Description of Artificial Sequence: Synthetic oligonucleotide
  Target: ATXN1; (+) strand; PAM type: YTN; PAM sequence: TTG
gaaggcatgttatctaggct

SEQ ID NO: 286622 - DNA, 20 bp, Artificial Sequence
  Description of Artificial Sequence: Synthetic oligonucleotide
  Target: ATXN1; (+) strand; PAM type: YTN; PAM sequence: TTA
tctaggctaggggaggtaat

SEQ ID NO: 286623 - DNA, 20 bp, Artificial Sequence
  Description of Artificial Sequence: Synthetic oligonucleotide
  Target: ATXN1; (+) strand; PAM type: YTN; PAM sequence: CTA
ggctaggggaggtaataaca

SEQ ID NO: 286624 - DNA, 20 bp, Artificial Sequence
  Description of Artificial Sequence: Synthetic oligonucleotide
  Target: ATXN1; (+) strand; PAM type: YTN; PAM sequence: CTA
ggggaggtaataacaaagga

SEQ ID NO: 286625 - DNA, 20 bp, Artificial Sequence
  Description of Artificial Sequence: Synthetic oligonucleotide
  Target: ATXN1; (+) strand; PAM type: YTN; PAM sequence: TTA
ggcttgctcctgaaattata

SEQ ID NO: 286626 - DNA, 20 bp, Artificial Sequence
  Description of Artificial Sequence: Synthetic oligonucleotide
  Target: ATXN1; (+) strand; PAM type: YTN; PAM sequence: CTT
gctcctgaaattatacgggt

SEQ ID NO: 286627 - DNA, 20 bp, Artificial Sequence
  Description of Artificial Sequence: Synthetic oligonucleotide
  Target: ATXN1; (+) strand; PAM type: YTN; PAM sequence: TTG
ctcctgaaattatacgggta

SEQ ID NO: 286628 - DNA, 20 bp, Artificial Sequence
  Description of Artificial Sequence: Synthetic oligonucleotide
  Target: ATXN1; (+) strand; PAM type: YTN; PAM sequence: CTC
ctgaaattatacgggtagtc

SEQ ID NO: 286629 - DNA, 20 bp, Artificial Sequence
  Description of Artificial Sequence: Synthetic oligonucleotide
  Target: ATXN1; (+) strand; PAM type: YTN; PAM sequence: CTG
aaattatacgggtagtcaaa

SEQ ID NO: 286630 - DNA, 20 bp, Artificial Sequence
  Description of Artificial Sequence: Synthetic oligonucleotide
  Target: ATXN1; (+) strand; PAM type: YTN; PAM sequence: TTA
tacgggtagtcaaaaaaacg

SEQ ID NO: 286631 - DNA, 20 bp, Artificial Sequence
  Description of Artificial Sequence: Synthetic oligonucleotide
  Target: ATXN1; (+) strand; PAM type: YTN; PAM sequence: CTA
ctaagctatgtgatgggtac

SEQ ID NO: 286632 - DNA, 20 bp, Artificial Sequence
  Description of Artificial Sequence: Synthetic oligonucleotide
  Target: ATXN1; (+) strand; PAM type: YTN; PAM sequence: CTA
agctatgtgatgggtaccta

SEQ ID NO: 286633 - DNA, 20 bp, Artificial Sequence
  Description of Artificial Sequence: Synthetic oligonucleotide
  Target: ATXN1; (+) strand; PAM type: YTN; PAM sequence: CTA
tgtgatgggtacctagctgg

SEQ ID NO: 286634 - DNA, 20 bp, Artificial Sequence
  Description of Artificial Sequence: Synthetic oligonucleotide
  Target: ATXN1; (+) strand; PAM type: YTN; PAM sequence: CTA
gctggtaaaaggtgtttcca

SEQ ID NO: 286635 - DNA, 20 bp, Artificial Sequence
  Description of Artificial Sequence: Synthetic oligonucleotide
  Target: ATXN1; (+) strand; PAM type: YTN; PAM sequence: CTG
gtaaaaggtgtttccaagac

SEQ ID NO: 286636 - DNA, 20 bp, Artificial Sequence
  Description of Artificial Sequence: Synthetic oligonucleotide
  Target: ATXN1; (+) strand; PAM type: YTN; PAM sequence: TTT
ccaagaccggatctaagtta

SEQ ID NO: 286637 - DNA, 20 bp, Artificial Sequence
  Description of Artificial Sequence: Synthetic oligonucleotide
  Target: ATXN1; (+) strand; PAM type: YTN; PAM sequence: TTC
caagaccggatctaagttat

SEQ ID NO: 286638 - DNA, 20 bp, Artificial Sequence
  Description of Artificial Sequence: Synthetic oligonucleotide
  Target: ATXN1; (+) strand; PAM type: YTN; PAM sequence: CTA
agttatttcataggtaactt

SEQ ID NO: 286639 - DNA, 20 bp, Artificial Sequence
  Description of Artificial Sequence: Synthetic oligonucleotide
  Target: ATXN1; (+) strand; PAM type: YTN; PAM sequence: TTA
tttcataggtaactttagaa

SEQ ID NO: 286640 - DNA, 20 bp, Artificial Sequence
  Description of Artificial Sequence: Synthetic oligonucleotide
  Target: ATXN1; (+) strand; PAM type: YTN; PAM sequence: TTT
cataggtaactttagaaagc

SEQ ID NO: 286641 - DNA, 20 bp, Artificial Sequence
  Description of Artificial Sequence: Synthetic oligonucleotide
  Target: ATXN1; (+) strand; PAM type: YTN; PAM sequence: TTC
ataggtaactttagaaagca

SEQ ID NO: 286642 - DNA, 20 bp, Artificial Sequence
  Description of Artificial Sequence: Synthetic oligonucleotide
  Target: ATXN1; (+) strand; PAM type: YTN; PAM sequence: CTT
tagaaagcacgtcccaacgt

SEQ ID NO: 286643 - DNA, 20 bp, Artificial Sequence
  Description of Artificial Sequence: Synthetic oligonucleotide
  Target: ATXN1; (+) strand; PAM type: YTN; PAM sequence: TTT
agaaagcacgtcccaacgtg

SEQ ID NO: 286644 - DNA, 20 bp, Artificial Sequence
  Description of Artificial Sequence: Synthetic oligonucleotide
  Target: ATXN1; (+) strand; PAM type: YTN; PAM sequence: TTA
gaaagcacgtcccaacgtgg

SEQ ID NO: 286645 - DNA, 20 bp, Artificial Sequence
  Description of Artificial Sequence: Synthetic oligonucleotide
  Target: ATXN1; (+) strand; PAM type: YTN; PAM sequence: TTA
aattcatgtgtaatttcaaa

SEQ ID NO: 286646 - DNA, 20 bp, Artificial Sequence
  Description of Artificial Sequence: Synthetic oligonucleotide
  Target: ATXN1; (+) strand; PAM type: YTN; PAM sequence: TTC
atgtgtaatttcaaaatagg

SEQ ID NO: 286647 - DNA, 20 bp, Artificial Sequence
  Description of Artificial Sequence: Synthetic oligonucleotide
  Target: ATXN1; (+) strand; PAM type: YTN; PAM sequence: TTT
caaaatagggtatcagtgta

SEQ ID NO: 286648 - DNA, 20 bp, Artificial Sequence
  Description of Artificial Sequence: Synthetic oligonucleotide
  Target: ATXN1; (+) strand; PAM type: YTN; PAM sequence: TTC
aaaatagggtatcagtgtat

SEQ ID NO: 286649 - DNA, 20 bp, Artificial Sequence
  Description of Artificial Sequence: Synthetic oligonucleotide
  Target: ATXN1; (+) strand; PAM type: YTN; PAM sequence: CTA
agttatgtgacacagagcat

SEQ ID NO: 286650 - DNA, 20 bp, Artificial Sequence
  Description of Artificial Sequence: Synthetic oligonucleotide
  Target: ATXN1; (+) strand; PAM type: YTN; PAM sequence: TTA
tgtgacacagagcatttagc

SEQ ID NO: 286651 - DNA, 20 bp, Artificial Sequence
  Description of Artificial Sequence: Synthetic oligonucleotide
  Target: ATXN1; (+) strand; PAM type: YTN; PAM sequence: TTT
agcctacatcaaaagctaaa

SEQ ID NO: 286652 - DNA, 20 bp, Artificial Sequence
  Description of Artificial Sequence: Synthetic oligonucleotide
  Target: ATXN1; (+) strand; PAM type: YTN; PAM sequence: TTA
gcctacatcaaaagctaaaa

SEQ ID NO: 286653 - DNA, 20 bp, Artificial Sequence
  Description of Artificial Sequence: Synthetic oligonucleotide
  Target: ATXN1; (+) strand; PAM type: YTN; PAM sequence: CTA
catcaaaagctaaaactgaa

SEQ ID NO: 286654 - DNA, 20 bp, Artificial Sequence
  Description of Artificial Sequence: Synthetic oligonucleotide
  Target: ATXN1; (+) strand; PAM type: YTN; PAM sequence: CTA
aaactgaaaaatgaaattct

SEQ ID NO: 286655 - DNA, 20 bp, Artificial Sequence
  Description of Artificial Sequence: Synthetic oligonucleotide
  Target: ATXN1; (+) strand; PAM type: YTN; PAM sequence: CTG
aaaaatgaaattcttattta

SEQ ID NO: 286656 - DNA, 20 bp, Artificial Sequence
  Description of Artificial Sequence: Synthetic oligonucleotide
  Target: ATXN1; (+) strand; PAM type: YTN; PAM sequence: TTC
ttatttaagtatgttgctat

SEQ ID NO: 286657 - DNA, 20 bp, Artificial Sequence
  Description of Artificial Sequence: Synthetic oligonucleotide
  Target: ATXN1; (+) strand; PAM type: YTN; PAM sequence: CTT
atttaagtatgttgctatct

SEQ ID NO: 286658 - DNA, 20 bp, Artificial Sequence
  Description of Artificial Sequence: Synthetic oligonucleotide
  Target: ATXN1; (+) strand; PAM type: YTN; PAM sequence: TTA
tttaagtatgttgctatctt

SEQ ID NO: 286659 - DNA, 20 bp, Artificial Sequence
  Description of Artificial Sequence: Synthetic oligonucleotide
  Target: ATXN1; (+) strand; PAM type: YTN; PAM sequence: TTT
aagtatgttgctatcttcac

SEQ ID NO: 286660 - DNA, 20 bp, Artificial Sequence
  Description of Artificial Sequence: Synthetic oligonucleotide
  Target: ATXN1; (+) strand; PAM type: YTN; PAM sequence: TTA
agtatgttgctatcttcact

SEQ ID NO: 286661 - DNA, 20 bp, Artificial Sequence
  Description of Artificial Sequence: Synthetic oligonucleotide
  Target: ATXN1; (+) strand; PAM type: YTN; PAM sequence: TTG
ctatcttcactctaatgaga

SEQ ID NO: 286662 - DNA, 20 bp, Artificial Sequence
  Description of Artificial Sequence: Synthetic oligonucleotide
  Target: ATXN1; (+) strand; PAM type: YTN; PAM sequence: CTA
tcttcactctaatgagatac

SEQ ID NO: 286663 - DNA, 20 bp, Artificial Sequence
  Description of Artificial Sequence: Synthetic oligonucleotide
  Target: ATXN1; (+) strand; PAM type: YTN; PAM sequence: CTT
cactctaatgagatacgtgg

SEQ ID NO: 286664 - DNA, 20 bp, Artificial Sequence
  Description of Artificial Sequence: Synthetic oligonucleotide
  Target: ATXN1; (+) strand; PAM type: YTN; PAM sequence: TTC
actctaatgagatacgtgga

SEQ ID NO: 286665 - DNA, 20 bp, Artificial Sequence
  Description of Artificial Sequence: Synthetic oligonucleotide
  Target: ATXN1; (+) strand; PAM type: YTN; PAM sequence: CTC
taatgagatacgtggaacaa

SEQ ID NO: 286666 - DNA, 20 bp, Artificial Sequence
  Description of Artificial Sequence: Synthetic oligonucleotide
  Target: ATXN1; (+) strand; PAM type: YTN; PAM sequence: CTA
atgagatacgtggaacaaat

SEQ ID NO: 286667 - DNA, 20 bp, Artificial Sequence
  Description of Artificial Sequence: Synthetic oligonucleotide
  Target: ATXN1; (+) strand; PAM type: YTN; PAM sequence: TTA
ctggggctagaatgtattat

SEQ ID NO: 286668 - DNA, 20 bp, Artificial Sequence
  Description of Artificial Sequence: Synthetic oligonucleotide
  Target: ATXN1; (+) strand; PAM type: YTN; PAM sequence: CTG
gggctagaatgtattataac

SEQ ID NO: 286669 - DNA, 20 bp, Artificial Sequence
  Description of Artificial Sequence: Synthetic oligonucleotide
  Target: ATXN1; (+) strand; PAM type: YTN; PAM sequence: CTA
gaatgtattataacaatagt

SEQ ID NO: 286670 - DNA, 20 bp, Artificial Sequence
  Description of Artificial Sequence: Synthetic oligonucleotide
  Target: ATXN1; (+) strand; PAM type: YTN; PAM sequence: TTA
taacaatagtaaggaagaag

SEQ ID NO: 286671 - DNA, 20 bp, Artificial Sequence
  Description of Artificial Sequence: Synthetic oligonucleotide
  Target: ATXN1; (+) strand; PAM type: YTN; PAM sequence: TTC
ctgctggatacttggtaaga

SEQ ID NO: 286672 - DNA, 20 bp, Artificial Sequence
  Description of Artificial Sequence: Synthetic oligonucleotide
  Target: ATXN1; (+) strand; PAM type: YTN; PAM sequence: CTG
ctggatacttggtaagaggt

SEQ ID NO: 286673 - DNA, 20 bp, Artificial Sequence
  Description of Artificial Sequence: Synthetic oligonucleotide
  Target: ATXN1; (+) strand; PAM type: YTN; PAM sequence: CTG
gatacttggtaagaggtggg

SEQ ID NO: 286674 - DNA, 20 bp, Artificial Sequence
  Description of Artificial Sequence: Synthetic oligonucleotide
  Target: ATXN1; (+) strand; PAM type: YTN; PAM sequence: CTT
ggtaagaggtgggtggggtc

SEQ ID NO: 286675 - DNA, 20 bp, Artificial Sequence
  Description of Artificial Sequence: Synthetic oligonucleotide
  Target: ATXN1; (+) strand; PAM type: YTN; PAM sequence: TTG
gtaagaggtgggtggggtcc

SEQ ID NO: 286676 - DNA, 20 bp, Artificial Sequence
  Description of Artificial Sequence: Synthetic oligonucleotide
  Target: ATXN1; (+) strand; PAM type: YTN; PAM sequence: TTT
ccaggggactttgagtttat

SEQ ID NO: 286677 - DNA, 20 bp, Artificial Sequence
  Description of Artificial Sequence: Synthetic oligonucleotide
  Target: ATXN1; (+) strand; PAM type: YTN; PAM sequence: TTC
caggggactttgagtttatt

SEQ ID NO: 286678 - DNA, 20 bp, Artificial Sequence
  Description of Artificial Sequence: Synthetic oligonucleotide
  Target: ATXN1; (+) strand; PAM type: YTN; PAM sequence: CTT
tgagtttattcttccaacac

SEQ ID NO: 286679 - DNA, 20 bp, Artificial Sequence
  Description of Artificial Sequence: Synthetic oligonucleotide
  Target: ATXN1; (+) strand; PAM type: YTN; PAM sequence: TTT
gagtttattcttccaacact

SEQ ID NO: 286680 - DNA, 20 bp, Artificial Sequence
  Description of Artificial Sequence: Synthetic oligonucleotide
  Target: ATXN1; (+) strand; PAM type: YTN; PAM sequence: TTG
agtttattcttccaacactg

SEQ ID NO: 286681 - DNA, 20 bp, Artificial Sequence
  Description of Artificial Sequence: Synthetic oligonucleotide
  Target: ATXN1; (+) strand; PAM type: YTN; PAM sequence: TTT
attcttccaacactgctaaa

SEQ ID NO: 286682 - DNA, 20 bp, Artificial Sequence
  Description of Artificial Sequence: Synthetic oligonucleotide
  Target: ATXN1; (+) strand; PAM type: YTN; PAM sequence: TTA
ttcttccaacactgctaaaa

SEQ ID NO: 286683 - DNA, 20 bp, Artificial Sequence
  Description of Artificial Sequence: Synthetic oligonucleotide
  Target: ATXN1; (+) strand; PAM type: YTN; PAM sequence: TTC
ttccaacactgctaaaatgc

SEQ ID NO: 286684 - DNA, 20 bp, Artificial Sequence
  Description of Artificial Sequence: Synthetic oligonucleotide
  Target: ATXN1; (+) strand; PAM type: YTN; PAM sequence: CTT
ccaacactgctaaaatgcat

SEQ ID NO: 286685 - DNA, 20 bp, Artificial Sequence
  Description of Artificial Sequence: Synthetic oligonucleotide
  Target: ATXN1; (+) strand; PAM type: YTN; PAM sequence: TTC
caacactgctaaaatgcatc

SEQ ID NO: 286686 - DNA, 20 bp, Artificial Sequence
  Description of Artificial Sequence: Synthetic oligonucleotide
  Target: ATXN1; (+) strand; PAM type: YTN; PAM sequence: CTG
ctaaaatgcatctattttct

SEQ ID NO: 286687 - DNA, 20 bp, Artificial Sequence
  Description of Artificial Sequence: Synthetic oligonucleotide
  Target: ATXN1; (+) strand; PAM type: YTN; PAM sequence: CTA
aaatgcatctattttctatt

SEQ ID NO: 286688 - DNA, 20 bp, Artificial Sequence
  Description of Artificial Sequence: Synthetic oligonucleotide
  Target: ATXN1; (+) strand; PAM type: YTN; PAM sequence: CTA
ttttctattctgactttcta

SEQ ID NO: 286689 - DNA, 20 bp, Artificial Sequence
  Description of Artificial Sequence: Synthetic oligonucleotide
  Target: ATXN1; (+) strand; PAM type: YTN; PAM sequence: TTT
tctattctgactttctaaca

SEQ ID NO: 286690 - DNA, 20 bp, Artificial Sequence
  Description of Artificial Sequence: Synthetic oligonucleotide
  Target: ATXN1; (+) strand; PAM type: YTN; PAM sequence: TTT
ctattctgactttctaacag

SEQ ID NO: 286691 - DNA, 20 bp, Artificial Sequence
  Description of Artificial Sequence: Synthetic oligonucleotide
  Target: ATXN1; (+) strand; PAM type: YTN; PAM sequence: TTC
tattctgactttctaacagg

SEQ ID NO: 286692 - DNA, 20 bp, Artificial Sequence
  Description of Artificial Sequence: Synthetic oligonucleotide
  Target: ATXN1; (+) strand; PAM type: YTN; PAM sequence: CTA
ttctgactttctaacaggat

SEQ ID NO: 286693 - DNA, 20 bp, Artificial Sequence
  Description of Artificial Sequence: Synthetic oligonucleotide
  Target: ATXN1; (+) strand; PAM type: YTN; PAM sequence: TTC
tgactttctaacaggatgca

SEQ ID NO: 286694 - DNA, 20 bp, Artificial Sequence
  Description of Artificial Sequence: Synthetic oligonucleotide
  Target: ATXN1; (+) strand; PAM type: YTN; PAM sequence: CTG
actttctaacaggatgcaat

SEQ ID NO: 286695 - DNA, 20 bp, Artificial Sequence
  Description of Artificial Sequence: Synthetic oligonucleotide
  Target: ATXN1; (+) strand; PAM type: YTN; PAM sequence: CTT
tctaacaggatgcaatctga

SEQ ID NO: 286696 - DNA, 20 bp, Artificial Sequence
  Description of Artificial Sequence: Synthetic oligonucleotide
  Target: ATXN1; (+) strand; PAM type: YTN; PAM sequence: TTT
ctaacaggatgcaatctgag

SEQ ID NO: 286697 - DNA, 20 bp, Artificial Sequence
  Description of Artificial Sequence: Synthetic oligonucleotide
  Target: ATXN1; (+) strand; PAM type: YTN; PAM sequence: TTC
taacaggatgcaatctgaga

SEQ ID NO: 286698 - DNA, 20 bp, Artificial Sequence
  Description of Artificial Sequence: Synthetic oligonucleotide
  Target: ATXN1; (+) strand; PAM type: YTN; PAM sequence: CTA
acaggatgcaatctgagagc

SEQ ID NO: 286699 - DNA, 20 bp, Artificial Sequence
  Description of Artificial Sequence: Synthetic oligonucleotide
  Target: ATXN1; (+) strand; PAM type: YTN; PAM sequence: CTG
agagccagccagccacttaa

SEQ ID NO: 286700 - DNA, 20 bp, Artificial Sequence
  Description of Artificial Sequence: Synthetic oligonucleotide
  Target: ATXN1; (+) strand; PAM type: YTN; PAM sequence: CTT
aaaatctatttatttcagct

SEQ ID NO: 286701 - DNA, 20 bp, Artificial Sequence
  Description of Artificial Sequence: Synthetic oligonucleotide
  Target: ATXN1; (+) strand; PAM type: YTN; PAM sequence: TTA
aaatctatttatttcagctg

SEQ ID NO: 286702 - DNA, 20 bp, Artificial Sequence
  Description of Artificial Sequence: Synthetic oligonucleotide
  Target: ATXN1; (+) strand; PAM type: YTN; PAM sequence: CTA
tttatttcagctgtgcgcag

SEQ ID NO: 286703 - DNA, 20 bp, Artificial Sequence
  Description of Artificial Sequence: Synthetic oligonucleotide
  Target: ATXN1; (+) strand; PAM type: YTN; PAM sequence: TTT
atttcagctgtgcgcagtgg

SEQ ID NO: 286704 - DNA, 20 bp, Artificial Sequence
  Description of Artificial Sequence: Synthetic oligonucleotide
  Target: ATXN1; (+) strand; PAM type: YTN; PAM sequence: TTA
tttcagctgtgcgcagtggc

SEQ ID NO: 286705 - DNA, 20 bp, Artificial Sequence
  Description of Artificial Sequence: Synthetic oligonucleotide
  Target: ATXN1; (+) strand; PAM type: YTN; PAM sequence: TTT
cagctgtgcgcagtggctca

SEQ ID NO: 286706 - DNA, 20 bp, Artificial Sequence
  Description of Artificial Sequence: Synthetic oligonucleotide
  Target: ATXN1; (+) strand; PAM type: YTN; PAM sequence: TTC
agctgtgcgcagtggctcac

SEQ ID NO: 286707 - DNA, 20 bp, Artificial Sequence
  Description of Artificial Sequence: Synthetic oligonucleotide
  Target: ATXN1; (+) strand; PAM type: YTN; PAM sequence: CTG
tgcgcagtggctcacgcctg

SEQ ID NO: 286708 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 286709 - DNA, 20 bp, Artificial Sequence
  Description of Artificial Sequence: Synthetic oligonucleotide
  Target: ATXN1; (+) strand; PAM type: YTN; PAM sequence: CTG
taatcccagcacttagtgag

SEQ ID NO: 286710 - DNA, 20 bp, Artificial Sequence
  Description of Artificial Sequence: Synthetic oligonucleotide
  Target: ATXN1; (+) strand; PAM type: YTN; PAM sequence: CTT
agtgaggccgaggcgggcgg

SEQ ID NO: 286711 - DNA, 20 bp, Artificial Sequence
  Description of Artificial Sequence: Synthetic oligonucleotide
  Target: ATXN1; (+) strand; PAM type: YTN; PAM sequence: TTA
gtgaggccgaggcgggcgga

SEQ ID NO: 286712 - DNA, 20 bp, Artificial Sequence
  Description of Artificial Sequence: Synthetic oligonucleotide
  Target: ATXN1; (+) strand; PAM type: YTN; PAM sequence: CTG
gctaacacggtgaaacccca

SEQ ID NO: 286713 - DNA, 20 bp, Artificial Sequence
  Description of Artificial Sequence: Synthetic oligonucleotide
  Target: ATXN1; (+) strand; PAM type: YTN; PAM sequence: CTA
acacggtgaaaccccatctc

SEQ ID NO: 286714 - DNA, 20 bp, Artificial Sequence
  Description of Artificial Sequence: Synthetic oligonucleotide
  Target: ATXN1; (+) strand; PAM type: YTN; PAM sequence: CTC
tactaaaaaatacaaaaaat

SEQ ID NO: 286715 - DNA, 20 bp, Artificial Sequence
  Description of Artificial Sequence: Synthetic oligonucleotide
  Target: ATXN1; (+) strand; PAM type: YTN; PAM sequence: CTA
ctaaaaaatacaaaaaatat

SEQ ID NO: 286716 - DNA, 20 bp, Artificial Sequence
  Description of Artificial Sequence: Synthetic oligonucleotide
  Target: ATXN1; (+) strand; PAM type: YTN; PAM sequence: CTA
aaaaatacaaaaaatattag

SEQ ID NO: 286717 - DNA, 20 bp, Artificial Sequence
  Description of Artificial Sequence: Synthetic oligonucleotide
  Target: ATXN1; (+) strand; PAM type: YTN; PAM sequence: TTA
gttgggtgtggtggcgggca

SEQ ID NO: 286718 - DNA, 20 bp, Artificial Sequence
  Description of Artificial Sequence: Synthetic oligonucleotide
  Target: ATXN1; (+) strand; PAM type: YTN; PAM sequence: TTG
ggtgtggtggcgggcacctg

SEQ ID NO: 286719 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctactcgggag

SEQ ID NO: 286720 - DNA, 20 bp, Artificial Sequence
  Description of Artificial Sequence: Synthetic oligonucleotide
  Target: ATXN1; (+) strand; PAM type: YTN; PAM sequence: CTA
ctcgggaggctgaggcagga

SEQ ID NO: 286721 - DNA, 20 bp, Artificial Sequence
  Description of Artificial Sequence: Synthetic oligonucleotide
  Target: ATXN1; (+) strand; PAM type: YTN; PAM sequence: CTC
gggaggctgaggcaggaaaa

SEQ ID NO: 286722 - DNA, 20 bp, Artificial Sequence
  Description of Artificial Sequence: Synthetic oligonucleotide
  Target: ATXN1; (+) strand; PAM type: YTN; PAM sequence: CTG
aggcaggaaaatggcgtgaa

SEQ ID NO: 286723 - DNA, 20 bp, Artificial Sequence
  Description of Artificial Sequence: Synthetic oligonucleotide
  Target: ATXN1; (+) strand; PAM type: YTN; PAM sequence: CTT
gcagtgagccaagattgcac

SEQ ID NO: 286724 - DNA, 20 bp, Artificial Sequence
  Description of Artificial Sequence: Synthetic oligonucleotide
  Target: ATXN1; (+) strand; PAM type: YTN; PAM sequence: TTG
cagtgagccaagattgcacc

SEQ ID NO: 286725 - DNA, 20 bp, Artificial Sequence
  Description of Artificial Sequence: Synthetic oligonucleotide
  Target: ATXN1; (+) strand; PAM type: YTN; PAM sequence: TTG
caccactgcattccagcctg

SEQ ID NO: 286726 - DNA, 20 bp, Artificial Sequence
  Description of Artificial Sequence: Synthetic oligonucleotide
  Target: ATXN1; (+) strand; PAM type: YTN; PAM sequence: CTG
cattccagcctggatgacag

SEQ ID NO: 286727 - DNA, 20 bp, Artificial Sequence
  Description of Artificial Sequence: Synthetic oligonucleotide
  Target: ATXN1; (+) strand; PAM type: YTN; PAM sequence: TTC
cagcctggatgacagagtga

SEQ ID NO: 286728 - DNA, 20 bp, Artificial Sequence
  Description of Artificial Sequence: Synthetic oligonucleotide
  Target: ATXN1; (+) strand; PAM type: YTN; PAM sequence: CTG
gatgacagagtgagactttg

SEQ ID NO: 286729 - DNA, 20 bp, Artificial Sequence
  Description of Artificial Sequence: Synthetic oligonucleotide
  Target: ATXN1; (+) strand; PAM type: YTN; PAM sequence: CTT
tgtctcaaaaaagaaaaaat

SEQ ID NO: 286730 - DNA, 20 bp, Artificial Sequence
  Description of Artificial Sequence: Synthetic oligonucleotide
  Target: ATXN1; (+) strand; PAM type: YTN; PAM sequence: TTT
gtctcaaaaaagaaaaaatc

SEQ ID NO: 286731 - DNA, 20 bp, Artificial Sequence
  Description of Artificial Sequence: Synthetic oligonucleotide
  Target: ATXN1; (+) strand; PAM type: YTN; PAM sequence: TTG
tctcaaaaaagaaaaaatca

SEQ ID NO: 286732 - DNA, 20 bp, Artificial Sequence
  Description of Artificial Sequence: Synthetic oligonucleotide
  Target: ATXN1; (+) strand; PAM type: YTN; PAM sequence: CTC
aaaaaagaaaaaatcaattt

SEQ ID NO: 286733 - DNA, 20 bp, Artificial Sequence
  Description of Artificial Sequence: Synthetic oligonucleotide
  Target: ATXN1; (+) strand; PAM type: YTN; PAM sequence: TTT
gtttcaacaatccagagtag

SEQ ID NO: 286734 - DNA, 20 bp, Artificial Sequence
  Description of Artificial Sequence: Synthetic oligonucleotide
  Target: ATXN1; (+) strand; PAM type: YTN; PAM sequence: TTG
tttcaacaatccagagtaga

SEQ ID NO: 286735 - DNA, 20 bp, Artificial Sequence
  Description of Artificial Sequence: Synthetic oligonucleotide
  Target: ATXN1; (+) strand; PAM type: YTN; PAM sequence: TTT
caacaatccagagtagaaat

SEQ ID NO: 286736 - DNA, 20 bp, Artificial Sequence
  Description of Artificial Sequence: Synthetic oligonucleotide
  Target: ATXN1; (+) strand; PAM type: YTN; PAM sequence: TTC
aacaatccagagtagaaata

SEQ ID NO: 286737 - DNA, 20 bp, Artificial Sequence
  Description of Artificial Sequence: Synthetic oligonucleotide
  Target: ATXN1; (+) strand; PAM type: YTN; PAM sequence: TTT
tgtgcaagcgtattttgtgc

SEQ ID NO: 286738 - DNA, 20 bp, Artificial Sequence
  Description of Artificial Sequence: Synthetic oligonucleotide
  Target: ATXN1; (+) strand; PAM type: YTN; PAM sequence: TTT
gtgcaagcgtattttgtgca

SEQ ID NO: 286739 - DNA, 20 bp, Artificial Sequence
  Description of Artificial Sequence: Synthetic oligonucleotide
  Target: ATXN1; (+) strand; PAM type: YTN; PAM sequence: TTG
tgcaagcgtattttgtgcaa

SEQ ID NO: 286740 - DNA, 20 bp, Artificial Sequence
  Description of Artificial Sequence: Synthetic oligonucleotide
  Target: ATXN1; (+) strand; PAM type: YTN; PAM sequence: TTT
tgtgcaagcgtaatctattt

SEQ ID NO: 286741 - DNA, 20 bp, Artificial Sequence
  Description of Artificial Sequence: Synthetic oligonucleotide
  Target: ATXN1; (+) strand; PAM type: YTN; PAM sequence: TTT
gtgcaagcgtaatctatttt

SEQ ID NO: 286742 - DNA, 20 bp, Artificial Sequence
  Description of Artificial Sequence: Synthetic oligonucleotide
  Target: ATXN1; (+) strand; PAM type: YTN; PAM sequence: TTG
tgcaagcgtaatctattttg

SEQ ID NO: 286743 - DNA, 20 bp, Artificial Sequence
  Description of Artificial Sequence: Synthetic oligonucleotide
  Target: ATXN1; (+) strand; PAM type: YTN; PAM sequence: CTA
ttttgcaagcagaaaattct

SEQ ID NO: 286744 - DNA, 20 bp, Artificial Sequence
  Description of Artificial Sequence: Synthetic oligonucleotide
  Target: ATXN1; (+) strand; PAM type: YTN; PAM sequence: TTT
tgcaagcagaaaattctcac

SEQ ID NO: 286745 - DNA, 20 bp, Artificial Sequence
  Description of Artificial Sequence: Synthetic oligonucleotide
  Target: ATXN1; (+) strand; PAM type: YTN; PAM sequence: TTT
gcaagcagaaaattctcacg

SEQ ID NO: 286746 - DNA, 20 bp, Artificial Sequence
  Description of Artificial Sequence: Synthetic oligonucleotide
  Target: ATXN1; (+) strand; PAM type: YTN; PAM sequence: TTG
caagcagaaaattctcacgt

SEQ ID NO: 286747 - DNA, 20 bp, Artificial Sequence
  Description of Artificial Sequence: Synthetic oligonucleotide
  Target: ATXN1; (+) strand; PAM type: YTN; PAM sequence: TTC
tcacgtattttagagtcagg

SEQ ID NO: 286748 - DNA, 20 bp, Artificial Sequence
  Description of Artificial Sequence: Synthetic oligonucleotide
  Target: ATXN1; (+) strand; PAM type: YTN; PAM sequence: CTC
acgtattttagagtcagggt

SEQ ID NO: 286749 - DNA, 20 bp, Artificial Sequence
  Description of Artificial Sequence: Synthetic oligonucleotide
  Target: ATXN1; (+) strand; PAM type: YTN; PAM sequence: TTT
tagagtcagggttctcaaat

SEQ ID NO: 286750 - DNA, 20 bp, Artificial Sequence
  Description of Artificial Sequence: Synthetic oligonucleotide
  Target: ATXN1; (+) strand; PAM type: YTN; PAM sequence: TTT
agagtcagggttctcaaatc

SEQ ID NO: 286751 - DNA, 20 bp, Artificial Sequence
  Description of Artificial Sequence: Synthetic oligonucleotide
  Target: ATXN1; (+) strand; PAM type: YTN; PAM sequence: TTA
gagtcagggttctcaaatca

SEQ ID NO: 286752 - DNA, 20 bp, Artificial Sequence
  Description of Artificial Sequence: Synthetic oligonucleotide
  Target: ATXN1; (+) strand; PAM type: YTN; PAM sequence: TTC
tcaaatcataaatcttaaag

SEQ ID NO: 286753 - DNA, 20 bp, Artificial Sequence
  Description of Artificial Sequence: Synthetic oligonucleotide
  Target: ATXN1; (+) strand; PAM type: YTN; PAM sequence: CTC
aaatcataaatcttaaagtt

SEQ ID NO: 286754 - DNA, 20 bp, Artificial Sequence
  Description of Artificial Sequence: Synthetic oligonucleotide
  Target: ATXN1; (+) strand; PAM type: YTN; PAM sequence: CTT
aaagttttcagaatccatgc

SEQ ID NO: 286755 - DNA, 20 bp, Artificial Sequence
  Description of Artificial Sequence: Synthetic oligonucleotide
  Target: ATXN1; (+) strand; PAM type: YTN; PAM sequence: TTA
aagttttcagaatccatgcc

SEQ ID NO: 286756 - DNA, 20 bp, Artificial Sequence
  Description of Artificial Sequence: Synthetic oligonucleotide
  Target: ATXN1; (+) strand; PAM type: YTN; PAM sequence: TTT
tcagaatccatgccaaggga

SEQ ID NO: 286757 - DNA, 20 bp, Artificial Sequence
  Description of Artificial Sequence: Synthetic oligonucleotide
  Target: ATXN1; (+) strand; PAM type: YTN; PAM sequence: TTT
cagaatccatgccaagggac

SEQ ID NO: 286758 - DNA, 20 bp, Artificial Sequence
  Description of Artificial Sequence: Synthetic oligonucleotide
  Target: ATXN1; (+) strand; PAM type: YTN; PAM sequence: TTC
agaatccatgccaagggact

SEQ ID NO: 286759 - DNA, 20 bp, Artificial Sequence
  Description of Artificial Sequence: Synthetic oligonucleotide
  Target: ATXN1; (+) strand; PAM type: YTN; PAM sequence: CTT
aagaaaattaatattgcccc

SEQ ID NO: 286760 - DNA, 20 bp, Artificial Sequence
  Description of Artificial Sequence: Synthetic oligonucleotide
  Target: ATXN1; (+) strand; PAM type: YTN; PAM sequence: TTA
agaaaattaatattgccccc

SEQ ID NO: 286761 - DNA, 20 bp, Artificial Sequence
  Description of Artificial Sequence: Synthetic oligonucleotide
  Target: ATXN1; (+) strand; PAM type: YTN; PAM sequence: TTA
atattgcccccatataagct

SEQ ID NO: 286762 - DNA, 20 bp, Artificial Sequence
  Description of Artificial Sequence: Synthetic oligonucleotide
  Target: ATXN1; (+) strand; PAM type: YTN; PAM sequence: TTG
cccccatataagctgtcttt

SEQ ID NO: 286763 - DNA, 20 bp, Artificial Sequence
  Description of Artificial Sequence: Synthetic oligonucleotide
  Target: ATXN1; (+) strand; PAM type: YTN; PAM sequence: CTG
tcttttgtatactaagcatc

SEQ ID NO: 286764 - DNA, 20 bp, Artificial Sequence
  Description of Artificial Sequence: Synthetic oligonucleotide
  Target: ATXN1; (+) strand; PAM type: YTN; PAM sequence: CTT
ttgtatactaagcatcagca

SEQ ID NO: 286765 - DNA, 20 bp, Artificial Sequence
  Description of Artificial Sequence: Synthetic oligonucleotide
  Target: ATXN1; (+) strand; PAM type: YTN; PAM sequence: TTT
tgtatactaagcatcagcaa

SEQ ID NO: 286766 - DNA, 20 bp, Artificial Sequence
  Description of Artificial Sequence: Synthetic oligonucleotide
  Target: ATXN1; (+) strand; PAM type: YTN; PAM sequence: TTT
gtatactaagcatcagcaaa

SEQ ID NO: 286767 - DNA, 20 bp, Artificial Sequence
  Description of Artificial Sequence: Synthetic oligonucleotide
  Target: ATXN1; (+) strand; PAM type: YTN; PAM sequence: TTG
tatactaagcatcagcaaag

SEQ ID NO: 286768 - DNA, 20 bp, Artificial Sequence
  Description of Artificial Sequence: Synthetic oligonucleotide
  Target: ATXN1; (+) strand; PAM type: YTN; PAM sequence: CTA
agcatcagcaaagcatctgc

SEQ ID NO: 286769 - DNA, 20 bp, Artificial Sequence
  Description of Artificial Sequence: Synthetic oligonucleotide
  Target: ATXN1; (+) strand; PAM type: YTN; PAM sequence: CTG
cccccaacagctattttact

SEQ ID NO: 286770 - DNA, 20 bp, Artificial Sequence
  Description of Artificial Sequence: Synthetic oligonucleotide
  Target: ATXN1; (+) strand; PAM type: YTN; PAM sequence: CTA
ttttactggtcccagaggaa

SEQ ID NO: 286771 - DNA, 20 bp, Artificial Sequence
  Description of Artificial Sequence: Synthetic oligonucleotide
  Target: ATXN1; (+) strand; PAM type: YTN; PAM sequence: TTT
tactggtcccagaggaaaga

SEQ ID NO: 286772 - DNA, 20 bp, Artificial Sequence
  Description of Artificial Sequence: Synthetic oligonucleotide
  Target: ATXN1; (+) strand; PAM type: YTN; PAM sequence: TTT
actggtcccagaggaaagat

SEQ ID NO: 286773 - DNA, 20 bp, Artificial Sequence
  Description of Artificial Sequence: Synthetic oligonucleotide
  Target: ATXN1; (+) strand; PAM type: YTN; PAM sequence: TTA
ctggtcccagaggaaagata

SEQ ID NO: 286774 - DNA, 20 bp, Artificial Sequence
  Description of Artificial Sequence: Synthetic oligonucleotide
  Target: ATXN1; (+) strand; PAM type: YTN; PAM sequence: CTG
gtcccagaggaaagataagc

SEQ ID NO: 286775 - DNA, 20 bp, Artificial Sequence
  Description of Artificial Sequence: Synthetic oligonucleotide
  Target: ATXN1; (+) strand; PAM type: YTN; PAM sequence: TTG
tcttccgcaaaatcataaag

SEQ ID NO: 286776 - DNA, 20 bp, Artificial Sequence
  Description of Artificial Sequence: Synthetic oligonucleotide
  Target: ATXN1; (+) strand; PAM type: YTN; PAM sequence: CTT
ccgcaaaatcataaagaagg

SEQ ID NO: 286777 - DNA, 20 bp, Artificial Sequence
  Description of Artificial Sequence: Synthetic oligonucleotide
  Target: ATXN1; (+) strand; PAM type: YTN; PAM sequence: TTC
cgcaaaatcataaagaaggt

SEQ ID NO: 286778 - DNA, 20 bp, Artificial Sequence
  Description of Artificial Sequence: Synthetic oligonucleotide
  Target: ATXN1; (+) strand; PAM type: YTN; PAM sequence: TTC
atctgtaggatccttcccct

SEQ ID NO: 286779 - DNA, 20 bp, Artificial Sequence
  Description of Artificial Sequence: Synthetic oligonucleotide
  Target: ATXN1; (+) strand; PAM type: YTN; PAM sequence: CTG
taggatccttccccttaggc

SEQ ID NO: 286780 - DNA, 20 bp, Artificial Sequence
  Description of Artificial Sequence: Synthetic oligonucleotide
  Target: ATXN1; (+) strand; PAM type: YTN; PAM sequence: CTT
ccccttaggccctctaggtg

SEQ ID NO: 286781 - DNA, 20 bp, Artificial Sequence
  Description of Artificial Sequence: Synthetic oligonucleotide
  Target: ATXN1; (+) strand; PAM type: YTN; PAM sequence: TTC
cccttaggccctctaggtgc

SEQ ID NO: 286782 - DNA, 20 bp, Artificial Sequence
  Description of Artificial Sequence: Synthetic oligonucleotide
  Target: ATXN1; (+) strand; PAM type: YTN; PAM sequence: CTT
aggccctctaggtgcctccc

SEQ ID NO: 286783 - DNA, 20 bp, Artificial Sequence
  Description of Artificial Sequence: Synthetic oligonucleotide
  Target: ATXN1; (+) strand; PAM type: YTN; PAM sequence: TTA
ggccctctaggtgcctcccc

SEQ ID NO: 286784 - DNA, 20 bp, Artificial Sequence
  Description of Artificial Sequence: Synthetic oligonucleotide
  Target: ATXN1; (+) strand; PAM type: YTN; PAM sequence: CTC
taggtgcctccccattgggc

SEQ ID NO: 286785 - DNA, 20 bp, Artificial Sequence
  Description of Artificial Sequence: Synthetic oligonucleotide
  Target: ATXN1; (+) strand; PAM type: YTN; PAM sequence: CTA
ggtgcctccccattgggccc

SEQ ID NO: 286786 - DNA, 20 bp, Artificial Sequence
  Description of Artificial Sequence: Synthetic oligonucleotide
  Target: ATXN1; (+) strand; PAM type: YTN; PAM sequence: CTC
cccattgggccccaggggtt

SEQ ID NO: 286787 - DNA, 20 bp, Artificial Sequence
  Description of Artificial Sequence: Synthetic oligonucleotide
  Target: ATXN1; (+) strand; PAM type: YTN; PAM sequence: TTG
ggccccaggggtttctactc

SEQ ID NO: 286788 - DNA, 20 bp, Artificial Sequence
  Description of Artificial Sequence: Synthetic oligonucleotide
  Target: ATXN1; (+) strand; PAM type: YTN; PAM sequence: TTT
ctactccgtaattctttccc

SEQ ID NO: 286789 - DNA, 20 bp, Artificial Sequence
  Description of Artificial Sequence: Synthetic oligonucleotide
  Target: ATXN1; (+) strand; PAM type: YTN; PAM sequence: TTC
tactccgtaattctttccca

SEQ ID NO: 286790 - DNA, 20 bp, Artificial Sequence
  Description of Artificial Sequence: Synthetic oligonucleotide
  Target: ATXN1; (+) strand; PAM type: YTN; PAM sequence: CTA
ctccgtaattctttcccacc

SEQ ID NO: 286791 - DNA, 20 bp, Artificial Sequence
  Description of Artificial Sequence: Synthetic oligonucleotide
  Target: ATXN1; (+) strand; PAM type: YTN; PAM sequence: CTC
cgtaattctttcccacccct

SEQ ID NO: 286792 - DNA, 20 bp, Artificial Sequence
  Description of Artificial Sequence: Synthetic oligonucleotide
  Target: ATXN1; (+) strand; PAM type: YTN; PAM sequence: TTC
tttcccacccctgccctgtc

SEQ ID NO: 286793 - DNA, 20 bp, Artificial Sequence
  Description of Artificial Sequence: Synthetic oligonucleotide
  Target: ATXN1; (+) strand; PAM type: YTN; PAM sequence: CTT
tcccacccctgccctgtcaa

SEQ ID NO: 286794 - DNA, 20 bp, Artificial Sequence
  Description of Artificial Sequence: Synthetic oligonucleotide
  Target: ATXN1; (+) strand; PAM type: YTN; PAM sequence: TTT
cccacccctgccctgtcaac

SEQ ID NO: 286795 - DNA, 20 bp, Artificial Sequence
  Description of Artificial Sequence: Synthetic oligonucleotide
  Target: ATXN1; (+) strand; PAM type: YTN; PAM sequence: TTC
ccacccctgccctgtcaact

SEQ ID NO: 286796 - DNA, 20 bp, Artificial Sequence
  Description of Artificial Sequence: Synthetic oligonucleotide
  Target: ATXN1; (+) strand; PAM type: YTN; PAM sequence: CTG
ccctgtcaacttgaacacca

SEQ ID NO: 286797 - DNA, 20 bp, Artificial Sequence
  Description of Artificial Sequence: Synthetic oligonucleotide
  Target: ATXN1; (+) strand; PAM type: YTN; PAM sequence: CTG
tcaacttgaacaccagtgaa

SEQ ID NO: 286798 - DNA, 20 bp, Artificial Sequence
  Description of Artificial Sequence: Synthetic oligonucleotide
  Target: ATXN1; (+) strand; PAM type: YTN; PAM sequence: CTT
gaacaccagtgaaacaccac

SEQ ID NO: 286799 - DNA, 20 bp, Artificial Sequence
  Description of Artificial Sequence: Synthetic oligonucleotide
  Target: ATXN1; (+) strand; PAM type: YTN; PAM sequence: TTG
aacaccagtgaaacaccaca

SEQ ID NO: 286800 - DNA, 20 bp, Artificial Sequence
  Description of Artificial Sequence: Synthetic oligonucleotide
  Target: ATXN1; (+) strand; PAM type: YTN; PAM sequence: TTT
caatatgaatacacttcagt

SEQ ID NO: 286801 - DNA, 20 bp, Artificial Sequence
  Description of Artificial Sequence: Synthetic oligonucleotide
  Target: ATXN1; (+) strand; PAM type: YTN; PAM sequence: TTC
aatatgaatacacttcagtc

SEQ ID NO: 286802 - DNA, 20 bp, Artificial Sequence
  Description of Artificial Sequence: Synthetic oligonucleotide
  Target: ATXN1; (+) strand; PAM type: YTN; PAM sequence: CTT
cagtcactgtttttgctccg

SEQ ID NO: 286803 - DNA, 20 bp, Artificial Sequence
  Description of Artificial Sequence: Synthetic oligonucleotide
  Target: ATXN1; (+) strand; PAM type: YTN; PAM sequence: TTC
agtcactgtttttgctccgc

SEQ ID NO: 286804 - DNA, 20 bp, Artificial Sequence
  Description of Artificial Sequence: Synthetic oligonucleotide
  Target: ATXN1; (+) strand; PAM type: YTN; PAM sequence: CTG
tttttgctccgcccaccaaa

SEQ ID NO: 286805 - DNA, 20 bp, Artificial Sequence
  Description of Artificial Sequence: Synthetic oligonucleotide
  Target: ATXN1; (+) strand; PAM type: YTN; PAM sequence: TTT
ttgctccgcccaccaaaaaa

SEQ ID NO: 286806 - DNA, 20 bp, Artificial Sequence
  Description of Artificial Sequence: Synthetic oligonucleotide
  Target: ATXN1; (+) strand; PAM type: YTN; PAM sequence: TTT
tgctccgcccaccaaaaaaa

SEQ ID NO: 286807 - DNA, 20 bp, Artificial Sequence
  Description of Artificial Sequence: Synthetic oligonucleotide
  Target: ATXN1; (+) strand; PAM type: YTN; PAM sequence: TTT
gctccgcccaccaaaaaaaa

SEQ ID NO: 286808 - DNA, 20 bp, Artificial Sequence
  Description of Artificial Sequence: Synthetic oligonucleotide
  Target: ATXN1; (+) strand; PAM type: YTN; PAM sequence: TTG
ctccgcccaccaaaaaaaat

SEQ ID NO: 286809 - DNA, 20 bp, Artificial Sequence
  Description of Artificial Sequence: Synthetic oligonucleotide
  Target: ATXN1; (+) strand; PAM type: YTN; PAM sequence: CTC
cgcccaccaaaaaaaatcca

SEQ ID NO: 286810 - DNA, 20 bp, Artificial Sequence
  Description of Artificial Sequence: Synthetic oligonucleotide
  Target: ATXN1; (+) strand; PAM type: YTN; PAM sequence: CTT
taaagcttttaattttttta

SEQ ID NO: 286811 - DNA, 20 bp, Artificial Sequence
  Description of Artificial Sequence: Synthetic oligonucleotide
  Target: ATXN1; (+) strand; PAM type: YTN; PAM sequence: TTT
aaagcttttaatttttttaa

SEQ ID NO: 286812 - DNA, 20 bp, Artificial Sequence
  Description of Artificial Sequence: Synthetic oligonucleotide
  Target: ATXN1; (+) strand; PAM type: YTN; PAM sequence: TTA
aagcttttaatttttttaag

SEQ ID NO: 286813 - DNA, 20 bp, Artificial Sequence
  Description of Artificial Sequence: Synthetic oligonucleotide
  Target: ATXN1; (+) strand; PAM type: YTN; PAM sequence: CTT
ttaatttttttaagctttta

SEQ ID NO: 286814 - DNA, 20 bp, Artificial Sequence
  Description of Artificial Sequence: Synthetic oligonucleotide
  Target: ATXN1; (+) strand; PAM type: YTN; PAM sequence: TTT
taatttttttaagcttttaa

SEQ ID NO: 286815 - DNA, 20 bp, Artificial Sequence
  Description of Artificial Sequence: Synthetic oligonucleotide
  Target: ATXN1; (+) strand; PAM type: YTN; PAM sequence: TTT
aatttttttaagcttttaat

SEQ ID NO: 286816 - DNA, 20 bp, Artificial Sequence
  Description of Artificial Sequence: Synthetic oligonucleotide
  Target: ATXN1; (+) strand; PAM type: YTN; PAM sequence: TTA
atttttttaagcttttaatt

SEQ ID NO: 286817 - DNA, 20 bp, Artificial Sequence
  Description of Artificial Sequence: Synthetic oligonucleotide
  Target: ATXN1; (+) strand; PAM type: YTN; PAM sequence: TTT
ttttaagcttttaatttttt

SEQ ID NO: 286818 - DNA, 20 bp, Artificial Sequence
  Description of Artificial Sequence: Synthetic oligonucleotide
  Target: ATXN1; (+) strand; PAM type: YTN; PAM sequence: TTT
tttaagcttttaattttttt

SEQ ID NO: 286819 - DNA, 20 bp, Artificial Sequence
  Description of Artificial Sequence: Synthetic oligonucleotide
  Target: ATXN1; (+) strand; PAM type: YTN; PAM sequence: TTT
ttaagcttttaattttttta

SEQ ID NO: 286820 - DNA, 20 bp, Artificial Sequence
  Description of Artificial Sequence: Synthetic oligonucleotide
  Target: ATXN1; (+) strand; PAM type: YTN; PAM sequence: TTT
taagcttttaatttttttaa

SEQ ID NO: 286821 - DNA, 20 bp, Artificial Sequence
  Description of Artificial Sequence: Synthetic oligonucleotide
  Target: ATXN1; (+) strand; PAM type: YTN; PAM sequence: TTT
aagcttttaatttttttaat

SEQ ID NO: 286822 - DNA, 20 bp, Artificial Sequence
  Description of Artificial Sequence: Synthetic oligonucleotide
  Target: ATXN1; (+) strand; PAM type: YTN; PAM sequence: TTA
agcttttaatttttttaatt

SEQ ID NO: 286823 - DNA, 20 bp, Artificial Sequence
  Description of Artificial Sequence: Synthetic oligonucleotide
  Target: ATXN1; (+) strand; PAM type: YTN; PAM sequence: CTT
ttaatttttttaattgaagc

SEQ ID NO: 286824 - DNA, 20 bp, Artificial Sequence
  Description of Artificial Sequence: Synthetic oligonucleotide
  Target: ATXN1; (+) strand; PAM type: YTN; PAM sequence: TTT
taatttttttaattgaagca

SEQ ID NO: 286825 - DNA, 20 bp, Artificial Sequence
  Description of Artificial Sequence: Synthetic oligonucleotide
  Target: ATXN1; (+) strand; PAM type: YTN; PAM sequence: TTT
aatttttttaattgaagcat

SEQ ID NO: 286826 - DNA, 20 bp, Artificial Sequence
  Description of Artificial Sequence: Synthetic oligonucleotide
  Target: ATXN1; (+) strand; PAM type: YTN; PAM sequence: TTA
atttttttaattgaagcatc

SEQ ID NO: 286827 - DNA, 20 bp, Artificial Sequence
  Description of Artificial Sequence: Synthetic oligonucleotide
  Target: ATXN1; (+) strand; PAM type: YTN; PAM sequence: TTT
ttttaattgaagcatcactt

SEQ ID NO: 286828 - DNA, 20 bp, Artificial Sequence
  Description of Artificial Sequence: Synthetic oligonucleotide
  Target: ATXN1; (+) strand; PAM type: YTN; PAM sequence: TTT
tttaattgaagcatcacttt

SEQ ID NO: 286829 - DNA, 20 bp, Artificial Sequence
  Description of Artificial Sequence: Synthetic oligonucleotide
  Target: ATXN1; (+) strand; PAM type: YTN; PAM sequence: TTT
ttaattgaagcatcacttta

SEQ ID NO: 286830 - DNA, 20 bp, Artificial Sequence
  Description of Artificial Sequence: Synthetic oligonucleotide
  Target: ATXN1; (+) strand; PAM type: YTN; PAM sequence: TTT
taattgaagcatcactttac

SEQ ID NO: 286831 - DNA, 20 bp, Artificial Sequence
  Description of Artificial Sequence: Synthetic oligonucleotide
  Target: ATXN1; (+) strand; PAM type: YTN; PAM sequence: TTT
aattgaagcatcactttact

SEQ ID NO: 286832 - DNA, 20 bp, Artificial Sequence
  Description of Artificial Sequence: Synthetic oligonucleotide
  Target: ATXN1; (+) strand; PAM type: YTN; PAM sequence: TTA
attgaagcatcactttactt

SEQ ID NO: 286833 - DNA, 20 bp, Artificial Sequence
  Description of Artificial Sequence: Synthetic oligonucleotide
  Target: ATXN1; (+) strand; PAM type: YTN; PAM sequence: TTG
aagcatcactttactttctt

SEQ ID NO: 286834 - DNA, 20 bp, Artificial Sequence
  Description of Artificial Sequence: Synthetic oligonucleotide
  Target: ATXN1; (+) strand; PAM type: YTN; PAM sequence: CTT
tactttcttttaaattctaa

SEQ ID NO: 286835 - DNA, 20 bp, Artificial Sequence
  Description of Artificial Sequence: Synthetic oligonucleotide
  Target: ATXN1; (+) strand; PAM type: YTN; PAM sequence: TTT
actttcttttaaattctaac

SEQ ID NO: 286836 - DNA, 20 bp, Artificial Sequence
  Description of Artificial Sequence: Synthetic oligonucleotide
  Target: ATXN1; (+) strand; PAM type: YTN; PAM sequence: TTA
ctttcttttaaattctaaca

SEQ ID NO: 286837 - DNA, 20 bp, Artificial Sequence
  Description of Artificial Sequence: Synthetic oligonucleotide
  Target: ATXN1; (+) strand; PAM type: YTN; PAM sequence: CTT
tcttttaaattctaacatca

SEQ ID NO: 286838 - DNA, 20 bp, Artificial Sequence
  Description of Artificial Sequence: Synthetic oligonucleotide
  Target: ATXN1; (+) strand; PAM type: YTN; PAM sequence: TTT
cttttaaattctaacatcag

SEQ ID NO: 286839 - DNA, 20 bp, Artificial Sequence
  Description of Artificial Sequence: Synthetic oligonucleotide
  Target: ATXN1; (+) strand; PAM type: YTN; PAM sequence: TTC
ttttaaattctaacatcagt

SEQ ID NO: 286840 - DNA, 20 bp, Artificial Sequence
  Description of Artificial Sequence: Synthetic oligonucleotide
  Target: ATXN1; (+) strand; PAM type: YTN; PAM sequence: CTT
ttaaattctaacatcagtga

SEQ ID NO: 286841 - DNA, 20 bp, Artificial Sequence
  Description of Artificial Sequence: Synthetic oligonucleotide
  Target: ATXN1; (+) strand; PAM type: YTN; PAM sequence: TTT
taaattctaacatcagtgag

SEQ ID NO: 286842 - DNA, 20 bp, Artificial Sequence
  Description of Artificial Sequence: Synthetic oligonucleotide
  Target: ATXN1; (+) strand; PAM type: YTN; PAM sequence: TTT
aaattctaacatcagtgagc

SEQ ID NO: 286843 - DNA, 20 bp, Artificial Sequence
  Description of Artificial Sequence: Synthetic oligonucleotide
  Target: ATXN1; (+) strand; PAM type: YTN; PAM sequence: TTA
aattctaacatcagtgagca

SEQ ID NO: 286844 - DNA, 20 bp, Artificial Sequence
  Description of Artificial Sequence: Synthetic oligonucleotide
  Target: ATXN1; (+) strand; PAM type: YTN; PAM sequence: TTC
taacatcagtgagcagccaa

SEQ ID NO: 286845 - DNA, 20 bp, Artificial Sequence
  Description of Artificial Sequence: Synthetic oligonucleotide
  Target: ATXN1; (+) strand; PAM type: YTN; PAM sequence: CTA
acatcagtgagcagccaaaa

SEQ ID NO: 286846 - DNA, 20 bp, Artificial Sequence
  Description of Artificial Sequence: Synthetic oligonucleotide
  Target: ATXN1; (+) strand; PAM type: YTN; PAM sequence: TTC
tttttttttttttttagatg

SEQ ID NO: 286847 - DNA, 20 bp, Artificial Sequence
  Description of Artificial Sequence: Synthetic oligonucleotide
  Target: ATXN1; (+) strand; PAM type: YTN; PAM sequence: CTT
tttttttttttttagatgga

SEQ ID NO: 286848 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttagatggag

SEQ ID NO: 286849 - DNA, 20 bp, Artificial Sequence
  Description of Artificial Sequence: Synthetic oligonucleotide
  Target: ATXN1; (+) strand; PAM type: YTN; PAM sequence: TTT
tttttttttttagatggagt

SEQ ID NO: 286850 - DNA, 20 bp, Artificial Sequence
  Description of Artificial Sequence: Synthetic oligonucleotide
  Target: ATXN1; (+) strand; PAM type: YTN; PAM sequence: TTT
ttttttttttagatggagtc

SEQ ID NO: 286851 - DNA, 20 bp, Artificial Sequence
  Description of Artificial Sequence: Synthetic oligonucleotide
  Target: ATXN1; (+) strand; PAM type: YTN; PAM sequence: TTT
tttttttttagatggagtct

SEQ ID NO: 286852 - DNA, 20 bp, Artificial Sequence
  Description of Artificial Sequence: Synthetic oligonucleotide
  Target: ATXN1; (+) strand; PAM type: YTN; PAM sequence: TTT
ttttttttagatggagtctc

SEQ ID NO: 286853 - DNA, 20 bp, Artificial Sequence
  Description of Artificial Sequence: Synthetic oligonucleotide
  Target: ATXN1; (+) strand; PAM type: YTN; PAM sequence: TTT
tttttttagatggagtctcg

SEQ ID NO: 286854 - DNA, 20 bp, Artificial Sequence
  Description of Artificial Sequence: Synthetic oligonucleotide
  Target: ATXN1; (+) strand; PAM type: YTN; PAM sequence: TTT
ttttttagatggagtctcgc

SEQ ID NO: 286855 - DNA, 20 bp, Artificial Sequence
  Description of Artificial Sequence: Synthetic oligonucleotide
  Target: ATXN1; (+) strand; PAM type: YTN; PAM sequence: TTT
tttttagatggagtctcgct

SEQ ID NO: 286856 - DNA, 20 bp, Artificial Sequence
  Description of Artificial Sequence: Synthetic oligonucleotide
  Target: ATXN1; (+) strand; PAM type: YTN; PAM sequence: TTT
ttttagatggagtctcgctc

SEQ ID NO: 286857 - DNA, 20 bp, Artificial Sequence
  Description of Artificial Sequence: Synthetic oligonucleotide
  Target: ATXN1; (+) strand; PAM type: YTN; PAM sequence: TTT
tttagatggagtctcgctct

SEQ ID NO: 286858 - DNA, 20 bp, Artificial Sequence
  Description of Artificial Sequence: Synthetic oligonucleotide
  Target: ATXN1; (+) strand; PAM type: YTN; PAM sequence: TTT
ttagatggagtctcgctctg

SEQ ID NO: 286859 - DNA, 20 bp, Artificial Sequence
  Description of Artificial Sequence: Synthetic oligonucleotide
  Target: ATXN1; (+) strand; PAM type: YTN; PAM sequence: TTT
tagatggagtctcgctctgt

SEQ ID NO: 286860 - DNA, 20 bp, Artificial Sequence
  Description of Artificial Sequence: Synthetic oligonucleotide
  Target: ATXN1; (+) strand; PAM type: YTN; PAM sequence: TTT
agatggagtctcgctctgtg

SEQ ID NO: 286861 - DNA, 20 bp, Artificial Sequence
  Description of Artificial Sequence: Synthetic oligonucleotide
  Target: ATXN1; (+) strand; PAM type: YTN; PAM sequence: TTA
gatggagtctcgctctgtga

SEQ ID NO: 286862 - DNA, 20 bp, Artificial Sequence
  Description of Artificial Sequence: Synthetic oligonucleotide
  Target: ATXN1; (+) strand; PAM type: YTN; PAM sequence: CTC
gctctgtgacccaggctgga

SEQ ID NO: 286863 - DNA, 20 bp, Artificial Sequence
  Description of Artificial Sequence: Synthetic oligonucleotide
  Target: ATXN1; (+) strand; PAM type: YTN; PAM sequence: CTC
tgtgacccaggctggagtgc

SEQ ID NO: 286864 - DNA, 20 bp, Artificial Sequence
  Description of Artificial Sequence: Synthetic oligonucleotide
  Target: ATXN1; (+) strand; PAM type: YTN; PAM sequence: CTG
tgacccaggctggagtgcag

SEQ ID NO: 286865 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggcatgatctt

SEQ ID NO: 286866 - DNA, 20 bp, Artificial Sequence
  Description of Artificial Sequence: Synthetic oligonucleotide
  Target: ATXN1; (+) strand; PAM type: YTN; PAM sequence: CTT
ggctcactgcaaccttcgcc

SEQ ID NO: 286867 - DNA, 20 bp, Artificial Sequence
  Description of Artificial Sequence: Synthetic oligonucleotide
  Target: ATXN1; (+) strand; PAM type: YTN; PAM sequence: TTG
gctcactgcaaccttcgcct

SEQ ID NO: 286868 - DNA, 20 bp, Artificial Sequence
  Description of Artificial Sequence: Synthetic oligonucleotide
  Target: ATXN1; (+) strand; PAM type: YTN; PAM sequence: CTC
actgcaaccttcgcctcctg

SEQ ID NO: 286869 - DNA, 20 bp, Artificial Sequence
  Description of Artificial Sequence: Synthetic oligonucleotide
  Target: ATXN1; (+) strand; PAM type: YTN; PAM sequence: CTG
caaccttcgcctcctgggtt

SEQ ID NO: 286870 - DNA, 20 bp, Artificial Sequence
  Description of Artificial Sequence: Synthetic oligonucleotide
  Target: ATXN1; (+) strand; PAM type: YTN; PAM sequence: CTT
cgcctcctgggttcaagcaa

SEQ ID NO: 286871 - DNA, 20 bp, Artificial Sequence
  Description of Artificial Sequence: Synthetic oligonucleotide
  Target: ATXN1; (+) strand; PAM type: YTN; PAM sequence: TTC
gcctcctgggttcaagcaag

SEQ ID NO: 286872 - DNA, 20 bp, Artificial Sequence
  Description of Artificial Sequence: Synthetic oligonucleotide
  Target: ATXN1; (+) strand; PAM type: YTN; PAM sequence: CTC
ctgggttcaagcaagtctct

SEQ ID NO: 286873 - DNA, 20 bp, Artificial Sequence
  Description of Artificial Sequence: Synthetic oligonucleotide
  Target: ATXN1; (+) strand; PAM type: YTN; PAM sequence: CTG
ggttcaagcaagtctcttgc

SEQ ID NO: 286874 - DNA, 20 bp, Artificial Sequence
  Description of Artificial Sequence: Synthetic oligonucleotide
  Target: ATXN1; (+) strand; PAM type: YTN; PAM sequence: TTC
aagcaagtctcttgcctcag

SEQ ID NO: 286875 - DNA, 20 bp, Artificial Sequence
  Description of Artificial Sequence: Synthetic oligonucleotide
  Target: ATXN1; (+) strand; PAM type: YTN; PAM sequence: CTC
ttgcctcagcctcccaagta

SEQ ID NO: 286876 - DNA, 20 bp, Artificial Sequence
  Description of Artificial Sequence: Synthetic oligonucleotide
  Target: ATXN1; (+) strand; PAM type: YTN; PAM sequence: CTT
gcctcagcctcccaagtagc

SEQ ID NO: 286877 - DNA, 20 bp, Artificial Sequence
  Description of Artificial Sequence: Synthetic oligonucleotide
  Target: ATXN1; (+) strand; PAM type: YTN; PAM sequence: TTG
cctcagcctcccaagtagct

SEQ ID NO: 286878 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagtagctggga

SEQ ID NO: 286879 - DNA, 20 bp, Artificial Sequence
  Description of Artificial Sequence: Synthetic oligonucleotide
  Target: ATXN1; (+) strand; PAM type: YTN; PAM sequence: CTC
ccaagtagctgggactacag

SEQ ID NO: 286880 - DNA, 20 bp, Artificial Sequence
  Description of Artificial Sequence: Synthetic oligonucleotide
  Target: ATXN1; (+) strand; PAM type: YTN; PAM sequence: CTG
ggactacaggcgcaggccac

SEQ ID NO: 286881 - DNA, 20 bp, Artificial Sequence
  Description of Artificial Sequence: Synthetic oligonucleotide
  Target: ATXN1; (+) strand; PAM type: YTN; PAM sequence: CTA
caggcgcaggccaccatgcc

SEQ ID NO: 286882 - DNA, 20 bp, Artificial Sequence
  Description of Artificial Sequence: Synthetic oligonucleotide
  Target: ATXN1; (+) strand; PAM type: YTN; PAM sequence: CTG
ctaatttttgtatttttagt

SEQ ID NO: 286883 - DNA, 20 bp, Artificial Sequence
  Description of Artificial Sequence: Synthetic oligonucleotide
  Target: ATXN1; (+) strand; PAM type: YTN; PAM sequence: CTA
atttttgtatttttagtaca

SEQ ID NO: 286884 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtacagatg

SEQ ID NO: 286885 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtacagatgg

SEQ ID NO: 286886 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtacagatggg

SEQ ID NO: 286887 - DNA, 20 bp, Artificial Sequence
  Description of Artificial Sequence: Synthetic oligonucleotide
  Target: ATXN1; (+) strand; PAM type: YTN; PAM sequence: TTG
tatttttagtacagatgggg

SEQ ID NO: 286888 - DNA, 20 bp, Artificial Sequence
  Description of Artificial Sequence: Synthetic oligonucleotide
  Target: ATXN1; (+) strand; PAM type: YTN; PAM sequence: TTT
ttagtacagatggggtttca

SEQ ID NO: 286889 - DNA, 20 bp, Artificial Sequence
  Description of Artificial Sequence: Synthetic oligonucleotide
  Target: ATXN1; (+) strand; PAM type: YTN; PAM sequence: TTT
tagtacagatggggtttcac

SEQ ID NO: 286890 - DNA, 20 bp, Artificial Sequence
  Description of Artificial Sequence: Synthetic oligonucleotide
  Target: ATXN1; (+) strand; PAM type: YTN; PAM sequence: TTT
agtacagatggggtttcacc

SEQ ID NO: 286891 - DNA, 20 bp, Artificial Sequence
  Description of Artificial Sequence: Synthetic oligonucleotide
  Target: ATXN1; (+) strand; PAM type: YTN; PAM sequence: TTA
gtacagatggggtttcaccg

SEQ ID NO: 286892 - DNA, 20 bp, Artificial Sequence
  Description of Artificial Sequence: Synthetic oligonucleotide
  Target: ATXN1; (+) strand; PAM type: YTN; PAM sequence: TTT
caccgtgttggccagaatgg

SEQ ID NO: 286893 - DNA, 20 bp, Artificial Sequence
  Description of Artificial Sequence: Synthetic oligonucleotide
  Target: ATXN1; (+) strand; PAM type: YTN; PAM sequence: TTC
accgtgttggccagaatggt

SEQ ID NO: 286894 - DNA, 20 bp, Artificial Sequence
  Description of Artificial Sequence: Synthetic oligonucleotide
  Target: ATXN1; (+) strand; PAM type: YTN; PAM sequence: TTG
gccagaatggtcttgatctc

SEQ ID NO: 286895 - DNA, 20 bp, Artificial Sequence
  Description of Artificial Sequence: Synthetic oligonucleotide
  Target: ATXN1; (+) strand; PAM type: YTN; PAM sequence: CTT
gatctcttgacctcatgaac

SEQ ID NO: 286896 - DNA, 20 bp, Artificial Sequence
  Description of Artificial Sequence: Synthetic oligonucleotide
  Target: ATXN1; (+) strand; PAM type: YTN; PAM sequence: TTG
atctcttgacctcatgaacc

SEQ ID NO: 286897 - DNA, 20 bp, Artificial Sequence
  Description of Artificial Sequence: Synthetic oligonucleotide
  Target: ATXN1; (+) strand; PAM type: YTN; PAM sequence: CTC
ttgacctcatgaaccacccg

SEQ ID NO: 286898 - DNA, 20 bp, Artificial Sequence
  Description of Artificial Sequence: Synthetic oligonucleotide
  Target: ATXN1; (+) strand; PAM type: YTN; PAM sequence: CTT
gacctcatgaaccacccgct

SEQ ID NO: 286899 - DNA, 20 bp, Artificial Sequence
  Description of Artificial Sequence: Synthetic oligonucleotide
  Target: ATXN1; (+) strand; PAM type: YTN; PAM sequence: TTG
acctcatgaaccacccgctt

SEQ ID NO: 286900 - DNA, 20 bp, Artificial Sequence
  Description of Artificial Sequence: Synthetic oligonucleotide
  Target: ATXN1; (+) strand; PAM type: YTN; PAM sequence: CTC
atgaaccacccgcttcggcc

SEQ ID NO: 286901 - DNA, 20 bp, Artificial Sequence
  Description of Artificial Sequence: Synthetic oligonucleotide
  Target: ATXN1; (+) strand; PAM type: YTN; PAM sequence: CTT
cggcctcccaaagtgctgag

SEQ ID NO: 286902 - DNA, 20 bp, Artificial Sequence
  Description of Artificial Sequence: Synthetic oligonucleotide
  Target: ATXN1; (+) strand; PAM type: YTN; PAM sequence: TTC
ggcctcccaaagtgctgaga

SEQ ID NO: 286903 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgagattacag

SEQ ID NO: 286904 - DNA, 20 bp, Artificial Sequence
  Description of Artificial Sequence: Synthetic oligonucleotide
  Target: ATXN1; (+) strand; PAM type: YTN; PAM sequence: CTG
agattacaggcgtgagccac

SEQ ID NO: 286905 - DNA, 20 bp, Artificial Sequence
  Description of Artificial Sequence: Synthetic oligonucleotide
  Target: ATXN1; (+) strand; PAM type: YTN; PAM sequence: TTA
caggcgtgagccactgagcc

SEQ ID NO: 286906 - DNA, 20 bp, Artificial Sequence
  Description of Artificial Sequence: Synthetic oligonucleotide
  Target: ATXN1; (+) strand; PAM type: YTN; PAM sequence: CTG
agcctggccgcagcccaaat

SEQ ID NO: 286907 - DNA, 20 bp, Artificial Sequence
  Description of Artificial Sequence: Synthetic oligonucleotide
  Target: ATXN1; (+) strand; PAM type: YTN; PAM sequence: CTG
gccgcagcccaaattctgaa

SEQ ID NO: 286908 - DNA, 20 bp, Artificial Sequence
  Description of Artificial Sequence: Synthetic oligonucleotide
  Target: ATXN1; (+) strand; PAM type: YTN; PAM sequence: TTC
tgaacggggaaagaggataa

SEQ ID NO: 286909 - DNA, 20 bp, Artificial Sequence
  Description of Artificial Sequence: Synthetic oligonucleotide
  Target: ATXN1; (+) strand; PAM type: YTN; PAM sequence: CTG
aacggggaaagaggataagg

SEQ ID NO: 286910 - DNA, 20 bp, Artificial Sequence
  Description of Artificial Sequence: Synthetic oligonucleotide
  Target: ATXN1; (+) strand; PAM type: YTN; PAM sequence: CTC
ctacttttgcaagcttcttt

SEQ ID NO: 286911 - DNA, 20 bp, Artificial Sequence
  Description of Artificial Sequence: Synthetic oligonucleotide
  Target: ATXN1; (+) strand; PAM type: YTN; PAM sequence: CTA
cttttgcaagcttcttttgc

SEQ ID NO: 286912 - DNA, 20 bp, Artificial Sequence
  Description of Artificial Sequence: Synthetic oligonucleotide
  Target: ATXN1; (+) strand; PAM type: YTN; PAM sequence: CTT
ttgcaagcttcttttgcttc

SEQ ID NO: 286913 - DNA, 20 bp, Artificial Sequence
  Description of Artificial Sequence: Synthetic oligonucleotide
  Target: ATXN1; (+) strand; PAM type: YTN; PAM sequence: TTT
tgcaagcttcttttgcttcc

SEQ ID NO: 286914 - DNA, 20 bp, Artificial Sequence
  Description of Artificial Sequence: Synthetic oligonucleotide
  Target: ATXN1; (+) strand; PAM type: YTN; PAM sequence: TTT
gcaagcttcttttgcttcct

SEQ ID NO: 286915 - DNA, 20 bp, Artificial Sequence
  Description of Artificial Sequence: Synthetic oligonucleotide
  Target: ATXN1; (+) strand; PAM type: YTN; PAM sequence: TTG
caagcttcttttgcttccta

SEQ ID NO: 286916 - DNA, 20 bp, Artificial Sequence
  Description of Artificial Sequence: Synthetic oligonucleotide
  Target: ATXN1; (+) strand; PAM type: YTN; PAM sequence: CTT
cttttgcttcctatgaaggc

SEQ ID NO: 286917 - DNA, 20 bp, Artificial Sequence
  Description of Artificial Sequence: Synthetic oligonucleotide
  Target: ATXN1; (+) strand; PAM type: YTN; PAM sequence: TTC
ttttgcttcctatgaaggct

SEQ ID NO: 286918 - DNA, 20 bp, Artificial Sequence
  Description of Artificial Sequence: Synthetic oligonucleotide
  Target: ATXN1; (+) strand; PAM type: YTN; PAM sequence: CTT
ttgcttcctatgaaggcttg

SEQ ID NO: 286919 - DNA, 20 bp, Artificial Sequence
  Description of Artificial Sequence: Synthetic oligonucleotide
  Target: ATXN1; (+) strand; PAM type: YTN; PAM sequence: TTT
tgcttcctatgaaggcttgc

SEQ ID NO: 286920 - DNA, 20 bp, Artificial Sequence
  Description of Artificial Sequence: Synthetic oligonucleotide
  Target: ATXN1; (+) strand; PAM type: YTN; PAM sequence: TTT
gcttcctatgaaggcttgcc

SEQ ID NO: 286921 - DNA, 20 bp, Artificial Sequence
  Description of Artificial Sequence: Synthetic oligonucleotide
  Target: ATXN1; (+) strand; PAM type: YTN; PAM sequence: TTG
cttcctatgaaggcttgcca

SEQ ID NO: 286922 - DNA, 20 bp, Artificial Sequence
  Description of Artificial Sequence: Synthetic oligonucleotide
  Target: ATXN1; (+) strand; PAM type: YTN; PAM sequence: CTT
cctatgaaggcttgccataa

SEQ ID NO: 286923 - DNA, 20 bp, Artificial Sequence
  Description of Artificial Sequence: Synthetic oligonucleotide
  Target: ATXN1; (+) strand; PAM type: YTN; PAM sequence: TTC
ctatgaaggcttgccataaa

SEQ ID NO: 286924 - DNA, 20 bp, Artificial Sequence
  Description of Artificial Sequence: Synthetic oligonucleotide
  Target: ATXN1; (+) strand; PAM type: YTN; PAM sequence: CTA
tgaaggcttgccataaagat

SEQ ID NO: 286925 - DNA, 20 bp, Artificial Sequence
  Description of Artificial Sequence: Synthetic oligonucleotide
  Target: ATXN1; (+) strand; PAM type: YTN; PAM sequence: CTT
gccataaagatagaaatgct

SEQ ID NO: 286926 - DNA, 20 bp, Artificial Sequence
  Description of Artificial Sequence: Synthetic oligonucleotide
  Target: ATXN1; (+) strand; PAM type: YTN; PAM sequence: TTG
ccataaagatagaaatgctt

SEQ ID NO: 286927 - DNA, 20 bp, Artificial Sequence
  Description of Artificial Sequence: Synthetic oligonucleotide
  Target: ATXN1; (+) strand; PAM type: YTN; PAM sequence: CTT
tgacatcacaaactgggttc

SEQ ID NO: 286928 - DNA, 20 bp, Artificial Sequence
  Description of Artificial Sequence: Synthetic oligonucleotide
  Target: ATXN1; (+) strand; PAM type: YTN; PAM sequence: TTT
gacatcacaaactgggttca

SEQ ID NO: 286929 - DNA, 20 bp, Artificial Sequence
  Description of Artificial Sequence: Synthetic oligonucleotide
  Target: ATXN1; (+) strand; PAM type: YTN; PAM sequence: TTG
acatcacaaactgggttcat

SEQ ID NO: 286930 - DNA, 20 bp, Artificial Sequence
  Description of Artificial Sequence: Synthetic oligonucleotide
  Target: ATXN1; (+) strand; PAM type: YTN; PAM sequence: CTG
ggttcatgttccactgtgac

SEQ ID NO: 286931 - DNA, 20 bp, Artificial Sequence
  Description of Artificial Sequence: Synthetic oligonucleotide
  Target: ATXN1; (+) strand; PAM type: YTN; PAM sequence: TTC
atgttccactgtgaccatgg

SEQ ID NO: 286932 - DNA, 20 bp, Artificial Sequence
  Description of Artificial Sequence: Synthetic oligonucleotide
  Target: ATXN1; (+) strand; PAM type: YTN; PAM sequence: TTC
cactgtgaccatggacaggc

SEQ ID NO: 286933 - DNA, 20 bp, Artificial Sequence
  Description of Artificial Sequence: Synthetic oligonucleotide
  Target: ATXN1; (+) strand; PAM type: YTN; PAM sequence: CTG
tgaccatggacaggctatgt

SEQ ID NO: 286934 - DNA, 20 bp, Artificial Sequence
  Description of Artificial Sequence: Synthetic oligonucleotide
  Target: ATXN1; (+) strand; PAM type: YTN; PAM sequence: CTA
tgtaactgagcttcggctac

SEQ ID NO: 286935 - DNA, 20 bp, Artificial Sequence
  Description of Artificial Sequence: Synthetic oligonucleotide
  Target: ATXN1; (+) strand; PAM type: YTN; PAM sequence: CTG
agcttcggctactcatttac

SEQ ID NO: 286936 - DNA, 20 bp, Artificial Sequence
  Description of Artificial Sequence: Synthetic oligonucleotide
  Target: ATXN1; (+) strand; PAM type: YTN; PAM sequence: CTT
cggctactcatttacaaaac

SEQ ID NO: 286937 - DNA, 20 bp, Artificial Sequence
  Description of Artificial Sequence: Synthetic oligonucleotide
  Target: ATXN1; (+) strand; PAM type: YTN; PAM sequence: TTC
ggctactcatttacaaaaca

SEQ ID NO: 286938 - DNA, 20 bp, Artificial Sequence
  Description of Artificial Sequence: Synthetic oligonucleotide
  Target: ATXN1; (+) strand; PAM type: YTN; PAM sequence: CTA
ctcatttacaaaacaggaat

SEQ ID NO: 286939 - DNA, 20 bp, Artificial Sequence
  Description of Artificial Sequence: Synthetic oligonucleotide
  Target: ATXN1; (+) strand; PAM type: YTN; PAM sequence: CTC
atttacaaaacaggaattat

SEQ ID NO: 286940 - DNA, 20 bp, Artificial Sequence
  Description of Artificial Sequence: Synthetic oligonucleotide
  Target: ATXN1; (+) strand; PAM type: YTN; PAM sequence: TTT
acaaaacaggaattatcata

SEQ ID NO: 286941 - DNA, 20 bp, Artificial Sequence
  Description of Artificial Sequence: Synthetic oligonucleotide
  Target: ATXN1; (+) strand; PAM type: YTN; PAM sequence: TTA
caaaacaggaattatcataa

SEQ ID NO: 286942 - DNA, 20 bp, Artificial Sequence
  Description of Artificial Sequence: Synthetic oligonucleotide
  Target: ATXN1; (+) strand; PAM type: YTN; PAM sequence: TTA
tcataatataatgtaatgta

SEQ ID NO: 286943 - DNA, 20 bp, Artificial Sequence
  Description of Artificial Sequence: Synthetic oligonucleotide
  Target: ATXN1; (+) strand; PAM type: YTN; PAM sequence: TTA
tgagataatgatataaagtg

SEQ ID NO: 286944 - DNA, 20 bp, Artificial Sequence
  Description of Artificial Sequence: Synthetic oligonucleotide
  Target: ATXN1; (+) strand; PAM type: YTN; PAM sequence: TTG
gcccattgcaatgttaaaga

SEQ ID NO: 286945 - DNA, 20 bp, Artificial Sequence
  Description of Artificial Sequence: Synthetic oligonucleotide
  Target: ATXN1; (+) strand; PAM type: YTN; PAM sequence: TTG
caatgttaaagagccctctc

SEQ ID NO: 286946 - DNA, 20 bp, Artificial Sequence
  Description of Artificial Sequence: Synthetic oligonucleotide
  Target: ATXN1; (+) strand; PAM type: YTN; PAM sequence: TTA
aagagccctctcagaaggag

SEQ ID NO: 286947 - DNA, 20 bp, Artificial Sequence
  Description of Artificial Sequence: Synthetic oligonucleotide
  Target: ATXN1; (+) strand; PAM type: YTN; PAM sequence: CTC
tcagaaggagcaccatactt

SEQ ID NO: 286948 - DNA, 20 bp, Artificial Sequence
  Description of Artificial Sequence: Synthetic oligonucleotide
  Target: ATXN1; (+) strand; PAM type: YTN; PAM sequence: CTC
agaaggagcaccatactttc

SEQ ID NO: 286949 - DNA, 20 bp, Artificial Sequence
  Description of Artificial Sequence: Synthetic oligonucleotide
  Target: ATXN1; (+) strand; PAM type: YTN; PAM sequence: CTT
tctttctaagtgccgataaa

SEQ ID NO: 286950 - DNA, 20 bp, Artificial Sequence
  Description of Artificial Sequence: Synthetic oligonucleotide
  Target: ATXN1; (+) strand; PAM type: YTN; PAM sequence: TTT
ctttctaagtgccgataaaa

SEQ ID NO: 286951 - DNA, 20 bp, Artificial Sequence
  Description of Artificial Sequence: Synthetic oligonucleotide
  Target: ATXN1; (+) strand; PAM type: YTN; PAM sequence: TTC
tttctaagtgccgataaaat

SEQ ID NO: 286952 - DNA, 20 bp, Artificial Sequence
  Description of Artificial Sequence: Synthetic oligonucleotide
  Target: ATXN1; (+) strand; PAM type: YTN; PAM sequence: CTT
tctaagtgccgataaaataa

SEQ ID NO: 286953 - DNA, 20 bp, Artificial Sequence
  Description of Artificial Sequence: Synthetic oligonucleotide
  Target: ATXN1; (+) strand; PAM type: YTN; PAM sequence: TTT
ctaagtgccgataaaataaa

SEQ ID NO: 286954 - DNA, 20 bp, Artificial Sequence
  Description of Artificial Sequence: Synthetic oligonucleotide
  Target: ATXN1; (+) strand; PAM type: YTN; PAM sequence: TTC
taagtgccgataaaataaaa

SEQ ID NO: 286955 - DNA, 20 bp, Artificial Sequence
  Description of Artificial Sequence: Synthetic oligonucleotide
  Target: ATXN1; (+) strand; PAM type: YTN; PAM sequence: CTA
agtgccgataaaataaaaga

SEQ ID NO: 286956 - DNA, 20 bp, Artificial Sequence
  Description of Artificial Sequence: Synthetic oligonucleotide
  Target: ATXN1; (+) strand; PAM type: YTN; PAM sequence: CTG
ggattgacccagccacctct

SEQ ID NO: 286957 - DNA, 20 bp, Artificial Sequence
  Description of Artificial Sequence: Synthetic oligonucleotide
  Target: ATXN1; (+) strand; PAM type: YTN; PAM sequence: TTG
acccagccacctctgctaag

SEQ ID NO: 286958 - DNA, 20 bp, Artificial Sequence
  Description of Artificial Sequence: Synthetic oligonucleotide
  Target: ATXN1; (+) strand; PAM type: YTN; PAM sequence: CTC
tgctaagggcctcctaccta

SEQ ID NO: 286959 - DNA, 20 bp, Artificial Sequence
  Description of Artificial Sequence: Synthetic oligonucleotide
  Target: ATXN1; (+) strand; PAM type: YTN; PAM sequence: CTG
ctaagggcctcctacctaga

SEQ ID NO: 286960 - DNA, 20 bp, Artificial Sequence
  Description of Artificial Sequence: Synthetic oligonucleotide
  Target: ATXN1; (+) strand; PAM type: YTN; PAM sequence: CTA
agggcctcctacctagagtc

SEQ ID NO: 286961 - DNA, 20 bp, Artificial Sequence
  Description of Artificial Sequence: Synthetic oligonucleotide
  Target: ATXN1; (+) strand; PAM type: YTN; PAM sequence: CTC
ctacctagagtcacctcact

SEQ ID NO: 286962 - DNA, 20 bp, Artificial Sequence
  Description of Artificial Sequence: Synthetic oligonucleotide
  Target: ATXN1; (+) strand; PAM type: YTN; PAM sequence: CTA
cctagagtcacctcactggg

SEQ ID NO: 286963 - DNA, 20 bp, Artificial Sequence
  Description of Artificial Sequence: Synthetic oligonucleotide
  Target: ATXN1; (+) strand; PAM type: YTN; PAM sequence: CTA
gagtcacctcactgggacct

SEQ ID NO: 286964 - DNA, 20 bp, Artificial Sequence
  Description of Artificial Sequence: Synthetic oligonucleotide
  Target: ATXN1; (+) strand; PAM type: YTN; PAM sequence: CTC
actgggacctgggacagcat

SEQ ID NO: 286965 - DNA, 20 bp, Artificial Sequence
  Description of Artificial Sequence: Synthetic oligonucleotide
  Target: ATXN1; (+) strand; PAM type: YTN; PAM sequence: CTG
ggacctgggacagcatgatt

SEQ ID NO: 286966 - DNA, 20 bp, Artificial Sequence
  Description of Artificial Sequence: Synthetic oligonucleotide
  Target: ATXN1; (+) strand; PAM type: YTN; PAM sequence: CTG
ggacagcatgattcttacca

SEQ ID NO: 286967 - DNA, 20 bp, Artificial Sequence
  Description of Artificial Sequence: Synthetic oligonucleotide
  Target: ATXN1; (+) strand; PAM type: YTN; PAM sequence: TTC
ttaccagtttctgagagctt

SEQ ID NO: 286968 - DNA, 20 bp, Artificial Sequence
  Description of Artificial Sequence: Synthetic oligonucleotide
  Target: ATXN1; (+) strand; PAM type: YTN; PAM sequence: CTT
accagtttctgagagcttga

SEQ ID NO: 286969 - DNA, 20 bp, Artificial Sequence
  Description of Artificial Sequence: Synthetic oligonucleotide
  Target: ATXN1; (+) strand; PAM type: YTN; PAM sequence: TTA
ccagtttctgagagcttgag

SEQ ID NO: 286970 - DNA, 20 bp, Artificial Sequence
  Description of Artificial Sequence: Synthetic oligonucleotide
  Target: ATXN1; (+) strand; PAM type: YTN; PAM sequence: TTT
ctgagagcttgaggtcttgg

SEQ ID NO: 286971 - DNA, 20 bp, Artificial Sequence
  Description of Artificial Sequence: Synthetic oligonucleotide
  Target: ATXN1; (+) strand; PAM type: YTN; PAM sequence: TTC
tgagagcttgaggtcttggg

SEQ ID NO: 286972 - DNA, 20 bp, Artificial Sequence
  Description of Artificial Sequence: Synthetic oligonucleotide
  Target: ATXN1; (+) strand; PAM type: YTN; PAM sequence: CTG
agagcttgaggtcttgggcc

SEQ ID NO: 286973 - DNA, 20 bp, Artificial Sequence
  Description of Artificial Sequence: Synthetic oligonucleotide
  Target: ATXN1; (+) strand; PAM type: YTN; PAM sequence: CTT
gaggtcttgggccctcgagc

SEQ ID NO: 286974 - DNA, 20 bp, Artificial Sequence
  Description of Artificial Sequence: Synthetic oligonucleotide
  Target: ATXN1; (+) strand; PAM type: YTN; PAM sequence: TTG
aggtcttgggccctcgagcc

SEQ ID NO: 286975 - DNA, 20 bp, Artificial Sequence
  Description of Artificial Sequence: Synthetic oligonucleotide
  Target: ATXN1; (+) strand; PAM type: YTN; PAM sequence: CTT
gggccctcgagccaggcgtc

SEQ ID NO: 286976 - DNA, 20 bp, Artificial Sequence
  Description of Artificial Sequence: Synthetic oligonucleotide
  Target: ATXN1; (+) strand; PAM type: YTN; PAM sequence: TTG
ggccctcgagccaggcgtcc

SEQ ID NO: 286977 - DNA, 20 bp, Artificial Sequence
  Description of Artificial Sequence: Synthetic oligonucleotide
  Target: ATXN1; (+) strand; PAM type: YTN; PAM sequence: CTC
gagccaggcgtccgctaaag

SEQ ID NO: 286978 - DNA, 20 bp, Artificial Sequence
  Description of Artificial Sequence: Synthetic oligonucleotide
  Target: ATXN1; (+) strand; PAM type: YTN; PAM sequence: CTA
aaggcaggtctgaggttagc

SEQ ID NO: 286979 - DNA, 20 bp, Artificial Sequence
  Description of Artificial Sequence: Synthetic oligonucleotide
  Target: ATXN1; (+) strand; PAM type: YTN; PAM sequence: CTG
aggttagcccatttcccagt

SEQ ID NO: 286980 - DNA, 20 bp, Artificial Sequence
  Description of Artificial Sequence: Synthetic oligonucleotide
  Target: ATXN1; (+) strand; PAM type: YTN; PAM sequence: TTA
gcccatttcccagttaccat

SEQ ID NO: 286981 - DNA, 20 bp, Artificial Sequence
  Description of Artificial Sequence: Synthetic oligonucleotide
  Target: ATXN1; (+) strand; PAM type: YTN; PAM sequence: TTT
cccagttaccattctccttt

SEQ ID NO: 286982 - DNA, 20 bp, Artificial Sequence
  Description of Artificial Sequence: Synthetic oligonucleotide
  Target: ATXN1; (+) strand; PAM type: YTN; PAM sequence: TTC
ccagttaccattctcctttc

SEQ ID NO: 286983 - DNA, 20 bp, Artificial Sequence
  Description of Artificial Sequence: Synthetic oligonucleotide
  Target: ATXN1; (+) strand; PAM type: YTN; PAM sequence: TTA
ccattctcctttcccctggc

SEQ ID NO: 286984 - DNA, 20 bp, Artificial Sequence
  Description of Artificial Sequence: Synthetic oligonucleotide
  Target: ATXN1; (+) strand; PAM type: YTN; PAM sequence: TTC
tcctttcccctggcttttct

SEQ ID NO: 286985 - DNA, 20 bp, Artificial Sequence
  Description of Artificial Sequence: Synthetic oligonucleotide
  Target: ATXN1; (+) strand; PAM type: YTN; PAM sequence: CTC
ctttcccctggcttttctcc

SEQ ID NO: 286986 - DNA, 20 bp, Artificial Sequence
  Description of Artificial Sequence: Synthetic oligonucleotide
  Target: ATXN1; (+) strand; PAM type: YTN; PAM sequence: CTT
tcccctggcttttctccttc

SEQ ID NO: 286987 - DNA, 20 bp, Artificial Sequence
  Description of Artificial Sequence: Synthetic oligonucleotide
  Target: ATXN1; (+) strand; PAM type: YTN; PAM sequence: TTT
cccctggcttttctccttcc

SEQ ID NO: 286988 - DNA, 20 bp, Artificial Sequence
  Description of Artificial Sequence: Synthetic oligonucleotide
  Target: ATXN1; (+) strand; PAM type: YTN; PAM sequence: TTC
ccctggcttttctccttcca

SEQ ID NO: 286989 - DNA, 20 bp, Artificial Sequence
  Description of Artificial Sequence: Synthetic oligonucleotide
  Target: ATXN1; (+) strand; PAM type: YTN; PAM sequence: CTG
gcttttctccttccaagagg

SEQ ID NO: 286990 - DNA, 20 bp, Artificial Sequence
  Description of Artificial Sequence: Synthetic oligonucleotide
  Target: ATXN1; (+) strand; PAM type: YTN; PAM sequence: CTT
ttctccttccaagaggcttt

SEQ ID NO: 286991 - DNA, 20 bp, Artificial Sequence
  Description of Artificial Sequence: Synthetic oligonucleotide
  Target: ATXN1; (+) strand; PAM type: YTN; PAM sequence: TTT
tctccttccaagaggcttta

SEQ ID NO: 286992 - DNA, 20 bp, Artificial Sequence
  Description of Artificial Sequence: Synthetic oligonucleotide
  Target: ATXN1; (+) strand; PAM type: YTN; PAM sequence: TTT
ctccttccaagaggctttaa

SEQ ID NO: 286993 - DNA, 20 bp, Artificial Sequence
  Description of Artificial Sequence: Synthetic oligonucleotide
  Target: ATXN1; (+) strand; PAM type: YTN; PAM sequence: TTC
tccttccaagaggctttaag

SEQ ID NO: 286994 - DNA, 20 bp, Artificial Sequence
  Description of Artificial Sequence: Synthetic oligonucleotide
  Target: ATXN1; (+) strand; PAM type: YTN; PAM sequence: CTC
cttccaagaggctttaagcc

SEQ ID NO: 286995 - DNA, 20 bp, Artificial Sequence
  Description of Artificial Sequence: Synthetic oligonucleotide
  Target: ATXN1; (+) strand; PAM type: YTN; PAM sequence: CTT
ccaagaggctttaagccttt

SEQ ID NO: 286996 - DNA, 20 bp, Artificial Sequence
  Description of Artificial Sequence: Synthetic oligonucleotide
  Target: ATXN1; (+) strand; PAM type: YTN; PAM sequence: TTC
caagaggctttaagcctttc

SEQ ID NO: 286997 - DNA, 20 bp, Artificial Sequence
  Description of Artificial Sequence: Synthetic oligonucleotide
  Target: ATXN1; (+) strand; PAM type: YTN; PAM sequence: CTT
taagcctttcccactcctcc

SEQ ID NO: 286998 - DNA, 20 bp, Artificial Sequence
  Description of Artificial Sequence: Synthetic oligonucleotide
  Target: ATXN1; (+) strand; PAM type: YTN; PAM sequence: TTT
aagcctttcccactcctccc

SEQ ID NO: 286999 - DNA, 20 bp, Artificial Sequence
  Description of Artificial Sequence: Synthetic oligonucleotide
  Target: ATXN1; (+) strand; PAM type: YTN; PAM sequence: TTA
agcctttcccactcctccct

SEQ ID NO: 287000 - DNA, 20 bp, Artificial Sequence
  Description of Artificial Sequence: Synthetic oligonucleotide
  Target: ATXN1; (+) strand; PAM type: YTN; PAM sequence: CTT
tcccactcctccctcctctc

SEQ ID NO: 287001 - DNA, 20 bp, Artificial Sequence
  Description of Artificial Sequence: Synthetic oligonucleotide
  Target: ATXN1; (+) strand; PAM type: YTN; PAM sequence: TTT
cccactcctccctcctctcc

SEQ ID NO: 287002 - DNA, 20 bp, Artificial Sequence
  Description of Artificial Sequence: Synthetic oligonucleotide
  Target: ATXN1; (+) strand; PAM type: YTN; PAM sequence: TTC
ccactcctccctcctctcct

SEQ ID NO: 287003 - DNA, 20 bp, Artificial Sequence
  Description of Artificial Sequence: Synthetic oligonucleotide
  Target: ATXN1; (+) strand; PAM type: YTN; PAM sequence: CTC
ctccctcctctccttctggt

SEQ ID NO: 287004 - DNA, 20 bp, Artificial Sequence
  Description of Artificial Sequence: Synthetic oligonucleotide
  Target: ATXN1; (+) strand; PAM type: YTN; PAM sequence: CTC
cctcctctccttctggtccc

SEQ ID NO: 287005 - DNA, 20 bp, Artificial Sequence
  Description of Artificial Sequence: Synthetic oligonucleotide
  Target: ATXN1; (+) strand; PAM type: YTN; PAM sequence: CTC
ctctccttctggtcccctgc

SEQ ID NO: 287006 - DNA, 20 bp, Artificial Sequence
  Description of Artificial Sequence: Synthetic oligonucleotide
  Target: ATXN1; (+) strand; PAM type: YTN; PAM sequence: CTC
tccttctggtcccctgcctc

SEQ ID NO: 287007 - DNA, 20 bp, Artificial Sequence
  Description of Artificial Sequence: Synthetic oligonucleotide
  Target: ATXN1; (+) strand; PAM type: YTN; PAM sequence: CTC
cttctggtcccctgcctcaa

SEQ ID NO: 287008 - DNA, 20 bp, Artificial Sequence
  Description of Artificial Sequence: Synthetic oligonucleotide
  Target: ATXN1; (+) strand; PAM type: YTN; PAM sequence: CTT
ctggtcccctgcctcaactc

SEQ ID NO: 287009 - DNA, 20 bp, Artificial Sequence
  Description of Artificial Sequence: Synthetic oligonucleotide
  Target: ATXN1; (+) strand; PAM type: YTN; PAM sequence: TTC
tggtcccctgcctcaactca

SEQ ID NO: 287010 - DNA, 20 bp, Artificial Sequence
  Description of Artificial Sequence: Synthetic oligonucleotide
  Target: ATXN1; (+) strand; PAM type: YTN; PAM sequence: CTG
gtcccctgcctcaactcacc

SEQ ID NO: 287011 - DNA, 20 bp, Artificial Sequence
  Description of Artificial Sequence: Synthetic oligonucleotide
  Target: ATXN1; (+) strand; PAM type: YTN; PAM sequence: CTG
cctcaactcacccagagact

SEQ ID NO: 287012 - DNA, 20 bp, Artificial Sequence
  Description of Artificial Sequence: Synthetic oligonucleotide
  Target: ATXN1; (+) strand; PAM type: YTN; PAM sequence: CTC
aactcacccagagactgaga

SEQ ID NO: 287013 - DNA, 20 bp, Artificial Sequence
  Description of Artificial Sequence: Synthetic oligonucleotide
  Target: ATXN1; (+) strand; PAM type: YTN; PAM sequence: CTC
acccagagactgagaatgca

SEQ ID NO: 287014 - DNA, 20 bp, Artificial Sequence
  Description of Artificial Sequence: Synthetic oligonucleotide
  Target: ATXN1; (+) strand; PAM type: YTN; PAM sequence: CTG
agaatgcagtaccattcctc

SEQ ID NO: 287015 - DNA, 20 bp, Artificial Sequence
  Description of Artificial Sequence: Synthetic oligonucleotide
  Target: ATXN1; (+) strand; PAM type: YTN; PAM sequence: TTC
ctcactgggccaccttccct

SEQ ID NO: 287016 - DNA, 20 bp, Artificial Sequence
  Description of Artificial Sequence: Synthetic oligonucleotide
  Target: ATXN1; (+) strand; PAM type: YTN; PAM sequence: CTC
actgggccaccttccctttc

SEQ ID NO: 287017 - DNA, 20 bp, Artificial Sequence
  Description of Artificial Sequence: Synthetic oligonucleotide
  Target: ATXN1; (+) strand; PAM type: YTN; PAM sequence: CTG
ggccaccttccctttccagg

SEQ ID NO: 287018 - DNA, 20 bp, Artificial Sequence
  Description of Artificial Sequence: Synthetic oligonucleotide
  Target: ATXN1; (+) strand; PAM type: YTN; PAM sequence: CTT
ccctttccaggctccatact

SEQ ID NO: 287019 - DNA, 20 bp, Artificial Sequence
  Description of Artificial Sequence: Synthetic oligonucleotide
  Target: ATXN1; (+) strand; PAM type: YTN; PAM sequence: TTC
cctttccaggctccatactc

SEQ ID NO: 287020 - DNA, 20 bp, Artificial Sequence
  Description of Artificial Sequence: Synthetic oligonucleotide
  Target: ATXN1; (+) strand; PAM type: YTN; PAM sequence: CTT
tccaggctccatactccatt

SEQ ID NO: 287021 - DNA, 20 bp, Artificial Sequence
  Description of Artificial Sequence: Synthetic oligonucleotide
  Target: ATXN1; (+) strand; PAM type: YTN; PAM sequence: TTT
ccaggctccatactccattc

SEQ ID NO: 287022 - DNA, 20 bp, Artificial Sequence
  Description of Artificial Sequence: Synthetic oligonucleotide
  Target: ATXN1; (+) strand; PAM type: YTN; PAM sequence: TTC
caggctccatactccattct

SEQ ID NO: 287023 - DNA, 20 bp, Artificial Sequence
  Description of Artificial Sequence: Synthetic oligonucleotide
  Target: ATXN1; (+) strand; PAM type: YTN; PAM sequence: CTC
catactccattctgtaataa

SEQ ID NO: 287024 - DNA, 20 bp, Artificial Sequence
  Description of Artificial Sequence: Synthetic oligonucleotide
  Target: ATXN1; (+) strand; PAM type: YTN; PAM sequence: CTC
cattctgtaataaagttctc

SEQ ID NO: 287025 - DNA, 20 bp, Artificial Sequence
  Description of Artificial Sequence: Synthetic oligonucleotide
  Target: ATXN1; (+) strand; PAM type: YTN; PAM sequence: TTC
tgtaataaagttctcatggg

SEQ ID NO: 287026 - DNA, 20 bp, Artificial Sequence
  Description of Artificial Sequence: Synthetic oligonucleotide
  Target: ATXN1; (+) strand; PAM type: YTN; PAM sequence: CTG
taataaagttctcatgggga

SEQ ID NO: 287027 - DNA, 20 bp, Artificial Sequence
  Description of Artificial Sequence: Synthetic oligonucleotide
  Target: ATXN1; (+) strand; PAM type: YTN; PAM sequence: TTC
tcatggggagacctccaaca

SEQ ID NO: 287028 - DNA, 20 bp, Artificial Sequence
  Description of Artificial Sequence: Synthetic oligonucleotide
  Target: ATXN1; (+) strand; PAM type: YTN; PAM sequence: CTC
atggggagacctccaacagc

SEQ ID NO: 287029 - DNA, 20 bp, Artificial Sequence
  Description of Artificial Sequence: Synthetic oligonucleotide
  Target: ATXN1; (+) strand; PAM type: YTN; PAM sequence: CTC
caacagcccaacagttgagt

SEQ ID NO: 287030 - DNA, 20 bp, Artificial Sequence
  Description of Artificial Sequence: Synthetic oligonucleotide
  Target: ATXN1; (+) strand; PAM type: YTN; PAM sequence: TTG
agtgtacacagccttgagtg

SEQ ID NO: 287031 - DNA, 20 bp, Artificial Sequence
  Description of Artificial Sequence: Synthetic oligonucleotide
  Target: ATXN1; (+) strand; PAM type: YTN; PAM sequence: CTT
gagtgcttagcggccagaac

SEQ ID NO: 287032 - DNA, 20 bp, Artificial Sequence
  Description of Artificial Sequence: Synthetic oligonucleotide
  Target: ATXN1; (+) strand; PAM type: YTN; PAM sequence: TTG
agtgcttagcggccagaacc

SEQ ID NO: 287033 - DNA, 20 bp, Artificial Sequence
  Description of Artificial Sequence: Synthetic oligonucleotide
  Target: ATXN1; (+) strand; PAM type: YTN; PAM sequence: CTT
agcggccagaacctcattga

SEQ ID NO: 287034 - DNA, 20 bp, Artificial Sequence
  Description of Artificial Sequence: Synthetic oligonucleotide
  Target: ATXN1; (+) strand; PAM type: YTN; PAM sequence: TTA
gcggccagaacctcattgaa

SEQ ID NO: 287035 - DNA, 20 bp, Artificial Sequence
  Description of Artificial Sequence: Synthetic oligonucleotide
  Target: ATXN1; (+) strand; PAM type: YTN; PAM sequence: CTC
attgaaaacacagttccata

SEQ ID NO: 287036 - DNA, 20 bp, Artificial Sequence
  Description of Artificial Sequence: Synthetic oligonucleotide
  Target: ATXN1; (+) strand; PAM type: YTN; PAM sequence: TTG
aaaacacagttccataagga

SEQ ID NO: 287037 - DNA, 20 bp, Artificial Sequence
  Description of Artificial Sequence: Synthetic oligonucleotide
  Target: ATXN1; (+) strand; PAM type: YTN; PAM sequence: TTC
cataaggaaaggcaggtttt

SEQ ID NO: 287038 - DNA, 20 bp, Artificial Sequence
  Description of Artificial Sequence: Synthetic oligonucleotide
  Target: ATXN1; (+) strand; PAM type: YTN; PAM sequence: TTT
taagacgagcaggtgaccag

SEQ ID NO: 287039 - DNA, 20 bp, Artificial Sequence
  Description of Artificial Sequence: Synthetic oligonucleotide
  Target: ATXN1; (+) strand; PAM type: YTN; PAM sequence: TTT
aagacgagcaggtgaccagg

SEQ ID NO: 287040 - DNA, 20 bp, Artificial Sequence
  Description of Artificial Sequence: Synthetic oligonucleotide
  Target: ATXN1; (+) strand; PAM type: YTN; PAM sequence: TTA
agacgagcaggtgaccaggc

SEQ ID NO: 287041 - DNA, 20 bp, Artificial Sequence
  Description of Artificial Sequence: Synthetic oligonucleotide
  Target: ATXN1; (+) strand; PAM type: YTN; PAM sequence: CTC
gccaaaagctaggcttgact

SEQ ID NO: 287042 - DNA, 20 bp, Artificial Sequence
  Description of Artificial Sequence: Synthetic oligonucleotide
  Target: ATXN1; (+) strand; PAM type: YTN; PAM sequence: CTA
ggcttgacttaggcctcatt

SEQ ID NO: 287043 - DNA, 20 bp, Artificial Sequence
  Description of Artificial Sequence: Synthetic oligonucleotide
  Target: ATXN1; (+) strand; PAM type: YTN; PAM sequence: CTT
gacttaggcctcatttggag

SEQ ID NO: 287044 - DNA, 20 bp, Artificial Sequence
  Description of Artificial Sequence: Synthetic oligonucleotide
  Target: ATXN1; (+) strand; PAM type: YTN; PAM sequence: TTG
acttaggcctcatttggagg

SEQ ID NO: 287045 - DNA, 20 bp, Artificial Sequence
  Description of Artificial Sequence: Synthetic oligonucleotide
  Target: ATXN1; (+) strand; PAM type: YTN; PAM sequence: CTT
aggcctcatttggaggtctg

SEQ ID NO: 287046 - DNA, 20 bp, Artificial Sequence
  Description of Artificial Sequence: Synthetic oligonucleotide
  Target: ATXN1; (+) strand; PAM type: YTN; PAM sequence: TTA
ggcctcatttggaggtctga

SEQ ID NO: 287047 - DNA, 20 bp, Artificial Sequence
  Description of Artificial Sequence: Synthetic oligonucleotide
  Target: ATXN1; (+) strand; PAM type: YTN; PAM sequence: CTC
atttggaggtctgagttgaa

SEQ ID NO: 287048 - DNA, 20 bp, Artificial Sequence
  Description of Artificial Sequence: Synthetic oligonucleotide
  Target: ATXN1; (+) strand; PAM type: YTN; PAM sequence: TTT
ggaggtctgagttgaatttc

SEQ ID NO: 287049 - DNA, 20 bp, Artificial Sequence
  Description of Artificial Sequence: Synthetic oligonucleotide
  Target: ATXN1; (+) strand; PAM type: YTN; PAM sequence: TTG
gaggtctgagttgaatttca

SEQ ID NO: 287050 - DNA, 20 bp, Artificial Sequence
  Description of Artificial Sequence: Synthetic oligonucleotide
  Target: ATXN1; (+) strand; PAM type: YTN; PAM sequence: CTG
agttgaatttcaaaaatcaa

SEQ ID NO: 287051 - DNA, 20 bp, Artificial Sequence
  Description of Artificial Sequence: Synthetic oligonucleotide
  Target: ATXN1; (+) strand; PAM type: YTN; PAM sequence: TTG
aatttcaaaaatcaaataca

SEQ ID NO: 287052 - DNA, 20 bp, Artificial Sequence
  Description of Artificial Sequence: Synthetic oligonucleotide
  Target: ATXN1; (+) strand; PAM type: YTN; PAM sequence: TTT
caaaaatcaaatacaaaaac

SEQ ID NO: 287053 - DNA, 20 bp, Artificial Sequence
  Description of Artificial Sequence: Synthetic oligonucleotide
  Target: ATXN1; (+) strand; PAM type: YTN; PAM sequence: TTC
aaaaatcaaatacaaaaaca

SEQ ID NO: 287054 - DNA, 20 bp, Artificial Sequence
  Description of Artificial Sequence: Synthetic oligonucleotide
  Target: ATXN1; (+) strand; PAM type: YTN; PAM sequence: CTG
gcagaagtttagagaggcag

SEQ ID NO: 287055 - DNA, 20 bp, Artificial Sequence
  Description of Artificial Sequence: Synthetic oligonucleotide
  Target: ATXN1; (+) strand; PAM type: YTN; PAM sequence: TTT
agagaggcagaaaagagcat

SEQ ID NO: 287056 - DNA, 20 bp, Artificial Sequence
  Description of Artificial Sequence: Synthetic oligonucleotide
  Target: ATXN1; (+) strand; PAM type: YTN; PAM sequence: TTA
gagaggcagaaaagagcatt

SEQ ID NO: 287057 - DNA, 20 bp, Artificial Sequence
  Description of Artificial Sequence: Synthetic oligonucleotide
  Target: ATXN1; (+) strand; PAM type: YTN; PAM sequence: TTA
ccacaagaaaagacgcggga

SEQ ID NO: 287058 - DNA, 20 bp, Artificial Sequence
  Description of Artificial Sequence: Synthetic oligonucleotide
  Target: ATXN1; (+) strand; PAM type: YTN; PAM sequence: CTT
caccagaacaggcaggagga

SEQ ID NO: 287059 - DNA, 20 bp, Artificial Sequence
  Description of Artificial Sequence: Synthetic oligonucleotide
  Target: ATXN1; (+) strand; PAM type: YTN; PAM sequence: TTC
accagaacaggcaggaggaa

SEQ ID NO: 287060 - DNA, 20 bp, Artificial Sequence
  Description of Artificial Sequence: Synthetic oligonucleotide
  Target: ATXN1; (+) strand; PAM type: YTN; PAM sequence: TTC
caccaggtgaaactggcctg

SEQ ID NO: 287061 - DNA, 20 bp, Artificial Sequence
  Description of Artificial Sequence: Synthetic oligonucleotide
  Target: ATXN1; (+) strand; PAM type: YTN; PAM sequence: CTG
gcctggtggctgtggggtac

SEQ ID NO: 287062 - DNA, 20 bp, Artificial Sequence
  Description of Artificial Sequence: Synthetic oligonucleotide
  Target: ATXN1; (+) strand; PAM type: YTN; PAM sequence: CTG
gtggctgtggggtacagggg

SEQ ID NO: 287063 - DNA, 20 bp, Artificial Sequence
  Description of Artificial Sequence: Synthetic oligonucleotide
  Target: ATXN1; (+) strand; PAM type: YTN; PAM sequence: CTG
tggggtacaggggaagaggt

SEQ ID NO: 287064 - DNA, 20 bp, Artificial Sequence
  Description of Artificial Sequence: Synthetic oligonucleotide
  Target: ATXN1; (+) strand; PAM type: YTN; PAM sequence: CTG
gggtggggatgaggacagtg

SEQ ID NO: 287065 - DNA, 20 bp, Artificial Sequence
  Description of Artificial Sequence: Synthetic oligonucleotide
  Target: ATXN1; (+) strand; PAM type: YTN; PAM sequence: TTG
acgaaggcattgtgcagcac

SEQ ID NO: 287066 - DNA, 20 bp, Artificial Sequence
  Description of Artificial Sequence: Synthetic oligonucleotide
  Target: ATXN1; (+) strand; PAM type: YTN; PAM sequence: TTG
tgcagcaccccatgcaaagg

SEQ ID NO: 287067 - DNA, 20 bp, Artificial Sequence
  Description of Artificial Sequence: Synthetic oligonucleotide
  Target: ATXN1; (+) strand; PAM type: YTN; PAM sequence: CTC
tccgtcacacaggtactggc

SEQ ID NO: 287068 - DNA, 20 bp, Artificial Sequence
  Description of Artificial Sequence: Synthetic oligonucleotide
  Target: ATXN1; (+) strand; PAM type: YTN; PAM sequence: CTC
cgtcacacaggtactggcat

SEQ ID NO: 287069 - DNA, 20 bp, Artificial Sequence
  Description of Artificial Sequence: Synthetic oligonucleotide
  Target: ATXN1; (+) strand; PAM type: YTN; PAM sequence: CTG
gcatgagggtgtggggaccg

SEQ ID NO: 287070 - DNA, 20 bp, Artificial Sequence
  Description of Artificial Sequence: Synthetic oligonucleotide
  Target: ATXN1; (+) strand; PAM type: YTN; PAM sequence: CTA
tgagttcctgggtctctacc

SEQ ID NO: 287071 - DNA, 20 bp, Artificial Sequence
  Description of Artificial Sequence: Synthetic oligonucleotide
  Target: ATXN1; (+) strand; PAM type: YTN; PAM sequence: TTC
ctgggtctctaccaggattt

SEQ ID NO: 287072 - DNA, 20 bp, Artificial Sequence
  Description of Artificial Sequence: Synthetic oligonucleotide
  Target: ATXN1; (+) strand; PAM type: YTN; PAM sequence: CTG
ggtctctaccaggattttcc

SEQ ID NO: 287073 - DNA, 20 bp, Artificial Sequence
  Description of Artificial Sequence: Synthetic oligonucleotide
  Target: ATXN1; (+) strand; PAM type: YTN; PAM sequence: CTC
taccaggattttccaggtca

SEQ ID NO: 287074 - DNA, 20 bp, Artificial Sequence
  Description of Artificial Sequence: Synthetic oligonucleotide
  Target: ATXN1; (+) strand; PAM type: YTN; PAM sequence: CTA
ccaggattttccaggtcagc

SEQ ID NO: 287075 - DNA, 20 bp, Artificial Sequence
  Description of Artificial Sequence: Synthetic oligonucleotide
  Target: ATXN1; (+) strand; PAM type: YTN; PAM sequence: TTT
tccaggtcagcatcgagtga

SEQ ID NO: 287076 - DNA, 20 bp, Artificial Sequence
  Description of Artificial Sequence: Synthetic oligonucleotide
  Target: ATXN1; (+) strand; PAM type: YTN; PAM sequence: TTT
ccaggtcagcatcgagtgat

SEQ ID NO: 287077 - DNA, 20 bp, Artificial Sequence
  Description of Artificial Sequence: Synthetic oligonucleotide
  Target: ATXN1; (+) strand; PAM type: YTN; PAM sequence: TTC
caggtcagcatcgagtgata

SEQ ID NO: 287078 - DNA, 20 bp, Artificial Sequence
  Description of Artificial Sequence: Synthetic oligonucleotide
  Target: ATXN1; (+) strand; PAM type: YTN; PAM sequence: CTA
tctctcctagaagtggtggg

SEQ ID NO: 287079 - DNA, 20 bp, Artificial Sequence
  Description of Artificial Sequence: Synthetic oligonucleotide
  Target: ATXN1; (+) strand; PAM type: YTN; PAM sequence: CTC
tcctagaagtggtgggaact

SEQ ID NO: 287080 - DNA, 20 bp, Artificial Sequence
  Description of Artificial Sequence: Synthetic oligonucleotide
  Target: ATXN1; (+) strand; PAM type: YTN; PAM sequence: CTC
ctagaagtggtgggaactga

SEQ ID NO: 287081 - DNA, 20 bp, Artificial Sequence
  Description of Artificial Sequence: Synthetic oligonucleotide
  Target: ATXN1; (+) strand; PAM type: YTN; PAM sequence: CTA
gaagtggtgggaactgatgg

SEQ ID NO: 287082 - DNA, 20 bp, Artificial Sequence
  Description of Artificial Sequence: Synthetic oligonucleotide
  Target: ATXN1; (+) strand; PAM type: YTN; PAM sequence: CTG
atgggaatgaccatggaagc

SEQ ID NO: 287083 - DNA, 20 bp, Artificial Sequence
  Description of Artificial Sequence: Synthetic oligonucleotide
  Target: ATXN1; (+) strand; PAM type: YTN; PAM sequence: CTG
aatccacaaaccaagggtct

SEQ ID NO: 287084 - DNA, 20 bp, Artificial Sequence
  Description of Artificial Sequence: Synthetic oligonucleotide
  Target: ATXN1; (+) strand; PAM type: YTN; PAM sequence: CTC
cttatcttgtcctctcatgg

SEQ ID NO: 287085 - DNA, 20 bp, Artificial Sequence
  Description of Artificial Sequence: Synthetic oligonucleotide
  Target: ATXN1; (+) strand; PAM type: YTN; PAM sequence: CTT
atcttgtcctctcatggata

SEQ ID NO: 287086 - DNA, 20 bp, Artificial Sequence
  Description of Artificial Sequence: Synthetic oligonucleotide
  Target: ATXN1; (+) strand; PAM type: YTN; PAM sequence: TTA
tcttgtcctctcatggataa

SEQ ID NO: 287087 - DNA, 20 bp, Artificial Sequence
  Description of Artificial Sequence: Synthetic oligonucleotide
  Target: ATXN1; (+) strand; PAM type: YTN; PAM sequence: CTT
gtcctctcatggataaggct

SEQ ID NO: 287088 - DNA, 20 bp, Artificial Sequence
  Description of Artificial Sequence: Synthetic oligonucleotide
  Target: ATXN1; (+) strand; PAM type: YTN; PAM sequence: TTG
tcctctcatggataaggctt

SEQ ID NO: 287089 - DNA, 20 bp, Artificial Sequence
  Description of Artificial Sequence: Synthetic oligonucleotide
  Target: ATXN1; (+) strand; PAM type: YTN; PAM sequence: CTC
tcatggataaggcttcgtaa

SEQ ID NO: 287090 - DNA, 20 bp, Artificial Sequence
  Description of Artificial Sequence: Synthetic oligonucleotide
  Target: ATXN1; (+) strand; PAM type: YTN; PAM sequence: CTC
atggataaggcttcgtaaag

SEQ ID NO: 287091 - DNA, 20 bp, Artificial Sequence
  Description of Artificial Sequence: Synthetic oligonucleotide
  Target: ATXN1; (+) strand; PAM type: YTN; PAM sequence: CTT
cgtaaaggggggattcctca

SEQ ID NO: 287092 - DNA, 20 bp, Artificial Sequence
  Description of Artificial Sequence: Synthetic oligonucleotide
  Target: ATXN1; (+) strand; PAM type: YTN; PAM sequence: TTC
gtaaaggggggattcctcaa

SEQ ID NO: 287093 - DNA, 20 bp, Artificial Sequence
  Description of Artificial Sequence: Synthetic oligonucleotide
  Target: ATXN1; (+) strand; PAM type: YTN; PAM sequence: TTC
ctcaaggtcttttaaccaag

SEQ ID NO: 287094 - DNA, 20 bp, Artificial Sequence
  Description of Artificial Sequence: Synthetic oligonucleotide
  Target: ATXN1; (+) strand; PAM type: YTN; PAM sequence: CTC
aaggtcttttaaccaagtct

SEQ ID NO: 287095 - DNA, 20 bp, Artificial Sequence
  Description of Artificial Sequence: Synthetic oligonucleotide
  Target: ATXN1; (+) strand; PAM type: YTN; PAM sequence: CTT
ttaaccaagtctgcacatgg

SEQ ID NO: 287096 - DNA, 20 bp, Artificial Sequence
  Description of Artificial Sequence: Synthetic oligonucleotide
  Target: ATXN1; (+) strand; PAM type: YTN; PAM sequence: TTT
taaccaagtctgcacatggg

SEQ ID NO: 287097 - DNA, 20 bp, Artificial Sequence
  Description of Artificial Sequence: Synthetic oligonucleotide
  Target: ATXN1; (+) strand; PAM type: YTN; PAM sequence: TTT
aaccaagtctgcacatggga

SEQ ID NO: 287098 - DNA, 20 bp, Artificial Sequence
  Description of Artificial Sequence: Synthetic oligonucleotide
  Target: ATXN1; (+) strand; PAM type: YTN; PAM sequence: TTA
accaagtctgcacatgggag

SEQ ID NO: 287099 - DNA, 20 bp, Artificial Sequence
  Description of Artificial Sequence: Synthetic oligonucleotide
  Target: ATXN1; (+) strand; PAM type: YTN; PAM sequence: CTG
cacatgggagaaaacgatgg

SEQ ID NO: 287100 - DNA, 20 bp, Artificial Sequence
  Description of Artificial Sequence: Synthetic oligonucleotide
  Target: ATXN1; (+) strand; PAM type: YTN; PAM sequence: CTT
ctcaagaacctctcaataca

SEQ ID NO: 287101 - DNA, 20 bp, Artificial Sequence
  Description of Artificial Sequence: Synthetic oligonucleotide
  Target: ATXN1; (+) strand; PAM type: YTN; PAM sequence: TTC
tcaagaacctctcaatacaa

SEQ ID NO: 287102 - DNA, 20 bp, Artificial Sequence
  Description of Artificial Sequence: Synthetic oligonucleotide
  Target: ATXN1; (+) strand; PAM type: YTN; PAM sequence: CTC
aagaacctctcaatacaaag

SEQ ID NO: 287103 - DNA, 20 bp, Artificial Sequence
  Description of Artificial Sequence: Synthetic oligonucleotide
  Target: ATXN1; (+) strand; PAM type: YTN; PAM sequence: CTC
tcaatacaaagagataaaga

SEQ ID NO: 287104 - DNA, 20 bp, Artificial Sequence
  Description of Artificial Sequence: Synthetic oligonucleotide
  Target: ATXN1; (+) strand; PAM type: YTN; PAM sequence: CTC
aatacaaagagataaagagg

SEQ ID NO: 287105 - DNA, 20 bp, Artificial Sequence
  Description of Artificial Sequence: Synthetic oligonucleotide
  Target: ATXN1; (+) strand; PAM type: YTN; PAM sequence: CTG
taacctcagcactttggaag

SEQ ID NO: 287106 - DNA, 20 bp, Artificial Sequence
  Description of Artificial Sequence: Synthetic oligonucleotide
  Target: ATXN1; (+) strand; PAM type: YTN; PAM sequence: CTC
agcactttggaaggccaagg

SEQ ID NO: 287107 - DNA, 20 bp, Artificial Sequence
  Description of Artificial Sequence: Synthetic oligonucleotide
  Target: ATXN1; (+) strand; PAM type: YTN; PAM sequence: CTT
tggaaggccaaggagggaag

SEQ ID NO: 287108 - DNA, 20 bp, Artificial Sequence
  Description of Artificial Sequence: Synthetic oligonucleotide
  Target: ATXN1; (+) strand; PAM type: YTN; PAM sequence: TTT
ggaaggccaaggagggaaga

SEQ ID NO: 287109 - DNA, 20 bp, Artificial Sequence
  Description of Artificial Sequence: Synthetic oligonucleotide
  Target: ATXN1; (+) strand; PAM type: YTN; PAM sequence: TTG
gaaggccaaggagggaagac

SEQ ID NO: 287110 - DNA, 20 bp, Artificial Sequence
  Description of Artificial Sequence: Synthetic oligonucleotide
  Target: ATXN1; (+) strand; PAM type: YTN; PAM sequence: CTT
gagcccaggaattcaagacc

SEQ ID NO: 287111 - DNA, 20 bp, Artificial Sequence
  Description of Artificial Sequence: Synthetic oligonucleotide
  Target: ATXN1; (+) strand; PAM type: YTN; PAM sequence: TTG
agcccaggaattcaagacca

SEQ ID NO: 287112 - DNA, 20 bp, Artificial Sequence
  Description of Artificial Sequence: Synthetic oligonucleotide
  Target: ATXN1; (+) strand; PAM type: YTN; PAM sequence: TTC
aagaccagcctgggcaacac

SEQ ID NO: 287113 - DNA, 20 bp, Artificial Sequence
  Description of Artificial Sequence: Synthetic oligonucleotide
  Target: ATXN1; (+) strand; PAM type: YTN; PAM sequence: CTG
ggcaacacagcaaaactctg

SEQ ID NO: 287114 - DNA, 20 bp, Artificial Sequence
  Description of Artificial Sequence: Synthetic oligonucleotide
  Target: ATXN1; (+) strand; PAM type: YTN; PAM sequence: CTC
tgtctcaaaaaaaaaaaaaa

SEQ ID NO: 287115 - DNA, 20 bp, Artificial Sequence
  Description of Artificial Sequence: Synthetic oligonucleotide
  Target: ATXN1; (+) strand; PAM type: YTN; PAM sequence: CTG
tctcaaaaaaaaaaaaaaaa

SEQ ID NO: 287116 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaacaa

SEQ ID NO: 287117 - DNA, 20 bp, Artificial Sequence
  Description of Artificial Sequence: Synthetic oligonucleotide
  Target: ATXN1; (+) strand; PAM type: YTN; PAM sequence: TTA
tcgtggcacgtggtgcacat

SEQ ID NO: 287118 - DNA, 20 bp, Artificial Sequence
  Description of Artificial Sequence: Synthetic oligonucleotide
  Target: ATXN1; (+) strand; PAM type: YTN; PAM sequence: CTA
tagttccagctactcaactg

SEQ ID NO: 287119 - DNA, 20 bp, Artificial Sequence
  Description of Artificial Sequence: Synthetic oligonucleotide
  Target: ATXN1; (+) strand; PAM type: YTN; PAM sequence: TTC
cagctactcaactgactgag

SEQ ID NO: 287120 - DNA, 20 bp, Artificial Sequence
  Description of Artificial Sequence: Synthetic oligonucleotide
  Target: ATXN1; (+) strand; PAM type: YTN; PAM sequence: CTA
ctcaactgactgaggtggta

SEQ ID NO: 287121 - DNA, 20 bp, Artificial Sequence
  Description of Artificial Sequence: Synthetic oligonucleotide
  Target: ATXN1; (+) strand; PAM type: YTN; PAM sequence: CTC
aactgactgaggtggtagga

SEQ ID NO: 287122 - DNA, 20 bp, Artificial Sequence
  Description of Artificial Sequence: Synthetic oligonucleotide
  Target: ATXN1; (+) strand; PAM type: YTN; PAM sequence: CTG
actgaggtggtaggaccatt

SEQ ID NO: 287123 - DNA, 20 bp, Artificial Sequence
  Description of Artificial Sequence: Synthetic oligonucleotide
  Target: ATXN1; (+) strand; PAM type: YTN; PAM sequence: CTG
aggtggtaggaccattgctt

SEQ ID NO: 287124 - DNA, 20 bp, Artificial Sequence
  Description of Artificial Sequence: Synthetic oligonucleotide
  Target: ATXN1; (+) strand; PAM type: YTN; PAM sequence: TTG
cttgagcccaggagttcgag

SEQ ID NO: 287125 - DNA, 20 bp, Artificial Sequence
  Description of Artificial Sequence: Synthetic oligonucleotide
  Target: ATXN1; (+) strand; PAM type: YTN; PAM sequence: CTT
gagcccaggagttcgaggct

SEQ ID NO: 287126 - DNA, 20 bp, Artificial Sequence
  Description of Artificial Sequence: Synthetic oligonucleotide
  Target: ATXN1; (+) strand; PAM type: YTN; PAM sequence: TTG
agcccaggagttcgaggctg

SEQ ID NO: 287127 - DNA, 20 bp, Artificial Sequence
  Description of Artificial Sequence: Synthetic oligonucleotide
  Target: ATXN1; (+) strand; PAM type: YTN; PAM sequence: TTC
gaggctgcaatgaaccacaa

SEQ ID NO: 287128 - DNA, 20 bp, Artificial Sequence
  Description of Artificial Sequence: Synthetic oligonucleotide
  Target: ATXN1; (+) strand; PAM type: YTN; PAM sequence: CTG
caatgaaccacaattgtatc

SEQ ID NO: 287129 - DNA, 20 bp, Artificial Sequence
  Description of Artificial Sequence: Synthetic oligonucleotide
  Target: ATXN1; (+) strand; PAM type: YTN; PAM sequence: TTG
tatcactgctctccagcctg

SEQ ID NO: 287130 - DNA, 20 bp, Artificial Sequence
  Description of Artificial Sequence: Synthetic oligonucleotide
  Target: ATXN1; (+) strand; PAM type: YTN; PAM sequence: CTG
ctctccagcctgggtgatgg

SEQ ID NO: 287131 - DNA, 20 bp, Artificial Sequence
  Description of Artificial Sequence: Synthetic oligonucleotide
  Target: ATXN1; (+) strand; PAM type: YTN; PAM sequence: CTC
tccagcctgggtgatggaga

SEQ ID NO: 287132 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgatggagaga

SEQ ID NO: 287133 - DNA, 20 bp, Artificial Sequence
  Description of Artificial Sequence: Synthetic oligonucleotide
  Target: ATXN1; (+) strand; PAM type: YTN; PAM sequence: CTG
ggtgatggagagagaccctg

SEQ ID NO: 287134 - DNA, 20 bp, Artificial Sequence
  Description of Artificial Sequence: Synthetic oligonucleotide
  Target: ATXN1; (+) strand; PAM type: YTN; PAM sequence: CTG
tatctaaaaaaaagaaaaca

SEQ ID NO: 287135 - DNA, 20 bp, Artificial Sequence
  Description of Artificial Sequence: Synthetic oligonucleotide
  Target: ATXN1; (+) strand; PAM type: YTN; PAM sequence: CTA
aaaaaaagaaaacaaaatta

SEQ ID NO: 287136 - DNA, 20 bp, Artificial Sequence
  Description of Artificial Sequence: Synthetic oligonucleotide
  Target: ATXN1; (+) strand; PAM type: YTN; PAM sequence: TTA
aaagaaataaagaaaatgtc

SEQ ID NO: 287137 - DNA, 20 bp, Artificial Sequence
  Description of Artificial Sequence: Synthetic oligonucleotide
  Target: ATXN1; (+) strand; PAM type: YTN; PAM sequence: CTC
aggaagaagttgttcctctt

SEQ ID NO: 287138 - DNA, 20 bp, Artificial Sequence
  Description of Artificial Sequence: Synthetic oligonucleotide
  Target: ATXN1; (+) strand; PAM type: YTN; PAM sequence: TTG
ttcctcttcagacaactgga

SEQ ID NO: 287139 - DNA, 20 bp, Artificial Sequence
  Description of Artificial Sequence: Synthetic oligonucleotide
  Target: ATXN1; (+) strand; PAM type: YTN; PAM sequence: TTC
ctcttcagacaactggattt

SEQ ID NO: 287140 - DNA, 20 bp, Artificial Sequence
  Description of Artificial Sequence: Synthetic oligonucleotide
  Target: ATXN1; (+) strand; PAM type: YTN; PAM sequence: CTC
ttcagacaactggattttgt

SEQ ID NO: 287141 - DNA, 20 bp, Artificial Sequence
  Description of Artificial Sequence: Synthetic oligonucleotide
  Target: ATXN1; (+) strand; PAM type: YTN; PAM sequence: CTT
cagacaactggattttgttt

SEQ ID NO: 287142 - DNA, 20 bp, Artificial Sequence
  Description of Artificial Sequence: Synthetic oligonucleotide
  Target: ATXN1; (+) strand; PAM type: YTN; PAM sequence: TTC
agacaactggattttgtttc

SEQ ID NO: 287143 - DNA, 20 bp, Artificial Sequence
  Description of Artificial Sequence: Synthetic oligonucleotide
  Target: ATXN1; (+) strand; PAM type: YTN; PAM sequence: CTG
gattttgtttctcttctttt

SEQ ID NO: 287144 - DNA, 20 bp, Artificial Sequence
  Description of Artificial Sequence: Synthetic oligonucleotide
  Target: ATXN1; (+) strand; PAM type: YTN; PAM sequence: TTT
tgtttctcttcttttttttt

SEQ ID NO: 287145 - DNA, 20 bp, Artificial Sequence
  Description of Artificial Sequence: Synthetic oligonucleotide
  Target: ATXN1; (+) strand; PAM type: YTN; PAM sequence: TTT
gtttctcttctttttttttt

SEQ ID NO: 287146 - DNA, 20 bp, Artificial Sequence
  Description of Artificial Sequence: Synthetic oligonucleotide
  Target: ATXN1; (+) strand; PAM type: YTN; PAM sequence: TTG
tttctcttcttttttttttt

SEQ ID NO: 287147 - DNA, 20 bp, Artificial Sequence
  Description of Artificial Sequence: Synthetic oligonucleotide
  Target: ATXN1; (+) strand; PAM type: YTN; PAM sequence: TTT
ctcttctttttttttttttt

SEQ ID NO: 287148 - DNA, 20 bp, Artificial Sequence
  Description of Artificial Sequence: Synthetic oligonucleotide
  Target: ATXN1; (+) strand; PAM type: YTN; PAM sequence: TTC
tcttcttttttttttttttt

SEQ ID NO: 287149 - DNA, 20 bp, Artificial Sequence
  Description of Artificial Sequence: Synthetic oligonucleotide
  Target: ATXN1; (+) strand; PAM type: YTN; PAM sequence: CTC
ttcttttttttttttttttt

SEQ ID NO: 287150 - DNA, 20 bp, Artificial Sequence
  Description of Artificial Sequence: Synthetic oligonucleotide
  Target: ATXN1; (+) strand; PAM type: YTN; PAM sequence: CTT
ctttttttttttttttttta

SEQ ID NO: 287151 - DNA, 20 bp, Artificial Sequence
  Description of Artificial Sequence: Synthetic oligonucleotide
  Target: ATXN1; (+) strand; PAM type: YTN; PAM sequence: TTC
ttttttttttttttttttag

SEQ ID NO: 287152 - DNA, 20 bp, Artificial Sequence
  Description of Artificial Sequence: Synthetic oligonucleotide
  Target: ATXN1; (+) strand; PAM type: YTN; PAM sequence: CTT
ttttttttttttttttagac

SEQ ID NO: 287153 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttagaca

SEQ ID NO: 287154 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttagacag

SEQ ID NO: 287155 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttagacagg

SEQ ID NO: 287156 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttagacaggc

SEQ ID NO: 287157 - DNA, 20 bp, Artificial Sequence
  Description of Artificial Sequence: Synthetic oligonucleotide
  Target: ATXN1; (+) strand; PAM type: YTN; PAM sequence: TTT
tttttttttttagacaggct

SEQ ID NO: 287158 - DNA, 20 bp, Artificial Sequence
  Description of Artificial Sequence: Synthetic oligonucleotide
  Target: ATXN1; (+) strand; PAM type: YTN; PAM sequence: TTT
ttttttttttagacaggctt

SEQ ID NO: 287159 - DNA, 20 bp, Artificial Sequence
  Description of Artificial Sequence: Synthetic oligonucleotide
  Target: ATXN1; (+) strand; PAM type: YTN; PAM sequence: TTT
tttttttttagacaggcttg

SEQ ID NO: 287160 - DNA, 20 bp, Artificial Sequence
  Description of Artificial Sequence: Synthetic oligonucleotide
  Target: ATXN1; (+) strand; PAM type: YTN; PAM sequence: TTT
ttttttttagacaggcttgc

SEQ ID NO: 287161 - DNA, 20 bp, Artificial Sequence
  Description of Artificial Sequence: Synthetic oligonucleotide
  Target: ATXN1; (+) strand; PAM type: YTN; PAM sequence: TTT
tttttttagacaggcttgct

SEQ ID NO: 287162 - DNA, 20 bp, Artificial Sequence
  Description of Artificial Sequence: Synthetic oligonucleotide
  Target: ATXN1; (+) strand; PAM type: YTN; PAM sequence: TTT
ttttttagacaggcttgctt

SEQ ID NO: 287163 - DNA, 20 bp, Artificial Sequence
  Description of Artificial Sequence: Synthetic oligonucleotide
  Target: ATXN1; (+) strand; PAM type: YTN; PAM sequence: TTT
tttttagacaggcttgcttt

SEQ ID NO: 287164 - DNA, 20 bp, Artificial Sequence
  Description of Artificial Sequence: Synthetic oligonucleotide
  Target: ATXN1; (+) strand; PAM type: YTN; PAM sequence: TTT
ttttagacaggcttgctttg

SEQ ID NO: 287165 - DNA, 20 bp, Artificial Sequence
  Description of Artificial Sequence: Synthetic oligonucleotide
  Target: ATXN1; (+) strand; PAM type: YTN; PAM sequence: TTT
tttagacaggcttgctttgt

SEQ ID NO: 287166 - DNA, 20 bp, Artificial Sequence
  Description of Artificial Sequence: Synthetic oligonucleotide
  Target: ATXN1; (+) strand; PAM type: YTN; PAM sequence: TTT
ttagacaggcttgctttgtt

SEQ ID NO: 287167 - DNA, 20 bp, Artificial Sequence
  Description of Artificial Sequence: Synthetic oligonucleotide
  Target: ATXN1; (+) strand; PAM type: YTN; PAM sequence: TTT
tagacaggcttgctttgttg

SEQ ID NO: 287168 - DNA, 20 bp, Artificial Sequence
  Description of Artificial Sequence: Synthetic oligonucleotide
  Target: ATXN1; (+) strand; PAM type: YTN; PAM sequence: TTT
agacaggcttgctttgttgc

SEQ ID NO: 287169 - DNA, 20 bp, Artificial Sequence
  Description of Artificial Sequence: Synthetic oligonucleotide
  Target: ATXN1; (+) strand; PAM type: YTN; PAM sequence: TTA
gacaggcttgctttgttgcc

SEQ ID NO: 287170 - DNA, 20 bp, Artificial Sequence
  Description of Artificial Sequence: Synthetic oligonucleotide
  Target: ATXN1; (+) strand; PAM type: YTN; PAM sequence: CTT
gctttgttgcccaggctaga

SEQ ID NO: 287171 - DNA, 20 bp, Artificial Sequence
  Description of Artificial Sequence: Synthetic oligonucleotide
  Target: ATXN1; (+) strand; PAM type: YTN; PAM sequence: TTG
ctttgttgcccaggctagag

SEQ ID NO: 287172 - DNA, 20 bp, Artificial Sequence
  Description of Artificial Sequence: Synthetic oligonucleotide
  Target: ATXN1; (+) strand; PAM type: YTN; PAM sequence: CTT
tgttgcccaggctagagtgc

SEQ ID NO: 287173 - DNA, 20 bp, Artificial Sequence
  Description of Artificial Sequence: Synthetic oligonucleotide
  Target: ATXN1; (+) strand; PAM type: YTN; PAM sequence: TTT
gttgcccaggctagagtgca

SEQ ID NO: 287174 - DNA, 20 bp, Artificial Sequence
  Description of Artificial Sequence: Synthetic oligonucleotide
  Target: ATXN1; (+) strand; PAM type: YTN; PAM sequence: TTG
ttgcccaggctagagtgcag

SEQ ID NO: 287175 - DNA, 20 bp, Artificial Sequence
  Description of Artificial Sequence: Synthetic oligonucleotide
  Target: ATXN1; (+) strand; PAM type: YTN; PAM sequence: TTG
cccaggctagagtgcagtgg

SEQ ID NO: 287176 - DNA, 20 bp, Artificial Sequence
  Description of Artificial Sequence: Synthetic oligonucleotide
  Target: ATXN1; (+) strand; PAM type: YTN; PAM sequence: CTA
gagtgcagtggtacaatcag

SEQ ID NO: 287177 - DNA, 20 bp, Artificial Sequence
  Description of Artificial Sequence: Synthetic oligonucleotide
  Target: ATXN1; (+) strand; PAM type: YTN; PAM sequence: CTC
actgcagcctcagcctcctg

SEQ ID NO: 287178 - DNA, 20 bp, Artificial Sequence
  Description of Artificial Sequence: Synthetic oligonucleotide
  Target: ATXN1; (+) strand; PAM type: YTN; PAM sequence: CTG
cagcctcagcctcctggaac

SEQ ID NO: 287179 - DNA, 20 bp, Artificial Sequence
  Description of Artificial Sequence: Synthetic oligonucleotide
  Target: ATXN1; (+) strand; PAM type: YTN; PAM sequence: CTC
agcctcctggaaccaggtga

SEQ ID NO: 287180 - DNA, 20 bp, Artificial Sequence
  Description of Artificial Sequence: Synthetic oligonucleotide
  Target: ATXN1; (+) strand; PAM type: YTN; PAM sequence: CTC
ctggaaccaggtgatcctcc

SEQ ID NO: 287181 - DNA, 20 bp, Artificial Sequence
  Description of Artificial Sequence: Synthetic oligonucleotide
  Target: ATXN1; (+) strand; PAM type: YTN; PAM sequence: CTG
gaaccaggtgatcctcccac

SEQ ID NO: 287182 - DNA, 20 bp, Artificial Sequence
  Description of Artificial Sequence: Synthetic oligonucleotide
  Target: ATXN1; (+) strand; PAM type: YTN; PAM sequence: CTC
ccacttcagccttctgagta

SEQ ID NO: 287183 - DNA, 20 bp, Artificial Sequence
  Description of Artificial Sequence: Synthetic oligonucleotide
  Target: ATXN1; (+) strand; PAM type: YTN; PAM sequence: CTT
cagccttctgagtagccggg

SEQ ID NO: 287184 - DNA, 20 bp, Artificial Sequence
  Description of Artificial Sequence: Synthetic oligonucleotide
  Target: ATXN1; (+) strand; PAM type: YTN; PAM sequence: TTC
agccttctgagtagccggga

SEQ ID NO: 287185 - DNA, 20 bp, Artificial Sequence
  Description of Artificial Sequence: Synthetic oligonucleotide
  Target: ATXN1; (+) strand; PAM type: YTN; PAM sequence: CTT
ctgagtagccgggaccacag

SEQ ID NO: 287186 - DNA, 20 bp, Artificial Sequence
  Description of Artificial Sequence: Synthetic oligonucleotide
  Target: ATXN1; (+) strand; PAM type: YTN; PAM sequence: TTC
tgagtagccgggaccacagg

SEQ ID NO: 287187 - DNA, 20 bp, Artificial Sequence
  Description of Artificial Sequence: Synthetic oligonucleotide
  Target: ATXN1; (+) strand; PAM type: YTN; PAM sequence: CTG
agtagccgggaccacaggca

SEQ ID NO: 287188 - DNA, 20 bp, Artificial Sequence
  Description of Artificial Sequence: Synthetic oligonucleotide
  Target: ATXN1; (+) strand; PAM type: YTN; PAM sequence: CTG
gctgattaaaaaaaaaaaat

SEQ ID NO: 287189 - DNA, 20 bp, Artificial Sequence
  Description of Artificial Sequence: Synthetic oligonucleotide
  Target: ATXN1; (+) strand; PAM type: YTN; PAM sequence: CTG
attaaaaaaaaaaaatgtag

SEQ ID NO: 287190 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaaaaatgtagagat

SEQ ID NO: 287191 - DNA, 20 bp, Artificial Sequence
  Description of Artificial Sequence: Synthetic oligonucleotide
  Target: ATXN1; (+) strand; PAM type: YTN; PAM sequence: CTC
actatgttgcccaggctagt

SEQ ID NO: 287192 - DNA, 20 bp, Artificial Sequence
  Description of Artificial Sequence: Synthetic oligonucleotide
  Target: ATXN1; (+) strand; PAM type: YTN; PAM sequence: CTA
tgttgcccaggctagtctca

SEQ ID NO: 287193 - DNA, 20 bp, Artificial Sequence
  Description of Artificial Sequence: Synthetic oligonucleotide
  Target: ATXN1; (+) strand; PAM type: YTN; PAM sequence: TTG
cccaggctagtctcaaactc

SEQ ID NO: 287194 - DNA, 20 bp, Artificial Sequence
  Description of Artificial Sequence: Synthetic oligonucleotide
  Target: ATXN1; (+) strand; PAM type: YTN; PAM sequence: CTA
gtctcaaactcctgccctaa

SEQ ID NO: 287195 - DNA, 20 bp, Artificial Sequence
  Description of Artificial Sequence: Synthetic oligonucleotide
  Target: ATXN1; (+) strand; PAM type: YTN; PAM sequence: CTC
aaactcctgccctaagcaat

SEQ ID NO: 287196 - DNA, 20 bp, Artificial Sequence
  Description of Artificial Sequence: Synthetic oligonucleotide
  Target: ATXN1; (+) strand; PAM type: YTN; PAM sequence: CTC
ctgccctaagcaatcctccc

SEQ ID NO: 287197 - DNA, 20 bp, Artificial Sequence
  Description of Artificial Sequence: Synthetic oligonucleotide
  Target: ATXN1; (+) strand; PAM type: YTN; PAM sequence: CTG
ccctaagcaatcctcccact

SEQ ID NO: 287198 - DNA, 20 bp, Artificial Sequence
  Description of Artificial Sequence: Synthetic oligonucleotide
  Target: ATXN1; (+) strand; PAM type: YTN; PAM sequence: CTA
agcaatcctcccactttggc

SEQ ID NO: 287199 - DNA, 20 bp, Artificial Sequence
  Description of Artificial Sequence: Synthetic oligonucleotide
  Target: ATXN1; (+) strand; PAM type: YTN; PAM sequence: CTC
ccactttggcttcacaaagt

SEQ ID NO: 287200 - DNA, 20 bp, Artificial Sequence
  Description of Artificial Sequence: Synthetic oligonucleotide
  Target: ATXN1; (+) strand; PAM type: YTN; PAM sequence: CTT
tggcttcacaaagtgctgga

SEQ ID NO: 287201 - DNA, 20 bp, Artificial Sequence
  Description of Artificial Sequence: Synthetic oligonucleotide
  Target: ATXN1; (+) strand; PAM type: YTN; PAM sequence: TTT
ggcttcacaaagtgctggaa

SEQ ID NO: 287202 - DNA, 20 bp, Artificial Sequence
  Description of Artificial Sequence: Synthetic oligonucleotide
  Target: ATXN1; (+) strand; PAM type: YTN; PAM sequence: TTG
gcttcacaaagtgctggaaa

SEQ ID NO: 287203 - DNA, 20 bp, Artificial Sequence
  Description of Artificial Sequence: Synthetic oligonucleotide
  Target: ATXN1; (+) strand; PAM type: YTN; PAM sequence: CTT
cacaaagtgctggaaataca

SEQ ID NO: 287204 - DNA, 20 bp, Artificial Sequence
  Description of Artificial Sequence: Synthetic oligonucleotide
  Target: ATXN1; (+) strand; PAM type: YTN; PAM sequence: TTC
acaaagtgctggaaatacac

SEQ ID NO: 287205 - DNA, 20 bp, Artificial Sequence
  Description of Artificial Sequence: Synthetic oligonucleotide
  Target: ATXN1; (+) strand; PAM type: YTN; PAM sequence: CTG
gaaatacacactcaagccac

SEQ ID NO: 287206 - DNA, 20 bp, Artificial Sequence
  Description of Artificial Sequence: Synthetic oligonucleotide
  Target: ATXN1; (+) strand; PAM type: YTN; PAM sequence: CTC
aagccactgcacccagctga

SEQ ID NO: 287207 - DNA, 20 bp, Artificial Sequence
  Description of Artificial Sequence: Synthetic oligonucleotide
  Target: ATXN1; (+) strand; PAM type: YTN; PAM sequence: CTG
cacccagctgaccacctgga

SEQ ID NO: 287208 - DNA, 20 bp, Artificial Sequence
  Description of Artificial Sequence: Synthetic oligonucleotide
  Target: ATXN1; (+) strand; PAM type: YTN; PAM sequence: CTG
accacctggattttggaaaa

SEQ ID NO: 287209 - DNA, 20 bp, Artificial Sequence
  Description of Artificial Sequence: Synthetic oligonucleotide
  Target: ATXN1; (+) strand; PAM type: YTN; PAM sequence: CTG
gattttggaaaagaggaaaa

SEQ ID NO: 287210 - DNA, 20 bp, Artificial Sequence
  Description of Artificial Sequence: Synthetic oligonucleotide
  Target: ATXN1; (+) strand; PAM type: YTN; PAM sequence: TTT
tggaaaagaggaaaacggaa

SEQ ID NO: 287211 - DNA, 20 bp, Artificial Sequence
  Description of Artificial Sequence: Synthetic oligonucleotide
  Target: ATXN1; (+) strand; PAM type: YTN; PAM sequence: TTT
ggaaaagaggaaaacggaag

SEQ ID NO: 287212 - DNA, 20 bp, Artificial Sequence
  Description of Artificial Sequence: Synthetic oligonucleotide
  Target: ATXN1; (+) strand; PAM type: YTN; PAM sequence: TTG
gaaaagaggaaaacggaagt

SEQ ID NO: 287213 - DNA, 20 bp, Artificial Sequence
  Description of Artificial Sequence: Synthetic oligonucleotide
  Target: ATXN1; (+) strand; PAM type: YTN; PAM sequence: CTG
actgttagatgtgggaatca

SEQ ID NO: 287214 - DNA, 20 bp, Artificial Sequence
  Description of Artificial Sequence: Synthetic oligonucleotide
  Target: ATXN1; (+) strand; PAM type: YTN; PAM sequence: CTG
ttagatgtgggaatcagatg

SEQ ID NO: 287215 - DNA, 20 bp, Artificial Sequence
  Description of Artificial Sequence: Synthetic oligonucleotide
  Target: ATXN1; (+) strand; PAM type: YTN; PAM sequence: TTA
gatgtgggaatcagatgttt

SEQ ID NO: 287216 - DNA, 20 bp, Artificial Sequence
  Description of Artificial Sequence: Synthetic oligonucleotide
  Target: ATXN1; (+) strand; PAM type: YTN; PAM sequence: TTT
tcatgttatatatgtgaatt

SEQ ID NO: 287217 - DNA, 20 bp, Artificial Sequence
  Description of Artificial Sequence: Synthetic oligonucleotide
  Target: ATXN1; (+) strand; PAM type: YTN; PAM sequence: TTT
catgttatatatgtgaatta

SEQ ID NO: 287218 - DNA, 20 bp, Artificial Sequence
  Description of Artificial Sequence: Synthetic oligonucleotide
  Target: ATXN1; (+) strand; PAM type: YTN; PAM sequence: TTC
atgttatatatgtgaattat

SEQ ID NO: 287219 - DNA, 20 bp, Artificial Sequence
  Description of Artificial Sequence: Synthetic oligonucleotide
  Target: ATXN1; (+) strand; PAM type: YTN; PAM sequence: TTA
tatatgtgaattatattaca

SEQ ID NO: 287220 - DNA, 20 bp, Artificial Sequence
  Description of Artificial Sequence: Synthetic oligonucleotide
  Target: ATXN1; (+) strand; PAM type: YTN; PAM sequence: TTA
tattacatgcacatgtatgg

SEQ ID NO: 287221 - DNA, 20 bp, Artificial Sequence
  Description of Artificial Sequence: Synthetic oligonucleotide
  Target: ATXN1; (+) strand; PAM type: YTN; PAM sequence: TTA
catgcacatgtatggtgcat

SEQ ID NO: 287222 - DNA, 20 bp, Artificial Sequence
  Description of Artificial Sequence: Synthetic oligonucleotide
  Target: ATXN1; (+) strand; PAM type: YTN; PAM sequence: TTA
aacacactagagacattaga

SEQ ID NO: 287223 - DNA, 20 bp, Artificial Sequence
  Description of Artificial Sequence: Synthetic oligonucleotide
  Target: ATXN1; (+) strand; PAM type: YTN; PAM sequence: CTA
gagacattagaaaacaaatc

SEQ ID NO: 287224 - DNA, 20 bp, Artificial Sequence
  Description of Artificial Sequence: Synthetic oligonucleotide
  Target: ATXN1; (+) strand; PAM type: YTN; PAM sequence: TTA
gaaaacaaatcaaggactga

SEQ ID NO: 287225 - DNA, 20 bp, Artificial Sequence
  Description of Artificial Sequence: Synthetic oligonucleotide
  Target: ATXN1; (+) strand; PAM type: YTN; PAM sequence: CTG
aggaacaataaaaagtgttg

SEQ ID NO: 287226 - DNA, 20 bp, Artificial Sequence
  Description of Artificial Sequence: Synthetic oligonucleotide
  Target: ATXN1; (+) strand; PAM type: YTN; PAM sequence: TTG
caatggtgtaaaagtaatac

SEQ ID NO: 287227 - DNA, 20 bp, Artificial Sequence
  Description of Artificial Sequence: Synthetic oligonucleotide
  Target: ATXN1; (+) strand; PAM type: YTN; PAM sequence: TTA
tagtcttttacgtgaactgc

SEQ ID NO: 287228 - DNA, 20 bp, Artificial Sequence
  Description of Artificial Sequence: Synthetic oligonucleotide
  Target: ATXN1; (+) strand; PAM type: YTN; PAM sequence: CTT
ttacgtgaactgcttccact

SEQ ID NO: 287229 - DNA, 20 bp, Artificial Sequence
  Description of Artificial Sequence: Synthetic oligonucleotide
  Target: ATXN1; (+) strand; PAM type: YTN; PAM sequence: TTT
tacgtgaactgcttccacta

SEQ ID NO: 287230 - DNA, 20 bp, Artificial Sequence
  Description of Artificial Sequence: Synthetic oligonucleotide
  Target: ATXN1; (+) strand; PAM type: YTN; PAM sequence: TTT
acgtgaactgcttccactaa

SEQ ID NO: 287231 - DNA, 20 bp, Artificial Sequence
  Description of Artificial Sequence: Synthetic oligonucleotide
  Target: ATXN1; (+) strand; PAM type: YTN; PAM sequence: TTA
cgtgaactgcttccactaat

SEQ ID NO: 287232 - DNA, 20 bp, Artificial Sequence
  Description of Artificial Sequence: Synthetic oligonucleotide
  Target: ATXN1; (+) strand; PAM type: YTN; PAM sequence: CTG
cttccactaatgcccaatta

SEQ ID NO: 287233 - DNA, 20 bp, Artificial Sequence
  Description of Artificial Sequence: Synthetic oligonucleotide
  Target: ATXN1; (+) strand; PAM type: YTN; PAM sequence: CTT
ccactaatgcccaattacta

SEQ ID NO: 287234 - DNA, 20 bp, Artificial Sequence
  Description of Artificial Sequence: Synthetic oligonucleotide
  Target: ATXN1; (+) strand; PAM type: YTN; PAM sequence: TTC
cactaatgcccaattactat

SEQ ID NO: 287235 - DNA, 20 bp, Artificial Sequence
  Description of Artificial Sequence: Synthetic oligonucleotide
  Target: ATXN1; (+) strand; PAM type: YTN; PAM sequence: CTA
atgcccaattactatgcagc

SEQ ID NO: 287236 - DNA, 20 bp, Artificial Sequence
  Description of Artificial Sequence: Synthetic oligonucleotide
  Target: ATXN1; (+) strand; PAM type: YTN; PAM sequence: TTA
ctatgcagcacagtatcaat

SEQ ID NO: 287237 - DNA, 20 bp, Artificial Sequence
  Description of Artificial Sequence: Synthetic oligonucleotide
  Target: ATXN1; (+) strand; PAM type: YTN; PAM sequence: CTA
tgcagcacagtatcaattta

SEQ ID NO: 287238 - DNA, 20 bp, Artificial Sequence
  Description of Artificial Sequence: Synthetic oligonucleotide
  Target: ATXN1; (+) strand; PAM type: YTN; PAM sequence: TTT
agtggatcatgaactacgta

SEQ ID NO: 287239 - DNA, 20 bp, Artificial Sequence
  Description of Artificial Sequence: Synthetic oligonucleotide
  Target: ATXN1; (+) strand; PAM type: YTN; PAM sequence: TTA
gtggatcatgaactacgtat

SEQ ID NO: 287240 - DNA, 20 bp, Artificial Sequence
  Description of Artificial Sequence: Synthetic oligonucleotide
  Target: ATXN1; (+) strand; PAM type: YTN; PAM sequence: CTA
cgtatccgattgactcactt

SEQ ID NO: 287241 - DNA, 20 bp, Artificial Sequence
  Description of Artificial Sequence: Synthetic oligonucleotide
  Target: ATXN1; (+) strand; PAM type: YTN; PAM sequence: TTG
actcacttgtataagttaca

SEQ ID NO: 287242 - DNA, 20 bp, Artificial Sequence
  Description of Artificial Sequence: Synthetic oligonucleotide
  Target: ATXN1; (+) strand; PAM type: YTN; PAM sequence: CTC
acttgtataagttacatttt

SEQ ID NO: 287243 - DNA, 20 bp, Artificial Sequence
  Description of Artificial Sequence: Synthetic oligonucleotide
  Target: ATXN1; (+) strand; PAM type: YTN; PAM sequence: CTT
gtataagttacattttatga

SEQ ID NO: 287244 - DNA, 20 bp, Artificial Sequence
  Description of Artificial Sequence: Synthetic oligonucleotide
  Target: ATXN1; (+) strand; PAM type: YTN; PAM sequence: TTG
tataagttacattttatgac

SEQ ID NO: 287245 - DNA, 20 bp, Artificial Sequence
  Description of Artificial Sequence: Synthetic oligonucleotide
  Target: ATXN1; (+) strand; PAM type: YTN; PAM sequence: TTA
cattttatgacaacactaaa

SEQ ID NO: 287246 - DNA, 20 bp, Artificial Sequence
  Description of Artificial Sequence: Synthetic oligonucleotide
  Target: ATXN1; (+) strand; PAM type: YTN; PAM sequence: TTT
tatgacaacactaaattctc

SEQ ID NO: 287247 - DNA, 20 bp, Artificial Sequence
  Description of Artificial Sequence: Synthetic oligonucleotide
  Target: ATXN1; (+) strand; PAM type: YTN; PAM sequence: TTT
atgacaacactaaattctcc

SEQ ID NO: 287248 - DNA, 20 bp, Artificial Sequence
  Description of Artificial Sequence: Synthetic oligonucleotide
  Target: ATXN1; (+) strand; PAM type: YTN; PAM sequence: TTA
tgacaacactaaattctcct

SEQ ID NO: 287249 - DNA, 20 bp, Artificial Sequence
  Description of Artificial Sequence: Synthetic oligonucleotide
  Target: ATXN1; (+) strand; PAM type: YTN; PAM sequence: CTA
aattctcctttatatgttca

SEQ ID NO: 287250 - DNA, 20 bp, Artificial Sequence
  Description of Artificial Sequence: Synthetic oligonucleotide
  Target: ATXN1; (+) strand; PAM type: YTN; PAM sequence: TTC
tcctttatatgttcaggctc

SEQ ID NO: 287251 - DNA, 20 bp, Artificial Sequence
  Description of Artificial Sequence: Synthetic oligonucleotide
  Target: ATXN1; (+) strand; PAM type: YTN; PAM sequence: CTC
ctttatatgttcaggctccc

SEQ ID NO: 287252 - DNA, 20 bp, Artificial Sequence
  Description of Artificial Sequence: Synthetic oligonucleotide
  Target: ATXN1; (+) strand; PAM type: YTN; PAM sequence: CTT
tatatgttcaggctccctat

SEQ ID NO: 287253 - DNA, 20 bp, Artificial Sequence
  Description of Artificial Sequence: Synthetic oligonucleotide
  Target: ATXN1; (+) strand; PAM type: YTN; PAM sequence: TTT
atatgttcaggctccctatt

SEQ ID NO: 287254 - DNA, 20 bp, Artificial Sequence
  Description of Artificial Sequence: Synthetic oligonucleotide
  Target: ATXN1; (+) strand; PAM type: YTN; PAM sequence: TTA
tatgttcaggctccctattt

SEQ ID NO: 287255 - DNA, 20 bp, Artificial Sequence
  Description of Artificial Sequence: Synthetic oligonucleotide
  Target: ATXN1; (+) strand; PAM type: YTN; PAM sequence: TTC
aggctccctattttgtgatg

SEQ ID NO: 287256 - DNA, 20 bp, Artificial Sequence
  Description of Artificial Sequence: Synthetic oligonucleotide
  Target: ATXN1; (+) strand; PAM type: YTN; PAM sequence: CTC
cctattttgtgatgcgtgta

SEQ ID NO: 287257 - DNA, 20 bp, Artificial Sequence
  Description of Artificial Sequence: Synthetic oligonucleotide
  Target: ATXN1; (+) strand; PAM type: YTN; PAM sequence: CTA
ttttgtgatgcgtgtaattg

SEQ ID NO: 287258 - DNA, 20 bp, Artificial Sequence
  Description of Artificial Sequence: Synthetic oligonucleotide
  Target: ATXN1; (+) strand; PAM type: YTN; PAM sequence: TTT
tgtgatgcgtgtaattgcag

SEQ ID NO: 287259 - DNA, 20 bp, Artificial Sequence
  Description of Artificial Sequence: Synthetic oligonucleotide
  Target: ATXN1; (+) strand; PAM type: YTN; PAM sequence: TTT
gtgatgcgtgtaattgcaga

SEQ ID NO: 287260 - DNA, 20 bp, Artificial Sequence
  Description of Artificial Sequence: Synthetic oligonucleotide
  Target: ATXN1; (+) strand; PAM type: YTN; PAM sequence: TTG
tgatgcgtgtaattgcagaa

SEQ ID NO: 287261 - DNA, 20 bp, Artificial Sequence
  Description of Artificial Sequence: Synthetic oligonucleotide
  Target: ATXN1; (+) strand; PAM type: YTN; PAM sequence: TTG
cagaacttgggagctagaat

SEQ ID NO: 287262 - DNA, 20 bp, Artificial Sequence
  Description of Artificial Sequence: Synthetic oligonucleotide
  Target: ATXN1; (+) strand; PAM type: YTN; PAM sequence: CTT
gggagctagaatggaccttg

SEQ ID NO: 287263 - DNA, 20 bp, Artificial Sequence
  Description of Artificial Sequence: Synthetic oligonucleotide
  Target: ATXN1; (+) strand; PAM type: YTN; PAM sequence: TTG
ggagctagaatggaccttga

SEQ ID NO: 287264 - DNA, 20 bp, Artificial Sequence
  Description of Artificial Sequence: Synthetic oligonucleotide
  Target: ATXN1; (+) strand; PAM type: YTN; PAM sequence: CTA
gaatggaccttgaggagatc

SEQ ID NO: 287265 - DNA, 20 bp, Artificial Sequence
  Description of Artificial Sequence: Synthetic oligonucleotide
  Target: ATXN1; (+) strand; PAM type: YTN; PAM sequence: CTT
gaggagatcccttacgccaa

SEQ ID NO: 287266 - DNA, 20 bp, Artificial Sequence
  Description of Artificial Sequence: Synthetic oligonucleotide
  Target: ATXN1; (+) strand; PAM type: YTN; PAM sequence: TTG
aggagatcccttacgccaac

SEQ ID NO: 287267 - DNA, 20 bp, Artificial Sequence
  Description of Artificial Sequence: Synthetic oligonucleotide
  Target: ATXN1; (+) strand; PAM type: YTN; PAM sequence: CTT
acgccaacgctttcacttca

SEQ ID NO: 287268 - DNA, 20 bp, Artificial Sequence
  Description of Artificial Sequence: Synthetic oligonucleotide
  Target: ATXN1; (+) strand; PAM type: YTN; PAM sequence: TTA
cgccaacgctttcacttcac

SEQ ID NO: 287269 - DNA, 20 bp, Artificial Sequence
  Description of Artificial Sequence: Synthetic oligonucleotide
  Target: ATXN1; (+) strand; PAM type: YTN; PAM sequence: CTT
tcacttcacagatgtagaca

SEQ ID NO: 287270 - DNA, 20 bp, Artificial Sequence
  Description of Artificial Sequence: Synthetic oligonucleotide
  Target: ATXN1; (+) strand; PAM type: YTN; PAM sequence: TTT
cacttcacagatgtagacac

SEQ ID NO: 287271 - DNA, 20 bp, Artificial Sequence
  Description of Artificial Sequence: Synthetic oligonucleotide
  Target: ATXN1; (+) strand; PAM type: YTN; PAM sequence: TTC
acttcacagatgtagacacc

SEQ ID NO: 287272 - DNA, 20 bp, Artificial Sequence
  Description of Artificial Sequence: Synthetic oligonucleotide
  Target: ATXN1; (+) strand; PAM type: YTN; PAM sequence: CTT
cacagatgtagacaccgagg

SEQ ID NO: 287273 - DNA, 20 bp, Artificial Sequence
  Description of Artificial Sequence: Synthetic oligonucleotide
  Target: ATXN1; (+) strand; PAM type: YTN; PAM sequence: TTC
acagatgtagacaccgaggc

SEQ ID NO: 287274 - DNA, 20 bp, Artificial Sequence
  Description of Artificial Sequence: Synthetic oligonucleotide
  Target: ATXN1; (+) strand; PAM type: YTN; PAM sequence: CTT
aaagagggtatgactttccc

SEQ ID NO: 287275 - DNA, 20 bp, Artificial Sequence
  Description of Artificial Sequence: Synthetic oligonucleotide
  Target: ATXN1; (+) strand; PAM type: YTN; PAM sequence: TTA
aagagggtatgactttccca

SEQ ID NO: 287276 - DNA, 20 bp, Artificial Sequence
  Description of Artificial Sequence: Synthetic oligonucleotide
  Target: ATXN1; (+) strand; PAM type: YTN; PAM sequence: CTT
tcccaaggccacaagaggac

SEQ ID NO: 287277 - DNA, 20 bp, Artificial Sequence
  Description of Artificial Sequence: Synthetic oligonucleotide
  Target: ATXN1; (+) strand; PAM type: YTN; PAM sequence: TTT
cccaaggccacaagaggact

SEQ ID NO: 287278 - DNA, 20 bp, Artificial Sequence
  Description of Artificial Sequence: Synthetic oligonucleotide
  Target: ATXN1; (+) strand; PAM type: YTN; PAM sequence: TTC
ccaaggccacaagaggacta

SEQ ID NO: 287279 - DNA, 20 bp, Artificial Sequence
  Description of Artificial Sequence: Synthetic oligonucleotide
  Target: ATXN1; (+) strand; PAM type: YTN; PAM sequence: CTA
gtttacagcagagctgggct

SEQ ID NO: 287280 - DNA, 20 bp, Artificial Sequence
  Description of Artificial Sequence: Synthetic oligonucleotide
  Target: ATXN1; (+) strand; PAM type: YTN; PAM sequence: TTT
acagcagagctgggcttata

SEQ ID NO: 287281 - DNA, 20 bp, Artificial Sequence
  Description of Artificial Sequence: Synthetic oligonucleotide
  Target: ATXN1; (+) strand; PAM type: YTN; PAM sequence: TTA
cagcagagctgggcttatat

SEQ ID NO: 287282 - DNA, 20 bp, Artificial Sequence
  Description of Artificial Sequence: Synthetic oligonucleotide
  Target: ATXN1; (+) strand; PAM type: YTN; PAM sequence: CTG
ggcttatataacagggctgc

SEQ ID NO: 287283 - DNA, 20 bp, Artificial Sequence
  Description of Artificial Sequence: Synthetic oligonucleotide
  Target: ATXN1; (+) strand; PAM type: YTN; PAM sequence: CTT
atataacagggctgcccatg

SEQ ID NO: 287284 - DNA, 20 bp, Artificial Sequence
  Description of Artificial Sequence: Synthetic oligonucleotide
  Target: ATXN1; (+) strand; PAM type: YTN; PAM sequence: TTA
tataacagggctgcccatga

SEQ ID NO: 287285 - DNA, 20 bp, Artificial Sequence
  Description of Artificial Sequence: Synthetic oligonucleotide
  Target: ATXN1; (+) strand; PAM type: YTN; PAM sequence: CTG
cccatgagccctgcaaggct

SEQ ID NO: 287286 - DNA, 20 bp, Artificial Sequence
  Description of Artificial Sequence: Synthetic oligonucleotide
  Target: ATXN1; (+) strand; PAM type: YTN; PAM sequence: CTG
caaggctccagagctattct

SEQ ID NO: 287287 - DNA, 20 bp, Artificial Sequence
  Description of Artificial Sequence: Synthetic oligonucleotide
  Target: ATXN1; (+) strand; PAM type: YTN; PAM sequence: CTC
cagagctattcttaagatcc

SEQ ID NO: 287288 - DNA, 20 bp, Artificial Sequence
  Description of Artificial Sequence: Synthetic oligonucleotide
  Target: ATXN1; (+) strand; PAM type: YTN; PAM sequence: CTA
ttcttaagatcctctgcact

SEQ ID NO: 287289 - DNA, 20 bp, Artificial Sequence
  Description of Artificial Sequence: Synthetic oligonucleotide
  Target: ATXN1; (+) strand; PAM type: YTN; PAM sequence: TTC
ttaagatcctctgcacttag

SEQ ID NO: 287290 - DNA, 20 bp, Artificial Sequence
  Description of Artificial Sequence: Synthetic oligonucleotide
  Target: ATXN1; (+) strand; PAM type: YTN; PAM sequence: CTT
aagatcctctgcacttagac

SEQ ID NO: 287291 - DNA, 20 bp, Artificial Sequence
  Description of Artificial Sequence: Synthetic oligonucleotide
  Target: ATXN1; (+) strand; PAM type: YTN; PAM sequence: TTA
agatcctctgcacttagaca

SEQ ID NO: 287292 - DNA, 20 bp, Artificial Sequence
  Description of Artificial Sequence: Synthetic oligonucleotide
  Target: ATXN1; (+) strand; PAM type: YTN; PAM sequence: CTC
tgcacttagacaatgctgca

SEQ ID NO: 287293 - DNA, 20 bp, Artificial Sequence
  Description of Artificial Sequence: Synthetic oligonucleotide
  Target: ATXN1; (+) strand; PAM type: YTN; PAM sequence: CTG
cacttagacaatgctgcagg

SEQ ID NO: 287294 - DNA, 20 bp, Artificial Sequence
  Description of Artificial Sequence: Synthetic oligonucleotide
  Target: ATXN1; (+) strand; PAM type: YTN; PAM sequence: CTT
agacaatgctgcagggacac

SEQ ID NO: 287295 - DNA, 20 bp, Artificial Sequence
  Description of Artificial Sequence: Synthetic oligonucleotide
  Target: ATXN1; (+) strand; PAM type: YTN; PAM sequence: TTA
gacaatgctgcagggacaca

SEQ ID NO: 287296 - DNA, 20 bp, Artificial Sequence
  Description of Artificial Sequence: Synthetic oligonucleotide
  Target: ATXN1; (+) strand; PAM type: YTN; PAM sequence: CTG
cagggacacactctcttctt

SEQ ID NO: 287297 - DNA, 20 bp, Artificial Sequence
  Description of Artificial Sequence: Synthetic oligonucleotide
  Target: ATXN1; (+) strand; PAM type: YTN; PAM sequence: CTC
tcttctttattttgtaagaa

SEQ ID NO: 287298 - DNA, 20 bp, Artificial Sequence
  Description of Artificial Sequence: Synthetic oligonucleotide
  Target: ATXN1; (+) strand; PAM type: YTN; PAM sequence: CTC
ttctttattttgtaagaaca

SEQ ID NO: 287299 - DNA, 20 bp, Artificial Sequence
  Description of Artificial Sequence: Synthetic oligonucleotide
  Target: ATXN1; (+) strand; PAM type: YTN; PAM sequence: CTT
ctttattttgtaagaacatt

SEQ ID NO: 287300 - DNA, 20 bp, Artificial Sequence
  Description of Artificial Sequence: Synthetic oligonucleotide
  Target: ATXN1; (+) strand; PAM type: YTN; PAM sequence: TTC
tttattttgtaagaacattt

SEQ ID NO: 287301 - DNA, 20 bp, Artificial Sequence
  Description of Artificial Sequence: Synthetic oligonucleotide
  Target: ATXN1; (+) strand; PAM type: YTN; PAM sequence: CTT
tattttgtaagaacatttgc

SEQ ID NO: 287302 - DNA, 20 bp, Artificial Sequence
  Description of Artificial Sequence: Synthetic oligonucleotide
  Target: ATXN1; (+) strand; PAM type: YTN; PAM sequence: TTT
attttgtaagaacatttgct

SEQ ID NO: 287303 - DNA, 20 bp, Artificial Sequence
  Description of Artificial Sequence: Synthetic oligonucleotide
  Target: ATXN1; (+) strand; PAM type: YTN; PAM sequence: TTA
ttttgtaagaacatttgctc

SEQ ID NO: 287304 - DNA, 20 bp, Artificial Sequence
  Description of Artificial Sequence: Synthetic oligonucleotide
  Target: ATXN1; (+) strand; PAM type: YTN; PAM sequence: TTT
tgtaagaacatttgctcaca

SEQ ID NO: 287305 - DNA, 20 bp, Artificial Sequence
  Description of Artificial Sequence: Synthetic oligonucleotide
  Target: ATXN1; (+) strand; PAM type: YTN; PAM sequence: TTT
gtaagaacatttgctcacaa

SEQ ID NO: 287306 - DNA, 20 bp, Artificial Sequence
  Description of Artificial Sequence: Synthetic oligonucleotide
  Target: ATXN1; (+) strand; PAM type: YTN; PAM sequence: TTG
taagaacatttgctcacaat

SEQ ID NO: 287307 - DNA, 20 bp, Artificial Sequence
  Description of Artificial Sequence: Synthetic oligonucleotide
  Target: ATXN1; (+) strand; PAM type: YTN; PAM sequence: TTT
gctcacaattcaaaattatt

SEQ ID NO: 287308 - DNA, 20 bp, Artificial Sequence
  Description of Artificial Sequence: Synthetic oligonucleotide
  Target: ATXN1; (+) strand; PAM type: YTN; PAM sequence: TTG
ctcacaattcaaaattattc

SEQ ID NO: 287309 - DNA, 20 bp, Artificial Sequence
  Description of Artificial Sequence: Synthetic oligonucleotide
  Target: ATXN1; (+) strand; PAM type: YTN; PAM sequence: CTC
acaattcaaaattattcaaa

SEQ ID NO: 287310 - DNA, 20 bp, Artificial Sequence
  Description of Artificial Sequence: Synthetic oligonucleotide
  Target: ATXN1; (+) strand; PAM type: YTN; PAM sequence: TTC
aaaattattcaaagagaatg

SEQ ID NO: 287311 - DNA, 20 bp, Artificial Sequence
  Description of Artificial Sequence: Synthetic oligonucleotide
  Target: ATXN1; (+) strand; PAM type: YTN; PAM sequence: TTA
ttcaaagagaatgggaaaca

SEQ ID NO: 287312 - DNA, 20 bp, Artificial Sequence
  Description of Artificial Sequence: Synthetic oligonucleotide
  Target: ATXN1; (+) strand; PAM type: YTN; PAM sequence: TTC
aaagagaatgggaaacaggt

SEQ ID NO: 287313 - DNA, 20 bp, Artificial Sequence
  Description of Artificial Sequence: Synthetic oligonucleotide
  Target: ATXN1; (+) strand; PAM type: YTN; PAM sequence: CTC
agggattcagatgctggagc

SEQ ID NO: 287314 - DNA, 20 bp, Artificial Sequence
  Description of Artificial Sequence: Synthetic oligonucleotide
  Target: ATXN1; (+) strand; PAM type: YTN; PAM sequence: TTC
agatgctggagctcttggtt

SEQ ID NO: 287315 - DNA, 20 bp, Artificial Sequence
  Description of Artificial Sequence: Synthetic oligonucleotide
  Target: ATXN1; (+) strand; PAM type: YTN; PAM sequence: CTG
gagctcttggttaagcaact

SEQ ID NO: 287316 - DNA, 20 bp, Artificial Sequence
  Description of Artificial Sequence: Synthetic oligonucleotide
  Target: ATXN1; (+) strand; PAM type: YTN; PAM sequence: CTC
ttggttaagcaacttttgga

SEQ ID NO: 287317 - DNA, 20 bp, Artificial Sequence
  Description of Artificial Sequence: Synthetic oligonucleotide
  Target: ATXN1; (+) strand; PAM type: YTN; PAM sequence: CTT
ggttaagcaacttttggatc

SEQ ID NO: 287318 - DNA, 20 bp, Artificial Sequence
  Description of Artificial Sequence: Synthetic oligonucleotide
  Target: ATXN1; (+) strand; PAM type: YTN; PAM sequence: TTG
gttaagcaacttttggatca

SEQ ID NO: 287319 - DNA, 20 bp, Artificial Sequence
  Description of Artificial Sequence: Synthetic oligonucleotide
  Target: ATXN1; (+) strand; PAM type: YTN; PAM sequence: TTA
agcaacttttggatcatatg

SEQ ID NO: 287320 - DNA, 20 bp, Artificial Sequence
  Description of Artificial Sequence: Synthetic oligonucleotide
  Target: ATXN1; (+) strand; PAM type: YTN; PAM sequence: CTT
ttggatcatatgatacttag

SEQ ID NO: 287321 - DNA, 20 bp, Artificial Sequence
  Description of Artificial Sequence: Synthetic oligonucleotide
  Target: ATXN1; (+) strand; PAM type: YTN; PAM sequence: TTT
tggatcatatgatacttaga

SEQ ID NO: 287322 - DNA, 20 bp, Artificial Sequence
  Description of Artificial Sequence: Synthetic oligonucleotide
  Target: ATXN1; (+) strand; PAM type: YTN; PAM sequence: TTT
ggatcatatgatacttagaa

SEQ ID NO: 287323 - DNA, 20 bp, Artificial Sequence
  Description of Artificial Sequence: Synthetic oligonucleotide
  Target: ATXN1; (+) strand; PAM type: YTN; PAM sequence: TTG
gatcatatgatacttagaag

SEQ ID NO: 287324 - DNA, 20 bp, Artificial Sequence
  Description of Artificial Sequence: Synthetic oligonucleotide
  Target: ATXN1; (+) strand; PAM type: YTN; PAM sequence: CTT
agaagaactaccatctctct

SEQ ID NO: 287325 - DNA, 20 bp, Artificial Sequence
  Description of Artificial Sequence: Synthetic oligonucleotide
  Target: ATXN1; (+) strand; PAM type: YTN; PAM sequence: TTA
gaagaactaccatctctctc

SEQ ID NO: 287326 - DNA, 20 bp, Artificial Sequence
  Description of Artificial Sequence: Synthetic oligonucleotide
  Target: ATXN1; (+) strand; PAM type: YTN; PAM sequence: CTA
ccatctctctcagtaagaag

SEQ ID NO: 287327 - DNA, 20 bp, Artificial Sequence
  Description of Artificial Sequence: Synthetic oligonucleotide
  Target: ATXN1; (+) strand; PAM type: YTN; PAM sequence: CTC
tctcagtaagaagattagca

SEQ ID NO: 287328 - DNA, 20 bp, Artificial Sequence
  Description of Artificial Sequence: Synthetic oligonucleotide
  Target: ATXN1; (+) strand; PAM type: YTN; PAM sequence: CTC
tcagtaagaagattagcagg

SEQ ID NO: 287329 - DNA, 20 bp, Artificial Sequence
  Description of Artificial Sequence: Synthetic oligonucleotide
  Target: ATXN1; (+) strand; PAM type: YTN; PAM sequence: CTC
agtaagaagattagcaggag

SEQ ID NO: 287330 - DNA, 20 bp, Artificial Sequence
  Description of Artificial Sequence: Synthetic oligonucleotide
  Target: ATXN1; (+) strand; PAM type: YTN; PAM sequence: TTA
gcaggagaatacatatggta

SEQ ID NO: 287331 - DNA, 20 bp, Artificial Sequence
  Description of Artificial Sequence: Synthetic oligonucleotide
  Target: ATXN1; (+) strand; PAM type: YTN; PAM sequence: TTA
ttcaagcagtgaccctagga

SEQ ID NO: 287332 - DNA, 20 bp, Artificial Sequence
  Description of Artificial Sequence: Synthetic oligonucleotide
  Target: ATXN1; (+) strand; PAM type: YTN; PAM sequence: TTC
aagcagtgaccctaggatga

SEQ ID NO: 287333 - DNA, 20 bp, Artificial Sequence
  Description of Artificial Sequence: Synthetic oligonucleotide
  Target: ATXN1; (+) strand; PAM type: YTN; PAM sequence: CTA
ggatgagcctcaaagcttac

SEQ ID NO: 287334 - DNA, 20 bp, Artificial Sequence
  Description of Artificial Sequence: Synthetic oligonucleotide
  Target: ATXN1; (+) strand; PAM type: YTN; PAM sequence: CTC
aaagcttactagctatgtgg

SEQ ID NO: 287335 - DNA, 20 bp, Artificial Sequence
  Description of Artificial Sequence: Synthetic oligonucleotide
  Target: ATXN1; (+) strand; PAM type: YTN; PAM sequence: CTT
actagctatgtggtctggaa

SEQ ID NO: 287336 - DNA, 20 bp, Artificial Sequence
  Description of Artificial Sequence: Synthetic oligonucleotide
  Target: ATXN1; (+) strand; PAM type: YTN; PAM sequence: TTA
ctagctatgtggtctggaac

SEQ ID NO: 287337 - DNA, 20 bp, Artificial Sequence
  Description of Artificial Sequence: Synthetic oligonucleotide
  Target: ATXN1; (+) strand; PAM type: YTN; PAM sequence: CTA
gctatgtggtctggaacaag

SEQ ID NO: 287338 - DNA, 20 bp, Artificial Sequence
  Description of Artificial Sequence: Synthetic oligonucleotide
  Target: ATXN1; (+) strand; PAM type: YTN; PAM sequence: CTA
tgtggtctggaacaagctat

SEQ ID NO: 287339 - DNA, 20 bp, Artificial Sequence
  Description of Artificial Sequence: Synthetic oligonucleotide
  Target: ATXN1; (+) strand; PAM type: YTN; PAM sequence: CTG
gaacaagctatagaaacttg

SEQ ID NO: 287340 - DNA, 20 bp, Artificial Sequence
  Description of Artificial Sequence: Synthetic oligonucleotide
  Target: ATXN1; (+) strand; PAM type: YTN; PAM sequence: CTA
tagaaacttgccgggtctat

SEQ ID NO: 287341 - DNA, 20 bp, Artificial Sequence
  Description of Artificial Sequence: Synthetic oligonucleotide
  Target: ATXN1; (+) strand; PAM type: YTN; PAM sequence: CTT
gccgggtctatattccctta

SEQ ID NO: 287342 - DNA, 20 bp, Artificial Sequence
  Description of Artificial Sequence: Synthetic oligonucleotide
  Target: ATXN1; (+) strand; PAM type: YTN; PAM sequence: TTG
ccgggtctatattcccttaa

SEQ ID NO: 287343 - DNA, 20 bp, Artificial Sequence
  Description of Artificial Sequence: Synthetic oligonucleotide
  Target: ATXN1; (+) strand; PAM type: YTN; PAM sequence: CTA
tattcccttaaccgtaaaat

SEQ ID NO: 287344 - DNA, 20 bp, Artificial Sequence
  Description of Artificial Sequence: Synthetic oligonucleotide
  Target: ATXN1; (+) strand; PAM type: YTN; PAM sequence: TTC
ccttaaccgtaaaatggcca

SEQ ID NO: 287345 - DNA, 20 bp, Artificial Sequence
  Description of Artificial Sequence: Synthetic oligonucleotide
  Target: ATXN1; (+) strand; PAM type: YTN; PAM sequence: CTT
aaccgtaaaatggccaagat

SEQ ID NO: 287346 - DNA, 20 bp, Artificial Sequence
  Description of Artificial Sequence: Synthetic oligonucleotide
  Target: ATXN1; (+) strand; PAM type: YTN; PAM sequence: TTA
accgtaaaatggccaagata

SEQ ID NO: 287347 - DNA, 20 bp, Artificial Sequence
  Description of Artificial Sequence: Synthetic oligonucleotide
  Target: ATXN1; (+) strand; PAM type: YTN; PAM sequence: CTG
accaggtgtagtgtctcatg

SEQ ID NO: 287348 - DNA, 20 bp, Artificial Sequence
  Description of Artificial Sequence: Synthetic oligonucleotide
  Target: ATXN1; (+) strand; PAM type: YTN; PAM sequence: CTC
atgcctataatcccagcact

SEQ ID NO: 287349 - DNA, 20 bp, Artificial Sequence
  Description of Artificial Sequence: Synthetic oligonucleotide
  Target: ATXN1; (+) strand; PAM type: YTN; PAM sequence: CTA
taatcccagcactttgggag

SEQ ID NO: 287350 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgagatgggagg

SEQ ID NO: 287351 - DNA, 20 bp, Artificial Sequence
  Description of Artificial Sequence: Synthetic oligonucleotide
  Target: ATXN1; (+) strand; PAM type: YTN; PAM sequence: TTT
gggaggctgagatgggagga

SEQ ID NO: 287352 - DNA, 20 bp, Artificial Sequence
  Description of Artificial Sequence: Synthetic oligonucleotide
  Target: ATXN1; (+) strand; PAM type: YTN; PAM sequence: TTG
ggaggctgagatgggaggat

SEQ ID NO: 287353 - DNA, 20 bp, Artificial Sequence
  Description of Artificial Sequence: Synthetic oligonucleotide
  Target: ATXN1; (+) strand; PAM type: YTN; PAM sequence: CTG
agatgggaggatcacttgag

SEQ ID NO: 287354 - DNA, 20 bp, Artificial Sequence
  Description of Artificial Sequence: Synthetic oligonucleotide
  Target: ATXN1; (+) strand; PAM type: YTN; PAM sequence: CTT
gagcccaggagttcaagacc

SEQ ID NO: 287355 - DNA, 20 bp, Artificial Sequence
  Description of Artificial Sequence: Synthetic oligonucleotide
  Target: ATXN1; (+) strand; PAM type: YTN; PAM sequence: TTG
agcccaggagttcaagacca

SEQ ID NO: 287356 - DNA, 20 bp, Artificial Sequence
  Description of Artificial Sequence: Synthetic oligonucleotide
  Target: ATXN1; (+) strand; PAM type: YTN; PAM sequence: TTC
aagaccagcctgggaaacat

SEQ ID NO: 287357 - DNA, 20 bp, Artificial Sequence
  Description of Artificial Sequence: Synthetic oligonucleotide
  Target: ATXN1; (+) strand; PAM type: YTN; PAM sequence: CTG
ggaaacatgtgagaccctaa

SEQ ID NO: 287358 - DNA, 20 bp, Artificial Sequence
  Description of Artificial Sequence: Synthetic oligonucleotide
  Target: ATXN1; (+) strand; PAM type: YTN; PAM sequence: CTA
actttacaaataatgtttaa

SEQ ID NO: 287359 - DNA, 20 bp, Artificial Sequence
  Description of Artificial Sequence: Synthetic oligonucleotide
  Target: ATXN1; (+) strand; PAM type: YTN; PAM sequence: CTT
tacaaataatgtttaaaaaa

SEQ ID NO: 287360 - DNA, 20 bp, Artificial Sequence
  Description of Artificial Sequence: Synthetic oligonucleotide
  Target: ATXN1; (+) strand; PAM type: YTN; PAM sequence: TTT
acaaataatgtttaaaaaat

SEQ ID NO: 287361 - DNA, 20 bp, Artificial Sequence
  Description of Artificial Sequence: Synthetic oligonucleotide
  Target: ATXN1; (+) strand; PAM type: YTN; PAM sequence: TTA
caaataatgtttaaaaaatt

SEQ ID NO: 287362 - DNA, 20 bp, Artificial Sequence
  Description of Artificial Sequence: Synthetic oligonucleotide
  Target: ATXN1; (+) strand; PAM type: YTN; PAM sequence: TTT
aaaaaattagccaggtgtgg

SEQ ID NO: 287363 - DNA, 20 bp, Artificial Sequence
  Description of Artificial Sequence: Synthetic oligonucleotide
  Target: ATXN1; (+) strand; PAM type: YTN; PAM sequence: TTA
aaaaattagccaggtgtggt

SEQ ID NO: 287364 - DNA, 20 bp, Artificial Sequence
  Description of Artificial Sequence: Synthetic oligonucleotide
  Target: ATXN1; (+) strand; PAM type: YTN; PAM sequence: TTA
gccaggtgtggtggcacgta

SEQ ID NO: 287365 - DNA, 20 bp, Artificial Sequence
  Description of Artificial Sequence: Synthetic oligonucleotide
  Target: ATXN1; (+) strand; PAM type: YTN; PAM sequence: CTC
aggaggatgaggtgggggga

SEQ ID NO: 287366 - DNA, 20 bp, Artificial Sequence
  Description of Artificial Sequence: Synthetic oligonucleotide
  Target: ATXN1; (+) strand; PAM type: YTN; PAM sequence: CTT
gaacccaggagttcaaggct

SEQ ID NO: 287367 - DNA, 20 bp, Artificial Sequence
  Description of Artificial Sequence: Synthetic oligonucleotide
  Target: ATXN1; (+) strand; PAM type: YTN; PAM sequence: TTG
aacccaggagttcaaggctg

SEQ ID NO: 287368 - DNA, 20 bp, Artificial Sequence
  Description of Artificial Sequence: Synthetic oligonucleotide
  Target: ATXN1; (+) strand; PAM type: YTN; PAM sequence: TTC
aaggctgctgtgaggtacaa

SEQ ID NO: 287369 - DNA, 20 bp, Artificial Sequence
  Description of Artificial Sequence: Synthetic oligonucleotide
  Target: ATXN1; (+) strand; PAM type: YTN; PAM sequence: CTG
ctgtgaggtacaatcacgcc

SEQ ID NO: 287370 - DNA, 20 bp, Artificial Sequence
  Description of Artificial Sequence: Synthetic oligonucleotide
  Target: ATXN1; (+) strand; PAM type: YTN; PAM sequence: CTG
tgaggtacaatcacgccact

SEQ ID NO: 287371 - DNA, 20 bp, Artificial Sequence
  Description of Artificial Sequence: Synthetic oligonucleotide
  Target: ATXN1; (+) strand; PAM type: YTN; PAM sequence: CTG
cactccagcctggagtacag

SEQ ID NO: 287372 - DNA, 20 bp, Artificial Sequence
  Description of Artificial Sequence: Synthetic oligonucleotide
  Target: ATXN1; (+) strand; PAM type: YTN; PAM sequence: CTC
cagcctggagtacagtgtgt

SEQ ID NO: 287373 - DNA, 20 bp, Artificial Sequence
  Description of Artificial Sequence: Synthetic oligonucleotide
  Target: ATXN1; (+) strand; PAM type: YTN; PAM sequence: CTG
gagtacagtgtgtcactctg

SEQ ID NO: 287374 - DNA, 20 bp, Artificial Sequence
  Description of Artificial Sequence: Synthetic oligonucleotide
  Target: ATXN1; (+) strand; PAM type: YTN; PAM sequence: CTC
tggagacagagcgagaccct

SEQ ID NO: 287375 - DNA, 20 bp, Artificial Sequence
  Description of Artificial Sequence: Synthetic oligonucleotide
  Target: ATXN1; (+) strand; PAM type: YTN; PAM sequence: CTG
gagacagagcgagaccctgt

SEQ ID NO: 287376 - DNA, 20 bp, Artificial Sequence
  Description of Artificial Sequence: Synthetic oligonucleotide
  Target: ATXN1; (+) strand; PAM type: YTN; PAM sequence: CTG
tctcaaaaacaaacaaacaa

SEQ ID NO: 287377 - DNA, 20 bp, Artificial Sequence
  Description of Artificial Sequence: Synthetic oligonucleotide
  Target: ATXN1; (+) strand; PAM type: YTN; PAM sequence: CTC
aaaaacaaacaaacaaaaag

SEQ ID NO: 287378 - DNA, 20 bp, Artificial Sequence
  Description of Artificial Sequence: Synthetic oligonucleotide
  Target: ATXN1; (+) strand; PAM type: YTN; PAM sequence: TTA
actcaaagagttatgggatg

SEQ ID NO: 287379 - DNA, 20 bp, Artificial Sequence
  Description of Artificial Sequence: Synthetic oligonucleotide
  Target: ATXN1; (+) strand; PAM type: YTN; PAM sequence: CTC
aaagagttatgggatgagat

SEQ ID NO: 287380 - DNA, 20 bp, Artificial Sequence
  Description of Artificial Sequence: Synthetic oligonucleotide
  Target: ATXN1; (+) strand; PAM type: YTN; PAM sequence: TTA
tgggatgagataaggttcta

SEQ ID NO: 287381 - DNA, 20 bp, Artificial Sequence
  Description of Artificial Sequence: Synthetic oligonucleotide
  Target: ATXN1; (+) strand; PAM type: YTN; PAM sequence: TTC
tatatttagaacacctagca

SEQ ID NO: 287382 - DNA, 20 bp, Artificial Sequence
  Description of Artificial Sequence: Synthetic oligonucleotide
  Target: ATXN1; (+) strand; PAM type: YTN; PAM sequence: CTA
tatttagaacacctagcaca

SEQ ID NO: 287383 - DNA, 20 bp, Artificial Sequence
  Description of Artificial Sequence: Synthetic oligonucleotide
  Target: ATXN1; (+) strand; PAM type: YTN; PAM sequence: TTT
agaacacctagcacaggaca

SEQ ID NO: 287384 - DNA, 20 bp, Artificial Sequence
  Description of Artificial Sequence: Synthetic oligonucleotide
  Target: ATXN1; (+) strand; PAM type: YTN; PAM sequence: TTA
gaacacctagcacaggacat

SEQ ID NO: 287385 - DNA, 20 bp, Artificial Sequence
  Description of Artificial Sequence: Synthetic oligonucleotide
  Target: ATXN1; (+) strand; PAM type: YTN; PAM sequence: CTA
gcacaggacataggctcaat

SEQ ID NO: 287386 - DNA, 20 bp, Artificial Sequence
  Description of Artificial Sequence: Synthetic oligonucleotide
  Target: ATXN1; (+) strand; PAM type: YTN; PAM sequence: CTC
aatcaatattcagtattcaa

SEQ ID NO: 287387 - DNA, 20 bp, Artificial Sequence
  Description of Artificial Sequence: Synthetic oligonucleotide
  Target: ATXN1; (+) strand; PAM type: YTN; PAM sequence: TTC
agtattcaataaatatttct

SEQ ID NO: 287388 - DNA, 20 bp, Artificial Sequence
  Description of Artificial Sequence: Synthetic oligonucleotide
  Target: ATXN1; (+) strand; PAM type: YTN; PAM sequence: TTC
aataaatatttctttactat

SEQ ID NO: 287389 - DNA, 20 bp, Artificial Sequence
  Description of Artificial Sequence: Synthetic oligonucleotide
  Target: ATXN1; (+) strand; PAM type: YTN; PAM sequence: TTT
ctttactatgtctccttaca

SEQ ID NO: 287390 - DNA, 20 bp, Artificial Sequence
  Description of Artificial Sequence: Synthetic oligonucleotide
  Target: ATXN1; (+) strand; PAM type: YTN; PAM sequence: TTC
tttactatgtctccttacat

SEQ ID NO: 287391 - DNA, 20 bp, Artificial Sequence
  Description of Artificial Sequence: Synthetic oligonucleotide
  Target: ATXN1; (+) strand; PAM type: YTN; PAM sequence: CTT
tactatgtctccttacatag

SEQ ID NO: 287392 - DNA, 20 bp, Artificial Sequence
  Description of Artificial Sequence: Synthetic oligonucleotide
  Target: ATXN1; (+) strand; PAM type: YTN; PAM sequence: TTT
actatgtctccttacatagt

SEQ ID NO: 287393 - DNA, 20 bp, Artificial Sequence
  Description of Artificial Sequence: Synthetic oligonucleotide
  Target: ATXN1; (+) strand; PAM type: YTN; PAM sequence: TTA
ctatgtctccttacatagtg

SEQ ID NO: 287394 - DNA, 20 bp, Artificial Sequence
  Description of Artificial Sequence: Synthetic oligonucleotide
  Target: ATXN1; (+) strand; PAM type: YTN; PAM sequence: CTA
tgtctccttacatagtgctg

SEQ ID NO: 287395 - DNA, 20 bp, Artificial Sequence
  Description of Artificial Sequence: Synthetic oligonucleotide
  Target: ATXN1; (+) strand; PAM type: YTN; PAM sequence: CTC
cttacatagtgctgctaaga

SEQ ID NO: 287396 - DNA, 20 bp, Artificial Sequence
  Description of Artificial Sequence: Synthetic oligonucleotide
  Target: ATXN1; (+) strand; PAM type: YTN; PAM sequence: CTT
acatagtgctgctaagaaag

SEQ ID NO: 287397 - DNA, 20 bp, Artificial Sequence
  Description of Artificial Sequence: Synthetic oligonucleotide
  Target: ATXN1; (+) strand; PAM type: YTN; PAM sequence: TTA
catagtgctgctaagaaagc

SEQ ID NO: 287398 - DNA, 20 bp, Artificial Sequence
  Description of Artificial Sequence: Synthetic oligonucleotide
  Target: ATXN1; (+) strand; PAM type: YTN; PAM sequence: CTG
ctaagaaagcctcacctgcg

SEQ ID NO: 287399 - DNA, 20 bp, Artificial Sequence
  Description of Artificial Sequence: Synthetic oligonucleotide
  Target: ATXN1; (+) strand; PAM type: YTN; PAM sequence: CTA
agaaagcctcacctgcgaac

SEQ ID NO: 287400 - DNA, 20 bp, Artificial Sequence
  Description of Artificial Sequence: Synthetic oligonucleotide
  Target: ATXN1; (+) strand; PAM type: YTN; PAM sequence: CTC
acctgcgaacacatgtgatg

SEQ ID NO: 287401 - DNA, 20 bp, Artificial Sequence
  Description of Artificial Sequence: Synthetic oligonucleotide
  Target: ATXN1; (+) strand; PAM type: YTN; PAM sequence: CTG
cgaacacatgtgatgggtac

SEQ ID NO: 287402 - DNA, 20 bp, Artificial Sequence
  Description of Artificial Sequence: Synthetic oligonucleotide
  Target: ATXN1; (+) strand; PAM type: YTN; PAM sequence: CTG
gatggtgaaacgtatttcca

SEQ ID NO: 287403 - DNA, 20 bp, Artificial Sequence
  Description of Artificial Sequence: Synthetic oligonucleotide
  Target: ATXN1; (+) strand; PAM type: YTN; PAM sequence: TTT
ccaagaccaggtctaagtta

SEQ ID NO: 287404 - DNA, 20 bp, Artificial Sequence
  Description of Artificial Sequence: Synthetic oligonucleotide
  Target: ATXN1; (+) strand; PAM type: YTN; PAM sequence: TTC
caagaccaggtctaagttat

SEQ ID NO: 287405 - DNA, 20 bp, Artificial Sequence
  Description of Artificial Sequence: Synthetic oligonucleotide
  Target: ATXN1; (+) strand; PAM type: YTN; PAM sequence: CTA
agttatttcatggatactat

SEQ ID NO: 287406 - DNA, 20 bp, Artificial Sequence
  Description of Artificial Sequence: Synthetic oligonucleotide
  Target: ATXN1; (+) strand; PAM type: YTN; PAM sequence: TTA
tttcatggatactatgaaat

SEQ ID NO: 287407 - DNA, 20 bp, Artificial Sequence
  Description of Artificial Sequence: Synthetic oligonucleotide
  Target: ATXN1; (+) strand; PAM type: YTN; PAM sequence: TTT
catggatactatgaaatcta

SEQ ID NO: 287408 - DNA, 20 bp, Artificial Sequence
  Description of Artificial Sequence: Synthetic oligonucleotide
  Target: ATXN1; (+) strand; PAM type: YTN; PAM sequence: TTC
atggatactatgaaatctaa

SEQ ID NO: 287409 - DNA, 20 bp, Artificial Sequence
  Description of Artificial Sequence: Synthetic oligonucleotide
  Target: ATXN1; (+) strand; PAM type: YTN; PAM sequence: CTA
tgaaatctaatgttatctta

SEQ ID NO: 287410 - DNA, 20 bp, Artificial Sequence
  Description of Artificial Sequence: Synthetic oligonucleotide
  Target: ATXN1; (+) strand; PAM type: YTN; PAM sequence: CTA
atgttatcttaagatccaaa

SEQ ID NO: 287411 - DNA, 20 bp, Artificial Sequence
  Description of Artificial Sequence: Synthetic oligonucleotide
  Target: ATXN1; (+) strand; PAM type: YTN; PAM sequence: TTA
tcttaagatccaaagtgcag

SEQ ID NO: 287412 - DNA, 20 bp, Artificial Sequence
  Description of Artificial Sequence: Synthetic oligonucleotide
  Target: ATXN1; (+) strand; PAM type: YTN; PAM sequence: CTT
aagatccaaagtgcagagga

SEQ ID NO: 287413 - DNA, 20 bp, Artificial Sequence
  Description of Artificial Sequence: Synthetic oligonucleotide
  Target: ATXN1; (+) strand; PAM type: YTN; PAM sequence: TTA
agatccaaagtgcagaggat

SEQ ID NO: 287414 - DNA, 20 bp, Artificial Sequence
  Description of Artificial Sequence: Synthetic oligonucleotide
  Target: ATXN1; (+) strand; PAM type: YTN; PAM sequence: CTT
aagaatagctctggagccat

SEQ ID NO: 287415 - DNA, 20 bp, Artificial Sequence
  Description of Artificial Sequence: Synthetic oligonucleotide
  Target: ATXN1; (+) strand; PAM type: YTN; PAM sequence: TTA
agaatagctctggagccatg

SEQ ID NO: 287416 - DNA, 20 bp, Artificial Sequence
  Description of Artificial Sequence: Synthetic oligonucleotide
  Target: ATXN1; (+) strand; PAM type: YTN; PAM sequence: CTC
tggagccatgcaggggataa

SEQ ID NO: 287417 - DNA, 20 bp, Artificial Sequence
  Description of Artificial Sequence: Synthetic oligonucleotide
  Target: ATXN1; (+) strand; PAM type: YTN; PAM sequence: CTG
gagccatgcaggggataatg

SEQ ID NO: 287418 - DNA, 20 bp, Artificial Sequence
  Description of Artificial Sequence: Synthetic oligonucleotide
  Target: ATXN1; (+) strand; PAM type: YTN; PAM sequence: CTG
ttttgtttgtttgttcgttt

SEQ ID NO: 287419 - DNA, 20 bp, Artificial Sequence
  Description of Artificial Sequence: Synthetic oligonucleotide
  Target: ATXN1; (+) strand; PAM type: YTN; PAM sequence: TTT
tgtttgtttgttcgtttgtt

SEQ ID NO: 287420 - DNA, 20 bp, Artificial Sequence
  Description of Artificial Sequence: Synthetic oligonucleotide
  Target: ATXN1; (+) strand; PAM type: YTN; PAM sequence: TTT
gtttgtttgttcgtttgttt

SEQ ID NO: 287421 - DNA, 20 bp, Artificial Sequence
  Description of Artificial Sequence: Synthetic oligonucleotide
  Target: ATXN1; (+) strand; PAM type: YTN; PAM sequence: TTG
tttgtttgttcgtttgtttg

SEQ ID NO: 287422 - DNA, 20 bp, Artificial Sequence
  Description of Artificial Sequence: Synthetic oligonucleotide
  Target: ATXN1; (+) strand; PAM type: YTN; PAM sequence: TTT
gtttgttcgtttgtttgtgg

SEQ ID NO: 287423 - DNA, 20 bp, Artificial Sequence
  Description of Artificial Sequence: Synthetic oligonucleotide
  Target: ATXN1; (+) strand; PAM type: YTN; PAM sequence: TTG
tttgttcgtttgtttgtggt

SEQ ID NO: 287424 - DNA, 20 bp, Artificial Sequence
  Description of Artificial Sequence: Synthetic oligonucleotide
  Target: ATXN1; (+) strand; PAM type: YTN; PAM sequence: TTT
gttcgtttgtttgtggtttt

SEQ ID NO: 287425 - DNA, 20 bp, Artificial Sequence
  Description of Artificial Sequence: Synthetic oligonucleotide
  Target: ATXN1; (+) strand; PAM type: YTN; PAM sequence: TTG
ttcgtttgtttgtggttttt

SEQ ID NO: 287426 - DNA, 20 bp, Artificial Sequence
  Description of Artificial Sequence: Synthetic oligonucleotide
  Target: ATXN1; (+) strand; PAM type: YTN; PAM sequence: TTC
gtttgtttgtggtttttttg

SEQ ID NO: 287427 - DNA, 20 bp, Artificial Sequence
  Description of Artificial Sequence: Synthetic oligonucleotide
  Target: ATXN1; (+) strand; PAM type: YTN; PAM sequence: TTT
gtttgtggtttttttgtttg

SEQ ID NO: 287428 - DNA, 20 bp, Artificial Sequence
  Description of Artificial Sequence: Synthetic oligonucleotide
  Target: ATXN1; (+) strand; PAM type: YTN; PAM sequence: TTG
tttgtggtttttttgtttgt

SEQ ID NO: 287429 - DNA, 20 bp, Artificial Sequence
  Description of Artificial Sequence: Synthetic oligonucleotide
  Target: ATXN1; (+) strand; PAM type: YTN; PAM sequence: TTT
gtggtttttttgtttgtggg

SEQ ID NO: 287430 - DNA, 20 bp, Artificial Sequence
  Description of Artificial Sequence: Synthetic oligonucleotide
  Target: ATXN1; (+) strand; PAM type: YTN; PAM sequence: TTG
tggtttttttgtttgtgggt

SEQ ID NO: 287431 - DNA, 20 bp, Artificial Sequence
  Description of Artificial Sequence: Synthetic oligonucleotide
  Target: ATXN1; (+) strand; PAM type: YTN; PAM sequence: TTT
ttttgtttgtgggttttttt

SEQ ID NO: 287432 - DNA, 20 bp, Artificial Sequence
  Description of Artificial Sequence: Synthetic oligonucleotide
  Target: ATXN1; (+) strand; PAM type: YTN; PAM sequence: TTT
tttgtttgtgggtttttttt

SEQ ID NO: 287433 - DNA, 20 bp, Artificial Sequence
  Description of Artificial Sequence: Synthetic oligonucleotide
  Target: ATXN1; (+) strand; PAM type: YTN; PAM sequence: TTT
ttgtttgtgggttttttttt

SEQ ID NO: 287434 - DNA, 20 bp, Artificial Sequence
  Description of Artificial Sequence: Synthetic oligonucleotide
  Target: ATXN1; (+) strand; PAM type: YTN; PAM sequence: TTT
tgtttgtgggtttttttttt

SEQ ID NO: 287435 - DNA, 20 bp, Artificial Sequence
  Description of Artificial Sequence: Synthetic oligonucleotide
  Target: ATXN1; (+) strand; PAM type: YTN; PAM sequence: TTT
gtttgtgggttttttttttt

SEQ ID NO: 287436 - DNA, 20 bp, Artificial Sequence
  Description of Artificial Sequence: Synthetic oligonucleotide
  Target: ATXN1; (+) strand; PAM type: YTN; PAM sequence: TTG
tttgtgggttttttttttta

SEQ ID NO: 287437 - DNA, 20 bp, Artificial Sequence
  Description of Artificial Sequence: Synthetic oligonucleotide
  Target: ATXN1; (+) strand; PAM type: YTN; PAM sequence: TTT
gtgggtttttttttttattt

SEQ ID NO: 287438 - DNA, 20 bp, Artificial Sequence
  Description of Artificial Sequence: Synthetic oligonucleotide
  Target: ATXN1; (+) strand; PAM type: YTN; PAM sequence: TTG
tgggtttttttttttatttt

SEQ ID NO: 287439 - DNA, 20 bp, Artificial Sequence
  Description of Artificial Sequence: Synthetic oligonucleotide
  Target: ATXN1; (+) strand; PAM type: YTN; PAM sequence: TTT
ttttttttatttttattttt

SEQ ID NO: 287440 - DNA, 20 bp, Artificial Sequence
  Description of Artificial Sequence: Synthetic oligonucleotide
  Target: ATXN1; (+) strand; PAM type: YTN; PAM sequence: TTT
tttttttatttttatttttt

SEQ ID NO: 287441 - DNA, 20 bp, Artificial Sequence
  Description of Artificial Sequence: Synthetic oligonucleotide
  Target: ATXN1; (+) strand; PAM type: YTN; PAM sequence: TTT
ttttttatttttattttttg

SEQ ID NO: 287442 - DNA, 20 bp, Artificial Sequence
  Description of Artificial Sequence: Synthetic oligonucleotide
  Target: ATXN1; (+) strand; PAM type: YTN; PAM sequence: TTT
tttttatttttattttttga

SEQ ID NO: 287443 - DNA, 20 bp, Artificial Sequence
  Description of Artificial Sequence: Synthetic oligonucleotide
  Target: ATXN1; (+) strand; PAM type: YTN; PAM sequence: TTT
ttttatttttattttttgag

SEQ ID NO: 287444 - DNA, 20 bp, Artificial Sequence
  Description of Artificial Sequence: Synthetic oligonucleotide
  Target: ATXN1; (+) strand; PAM type: YTN; PAM sequence: TTT
tttatttttattttttgaga

SEQ ID NO: 287445 - DNA, 20 bp, Artificial Sequence
  Description of Artificial Sequence: Synthetic oligonucleotide
  Target: ATXN1; (+) strand; PAM type: YTN; PAM sequence: TTT
ttatttttattttttgagac

SEQ ID NO: 287446 - DNA, 20 bp, Artificial Sequence
  Description of Artificial Sequence: Synthetic oligonucleotide
  Target: ATXN1; (+) strand; PAM type: YTN; PAM sequence: TTT
tatttttattttttgagaca

SEQ ID NO: 287447 - DNA, 20 bp, Artificial Sequence
  Description of Artificial Sequence: Synthetic oligonucleotide
  Target: ATXN1; (+) strand; PAM type: YTN; PAM sequence: TTT
atttttattttttgagacac

SEQ ID NO: 287448 - DNA, 20 bp, Artificial Sequence
  Description of Artificial Sequence: Synthetic oligonucleotide
  Target: ATXN1; (+) strand; PAM type: YTN; PAM sequence: TTA
tttttattttttgagacaca

SEQ ID NO: 287449 - DNA, 20 bp, Artificial Sequence
  Description of Artificial Sequence: Synthetic oligonucleotide
  Target: ATXN1; (+) strand; PAM type: YTN; PAM sequence: TTT
ttattttttgagacacagtc

SEQ ID NO: 287450 - DNA, 20 bp, Artificial Sequence
  Description of Artificial Sequence: Synthetic oligonucleotide
  Target: ATXN1; (+) strand; PAM type: YTN; PAM sequence: TTT
tattttttgagacacagtct

SEQ ID NO: 287451 - DNA, 20 bp, Artificial Sequence
  Description of Artificial Sequence: Synthetic oligonucleotide
  Target: ATXN1; (+) strand; PAM type: YTN; PAM sequence: TTT
attttttgagacacagtctt

SEQ ID NO: 287452 - DNA, 20 bp, Artificial Sequence
  Description of Artificial Sequence: Synthetic oligonucleotide
  Target: ATXN1; (+) strand; PAM type: YTN; PAM sequence: TTA
ttttttgagacacagtcttg

SEQ ID NO: 287453 - DNA, 20 bp, Artificial Sequence
  Description of Artificial Sequence: Synthetic oligonucleotide
  Target: ATXN1; (+) strand; PAM type: YTN; PAM sequence: TTT
tttgagacacagtcttgctc

SEQ ID NO: 287454 - DNA, 20 bp, Artificial Sequence
  Description of Artificial Sequence: Synthetic oligonucleotide
  Target: ATXN1; (+) strand; PAM type: YTN; PAM sequence: TTT
ttgagacacagtcttgctct

SEQ ID NO: 287455 - DNA, 20 bp, Artificial Sequence
  Description of Artificial Sequence: Synthetic oligonucleotide
  Target: ATXN1; (+) strand; PAM type: YTN; PAM sequence: TTT
tgagacacagtcttgctctg

SEQ ID NO: 287456 - DNA, 20 bp, Artificial Sequence
  Description of Artificial Sequence: Synthetic oligonucleotide
  Target: ATXN1; (+) strand; PAM type: YTN; PAM sequence: TTT
gagacacagtcttgctctgt

SEQ ID NO: 287457 - DNA, 20 bp, Artificial Sequence
  Description of Artificial Sequence: Synthetic oligonucleotide
  Target: ATXN1; (+) strand; PAM type: YTN; PAM sequence: TTG
agacacagtcttgctctgtc

SEQ ID NO: 287458 - DNA, 20 bp, Artificial Sequence
  Description of Artificial Sequence: Synthetic oligonucleotide
  Target: ATXN1; (+) strand; PAM type: YTN; PAM sequence: CTT
gctctgtcgcccaggctgga

SEQ ID NO: 287459 - DNA, 20 bp, Artificial Sequence
  Description of Artificial Sequence: Synthetic oligonucleotide
  Target: ATXN1; (+) strand; PAM type: YTN; PAM sequence: TTG
ctctgtcgcccaggctggag

SEQ ID NO: 287460 - DNA, 20 bp, Artificial Sequence
  Description of Artificial Sequence: Synthetic oligonucleotide
  Target: ATXN1; (+) strand; PAM type: YTN; PAM sequence: CTC
tgtcgcccaggctggagtcc

SEQ ID NO: 287461 - DNA, 20 bp, Artificial Sequence
  Description of Artificial Sequence: Synthetic oligonucleotide
  Target: ATXN1; (+) strand; PAM type: YTN; PAM sequence: CTG
tcgcccaggctggagtccgg

SEQ ID NO: 287462 - DNA, 20 bp, Artificial Sequence
  Description of Artificial Sequence: Synthetic oligonucleotide
  Target: ATXN1; (+) strand; PAM type: YTN; PAM sequence: CTG
gagtccggtggtgcgatctc

SEQ ID NO: 287463 - DNA, 20 bp, Artificial Sequence
  Description of Artificial Sequence: Synthetic oligonucleotide
  Target: ATXN1; (+) strand; PAM type: YTN; PAM sequence: CTC
ggctcactgtgacctccgac

SEQ ID NO: 287464 - DNA, 20 bp, Artificial Sequence
  Description of Artificial Sequence: Synthetic oligonucleotide
  Target: ATXN1; (+) strand; PAM type: YTN; PAM sequence: CTC
actgtgacctccgactcctg

SEQ ID NO: 287465 - DNA, 20 bp, Artificial Sequence
  Description of Artificial Sequence: Synthetic oligonucleotide
  Target: ATXN1; (+) strand; PAM type: YTN; PAM sequence: CTG
tgacctccgactcctgggtt

SEQ ID NO: 287466 - DNA, 20 bp, Artificial Sequence
  Description of Artificial Sequence: Synthetic oligonucleotide
  Target: ATXN1; (+) strand; PAM type: YTN; PAM sequence: CTC
cgactcctgggttcaagtga

SEQ ID NO: 287467 - DNA, 20 bp, Artificial Sequence
  Description of Artificial Sequence: Synthetic oligonucleotide
  Target: ATXN1; (+) strand; PAM type: YTN; PAM sequence: CTC
ctgggttcaagtgattctcc

SEQ ID NO: 287468 - DNA, 20 bp, Artificial Sequence
  Description of Artificial Sequence: Synthetic oligonucleotide
  Target: ATXN1; (+) strand; PAM type: YTN; PAM sequence: CTG
ggttcaagtgattctcctgc

SEQ ID NO: 287469 - DNA, 20 bp, Artificial Sequence
  Description of Artificial Sequence: Synthetic oligonucleotide
  Target: ATXN1; (+) strand; PAM type: YTN; PAM sequence: TTC
aagtgattctcctgcctcag

SEQ ID NO: 287470 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcccaag

SEQ ID NO: 287471 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccaagta

SEQ ID NO: 287472 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaagtagct

SEQ ID NO: 287473 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagtagctggga

SEQ ID NO: 287474 - DNA, 20 bp, Artificial Sequence
  Description of Artificial Sequence: Synthetic oligonucleotide
  Target: ATXN1; (+) strand; PAM type: YTN; PAM sequence: CTC
ccaagtagctgggactacag

SEQ ID NO: 287475 - DNA, 20 bp, Artificial Sequence
  Description of Artificial Sequence: Synthetic oligonucleotide
  Target: ATXN1; (+) strand; PAM type: YTN; PAM sequence: CTG
ggactacaggcgcctgccac

SEQ ID NO: 287476 - DNA, 20 bp, Artificial Sequence
  Description of Artificial Sequence: Synthetic oligonucleotide
  Target: ATXN1; (+) strand; PAM type: YTN; PAM sequence: CTA
caggcgcctgccaccaaacc

SEQ ID NO: 287477 - DNA, 20 bp, Artificial Sequence
  Description of Artificial Sequence: Synthetic oligonucleotide
  Target: ATXN1; (+) strand; PAM type: YTN; PAM sequence: CTG
ccaccaaacctggctaattt

SEQ ID NO: 287478 - DNA, 20 bp, Artificial Sequence
  Description of Artificial Sequence: Synthetic oligonucleotide
  Target: ATXN1; (+) strand; PAM type: YTN; PAM sequence: CTG
gctaattttttgtattttta

SEQ ID NO: 287479 - DNA, 20 bp, Artificial Sequence
  Description of Artificial Sequence: Synthetic oligonucleotide
  Target: ATXN1; (+) strand; PAM type: YTN; PAM sequence: CTA
attttttgtatttttagtag

SEQ ID NO: 287480 - DNA, 20 bp, Artificial Sequence
  Description of Artificial Sequence: Synthetic oligonucleotide
  Target: ATXN1; (+) strand; PAM type: YTN; PAM sequence: TTT
tttgtatttttagtagagat

SEQ ID NO: 287481 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagatg

SEQ ID NO: 287482 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagatgg

SEQ ID NO: 287483 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagatggg

SEQ ID NO: 287484 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagatgggg

SEQ ID NO: 287485 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatggggtttcg

SEQ ID NO: 287486 - DNA, 20 bp, Artificial Sequence
  Description of Artificial Sequence: Synthetic oligonucleotide
  Target: ATXN1; (+) strand; PAM type: YTN; PAM sequence: TTT
tagtagagatggggtttcgc

SEQ ID NO: 287487 - DNA, 20 bp, Artificial Sequence
  Description of Artificial Sequence: Synthetic oligonucleotide
  Target: ATXN1; (+) strand; PAM type: YTN; PAM sequence: TTT
agtagagatggggtttcgcc

SEQ ID NO: 287488 - DNA, 20 bp, Artificial Sequence
  Description of Artificial Sequence: Synthetic oligonucleotide
  Target: ATXN1; (+) strand; PAM type: YTN; PAM sequence: TTA
gtagagatggggtttcgccg

SEQ ID NO: 287489 - DNA, 20 bp, Artificial Sequence
  Description of Artificial Sequence: Synthetic oligonucleotide
  Target: ATXN1; (+) strand; PAM type: YTN; PAM sequence: TTT
cgccgtgttagccaggacgg

SEQ ID NO: 287490 - DNA, 20 bp, Artificial Sequence
  Description of Artificial Sequence: Synthetic oligonucleotide
  Target: ATXN1; (+) strand; PAM type: YTN; PAM sequence: TTC
gccgtgttagccaggacggt

SEQ ID NO: 287491 - DNA, 20 bp, Artificial Sequence
  Description of Artificial Sequence: Synthetic oligonucleotide
  Target: ATXN1; (+) strand; PAM type: YTN; PAM sequence: TTA
gccaggacggtcttgatctc

SEQ ID NO: 287492 - DNA, 20 bp, Artificial Sequence
  Description of Artificial Sequence: Synthetic oligonucleotide
  Target: ATXN1; (+) strand; PAM type: YTN; PAM sequence: CTT
gatctcctgacctcgtgatc

SEQ ID NO: 287493 - DNA, 20 bp, Artificial Sequence
  Description of Artificial Sequence: Synthetic oligonucleotide
  Target: ATXN1; (+) strand; PAM type: YTN; PAM sequence: TTG
atctcctgacctcgtgatcc

SEQ ID NO: 287494 - DNA, 20 bp, Artificial Sequence
  Description of Artificial Sequence: Synthetic oligonucleotide
  Target: ATXN1; (+) strand; PAM type: YTN; PAM sequence: CTC
ctgacctcgtgatccgcccg

SEQ ID NO: 287495 - DNA, 20 bp, Artificial Sequence
  Description of Artificial Sequence: Synthetic oligonucleotide
  Target: ATXN1; (+) strand; PAM type: YTN; PAM sequence: CTG
acctcgtgatccgcccgcct

SEQ ID NO: 287496 - DNA, 20 bp, Artificial Sequence
  Description of Artificial Sequence: Synthetic oligonucleotide
  Target: ATXN1; (+) strand; PAM type: YTN; PAM sequence: CTC
gtgatccgcccgcctcagcc

SEQ ID NO: 287497 - DNA, 20 bp, Artificial Sequence
  Description of Artificial Sequence: Synthetic oligonucleotide
  Target: ATXN1; (+) strand; PAM type: YTN; PAM sequence: CTC
agcctcccgaagtgctggga

SEQ ID NO: 287498 - DNA, 20 bp, Artificial Sequence
  Description of Artificial Sequence: Synthetic oligonucleotide
  Target: ATXN1; (+) strand; PAM type: YTN; PAM sequence: CTC
ccgaagtgctgggattacaa

SEQ ID NO: 287499 - DNA, 20 bp, Artificial Sequence
  Description of Artificial Sequence: Synthetic oligonucleotide
  Target: ATXN1; (+) strand; PAM type: YTN; PAM sequence: CTG
ggattacaagcatgagccat

SEQ ID NO: 287500 - DNA, 20 bp, Artificial Sequence
  Description of Artificial Sequence: Synthetic oligonucleotide
  Target: ATXN1; (+) strand; PAM type: YTN; PAM sequence: TTA
caagcatgagccatcacgcc

SEQ ID NO: 287501 - DNA, 20 bp, Artificial Sequence
  Description of Artificial Sequence: Synthetic oligonucleotide
  Target: ATXN1; (+) strand; PAM type: YTN; PAM sequence: CTA
aattgaattttgggggaaag

SEQ ID NO: 287502 - DNA, 20 bp, Artificial Sequence
  Description of Artificial Sequence: Synthetic oligonucleotide
  Target: ATXN1; (+) strand; PAM type: YTN; PAM sequence: TTG
aattttgggggaaagtatac

SEQ ID NO: 287503 - DNA, 20 bp, Artificial Sequence
  Description of Artificial Sequence: Synthetic oligonucleotide
  Target: ATXN1; (+) strand; PAM type: YTN; PAM sequence: TTT
tgggggaaagtatacagttc

SEQ ID NO: 287504 - DNA, 20 bp, Artificial Sequence
  Description of Artificial Sequence: Synthetic oligonucleotide
  Target: ATXN1; (+) strand; PAM type: YTN; PAM sequence: TTT
gggggaaagtatacagttcc

SEQ ID NO: 287505 - DNA, 20 bp, Artificial Sequence
  Description of Artificial Sequence: Synthetic oligonucleotide
  Target: ATXN1; (+) strand; PAM type: YTN; PAM sequence: TTG
ggggaaagtatacagttcca

SEQ ID NO: 287506 - DNA, 20 bp, Artificial Sequence
  Description of Artificial Sequence: Synthetic oligonucleotide
  Target: ATXN1; (+) strand; PAM type: YTN; PAM sequence: TTC
catgagttgtgtgtgtgtgt

SEQ ID NO: 287507 - DNA, 20 bp, Artificial Sequence
  Description of Artificial Sequence: Synthetic oligonucleotide
  Target: ATXN1; (+) strand; PAM type: YTN; PAM sequence: TTG
tgtgtgtgtgtgtgtgtgtt

SEQ ID NO: 287508 - DNA, 20 bp, Artificial Sequence
  Description of Artificial Sequence: Synthetic oligonucleotide
  Target: ATXN1; (+) strand; PAM type: YTN; PAM sequence: TTG
tttgtttgtttttgagacgg

SEQ ID NO: 287509 - DNA, 20 bp, Artificial Sequence
  Description of Artificial Sequence: Synthetic oligonucleotide
  Target: ATXN1; (+) strand; PAM type: YTN; PAM sequence: TTT
gtttgtttttgagacggact

SEQ ID NO: 287510 - DNA, 20 bp, Artificial Sequence
  Description of Artificial Sequence: Synthetic oligonucleotide
  Target: ATXN1; (+) strand; PAM type: YTN; PAM sequence: TTG
tttgtttttgagacggactt

SEQ ID NO: 287511 - DNA, 20 bp, Artificial Sequence
  Description of Artificial Sequence: Synthetic oligonucleotide
  Target: ATXN1; (+) strand; PAM type: YTN; PAM sequence: TTT
gtttttgagacggacttttg

SEQ ID NO: 287512 - DNA, 20 bp, Artificial Sequence
  Description of Artificial Sequence: Synthetic oligonucleotide
  Target: ATXN1; (+) strand; PAM type: YTN; PAM sequence: TTG
tttttgagacggacttttgc

SEQ ID NO: 287513 - DNA, 20 bp, Artificial Sequence
  Description of Artificial Sequence: Synthetic oligonucleotide
  Target: ATXN1; (+) strand; PAM type: YTN; PAM sequence: TTT
ttgagacggacttttgctct

SEQ ID NO: 287514 - DNA, 20 bp, Artificial Sequence
  Description of Artificial Sequence: Synthetic oligonucleotide
  Target: ATXN1; (+) strand; PAM type: YTN; PAM sequence: TTT
tgagacggacttttgctctt

SEQ ID NO: 287515 - DNA, 20 bp, Artificial Sequence
  Description of Artificial Sequence: Synthetic oligonucleotide
  Target: ATXN1; (+) strand; PAM type: YTN; PAM sequence: TTT
gagacggacttttgctctta

SEQ ID NO: 287516 - DNA, 20 bp, Artificial Sequence
  Description of Artificial Sequence: Synthetic oligonucleotide
  Target: ATXN1; (+) strand; PAM type: YTN; PAM sequence: TTG
agacggacttttgctcttat

SEQ ID NO: 287517 - DNA, 20 bp, Artificial Sequence
  Description of Artificial Sequence: Synthetic oligonucleotide
  Target: ATXN1; (+) strand; PAM type: YTN; PAM sequence: CTT
ttgctcttattgcgcaggct

SEQ ID NO: 287518 - DNA, 20 bp, Artificial Sequence
  Description of Artificial Sequence: Synthetic oligonucleotide
  Target: ATXN1; (+) strand; PAM type: YTN; PAM sequence: TTT
tgctcttattgcgcaggctg

SEQ ID NO: 287519 - DNA, 20 bp, Artificial Sequence
  Description of Artificial Sequence: Synthetic oligonucleotide
  Target: ATXN1; (+) strand; PAM type: YTN; PAM sequence: TTT
gctcttattgcgcaggctgg

SEQ ID NO: 287520 - DNA, 20 bp, Artificial Sequence
  Description of Artificial Sequence: Synthetic oligonucleotide
  Target: ATXN1; (+) strand; PAM type: YTN; PAM sequence: TTG
ctcttattgcgcaggctgga

SEQ ID NO: 287521 - DNA, 20 bp, Artificial Sequence
  Description of Artificial Sequence: Synthetic oligonucleotide
  Target: ATXN1; (+) strand; PAM type: YTN; PAM sequence: CTC
ttattgcgcaggctggagta

SEQ ID NO: 287522 - DNA, 20 bp, Artificial Sequence
  Description of Artificial Sequence: Synthetic oligonucleotide
  Target: ATXN1; (+) strand; PAM type: YTN; PAM sequence: CTT
attgcgcaggctggagtaca

SEQ ID NO: 287523 - DNA, 20 bp, Artificial Sequence
  Description of Artificial Sequence: Synthetic oligonucleotide
  Target: ATXN1; (+) strand; PAM type: YTN; PAM sequence: TTA
ttgcgcaggctggagtacaa

SEQ ID NO: 287524 - DNA, 20 bp, Artificial Sequence
  Description of Artificial Sequence: Synthetic oligonucleotide
  Target: ATXN1; (+) strand; PAM type: YTN; PAM sequence: TTG
cgcaggctggagtacaatgg

SEQ ID NO: 287525 - DNA, 20 bp, Artificial Sequence
  Description of Artificial Sequence: Synthetic oligonucleotide
  Target: ATXN1; (+) strand; PAM type: YTN; PAM sequence: CTG
gagtacaatggtgcgatctt

SEQ ID NO: 287526 - DNA, 20 bp, Artificial Sequence
  Description of Artificial Sequence: Synthetic oligonucleotide
  Target: ATXN1; (+) strand; PAM type: YTN; PAM sequence: CTT
ggctcactgcaacctctgcc

SEQ ID NO: 287527 - DNA, 20 bp, Artificial Sequence
  Description of Artificial Sequence: Synthetic oligonucleotide
  Target: ATXN1; (+) strand; PAM type: YTN; PAM sequence: TTG
gctcactgcaacctctgcct

SEQ ID NO: 287528 - DNA, 20 bp, Artificial Sequence
  Description of Artificial Sequence: Synthetic oligonucleotide
  Target: ATXN1; (+) strand; PAM type: YTN; PAM sequence: CTC
actgcaacctctgcctcccg

SEQ ID NO: 287529 - DNA, 20 bp, Artificial Sequence
  Description of Artificial Sequence: Synthetic oligonucleotide
  Target: ATXN1; (+) strand; PAM type: YTN; PAM sequence: CTG
caacctctgcctcccgggtt

SEQ ID NO: 287530 - DNA, 20 bp, Artificial Sequence
  Description of Artificial Sequence: Synthetic oligonucleotide
  Target: ATXN1; (+) strand; PAM type: YTN; PAM sequence: CTC
tgcctcccgggttcaagcga

SEQ ID NO: 287531 - DNA, 20 bp, Artificial Sequence
  Description of Artificial Sequence: Synthetic oligonucleotide
  Target: ATXN1; (+) strand; PAM type: YTN; PAM sequence: CTG
cctcccgggttcaagcgatt

SEQ ID NO: 287532 - DNA, 20 bp, Artificial Sequence
  Description of Artificial Sequence: Synthetic oligonucleotide
  Target: ATXN1; (+) strand; PAM type: YTN; PAM sequence: CTC
ccgggttcaagcgattctcc

SEQ ID NO: 287533 - DNA, 20 bp, Artificial Sequence
  Description of Artificial Sequence: Synthetic oligonucleotide
  Target: ATXN1; (+) strand; PAM type: YTN; PAM sequence: TTC
aagcgattctcctgcctcag

SEQ ID NO: 287534 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcccaag

SEQ ID NO: 287535 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccaagta

SEQ ID NO: 287536 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaagtagct

SEQ ID NO: 287537 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagtagctggga

SEQ ID NO: 287538 - DNA, 20 bp, Artificial Sequence
  Description of Artificial Sequence: Synthetic oligonucleotide
  Target: ATXN1; (+) strand; PAM type: YTN; PAM sequence: CTC
ccaagtagctgggattacag

SEQ ID NO: 287539 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcatgcgccaa

SEQ ID NO: 287540 - DNA, 20 bp, Artificial Sequence
  Description of Artificial Sequence: Synthetic oligonucleotide
  Target: ATXN1; (+) strand; PAM type: YTN; PAM sequence: TTA
caggcatgcgccaacatgcc

SEQ ID NO: 287541 - DNA, 20 bp, Artificial Sequence
  Description of Artificial Sequence: Synthetic oligonucleotide
  Target: ATXN1; (+) strand; PAM type: YTN; PAM sequence: CTA
atgttttgtatttttagtag

SEQ ID NO: 287542 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagatgg

SEQ ID NO: 287543 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagatggg

SEQ ID NO: 287544 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagatgggg

SEQ ID NO: 287545 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatggggtttca

SEQ ID NO: 287546 - DNA, 20 bp, Artificial Sequence
  Description of Artificial Sequence: Synthetic oligonucleotide
  Target: ATXN1; (+) strand; PAM type: YTN; PAM sequence: TTT
tagtagagatggggtttcac

SEQ ID NO: 287547 - DNA, 20 bp, Artificial Sequence
  Description of Artificial Sequence: Synthetic oligonucleotide
  Target: ATXN1; (+) strand; PAM type: YTN; PAM sequence: TTT
agtagagatggggtttcacc

SEQ ID NO: 287548 - DNA, 20 bp, Artificial Sequence
  Description of Artificial Sequence: Synthetic oligonucleotide
  Target: ATXN1; (+) strand; PAM type: YTN; PAM sequence: TTA
gtagagatggggtttcacca

SEQ ID NO: 287549 - DNA, 20 bp, Artificial Sequence
  Description of Artificial Sequence: Synthetic oligonucleotide
  Target: ATXN1; (+) strand; PAM type: YTN; PAM sequence: TTT
caccagtttaaaactcctga

SEQ ID NO: 287550 - DNA, 20 bp, Artificial Sequence
  Description of Artificial Sequence: Synthetic oligonucleotide
  Target: ATXN1; (+) strand; PAM type: YTN; PAM sequence: TTC
accagtttaaaactcctgac

SEQ ID NO: 287551 - DNA, 20 bp, Artificial Sequence
  Description of Artificial Sequence: Synthetic oligonucleotide
  Target: ATXN1; (+) strand; PAM type: YTN; PAM sequence: TTT
aaaactcctgacctcaggtg

SEQ ID NO: 287552 - DNA, 20 bp, Artificial Sequence
  Description of Artificial Sequence: Synthetic oligonucleotide
  Target: ATXN1; (+) strand; PAM type: YTN; PAM sequence: TTA
aaactcctgacctcaggtga

SEQ ID NO: 287553 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaggtgatccacc

SEQ ID NO: 287554 - DNA, 20 bp, Artificial Sequence
  Description of Artificial Sequence: Synthetic oligonucleotide
  Target: ATXN1; (+) strand; PAM type: YTN; PAM sequence: CTG
acctcaggtgatccacccgc

SEQ ID NO: 287555 - DNA, 20 bp, Artificial Sequence
  Description of Artificial Sequence: Synthetic oligonucleotide
  Target: ATXN1; (+) strand; PAM type: YTN; PAM sequence: CTC
aggtgatccacccgccttgg

SEQ ID NO: 287556 - DNA, 20 bp, Artificial Sequence
  Description of Artificial Sequence: Synthetic oligonucleotide
  Target: ATXN1; (+) strand; PAM type: YTN; PAM sequence: CTT
ggcctcccaaagtgttggga

SEQ ID NO: 287557 - DNA, 20 bp, Artificial Sequence
  Description of Artificial Sequence: Synthetic oligonucleotide
  Target: ATXN1; (+) strand; PAM type: YTN; PAM sequence: TTG
gcctcccaaagtgttgggat

SEQ ID NO: 287558 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgttgggattacag

SEQ ID NO: 287559 - DNA, 20 bp, Artificial Sequence
  Description of Artificial Sequence: Synthetic oligonucleotide
  Target: ATXN1; (+) strand; PAM type: YTN; PAM sequence: TTG
ggattacaggcatgagccac

SEQ ID NO: 287560 - DNA, 20 bp, Artificial Sequence
  Description of Artificial Sequence: Synthetic oligonucleotide
  Target: ATXN1; (+) strand; PAM type: YTN; PAM sequence: TTA
caggcatgagccaccgcgtc

SEQ ID NO: 287561 - DNA, 20 bp, Artificial Sequence
  Description of Artificial Sequence: Synthetic oligonucleotide
  Target: ATXN1; (+) strand; PAM type: YTN; PAM sequence: CTG
ttatataagcccagctctgc

SEQ ID NO: 287562 - DNA, 20 bp, Artificial Sequence
  Description of Artificial Sequence: Synthetic oligonucleotide
  Target: ATXN1; (+) strand; PAM type: YTN; PAM sequence: TTA
tataagcccagctctgctgt

SEQ ID NO: 287563 - DNA, 20 bp, Artificial Sequence
  Description of Artificial Sequence: Synthetic oligonucleotide
  Target: ATXN1; (+) strand; PAM type: YTN; PAM sequence: CTC
tgctgtaaactagtcctttg

SEQ ID NO: 287564 - DNA, 20 bp, Artificial Sequence
  Description of Artificial Sequence: Synthetic oligonucleotide
  Target: ATXN1; (+) strand; PAM type: YTN; PAM sequence: CTG
ctgtaaactagtcctttgtg

SEQ ID NO: 287565 - DNA, 20 bp, Artificial Sequence
  Description of Artificial Sequence: Synthetic oligonucleotide
  Target: ATXN1; (+) strand; PAM type: YTN; PAM sequence: CTG
taaactagtcctttgtggcc

SEQ ID NO: 287566 - DNA, 20 bp, Artificial Sequence
  Description of Artificial Sequence: Synthetic oligonucleotide
  Target: ATXN1; (+) strand; PAM type: YTN; PAM sequence: CTA
gtcctttgtggccttgggaa

SEQ ID NO: 287567 - DNA, 20 bp, Artificial Sequence
  Description of Artificial Sequence: Synthetic oligonucleotide
  Target: ATXN1; (+) strand; PAM type: YTN; PAM sequence: CTT
tgtggccttgggaaagttat

SEQ ID NO: 287568 - DNA, 20 bp, Artificial Sequence
  Description of Artificial Sequence: Synthetic oligonucleotide
  Target: ATXN1; (+) strand; PAM type: YTN; PAM sequence: TTT
gtggccttgggaaagttata

SEQ ID NO: 287569 - DNA, 20 bp, Artificial Sequence
  Description of Artificial Sequence: Synthetic oligonucleotide
  Target: ATXN1; (+) strand; PAM type: YTN; PAM sequence: TTG
tggccttgggaaagttatac

SEQ ID NO: 287570 - DNA, 20 bp, Artificial Sequence
  Description of Artificial Sequence: Synthetic oligonucleotide
  Target: ATXN1; (+) strand; PAM type: YTN; PAM sequence: CTT
gggaaagttataccctctct

SEQ ID NO: 287571 - DNA, 20 bp, Artificial Sequence
  Description of Artificial Sequence: Synthetic oligonucleotide
  Target: ATXN1; (+) strand; PAM type: YTN; PAM sequence: TTG
ggaaagttataccctctcta

SEQ ID NO: 287572 - DNA, 20 bp, Artificial Sequence
  Description of Artificial Sequence: Synthetic oligonucleotide
  Target: ATXN1; (+) strand; PAM type: YTN; PAM sequence: TTA
taccctctctaagcctcagt

SEQ ID NO: 287573 - DNA, 20 bp, Artificial Sequence
  Description of Artificial Sequence: Synthetic oligonucleotide
  Target: ATXN1; (+) strand; PAM type: YTN; PAM sequence: CTC
tctaagcctcagtttctaca

SEQ ID NO: 287574 - DNA, 20 bp, Artificial Sequence
  Description of Artificial Sequence: Synthetic oligonucleotide
  Target: ATXN1; (+) strand; PAM type: YTN; PAM sequence: CTC
taagcctcagtttctacatc

SEQ ID NO: 287575 - DNA, 20 bp, Artificial Sequence
  Description of Artificial Sequence: Synthetic oligonucleotide
  Target: ATXN1; (+) strand; PAM type: YTN; PAM sequence: CTA
agcctcagtttctacatctg

SEQ ID NO: 287576 - DNA, 20 bp, Artificial Sequence
  Description of Artificial Sequence: Synthetic oligonucleotide
  Target: ATXN1; (+) strand; PAM type: YTN; PAM sequence: CTC
agtttctacatctgtgaagt

SEQ ID NO: 287577 - DNA, 20 bp, Artificial Sequence
  Description of Artificial Sequence: Synthetic oligonucleotide
  Target: ATXN1; (+) strand; PAM type: YTN; PAM sequence: TTT
ctacatctgtgaagtgaaag

SEQ ID NO: 287578 - DNA, 20 bp, Artificial Sequence
  Description of Artificial Sequence: Synthetic oligonucleotide
  Target: ATXN1; (+) strand; PAM type: YTN; PAM sequence: TTC
tacatctgtgaagtgaaagg

SEQ ID NO: 287579 - DNA, 20 bp, Artificial Sequence
  Description of Artificial Sequence: Synthetic oligonucleotide
  Target: ATXN1; (+) strand; PAM type: YTN; PAM sequence: CTA
catctgtgaagtgaaagggt

SEQ ID NO: 287580 - DNA, 20 bp, Artificial Sequence
  Description of Artificial Sequence: Synthetic oligonucleotide
  Target: ATXN1; (+) strand; PAM type: YTN; PAM sequence: CTG
tgaagtgaaagggttggcgt

SEQ ID NO: 287581 - DNA, 20 bp, Artificial Sequence
  Description of Artificial Sequence: Synthetic oligonucleotide
  Target: ATXN1; (+) strand; PAM type: YTN; PAM sequence: TTG
gcgtaagggacctctccaag

SEQ ID NO: 287582 - DNA, 20 bp, Artificial Sequence
  Description of Artificial Sequence: Synthetic oligonucleotide
  Target: ATXN1; (+) strand; PAM type: YTN; PAM sequence: CTC
tccaaggtccattctagctc

SEQ ID NO: 287583 - DNA, 20 bp, Artificial Sequence
  Description of Artificial Sequence: Synthetic oligonucleotide
  Target: ATXN1; (+) strand; PAM type: YTN; PAM sequence: CTC
caaggtccattctagctccc

SEQ ID NO: 287584 - DNA, 20 bp, Artificial Sequence
  Description of Artificial Sequence: Synthetic oligonucleotide
  Target: ATXN1; (+) strand; PAM type: YTN; PAM sequence: TTC
tagctcccaagttctgcaat

SEQ ID NO: 287585 - DNA, 20 bp, Artificial Sequence
  Description of Artificial Sequence: Synthetic oligonucleotide
  Target: ATXN1; (+) strand; PAM type: YTN; PAM sequence: CTA
gctcccaagttctgcaatta

SEQ ID NO: 287586 - DNA, 20 bp, Artificial Sequence
  Description of Artificial Sequence: Synthetic oligonucleotide
  Target: ATXN1; (+) strand; PAM type: YTN; PAM sequence: CTC
ccaagttctgcaattatgtg

SEQ ID NO: 287587 - DNA, 20 bp, Artificial Sequence
  Description of Artificial Sequence: Synthetic oligonucleotide
  Target: ATXN1; (+) strand; PAM type: YTN; PAM sequence: TTC
tgcaattatgtgcatcacaa

SEQ ID NO: 287588 - DNA, 20 bp, Artificial Sequence
  Description of Artificial Sequence: Synthetic oligonucleotide
  Target: ATXN1; (+) strand; PAM type: YTN; PAM sequence: CTG
caattatgtgcatcacaaaa

SEQ ID NO: 287589 - DNA, 20 bp, Artificial Sequence
  Description of Artificial Sequence: Synthetic oligonucleotide
  Target: ATXN1; (+) strand; PAM type: YTN; PAM sequence: TTA
tgtgcatcacaaaataggaa

SEQ ID NO: 287590 - DNA, 20 bp, Artificial Sequence
  Description of Artificial Sequence: Synthetic oligonucleotide
  Target: ATXN1; (+) strand; PAM type: YTN; PAM sequence: CTG
gacatataagggagaattaa

SEQ ID NO: 287591 - DNA, 20 bp, Artificial Sequence
  Description of Artificial Sequence: Synthetic oligonucleotide
  Target: ATXN1; (+) strand; PAM type: YTN; PAM sequence: TTA
agtgttgtcaaaaaatgtaa

SEQ ID NO: 287592 - DNA, 20 bp, Artificial Sequence
  Description of Artificial Sequence: Synthetic oligonucleotide
  Target: ATXN1; (+) strand; PAM type: YTN; PAM sequence: TTG
tcaaaaaatgtaaattatgc

SEQ ID NO: 287593 - DNA, 20 bp, Artificial Sequence
  Description of Artificial Sequence: Synthetic oligonucleotide
  Target: ATXN1; (+) strand; PAM type: YTN; PAM sequence: TTA
tgcaagtgagacaatcagac

SEQ ID NO: 287594 - DNA, 20 bp, Artificial Sequence
  Description of Artificial Sequence: Synthetic oligonucleotide
  Target: ATXN1; (+) strand; PAM type: YTN; PAM sequence: TTT
catgatccacttaattgata

SEQ ID NO: 287595 - DNA, 20 bp, Artificial Sequence
  Description of Artificial Sequence: Synthetic oligonucleotide
  Target: ATXN1; (+) strand; PAM type: YTN; PAM sequence: TTC
atgatccacttaattgatat

SEQ ID NO: 287596 - DNA, 20 bp, Artificial Sequence
  Description of Artificial Sequence: Synthetic oligonucleotide
  Target: ATXN1; (+) strand; PAM type: YTN; PAM sequence: CTT
aattgatattgcgctgcatg

SEQ ID NO: 287597 - DNA, 20 bp, Artificial Sequence
  Description of Artificial Sequence: Synthetic oligonucleotide
  Target: ATXN1; (+) strand; PAM type: YTN; PAM sequence: TTA
attgatattgcgctgcatgg

SEQ ID NO: 287598 - DNA, 20 bp, Artificial Sequence
  Description of Artificial Sequence: Synthetic oligonucleotide
  Target: ATXN1; (+) strand; PAM type: YTN; PAM sequence: TTG
atattgcgctgcatggtaat

SEQ ID NO: 287599 - DNA, 20 bp, Artificial Sequence
  Description of Artificial Sequence: Synthetic oligonucleotide
  Target: ATXN1; (+) strand; PAM type: YTN; PAM sequence: TTG
cgctgcatggtaattgagct

SEQ ID NO: 287600 - DNA, 20 bp, Artificial Sequence
  Description of Artificial Sequence: Synthetic oligonucleotide
  Target: ATXN1; (+) strand; PAM type: YTN; PAM sequence: CTG
catggtaattgagcttggaa

SEQ ID NO: 287601 - DNA, 20 bp, Artificial Sequence
  Description of Artificial Sequence: Synthetic oligonucleotide
  Target: ATXN1; (+) strand; PAM type: YTN; PAM sequence: TTG
agcttggaaagcatgtccca

SEQ ID NO: 287602 - DNA, 20 bp, Artificial Sequence
  Description of Artificial Sequence: Synthetic oligonucleotide
  Target: ATXN1; (+) strand; PAM type: YTN; PAM sequence: CTT
ggaaagcatgtcccaatgtg

SEQ ID NO: 287603 - DNA, 20 bp, Artificial Sequence
  Description of Artificial Sequence: Synthetic oligonucleotide
  Target: ATXN1; (+) strand; PAM type: YTN; PAM sequence: TTG
gaaagcatgtcccaatgtgt

SEQ ID NO: 287604 - DNA, 20 bp, Artificial Sequence
  Description of Artificial Sequence: Synthetic oligonucleotide
  Target: ATXN1; (+) strand; PAM type: YTN; PAM sequence: TTA
tattcatgtgtaacttcaaa

SEQ ID NO: 287605 - DNA, 20 bp, Artificial Sequence
  Description of Artificial Sequence: Synthetic oligonucleotide
  Target: ATXN1; (+) strand; PAM type: YTN; PAM sequence: TTC
atgtgtaacttcaaaatgga

SEQ ID NO: 287606 - DNA, 20 bp, Artificial Sequence
  Description of Artificial Sequence: Synthetic oligonucleotide
  Target: ATXN1; (+) strand; PAM type: YTN; PAM sequence: CTT
caaaatggaatgtcagtgtc

SEQ ID NO: 287607 - DNA, 20 bp, Artificial Sequence
  Description of Artificial Sequence: Synthetic oligonucleotide
  Target: ATXN1; (+) strand; PAM type: YTN; PAM sequence: TTC
aaaatggaatgtcagtgtct

SEQ ID NO: 287608 - DNA, 20 bp, Artificial Sequence
  Description of Artificial Sequence: Synthetic oligonucleotide
  Target: ATXN1; (+) strand; PAM type: YTN; PAM sequence: CTG
gggtgggtgggaaatccaaa

SEQ ID NO: 287609 - DNA, 20 bp, Artificial Sequence
  Description of Artificial Sequence: Synthetic oligonucleotide
  Target: ATXN1; (+) strand; PAM type: YTN; PAM sequence: TTC
taagagtgaagcctgtttcc

SEQ ID NO: 287610 - DNA, 20 bp, Artificial Sequence
  Description of Artificial Sequence: Synthetic oligonucleotide
  Target: ATXN1; (+) strand; PAM type: YTN; PAM sequence: CTA
agagtgaagcctgtttccat

SEQ ID NO: 287611 - DNA, 20 bp, Artificial Sequence
  Description of Artificial Sequence: Synthetic oligonucleotide
  Target: ATXN1; (+) strand; PAM type: YTN; PAM sequence: CTG
tttccatctgataggtcaaa

SEQ ID NO: 287612 - DNA, 20 bp, Artificial Sequence
  Description of Artificial Sequence: Synthetic oligonucleotide
  Target: ATXN1; (+) strand; PAM type: YTN; PAM sequence: TTT
ccatctgataggtcaaaata

SEQ ID NO: 287613 - DNA, 20 bp, Artificial Sequence
  Description of Artificial Sequence: Synthetic oligonucleotide
  Target: ATXN1; (+) strand; PAM type: YTN; PAM sequence: TTC
catctgataggtcaaaatac

SEQ ID NO: 287614 - DNA, 20 bp, Artificial Sequence
  Description of Artificial Sequence: Synthetic oligonucleotide
  Target: ATXN1; (+) strand; PAM type: YTN; PAM sequence: CTG
ataggtcaaaatacatgaat

SEQ ID NO: 287615 - DNA, 20 bp, Artificial Sequence
  Description of Artificial Sequence: Synthetic oligonucleotide
  Target: ATXN1; (+) strand; PAM type: YTN; PAM sequence: CTC
tctaggcaaccatggtcaac

SEQ ID NO: 287616 - DNA, 20 bp, Artificial Sequence
  Description of Artificial Sequence: Synthetic oligonucleotide
  Target: ATXN1; (+) strand; PAM type: YTN; PAM sequence: CTC
taggcaaccatggtcaactg

SEQ ID NO: 287617 - DNA, 20 bp, Artificial Sequence
  Description of Artificial Sequence: Synthetic oligonucleotide
  Target: ATXN1; (+) strand; PAM type: YTN; PAM sequence: CTA
ggcaaccatggtcaactgtt

SEQ ID NO: 287618 - DNA, 20 bp, Artificial Sequence
  Description of Artificial Sequence: Synthetic oligonucleotide
  Target: ATXN1; (+) strand; PAM type: YTN; PAM sequence: CTG
ttgaaaaccacttcttgctt

SEQ ID NO: 287619 - DNA, 20 bp, Artificial Sequence
  Description of Artificial Sequence: Synthetic oligonucleotide
  Target: ATXN1; (+) strand; PAM type: YTN; PAM sequence: TTG
aaaaccacttcttgctttac

SEQ ID NO: 287620 - DNA, 20 bp, Artificial Sequence
  Description of Artificial Sequence: Synthetic oligonucleotide
  Target: ATXN1; (+) strand; PAM type: YTN; PAM sequence: CTT
cttgctttacatcaaaatgt

SEQ ID NO: 287621 - DNA, 20 bp, Artificial Sequence
  Description of Artificial Sequence: Synthetic oligonucleotide
  Target: ATXN1; (+) strand; PAM type: YTN; PAM sequence: TTC
ttgctttacatcaaaatgtg

SEQ ID NO: 287622 - DNA, 20 bp, Artificial Sequence
  Description of Artificial Sequence: Synthetic oligonucleotide
  Target: ATXN1; (+) strand; PAM type: YTN; PAM sequence: CTT
gctttacatcaaaatgtgtt

SEQ ID NO: 287623 - DNA, 20 bp, Artificial Sequence
  Description of Artificial Sequence: Synthetic oligonucleotide
  Target: ATXN1; (+) strand; PAM type: YTN; PAM sequence: TTG
ctttacatcaaaatgtgtta

SEQ ID NO: 287624 - DNA, 20 bp, Artificial Sequence
  Description of Artificial Sequence: Synthetic oligonucleotide
  Target: ATXN1; (+) strand; PAM type: YTN; PAM sequence: CTT
tacatcaaaatgtgttagta

SEQ ID NO: 287625 - DNA, 20 bp, Artificial Sequence
  Description of Artificial Sequence: Synthetic oligonucleotide
  Target: ATXN1; (+) strand; PAM type: YTN; PAM sequence: TTT
acatcaaaatgtgttagtag

SEQ ID NO: 287626 - DNA, 20 bp, Artificial Sequence
  Description of Artificial Sequence: Synthetic oligonucleotide
  Target: ATXN1; (+) strand; PAM type: YTN; PAM sequence: TTA
catcaaaatgtgttagtaga

SEQ ID NO: 287627 - DNA, 20 bp, Artificial Sequence
  Description of Artificial Sequence: Synthetic oligonucleotide
  Target: ATXN1; (+) strand; PAM type: YTN; PAM sequence: TTA
gtagaaaacaaaaatacctt

SEQ ID NO: 287628 - DNA, 20 bp, Artificial Sequence
  Description of Artificial Sequence: Synthetic oligonucleotide
  Target: ATXN1; (+) strand; PAM type: YTN; PAM sequence: CTT
gggtcaagcatatccccaaa

SEQ ID NO: 287629 - DNA, 20 bp, Artificial Sequence
  Description of Artificial Sequence: Synthetic oligonucleotide
  Target: ATXN1; (+) strand; PAM type: YTN; PAM sequence: TTG
ggtcaagcatatccccaaat

SEQ ID NO: 287630 - DNA, 20 bp, Artificial Sequence
  Description of Artificial Sequence: Synthetic oligonucleotide
  Target: ATXN1; (+) strand; PAM type: YTN; PAM sequence: TTC
ctaaagatggctctttgctc

SEQ ID NO: 287631 - DNA, 20 bp, Artificial Sequence
  Description of Artificial Sequence: Synthetic oligonucleotide
  Target: ATXN1; (+) strand; PAM type: YTN; PAM sequence: CTA
aagatggctctttgctcatt

SEQ ID NO: 287632 - DNA, 20 bp, Artificial Sequence
  Description of Artificial Sequence: Synthetic oligonucleotide
  Target: ATXN1; (+) strand; PAM type: YTN; PAM sequence: CTC
tttgctcattttttatgccc

SEQ ID NO: 287633 - DNA, 20 bp, Artificial Sequence
  Description of Artificial Sequence: Synthetic oligonucleotide
  Target: ATXN1; (+) strand; PAM type: YTN; PAM sequence: CTT
tgctcattttttatgcccaa

SEQ ID NO: 287634 - DNA, 20 bp, Artificial Sequence
  Description of Artificial Sequence: Synthetic oligonucleotide
  Target: ATXN1; (+) strand; PAM type: YTN; PAM sequence: TTT
gctcattttttatgcccaaa

SEQ ID NO: 287635 - DNA, 20 bp, Artificial Sequence
  Description of Artificial Sequence: Synthetic oligonucleotide
  Target: ATXN1; (+) strand; PAM type: YTN; PAM sequence: TTG
ctcattttttatgcccaaaa

SEQ ID NO: 287636 - DNA, 20 bp, Artificial Sequence
  Description of Artificial Sequence: Synthetic oligonucleotide
  Target: ATXN1; (+) strand; PAM type: YTN; PAM sequence: CTC
attttttatgcccaaaatct

SEQ ID NO: 287637 - DNA, 20 bp, Artificial Sequence
  Description of Artificial Sequence: Synthetic oligonucleotide
  Target: ATXN1; (+) strand; PAM type: YTN; PAM sequence: TTT
tttatgcccaaaatctctaa

SEQ ID NO: 287638 - DNA, 20 bp, Artificial Sequence
  Description of Artificial Sequence: Synthetic oligonucleotide
  Target: ATXN1; (+) strand; PAM type: YTN; PAM sequence: TTT
ttatgcccaaaatctctaag

SEQ ID NO: 287639 - DNA, 20 bp, Artificial Sequence
  Description of Artificial Sequence: Synthetic oligonucleotide
  Target: ATXN1; (+) strand; PAM type: YTN; PAM sequence: TTT
tatgcccaaaatctctaaga

SEQ ID NO: 287640 - DNA, 20 bp, Artificial Sequence
  Description of Artificial Sequence: Synthetic oligonucleotide
  Target: ATXN1; (+) strand; PAM type: YTN; PAM sequence: TTT
atgcccaaaatctctaagaa

SEQ ID NO: 287641 - DNA, 20 bp, Artificial Sequence
  Description of Artificial Sequence: Synthetic oligonucleotide
  Target: ATXN1; (+) strand; PAM type: YTN; PAM sequence: TTA
tgcccaaaatctctaagaaa

SEQ ID NO: 287642 - DNA, 20 bp, Artificial Sequence
  Description of Artificial Sequence: Synthetic oligonucleotide
  Target: ATXN1; (+) strand; PAM type: YTN; PAM sequence: CTC
taagaaattgatcacagatc

SEQ ID NO: 287643 - DNA, 20 bp, Artificial Sequence
  Description of Artificial Sequence: Synthetic oligonucleotide
  Target: ATXN1; (+) strand; PAM type: YTN; PAM sequence: CTA
agaaattgatcacagatcct

SEQ ID NO: 287644 - DNA, 20 bp, Artificial Sequence
  Description of Artificial Sequence: Synthetic oligonucleotide
  Target: ATXN1; (+) strand; PAM type: YTN; PAM sequence: TTG
atcacagatcctaatatggt

SEQ ID NO: 287645 - DNA, 20 bp, Artificial Sequence
  Description of Artificial Sequence: Synthetic oligonucleotide
  Target: ATXN1; (+) strand; PAM type: YTN; PAM sequence: CTA
atatggtcaaccacaggtct

SEQ ID NO: 287646 - DNA, 20 bp, Artificial Sequence
  Description of Artificial Sequence: Synthetic oligonucleotide
  Target: ATXN1; (+) strand; PAM type: YTN; PAM sequence: CTG
caggtcacaacatatctttt

SEQ ID NO: 287647 - DNA, 20 bp, Artificial Sequence
  Description of Artificial Sequence: Synthetic oligonucleotide
  Target: ATXN1; (+) strand; PAM type: YTN; PAM sequence: CTT
tttgggcatggtctgaaatg

SEQ ID NO: 287648 - DNA, 20 bp, Artificial Sequence
  Description of Artificial Sequence: Synthetic oligonucleotide
  Target: ATXN1; (+) strand; PAM type: YTN; PAM sequence: TTT
ttgggcatggtctgaaatgc

SEQ ID NO: 287649 - DNA, 20 bp, Artificial Sequence
  Description of Artificial Sequence: Synthetic oligonucleotide
  Target: ATXN1; (+) strand; PAM type: YTN; PAM sequence: TTT
tgggcatggtctgaaatgcc

SEQ ID NO: 287650 - DNA, 20 bp, Artificial Sequence
  Description of Artificial Sequence: Synthetic oligonucleotide
  Target: ATXN1; (+) strand; PAM type: YTN; PAM sequence: TTT
gggcatggtctgaaatgccc

SEQ ID NO: 287651 - DNA, 20 bp, Artificial Sequence
  Description of Artificial Sequence: Synthetic oligonucleotide
  Target: ATXN1; (+) strand; PAM type: YTN; PAM sequence: TTG
ggcatggtctgaaatgccca

SEQ ID NO: 287652 - DNA, 20 bp, Artificial Sequence
  Description of Artificial Sequence: Synthetic oligonucleotide
  Target: ATXN1; (+) strand; PAM type: YTN; PAM sequence: CTG
aaatgcccaaggcatccgag

SEQ ID NO: 287653 - DNA, 20 bp, Artificial Sequence
  Description of Artificial Sequence: Synthetic oligonucleotide
  Target: ATXN1; (+) strand; PAM type: YTN; PAM sequence: CTT
ggtctatagacaaaggcccc

SEQ ID NO: 287654 - DNA, 20 bp, Artificial Sequence
  Description of Artificial Sequence: Synthetic oligonucleotide
  Target: ATXN1; (+) strand; PAM type: YTN; PAM sequence: TTG
gtctatagacaaaggcccct

SEQ ID NO: 287655 - DNA, 20 bp, Artificial Sequence
  Description of Artificial Sequence: Synthetic oligonucleotide
  Target: ATXN1; (+) strand; PAM type: YTN; PAM sequence: CTA
tagacaaaggcccctcaatc

SEQ ID NO: 287656 - DNA, 20 bp, Artificial Sequence
  Description of Artificial Sequence: Synthetic oligonucleotide
  Target: ATXN1; (+) strand; PAM type: YTN; PAM sequence: CTC
aatcggtggtgagacaatag

SEQ ID NO: 287657 - DNA, 20 bp, Artificial Sequence
  Description of Artificial Sequence: Synthetic oligonucleotide
  Target: ATXN1; (+) strand; PAM type: YTN; PAM sequence: TTC
tacagtcttcttatgacatc

SEQ ID NO: 287658 - DNA, 20 bp, Artificial Sequence
  Description of Artificial Sequence: Synthetic oligonucleotide
  Target: ATXN1; (+) strand; PAM type: YTN; PAM sequence: CTA
cagtcttcttatgacatcca

SEQ ID NO: 287659 - DNA, 20 bp, Artificial Sequence
  Description of Artificial Sequence: Synthetic oligonucleotide
  Target: ATXN1; (+) strand; PAM type: YTN; PAM sequence: CTT
cttatgacatccacttccca

SEQ ID NO: 287660 - DNA, 20 bp, Artificial Sequence
  Description of Artificial Sequence: Synthetic oligonucleotide
  Target: ATXN1; (+) strand; PAM type: YTN; PAM sequence: TTC
ttatgacatccacttcccat

SEQ ID NO: 287661 - DNA, 20 bp, Artificial Sequence
  Description of Artificial Sequence: Synthetic oligonucleotide
  Target: ATXN1; (+) strand; PAM type: YTN; PAM sequence: CTT
atgacatccacttcccatat

SEQ ID NO: 287662 - DNA, 20 bp, Artificial Sequence
  Description of Artificial Sequence: Synthetic oligonucleotide
  Target: ATXN1; (+) strand; PAM type: YTN; PAM sequence: TTA
tgacatccacttcccatata

SEQ ID NO: 287663 - DNA, 20 bp, Artificial Sequence
  Description of Artificial Sequence: Synthetic oligonucleotide
  Target: ATXN1; (+) strand; PAM type: YTN; PAM sequence: CTT
cccatatataatcttgttag

SEQ ID NO: 287664 - DNA, 20 bp, Artificial Sequence
  Description of Artificial Sequence: Synthetic oligonucleotide
  Target: ATXN1; (+) strand; PAM type: YTN; PAM sequence: TTC
ccatatataatcttgttagt

SEQ ID NO: 287665 - DNA, 20 bp, Artificial Sequence
  Description of Artificial Sequence: Synthetic oligonucleotide
  Target: ATXN1; (+) strand; PAM type: YTN; PAM sequence: CTT
gttagtaaatgaaacattaa

SEQ ID NO: 287666 - DNA, 20 bp, Artificial Sequence
  Description of Artificial Sequence: Synthetic oligonucleotide
  Target: ATXN1; (+) strand; PAM type: YTN; PAM sequence: TTG
ttagtaaatgaaacattaaa

SEQ ID NO: 287667 - DNA, 20 bp, Artificial Sequence
  Description of Artificial Sequence: Synthetic oligonucleotide
  Target: ATXN1; (+) strand; PAM type: YTN; PAM sequence: TTA
gtaaatgaaacattaaagtc

SEQ ID NO: 287668 - DNA, 20 bp, Artificial Sequence
  Description of Artificial Sequence: Synthetic oligonucleotide
  Target: ATXN1; (+) strand; PAM type: YTN; PAM sequence: TTA
aagtctcatggagaaaaaag

SEQ ID NO: 287669 - DNA, 20 bp, Artificial Sequence
  Description of Artificial Sequence: Synthetic oligonucleotide
  Target: ATXN1; (+) strand; PAM type: YTN; PAM sequence: CTC
atggagaaaaaagtctgcag

SEQ ID NO: 287670 - DNA, 20 bp, Artificial Sequence
  Description of Artificial Sequence: Synthetic oligonucleotide
  Target: ATXN1; (+) strand; PAM type: YTN; PAM sequence: CTG
cagtgtctgttttatgctat

SEQ ID NO: 287671 - DNA, 20 bp, Artificial Sequence
  Description of Artificial Sequence: Synthetic oligonucleotide
  Target: ATXN1; (+) strand; PAM type: YTN; PAM sequence: CTG
ttttatgctataaacagatc

SEQ ID NO: 287672 - DNA, 20 bp, Artificial Sequence
  Description of Artificial Sequence: Synthetic oligonucleotide
  Target: ATXN1; (+) strand; PAM type: YTN; PAM sequence: TTT
tatgctataaacagatctcc

SEQ ID NO: 287673 - DNA, 20 bp, Artificial Sequence
  Description of Artificial Sequence: Synthetic oligonucleotide
  Target: ATXN1; (+) strand; PAM type: YTN; PAM sequence: TTT
atgctataaacagatctcca

SEQ ID NO: 287674 - DNA, 20 bp, Artificial Sequence
  Description of Artificial Sequence: Synthetic oligonucleotide
  Target: ATXN1; (+) strand; PAM type: YTN; PAM sequence: TTA
tgctataaacagatctccag

SEQ ID NO: 287675 - DNA, 20 bp, Artificial Sequence
  Description of Artificial Sequence: Synthetic oligonucleotide
  Target: ATXN1; (+) strand; PAM type: YTN; PAM sequence: CTA
taaacagatctccagctgaa

SEQ ID NO: 287676 - DNA, 20 bp, Artificial Sequence
  Description of Artificial Sequence: Synthetic oligonucleotide
  Target: ATXN1; (+) strand; PAM type: YTN; PAM sequence: CTC
cagctgaaattgctatgtgc

SEQ ID NO: 287677 - DNA, 20 bp, Artificial Sequence
  Description of Artificial Sequence: Synthetic oligonucleotide
  Target: ATXN1; (+) strand; PAM type: YTN; PAM sequence: CTG
aaattgctatgtgctgaatg

SEQ ID NO: 287678 - DNA, 20 bp, Artificial Sequence
  Description of Artificial Sequence: Synthetic oligonucleotide
  Target: ATXN1; (+) strand; PAM type: YTN; PAM sequence: TTG
ctatgtgctgaatgacattg

SEQ ID NO: 287679 - DNA, 20 bp, Artificial Sequence
  Description of Artificial Sequence: Synthetic oligonucleotide
  Target: ATXN1; (+) strand; PAM type: YTN; PAM sequence: CTA
tgtgctgaatgacattggag

SEQ ID NO: 287680 - DNA, 20 bp, Artificial Sequence
  Description of Artificial Sequence: Synthetic oligonucleotide
  Target: ATXN1; (+) strand; PAM type: YTN; PAM sequence: CTG
aatgacattggagtgggagc

SEQ ID NO: 287681 - DNA, 20 bp, Artificial Sequence
  Description of Artificial Sequence: Synthetic oligonucleotide
  Target: ATXN1; (+) strand; PAM type: YTN; PAM sequence: TTG
gagtgggagccactggcttt

SEQ ID NO: 287682 - DNA, 20 bp, Artificial Sequence
  Description of Artificial Sequence: Synthetic oligonucleotide
  Target: ATXN1; (+) strand; PAM type: YTN; PAM sequence: CTG
gctttacctgcaagcctcag

SEQ ID NO: 287683 - DNA, 20 bp, Artificial Sequence
  Description of Artificial Sequence: Synthetic oligonucleotide
  Target: ATXN1; (+) strand; PAM type: YTN; PAM sequence: CTT
tacctgcaagcctcagcttt

SEQ ID NO: 287684 - DNA, 20 bp, Artificial Sequence
  Description of Artificial Sequence: Synthetic oligonucleotide
  Target: ATXN1; (+) strand; PAM type: YTN; PAM sequence: TTT
acctgcaagcctcagcttta

SEQ ID NO: 287685 - DNA, 20 bp, Artificial Sequence
  Description of Artificial Sequence: Synthetic oligonucleotide
  Target: ATXN1; (+) strand; PAM type: YTN; PAM sequence: TTA
cctgcaagcctcagctttag

SEQ ID NO: 287686 - DNA, 20 bp, Artificial Sequence
  Description of Artificial Sequence: Synthetic oligonucleotide
  Target: ATXN1; (+) strand; PAM type: YTN; PAM sequence: CTG
caagcctcagctttagtcca

SEQ ID NO: 287687 - DNA, 20 bp, Artificial Sequence
  Description of Artificial Sequence: Synthetic oligonucleotide
  Target: ATXN1; (+) strand; PAM type: YTN; PAM sequence: CTC
agctttagtccagatctgtt

SEQ ID NO: 287688 - DNA, 20 bp, Artificial Sequence
  Description of Artificial Sequence: Synthetic oligonucleotide
  Target: ATXN1; (+) strand; PAM type: YTN; PAM sequence: CTT
tagtccagatctgttccacg

SEQ ID NO: 287689 - DNA, 20 bp, Artificial Sequence
  Description of Artificial Sequence: Synthetic oligonucleotide
  Target: ATXN1; (+) strand; PAM type: YTN; PAM sequence: TTT
agtccagatctgttccacgc

SEQ ID NO: 287690 - DNA, 20 bp, Artificial Sequence
  Description of Artificial Sequence: Synthetic oligonucleotide
  Target: ATXN1; (+) strand; PAM type: YTN; PAM sequence: TTA
gtccagatctgttccacgca

SEQ ID NO: 287691 - DNA, 20 bp, Artificial Sequence
  Description of Artificial Sequence: Synthetic oligonucleotide
  Target: ATXN1; (+) strand; PAM type: YTN; PAM sequence: CTG
ttccacgcaaccctggcaat

SEQ ID NO: 287692 - DNA, 20 bp, Artificial Sequence
  Description of Artificial Sequence: Synthetic oligonucleotide
  Target: ATXN1; (+) strand; PAM type: YTN; PAM sequence: TTC
cacgcaaccctggcaatatt

SEQ ID NO: 287693 - DNA, 20 bp, Artificial Sequence
  Description of Artificial Sequence: Synthetic oligonucleotide
  Target: ATXN1; (+) strand; PAM type: YTN; PAM sequence: CTG
gcaatattacctctgttcta

SEQ ID NO: 287694 - DNA, 20 bp, Artificial Sequence
  Description of Artificial Sequence: Synthetic oligonucleotide
  Target: ATXN1; (+) strand; PAM type: YTN; PAM sequence: TTA
cctctgttctagaaccatct

SEQ ID NO: 287695 - DNA, 20 bp, Artificial Sequence
  Description of Artificial Sequence: Synthetic oligonucleotide
  Target: ATXN1; (+) strand; PAM type: YTN; PAM sequence: CTC
tgttctagaaccatctgcga

SEQ ID NO: 287696 - DNA, 20 bp, Artificial Sequence
  Description of Artificial Sequence: Synthetic oligonucleotide
  Target: ATXN1; (+) strand; PAM type: YTN; PAM sequence: CTG
ttctagaaccatctgcgact

SEQ ID NO: 287697 - DNA, 20 bp, Artificial Sequence
  Description of Artificial Sequence: Synthetic oligonucleotide
  Target: ATXN1; (+) strand; PAM type: YTN; PAM sequence: TTC
tagaaccatctgcgacttgg

SEQ ID NO: 287698 - DNA, 20 bp, Artificial Sequence
  Description of Artificial Sequence: Synthetic oligonucleotide
  Target: ATXN1; (+) strand; PAM type: YTN; PAM sequence: CTA
gaaccatctgcgacttggat

SEQ ID NO: 287699 - DNA, 20 bp, Artificial Sequence
  Description of Artificial Sequence: Synthetic oligonucleotide
  Target: ATXN1; (+) strand; PAM type: YTN; PAM sequence: CTG
cgacttggatgttctgccaa

SEQ ID NO: 287700 - DNA, 20 bp, Artificial Sequence
  Description of Artificial Sequence: Synthetic oligonucleotide
  Target: ATXN1; (+) strand; PAM type: YTN; PAM sequence: CTT
ggatgttctgccaagcaaac

SEQ ID NO: 287701 - DNA, 20 bp, Artificial Sequence
  Description of Artificial Sequence: Synthetic oligonucleotide
  Target: ATXN1; (+) strand; PAM type: YTN; PAM sequence: TTG
gatgttctgccaagcaaaca

SEQ ID NO: 287702 - DNA, 20 bp, Artificial Sequence
  Description of Artificial Sequence: Synthetic oligonucleotide
  Target: ATXN1; (+) strand; PAM type: YTN; PAM sequence: TTC
tgccaagcaaacaaacctgc

SEQ ID NO: 287703 - DNA, 20 bp, Artificial Sequence
  Description of Artificial Sequence: Synthetic oligonucleotide
  Target: ATXN1; (+) strand; PAM type: YTN; PAM sequence: CTG
ccaagcaaacaaacctgctc

SEQ ID NO: 287704 - DNA, 20 bp, Artificial Sequence
  Description of Artificial Sequence: Synthetic oligonucleotide
  Target: ATXN1; (+) strand; PAM type: YTN; PAM sequence: CTG
ctctacatctgtctgcctat

SEQ ID NO: 287705 - DNA, 20 bp, Artificial Sequence
  Description of Artificial Sequence: Synthetic oligonucleotide
  Target: ATXN1; (+) strand; PAM type: YTN; PAM sequence: CTC
tacatctgtctgcctatcca

SEQ ID NO: 287706 - DNA, 20 bp, Artificial Sequence
  Description of Artificial Sequence: Synthetic oligonucleotide
  Target: ATXN1; (+) strand; PAM type: YTN; PAM sequence: CTA
catctgtctgcctatccagc

SEQ ID NO: 287707 - DNA, 20 bp, Artificial Sequence
  Description of Artificial Sequence: Synthetic oligonucleotide
  Target: ATXN1; (+) strand; PAM type: YTN; PAM sequence: CTG
tctgcctatccagctctctc

SEQ ID NO: 287708 - DNA, 20 bp, Artificial Sequence
  Description of Artificial Sequence: Synthetic oligonucleotide
  Target: ATXN1; (+) strand; PAM type: YTN; PAM sequence: CTG
cctatccagctctctctctt

SEQ ID NO: 287709 - DNA, 20 bp, Artificial Sequence
  Description of Artificial Sequence: Synthetic oligonucleotide
  Target: ATXN1; (+) strand; PAM type: YTN; PAM sequence: CTA
tccagctctctctctttctg

SEQ ID NO: 287710 - DNA, 20 bp, Artificial Sequence
  Description of Artificial Sequence: Synthetic oligonucleotide
  Target: ATXN1; (+) strand; PAM type: YTN; PAM sequence: CTC
tctctctttctgtctctctc

SEQ ID NO: 287711 - DNA, 20 bp, Artificial Sequence
  Description of Artificial Sequence: Synthetic oligonucleotide
  Target: ATXN1; (+) strand; PAM type: YTN; PAM sequence: CTC
tctctttctgtctctctcca

SEQ ID NO: 287712 - DNA, 20 bp, Artificial Sequence
  Description of Artificial Sequence: Synthetic oligonucleotide
  Target: ATXN1; (+) strand; PAM type: YTN; PAM sequence: CTC
tctttctgtctctctccaag

SEQ ID NO: 287713 - DNA, 20 bp, Artificial Sequence
  Description of Artificial Sequence: Synthetic oligonucleotide
  Target: ATXN1; (+) strand; PAM type: YTN; PAM sequence: CTC
tttctgtctctctccaaggt

SEQ ID NO: 287714 - DNA, 20 bp, Artificial Sequence
  Description of Artificial Sequence: Synthetic oligonucleotide
  Target: ATXN1; (+) strand; PAM type: YTN; PAM sequence: CTT
tctgtctctctccaaggtct

SEQ ID NO: 287715 - DNA, 20 bp, Artificial Sequence
  Description of Artificial Sequence: Synthetic oligonucleotide
  Target: ATXN1; (+) strand; PAM type: YTN; PAM sequence: TTT
ctgtctctctccaaggtctc

SEQ ID NO: 287716 - DNA, 20 bp, Artificial Sequence
  Description of Artificial Sequence: Synthetic oligonucleotide
  Target: ATXN1; (+) strand; PAM type: YTN; PAM sequence: TTC
tgtctctctccaaggtctct

SEQ ID NO: 287717 - DNA, 20 bp, Artificial Sequence
  Description of Artificial Sequence: Synthetic oligonucleotide
  Target: ATXN1; (+) strand; PAM type: YTN; PAM sequence: CTG
tctctctccaaggtctctct

SEQ ID NO: 287718 - DNA, 20 bp, Artificial Sequence
  Description of Artificial Sequence: Synthetic oligonucleotide
  Target: ATXN1; (+) strand; PAM type: YTN; PAM sequence: CTC
tctccaaggtctctcttttt

SEQ ID NO: 287719 - DNA, 20 bp, Artificial Sequence
  Description of Artificial Sequence: Synthetic oligonucleotide
  Target: ATXN1; (+) strand; PAM type: YTN; PAM sequence: CTC
tccaaggtctctctttttct

SEQ ID NO: 287720 - DNA, 20 bp, Artificial Sequence
  Description of Artificial Sequence: Synthetic oligonucleotide
  Target: ATXN1; (+) strand; PAM type: YTN; PAM sequence: CTC
caaggtctctctttttctaa

SEQ ID NO: 287721 - DNA, 20 bp, Artificial Sequence
  Description of Artificial Sequence: Synthetic oligonucleotide
  Target: ATXN1; (+) strand; PAM type: YTN; PAM sequence: CTC
tctttttctaagtcaccttt

SEQ ID NO: 287722 - DNA, 20 bp, Artificial Sequence
  Description of Artificial Sequence: Synthetic oligonucleotide
  Target: ATXN1; (+) strand; PAM type: YTN; PAM sequence: CTC
tttttctaagtcacctttgt

SEQ ID NO: 287723 - DNA, 20 bp, Artificial Sequence
  Description of Artificial Sequence: Synthetic oligonucleotide
  Target: ATXN1; (+) strand; PAM type: YTN; PAM sequence: CTT
tttctaagtcacctttgttg

SEQ ID NO: 287724 - DNA, 20 bp, Artificial Sequence
  Description of Artificial Sequence: Synthetic oligonucleotide
  Target: ATXN1; (+) strand; PAM type: YTN; PAM sequence: TTT
ttctaagtcacctttgttga

SEQ ID NO: 287725 - DNA, 20 bp, Artificial Sequence
  Description of Artificial Sequence: Synthetic oligonucleotide
  Target: ATXN1; (+) strand; PAM type: YTN; PAM sequence: TTT
tctaagtcacctttgttgac

SEQ ID NO: 287726 - DNA, 20 bp, Artificial Sequence
  Description of Artificial Sequence: Synthetic oligonucleotide
  Target: ATXN1; (+) strand; PAM type: YTN; PAM sequence: TTT
ctaagtcacctttgttgaca

SEQ ID NO: 287727 - DNA, 20 bp, Artificial Sequence
  Description of Artificial Sequence: Synthetic oligonucleotide
  Target: ATXN1; (+) strand; PAM type: YTN; PAM sequence: TTC
taagtcacctttgttgacaa

SEQ ID NO: 287728 - DNA, 20 bp, Artificial Sequence
  Description of Artificial Sequence: Synthetic oligonucleotide
  Target: ATXN1; (+) strand; PAM type: YTN; PAM sequence: CTA
agtcacctttgttgacaatc

SEQ ID NO: 287729 - DNA, 20 bp, Artificial Sequence
  Description of Artificial Sequence: Synthetic oligonucleotide
  Target: ATXN1; (+) strand; PAM type: YTN; PAM sequence: CTT
tgttgacaatcattgcagct

SEQ ID NO: 287730 - DNA, 20 bp, Artificial Sequence
  Description of Artificial Sequence: Synthetic oligonucleotide
  Target: ATXN1; (+) strand; PAM type: YTN; PAM sequence: TTT
gttgacaatcattgcagctg

SEQ ID NO: 287731 - DNA, 20 bp, Artificial Sequence
  Description of Artificial Sequence: Synthetic oligonucleotide
  Target: ATXN1; (+) strand; PAM type: YTN; PAM sequence: TTG
ttgacaatcattgcagctgg

SEQ ID NO: 287732 - DNA, 20 bp, Artificial Sequence
  Description of Artificial Sequence: Synthetic oligonucleotide
  Target: ATXN1; (+) strand; PAM type: YTN; PAM sequence: TTG
acaatcattgcagctggacc

SEQ ID NO: 287733 - DNA, 20 bp, Artificial Sequence
  Description of Artificial Sequence: Synthetic oligonucleotide
  Target: ATXN1; (+) strand; PAM type: YTN; PAM sequence: TTG
cagctggaccagtgagaagg

SEQ ID NO: 287734 - DNA, 20 bp, Artificial Sequence
  Description of Artificial Sequence: Synthetic oligonucleotide
  Target: ATXN1; (+) strand; PAM type: YTN; PAM sequence: CTG
gaccagtgagaagggataaa

SEQ ID NO: 287735 - DNA, 20 bp, Artificial Sequence
  Description of Artificial Sequence: Synthetic oligonucleotide
  Target: ATXN1; (+) strand; PAM type: YTN; PAM sequence: CTC
ttctgggttcattaagccta

SEQ ID NO: 287736 - DNA, 20 bp, Artificial Sequence
  Description of Artificial Sequence: Synthetic oligonucleotide
  Target: ATXN1; (+) strand; PAM type: YTN; PAM sequence: CTT
ctgggttcattaagcctatg

SEQ ID NO: 287737 - DNA, 20 bp, Artificial Sequence
  Description of Artificial Sequence: Synthetic oligonucleotide
  Target: ATXN1; (+) strand; PAM type: YTN; PAM sequence: TTC
tgggttcattaagcctatga

SEQ ID NO: 287738 - DNA, 20 bp, Artificial Sequence
  Description of Artificial Sequence: Synthetic oligonucleotide
  Target: ATXN1; (+) strand; PAM type: YTN; PAM sequence: CTG
ggttcattaagcctatgacc

SEQ ID NO: 287739 - DNA, 20 bp, Artificial Sequence
  Description of Artificial Sequence: Synthetic oligonucleotide
  Target: ATXN1; (+) strand; PAM type: YTN; PAM sequence: TTC
attaagcctatgacctaccc

SEQ ID NO: 287740 - DNA, 20 bp, Artificial Sequence
  Description of Artificial Sequence: Synthetic oligonucleotide
  Target: ATXN1; (+) strand; PAM type: YTN; PAM sequence: TTA
agcctatgacctaccctctg

SEQ ID NO: 287741 - DNA, 20 bp, Artificial Sequence
  Description of Artificial Sequence: Synthetic oligonucleotide
  Target: ATXN1; (+) strand; PAM type: YTN; PAM sequence: CTA
tgacctaccctctgcccatg

SEQ ID NO: 287742 - DNA, 20 bp, Artificial Sequence
  Description of Artificial Sequence: Synthetic oligonucleotide
  Target: ATXN1; (+) strand; PAM type: YTN; PAM sequence: CTA
ccctctgcccatgcacactt

SEQ ID NO: 287743 - DNA, 20 bp, Artificial Sequence
  Description of Artificial Sequence: Synthetic oligonucleotide
  Target: ATXN1; (+) strand; PAM type: YTN; PAM sequence: CTC
tgcccatgcacacttgattt

SEQ ID NO: 287744 - DNA, 20 bp, Artificial Sequence
  Description of Artificial Sequence: Synthetic oligonucleotide
  Target: ATXN1; (+) strand; PAM type: YTN; PAM sequence: CTG
cccatgcacacttgatttct

SEQ ID NO: 287745 - DNA, 20 bp, Artificial Sequence
  Description of Artificial Sequence: Synthetic oligonucleotide
  Target: ATXN1; (+) strand; PAM type: YTN; PAM sequence: CTT
gatttctatcttcttaattt

SEQ ID NO: 287746 - DNA, 20 bp, Artificial Sequence
  Description of Artificial Sequence: Synthetic oligonucleotide
  Target: ATXN1; (+) strand; PAM type: YTN; PAM sequence: TTG
atttctatcttcttaatttt

SEQ ID NO: 287747 - DNA, 20 bp, Artificial Sequence
  Description of Artificial Sequence: Synthetic oligonucleotide
  Target: ATXN1; (+) strand; PAM type: YTN; PAM sequence: TTT
ctatcttcttaattttgact

SEQ ID NO: 287748 - DNA, 20 bp, Artificial Sequence
  Description of Artificial Sequence: Synthetic oligonucleotide
  Target: ATXN1; (+) strand; PAM type: YTN; PAM sequence: TTC
tatcttcttaattttgacta

SEQ ID NO: 287749 - DNA, 20 bp, Artificial Sequence
  Description of Artificial Sequence: Synthetic oligonucleotide
  Target: ATXN1; (+) strand; PAM type: YTN; PAM sequence: CTA
tcttcttaattttgactaca

SEQ ID NO: 287750 - DNA, 20 bp, Artificial Sequence
  Description of Artificial Sequence: Synthetic oligonucleotide
  Target: ATXN1; (+) strand; PAM type: YTN; PAM sequence: CTT
cttaattttgactacactgt

SEQ ID NO: 287751 - DNA, 20 bp, Artificial Sequence
  Description of Artificial Sequence: Synthetic oligonucleotide
  Target: ATXN1; (+) strand; PAM type: YTN; PAM sequence: TTC
ttaattttgactacactgtg

SEQ ID NO: 287752 - DNA, 20 bp, Artificial Sequence
  Description of Artificial Sequence: Synthetic oligonucleotide
  Target: ATXN1; (+) strand; PAM type: YTN; PAM sequence: CTT
aattttgactacactgtgtt

SEQ ID NO: 287753 - DNA, 20 bp, Artificial Sequence
  Description of Artificial Sequence: Synthetic oligonucleotide
  Target: ATXN1; (+) strand; PAM type: YTN; PAM sequence: TTA
attttgactacactgtgttt

SEQ ID NO: 287754 - DNA, 20 bp, Artificial Sequence
  Description of Artificial Sequence: Synthetic oligonucleotide
  Target: ATXN1; (+) strand; PAM type: YTN; PAM sequence: TTT
tgactacactgtgtttggat

SEQ ID NO: 287755 - DNA, 20 bp, Artificial Sequence
  Description of Artificial Sequence: Synthetic oligonucleotide
  Target: ATXN1; (+) strand; PAM type: YTN; PAM sequence: TTT
gactacactgtgtttggatg

SEQ ID NO: 287756 - DNA, 20 bp, Artificial Sequence
  Description of Artificial Sequence: Synthetic oligonucleotide
  Target: ATXN1; (+) strand; PAM type: YTN; PAM sequence: TTG
actacactgtgtttggatgt

SEQ ID NO: 287757 - DNA, 20 bp, Artificial Sequence
  Description of Artificial Sequence: Synthetic oligonucleotide
  Target: ATXN1; (+) strand; PAM type: YTN; PAM sequence: CTA
cactgtgtttggatgtgggg

SEQ ID NO: 287758 - DNA, 20 bp, Artificial Sequence
  Description of Artificial Sequence: Synthetic oligonucleotide
  Target: ATXN1; (+) strand; PAM type: YTN; PAM sequence: CTG
tgtttggatgtggggagaac

SEQ ID NO: 287759 - DNA, 20 bp, Artificial Sequence
  Description of Artificial Sequence: Synthetic oligonucleotide
  Target: ATXN1; (+) strand; PAM type: YTN; PAM sequence: TTT
ggatgtggggagaactattt

SEQ ID NO: 287760 - DNA, 20 bp, Artificial Sequence
  Description of Artificial Sequence: Synthetic oligonucleotide
  Target: ATXN1; (+) strand; PAM type: YTN; PAM sequence: TTG
gatgtggggagaactatttt

SEQ ID NO: 287761 - DNA, 20 bp, Artificial Sequence
  Description of Artificial Sequence: Synthetic oligonucleotide
  Target: ATXN1; (+) strand; PAM type: YTN; PAM sequence: CTA
ttttttcactcttattcaaa

SEQ ID NO: 287762 - DNA, 20 bp, Artificial Sequence
  Description of Artificial Sequence: Synthetic oligonucleotide
  Target: ATXN1; (+) strand; PAM type: YTN; PAM sequence: TTT
tttcactcttattcaaagac

SEQ ID NO: 287763 - DNA, 20 bp, Artificial Sequence
  Description of Artificial Sequence: Synthetic oligonucleotide
  Target: ATXN1; (+) strand; PAM type: YTN; PAM sequence: TTT
ttcactcttattcaaagacg

SEQ ID NO: 287764 - DNA, 20 bp, Artificial Sequence
  Description of Artificial Sequence: Synthetic oligonucleotide
  Target: ATXN1; (+) strand; PAM type: YTN; PAM sequence: TTT
tcactcttattcaaagacgt

SEQ ID NO: 287765 - DNA, 20 bp, Artificial Sequence
  Description of Artificial Sequence: Synthetic oligonucleotide
  Target: ATXN1; (+) strand; PAM type: YTN; PAM sequence: TTT
cactcttattcaaagacgtg

SEQ ID NO: 287766 - DNA, 20 bp, Artificial Sequence
  Description of Artificial Sequence: Synthetic oligonucleotide
  Target: ATXN1; (+) strand; PAM type: YTN; PAM sequence: TTC
actcttattcaaagacgtgt

SEQ ID NO: 287767 - DNA, 20 bp, Artificial Sequence
  Description of Artificial Sequence: Synthetic oligonucleotide
  Target: ATXN1; (+) strand; PAM type: YTN; PAM sequence: CTC
ttattcaaagacgtgtgaca

SEQ ID NO: 287768 - DNA, 20 bp, Artificial Sequence
  Description of Artificial Sequence: Synthetic oligonucleotide
  Target: ATXN1; (+) strand; PAM type: YTN; PAM sequence: CTT
attcaaagacgtgtgacact

SEQ ID NO: 287769 - DNA, 20 bp, Artificial Sequence
  Description of Artificial Sequence: Synthetic oligonucleotide
  Target: ATXN1; (+) strand; PAM type: YTN; PAM sequence: TTA
ttcaaagacgtgtgacacta

SEQ ID NO: 287770 - DNA, 20 bp, Artificial Sequence
  Description of Artificial Sequence: Synthetic oligonucleotide
  Target: ATXN1; (+) strand; PAM type: YTN; PAM sequence: TTC
aaagacgtgtgacactatta

SEQ ID NO: 287771 - DNA, 20 bp, Artificial Sequence
  Description of Artificial Sequence: Synthetic oligonucleotide
  Target: ATXN1; (+) strand; PAM type: YTN; PAM sequence: CTA
ttattctttgtttccttaaa

SEQ ID NO: 287772 - DNA, 20 bp, Artificial Sequence
  Description of Artificial Sequence: Synthetic oligonucleotide
  Target: ATXN1; (+) strand; PAM type: YTN; PAM sequence: TTA
ttctttgtttccttaaaata

SEQ ID NO: 287773 - DNA, 20 bp, Artificial Sequence
  Description of Artificial Sequence: Synthetic oligonucleotide
  Target: ATXN1; (+) strand; PAM type: YTN; PAM sequence: TTC
tttgtttccttaaaatatgt

SEQ ID NO: 287774 - DNA, 20 bp, Artificial Sequence
  Description of Artificial Sequence: Synthetic oligonucleotide
  Target: ATXN1; (+) strand; PAM type: YTN; PAM sequence: CTT
tgtttccttaaaatatgttg

SEQ ID NO: 287775 - DNA, 20 bp, Artificial Sequence
  Description of Artificial Sequence: Synthetic oligonucleotide
  Target: ATXN1; (+) strand; PAM type: YTN; PAM sequence: TTT
gtttccttaaaatatgttgg

SEQ ID NO: 287776 - DNA, 20 bp, Artificial Sequence
  Description of Artificial Sequence: Synthetic oligonucleotide
  Target: ATXN1; (+) strand; PAM type: YTN; PAM sequence: TTG
tttccttaaaatatgttggc

SEQ ID NO: 287777 - DNA, 20 bp, Artificial Sequence
  Description of Artificial Sequence: Synthetic oligonucleotide
  Target: ATXN1; (+) strand; PAM type: YTN; PAM sequence: TTT
ccttaaaatatgttggcatt

SEQ ID NO: 287778 - DNA, 20 bp, Artificial Sequence
  Description of Artificial Sequence: Synthetic oligonucleotide
  Target: ATXN1; (+) strand; PAM type: YTN; PAM sequence: TTC
cttaaaatatgttggcattc

SEQ ID NO: 287779 - DNA, 20 bp, Artificial Sequence
  Description of Artificial Sequence: Synthetic oligonucleotide
  Target: ATXN1; (+) strand; PAM type: YTN; PAM sequence: CTT
aaaatatgttggcattcttc

SEQ ID NO: 287780 - DNA, 20 bp, Artificial Sequence
  Description of Artificial Sequence: Synthetic oligonucleotide
  Target: ATXN1; (+) strand; PAM type: YTN; PAM sequence: TTA
aaatatgttggcattcttct

SEQ ID NO: 287781 - DNA, 20 bp, Artificial Sequence
  Description of Artificial Sequence: Synthetic oligonucleotide
  Target: ATXN1; (+) strand; PAM type: YTN; PAM sequence: TTG
gcattcttctctccctagta

SEQ ID NO: 287782 - DNA, 20 bp, Artificial Sequence
  Description of Artificial Sequence: Synthetic oligonucleotide
  Target: ATXN1; (+) strand; PAM type: YTN; PAM sequence: TTC
ttctctccctagtaggagag

SEQ ID NO: 287783 - DNA, 20 bp, Artificial Sequence
  Description of Artificial Sequence: Synthetic oligonucleotide
  Target: ATXN1; (+) strand; PAM type: YTN; PAM sequence: CTT
ctctccctagtaggagagcg

SEQ ID NO: 287784 - DNA, 20 bp, Artificial Sequence
  Description of Artificial Sequence: Synthetic oligonucleotide
  Target: ATXN1; (+) strand; PAM type: YTN; PAM sequence: TTC
tctccctagtaggagagcgc

SEQ ID NO: 287785 - DNA, 20 bp, Artificial Sequence
  Description of Artificial Sequence: Synthetic oligonucleotide
  Target: ATXN1; (+) strand; PAM type: YTN; PAM sequence: CTC
tccctagtaggagagcgcct

SEQ ID NO: 287786 - DNA, 20 bp, Artificial Sequence
  Description of Artificial Sequence: Synthetic oligonucleotide
  Target: ATXN1; (+) strand; PAM type: YTN; PAM sequence: CTC
cctagtaggagagcgcctgc

SEQ ID NO: 287787 - DNA, 20 bp, Artificial Sequence
  Description of Artificial Sequence: Synthetic oligonucleotide
  Target: ATXN1; (+) strand; PAM type: YTN; PAM sequence: CTA
gtaggagagcgcctgcaagg

SEQ ID NO: 287788 - DNA, 20 bp, Artificial Sequence
  Description of Artificial Sequence: Synthetic oligonucleotide
  Target: ATXN1; (+) strand; PAM type: YTN; PAM sequence: CTG
caaggatcacaaaagcttct

SEQ ID NO: 287789 - DNA, 20 bp, Artificial Sequence
  Description of Artificial Sequence: Synthetic oligonucleotide
  Target: ATXN1; (+) strand; PAM type: YTN; PAM sequence: CTT
ctggggagaagcaataatct

SEQ ID NO: 287790 - DNA, 20 bp, Artificial Sequence
  Description of Artificial Sequence: Synthetic oligonucleotide
  Target: ATXN1; (+) strand; PAM type: YTN; PAM sequence: TTC
tggggagaagcaataatctg

SEQ ID NO: 287791 - DNA, 20 bp, Artificial Sequence
  Description of Artificial Sequence: Synthetic oligonucleotide
  Target: ATXN1; (+) strand; PAM type: YTN; PAM sequence: CTG
gggagaagcaataatctgct

SEQ ID NO: 287792 - DNA, 20 bp, Artificial Sequence
  Description of Artificial Sequence: Synthetic oligonucleotide
  Target: ATXN1; (+) strand; PAM type: YTN; PAM sequence: CTG
ctgaataaccaggccccagc

SEQ ID NO: 287793 - DNA, 20 bp, Artificial Sequence
  Description of Artificial Sequence: Synthetic oligonucleotide
  Target: ATXN1; (+) strand; PAM type: YTN; PAM sequence: CTG
aataaccaggccccagctgc

SEQ ID NO: 287794 - DNA, 20 bp, Artificial Sequence
  Description of Artificial Sequence: Synthetic oligonucleotide
  Target: ATXN1; (+) strand; PAM type: YTN; PAM sequence: CTG
ccaaatgccactgggaaaag

SEQ ID NO: 287795 - DNA, 20 bp, Artificial Sequence
  Description of Artificial Sequence: Synthetic oligonucleotide
  Target: ATXN1; (+) strand; PAM type: YTN; PAM sequence: CTG
ggaaaagtgcaaagggtgaa

SEQ ID NO: 287796 - DNA, 20 bp, Artificial Sequence
  Description of Artificial Sequence: Synthetic oligonucleotide
  Target: ATXN1; (+) strand; PAM type: YTN; PAM sequence: TTG
ggcaccactctgaatcataa

SEQ ID NO: 287797 - DNA, 20 bp, Artificial Sequence
  Description of Artificial Sequence: Synthetic oligonucleotide
  Target: ATXN1; (+) strand; PAM type: YTN; PAM sequence: CTC
tgaatcataaacattattac

SEQ ID NO: 287798 - DNA, 20 bp, Artificial Sequence
  Description of Artificial Sequence: Synthetic oligonucleotide
  Target: ATXN1; (+) strand; PAM type: YTN; PAM sequence: CTG
aatcataaacattattacag

SEQ ID NO: 287799 - DNA, 20 bp, Artificial Sequence
  Description of Artificial Sequence: Synthetic oligonucleotide
  Target: ATXN1; (+) strand; PAM type: YTN; PAM sequence: TTA
ttacaggcaaagtgactggc

SEQ ID NO: 287800 - DNA, 20 bp, Artificial Sequence
  Description of Artificial Sequence: Synthetic oligonucleotide
  Target: ATXN1; (+) strand; PAM type: YTN; PAM sequence: TTA
caggcaaagtgactggctgc

SEQ ID NO: 287801 - DNA, 20 bp, Artificial Sequence
  Description of Artificial Sequence: Synthetic oligonucleotide
  Target: ATXN1; (+) strand; PAM type: YTN; PAM sequence: CTG
gctgctacttgagagttctt

SEQ ID NO: 287802 - DNA, 20 bp, Artificial Sequence
  Description of Artificial Sequence: Synthetic oligonucleotide
  Target: ATXN1; (+) strand; PAM type: YTN; PAM sequence: CTG
ctacttgagagttcttctgt

SEQ ID NO: 287803 - DNA, 20 bp, Artificial Sequence
  Description of Artificial Sequence: Synthetic oligonucleotide
  Target: ATXN1; (+) strand; PAM type: YTN; PAM sequence: CTA
cttgagagttcttctgtacc

SEQ ID NO: 287804 - DNA, 20 bp, Artificial Sequence
  Description of Artificial Sequence: Synthetic oligonucleotide
  Target: ATXN1; (+) strand; PAM type: YTN; PAM sequence: CTT
gagagttcttctgtacctaa

SEQ ID NO: 287805 - DNA, 20 bp, Artificial Sequence
  Description of Artificial Sequence: Synthetic oligonucleotide
  Target: ATXN1; (+) strand; PAM type: YTN; PAM sequence: TTG
agagttcttctgtacctaat

SEQ ID NO: 287806 - DNA, 20 bp, Artificial Sequence
  Description of Artificial Sequence: Synthetic oligonucleotide
  Target: ATXN1; (+) strand; PAM type: YTN; PAM sequence: TTC
ttctgtacctaattggacca

SEQ ID NO: 287807 - DNA, 20 bp, Artificial Sequence
  Description of Artificial Sequence: Synthetic oligonucleotide
  Target: ATXN1; (+) strand; PAM type: YTN; PAM sequence: CTT
ctgtacctaattggaccatg

SEQ ID NO: 287808 - DNA, 20 bp, Artificial Sequence
  Description of Artificial Sequence: Synthetic oligonucleotide
  Target: ATXN1; (+) strand; PAM type: YTN; PAM sequence: TTC
tgtacctaattggaccatgc

SEQ ID NO: 287809 - DNA, 20 bp, Artificial Sequence
  Description of Artificial Sequence: Synthetic oligonucleotide
  Target: ATXN1; (+) strand; PAM type: YTN; PAM sequence: CTG
tacctaattggaccatgcag

SEQ ID NO: 287810 - DNA, 20 bp, Artificial Sequence
  Description of Artificial Sequence: Synthetic oligonucleotide
  Target: ATXN1; (+) strand; PAM type: YTN; PAM sequence: CTA
attggaccatgcagcgtgat

SEQ ID NO: 287811 - DNA, 20 bp, Artificial Sequence
  Description of Artificial Sequence: Synthetic oligonucleotide
  Target: ATXN1; (+) strand; PAM type: YTN; PAM sequence: TTG
gaccatgcagcgtgatactc

SEQ ID NO: 287812 - DNA, 20 bp, Artificial Sequence
  Description of Artificial Sequence: Synthetic oligonucleotide
  Target: ATXN1; (+) strand; PAM type: YTN; PAM sequence: CTC
ctggggaccattacagggat

SEQ ID NO: 287813 - DNA, 20 bp, Artificial Sequence
  Description of Artificial Sequence: Synthetic oligonucleotide
  Target: ATXN1; (+) strand; PAM type: YTN; PAM sequence: CTG
gggaccattacagggataca

SEQ ID NO: 287814 - DNA, 20 bp, Artificial Sequence
  Description of Artificial Sequence: Synthetic oligonucleotide
  Target: ATXN1; (+) strand; PAM type: YTN; PAM sequence: TTA
cagggatacaggtgtagctt

SEQ ID NO: 287815 - DNA, 20 bp, Artificial Sequence
  Description of Artificial Sequence: Synthetic oligonucleotide
  Target: ATXN1; (+) strand; PAM type: YTN; PAM sequence: CTT
acaatatacaaaagctgtgt

SEQ ID NO: 287816 - DNA, 20 bp, Artificial Sequence
  Description of Artificial Sequence: Synthetic oligonucleotide
  Target: ATXN1; (+) strand; PAM type: YTN; PAM sequence: TTA
caatatacaaaagctgtgtg

SEQ ID NO: 287817 - DNA, 20 bp, Artificial Sequence
  Description of Artificial Sequence: Synthetic oligonucleotide
  Target: ATXN1; (+) strand; PAM type: YTN; PAM sequence: CTG
tgtgtctgacaatctacgtg

SEQ ID NO: 287818 - DNA, 20 bp, Artificial Sequence
  Description of Artificial Sequence: Synthetic oligonucleotide
  Target: ATXN1; (+) strand; PAM type: YTN; PAM sequence: CTG
acaatctacgtgtaagccta

SEQ ID NO: 287819 - DNA, 20 bp, Artificial Sequence
  Description of Artificial Sequence: Synthetic oligonucleotide
  Target: ATXN1; (+) strand; PAM type: YTN; PAM sequence: CTA
cgtgtaagcctaacttttta

SEQ ID NO: 287820 - DNA, 20 bp, Artificial Sequence
  Description of Artificial Sequence: Synthetic oligonucleotide
  Target: ATXN1; (+) strand; PAM type: YTN; PAM sequence: CTA
actttttacattacttggtg

SEQ ID NO: 287821 - DNA, 20 bp, Artificial Sequence
  Description of Artificial Sequence: Synthetic oligonucleotide
  Target: ATXN1; (+) strand; PAM type: YTN; PAM sequence: CTT
tttacattacttggtgtgct

SEQ ID NO: 287822 - DNA, 20 bp, Artificial Sequence
  Description of Artificial Sequence: Synthetic oligonucleotide
  Target: ATXN1; (+) strand; PAM type: YTN; PAM sequence: TTT
ttacattacttggtgtgcta

SEQ ID NO: 287823 - DNA, 20 bp, Artificial Sequence
  Description of Artificial Sequence: Synthetic oligonucleotide
  Target: ATXN1; (+) strand; PAM type: YTN; PAM sequence: TTT
tacattacttggtgtgctaa

SEQ ID NO: 287824 - DNA, 20 bp, Artificial Sequence
  Description of Artificial Sequence: Synthetic oligonucleotide
  Target: ATXN1; (+) strand; PAM type: YTN; PAM sequence: TTT
acattacttggtgtgctaag

SEQ ID NO: 287825 - DNA, 20 bp, Artificial Sequence
  Description of Artificial Sequence: Synthetic oligonucleotide
  Target: ATXN1; (+) strand; PAM type: YTN; PAM sequence: TTA
cattacttggtgtgctaagt

SEQ ID NO: 287826 - DNA, 20 bp, Artificial Sequence
  Description of Artificial Sequence: Synthetic oligonucleotide
  Target: ATXN1; (+) strand; PAM type: YTN; PAM sequence: TTA
cttggtgtgctaagtgtcct

SEQ ID NO: 287827 - DNA, 20 bp, Artificial Sequence
  Description of Artificial Sequence: Synthetic oligonucleotide
  Target: ATXN1; (+) strand; PAM type: YTN; PAM sequence: CTT
ggtgtgctaagtgtcctgag

SEQ ID NO: 287828 - DNA, 20 bp, Artificial Sequence
  Description of Artificial Sequence: Synthetic oligonucleotide
  Target: ATXN1; (+) strand; PAM type: YTN; PAM sequence: TTG
gtgtgctaagtgtcctgagg

SEQ ID NO: 287829 - DNA, 20 bp, Artificial Sequence
  Description of Artificial Sequence: Synthetic oligonucleotide
  Target: ATXN1; (+) strand; PAM type: YTN; PAM sequence: CTA
agtgtcctgagggagttcat

SEQ ID NO: 287830 - DNA, 20 bp, Artificial Sequence
  Description of Artificial Sequence: Synthetic oligonucleotide
  Target: ATXN1; (+) strand; PAM type: YTN; PAM sequence: CTG
agggagttcattatttagag

SEQ ID NO: 287831 - DNA, 20 bp, Artificial Sequence
  Description of Artificial Sequence: Synthetic oligonucleotide
  Target: ATXN1; (+) strand; PAM type: YTN; PAM sequence: TTC
attatttagagaactccata

SEQ ID NO: 287832 - DNA, 20 bp, Artificial Sequence
  Description of Artificial Sequence: Synthetic oligonucleotide
  Target: ATXN1; (+) strand; PAM type: YTN; PAM sequence: TTA
tttagagaactccataaata

SEQ ID NO: 287833 - DNA, 20 bp, Artificial Sequence
  Description of Artificial Sequence: Synthetic oligonucleotide
  Target: ATXN1; (+) strand; PAM type: YTN; PAM sequence: TTT
agagaactccataaatactt

SEQ ID NO: 287834 - DNA, 20 bp, Artificial Sequence
  Description of Artificial Sequence: Synthetic oligonucleotide
  Target: ATXN1; (+) strand; PAM type: YTN; PAM sequence: TTA
gagaactccataaatacttt

SEQ ID NO: 287835 - DNA, 20 bp, Artificial Sequence
  Description of Artificial Sequence: Synthetic oligonucleotide
  Target: ATXN1; (+) strand; PAM type: YTN; PAM sequence: CTC
cataaatacttttgtaaaat

SEQ ID NO: 287836 - DNA, 20 bp, Artificial Sequence
  Description of Artificial Sequence: Synthetic oligonucleotide
  Target: ATXN1; (+) strand; PAM type: YTN; PAM sequence: CTT
ttgtaaaattcacattcctc

SEQ ID NO: 287837 - DNA, 20 bp, Artificial Sequence
  Description of Artificial Sequence: Synthetic oligonucleotide
  Target: ATXN1; (+) strand; PAM type: YTN; PAM sequence: TTT
tgtaaaattcacattcctct

SEQ ID NO: 287838 - DNA, 20 bp, Artificial Sequence
  Description of Artificial Sequence: Synthetic oligonucleotide
  Target: ATXN1; (+) strand; PAM type: YTN; PAM sequence: TTT
gtaaaattcacattcctctc

SEQ ID NO: 287839 - DNA, 20 bp, Artificial Sequence
  Description of Artificial Sequence: Synthetic oligonucleotide
  Target: ATXN1; (+) strand; PAM type: YTN; PAM sequence: TTG
taaaattcacattcctctcc

SEQ ID NO: 287840 - DNA, 20 bp, Artificial Sequence
  Description of Artificial Sequence: Synthetic oligonucleotide
  Target: ATXN1; (+) strand; PAM type: YTN; PAM sequence: TTC
acattcctctccatttgtgt

SEQ ID NO: 287841 - DNA, 20 bp, Artificial Sequence
  Description of Artificial Sequence: Synthetic oligonucleotide
  Target: ATXN1; (+) strand; PAM type: YTN; PAM sequence: TTC
ctctccatttgtgttttgta

SEQ ID NO: 287842 - DNA, 20 bp, Artificial Sequence
  Description of Artificial Sequence: Synthetic oligonucleotide
  Target: ATXN1; (+) strand; PAM type: YTN; PAM sequence: CTC
tccatttgtgttttgtaaat

SEQ ID NO: 287843 - DNA, 20 bp, Artificial Sequence
  Description of Artificial Sequence: Synthetic oligonucleotide
  Target: ATXN1; (+) strand; PAM type: YTN; PAM sequence: CTC
catttgtgttttgtaaattt

SEQ ID NO: 287844 - DNA, 20 bp, Artificial Sequence
  Description of Artificial Sequence: Synthetic oligonucleotide
  Target: ATXN1; (+) strand; PAM type: YTN; PAM sequence: TTT
gtgttttgtaaatttcccct

SEQ ID NO: 287845 - DNA, 20 bp, Artificial Sequence
  Description of Artificial Sequence: Synthetic oligonucleotide
  Target: ATXN1; (+) strand; PAM type: YTN; PAM sequence: TTG
tgttttgtaaatttcccctc

SEQ ID NO: 287846 - DNA, 20 bp, Artificial Sequence
  Description of Artificial Sequence: Synthetic oligonucleotide
  Target: ATXN1; (+) strand; PAM type: YTN; PAM sequence: TTT
tgtaaatttcccctctctgt

SEQ ID NO: 287847 - DNA, 20 bp, Artificial Sequence
  Description of Artificial Sequence: Synthetic oligonucleotide
  Target: ATXN1; (+) strand; PAM type: YTN; PAM sequence: TTT
gtaaatttcccctctctgtc

SEQ ID NO: 287848 - DNA, 20 bp, Artificial Sequence
  Description of Artificial Sequence: Synthetic oligonucleotide
  Target: ATXN1; (+) strand; PAM type: YTN; PAM sequence: TTG
taaatttcccctctctgtct

SEQ ID NO: 287849 - DNA, 20 bp, Artificial Sequence
  Description of Artificial Sequence: Synthetic oligonucleotide
  Target: ATXN1; (+) strand; PAM type: YTN; PAM sequence: TTT
cccctctctgtctttagagc

SEQ ID NO: 287850 - DNA, 20 bp, Artificial Sequence
  Description of Artificial Sequence: Synthetic oligonucleotide
  Target: ATXN1; (+) strand; PAM type: YTN; PAM sequence: TTC
ccctctctgtctttagagca

SEQ ID NO: 287851 - DNA, 20 bp, Artificial Sequence
  Description of Artificial Sequence: Synthetic oligonucleotide
  Target: ATXN1; (+) strand; PAM type: YTN; PAM sequence: CTC
tctgtctttagagcacgtca

SEQ ID NO: 287852 - DNA, 20 bp, Artificial Sequence
  Description of Artificial Sequence: Synthetic oligonucleotide
  Target: ATXN1; (+) strand; PAM type: YTN; PAM sequence: CTC
tgtctttagagcacgtcatc

SEQ ID NO: 287853 - DNA, 20 bp, Artificial Sequence
  Description of Artificial Sequence: Synthetic oligonucleotide
  Target: ATXN1; (+) strand; PAM type: YTN; PAM sequence: CTG
tctttagagcacgtcatcaa

SEQ ID NO: 287854 - DNA, 20 bp, Artificial Sequence
  Description of Artificial Sequence: Synthetic oligonucleotide
  Target: ATXN1; (+) strand; PAM type: YTN; PAM sequence: CTT
tagagcacgtcatcaatctg

SEQ ID NO: 287855 - DNA, 20 bp, Artificial Sequence
  Description of Artificial Sequence: Synthetic oligonucleotide
  Target: ATXN1; (+) strand; PAM type: YTN; PAM sequence: TTT
agagcacgtcatcaatctga

SEQ ID NO: 287856 - DNA, 20 bp, Artificial Sequence
  Description of Artificial Sequence: Synthetic oligonucleotide
  Target: ATXN1; (+) strand; PAM type: YTN; PAM sequence: TTA
gagcacgtcatcaatctgaa

SEQ ID NO: 287857 - DNA, 20 bp, Artificial Sequence
  Description of Artificial Sequence: Synthetic oligonucleotide
  Target: ATXN1; (+) strand; PAM type: YTN; PAM sequence: CTG
aacatccatttcccacaaat

SEQ ID NO: 287858 - DNA, 20 bp, Artificial Sequence
  Description of Artificial Sequence: Synthetic oligonucleotide
  Target: ATXN1; (+) strand; PAM type: YTN; PAM sequence: TTT
cccacaaatataaagatggg

SEQ ID NO: 287859 - DNA, 20 bp, Artificial Sequence
  Description of Artificial Sequence: Synthetic oligonucleotide
  Target: ATXN1; (+) strand; PAM type: YTN; PAM sequence: TTC
ccacaaatataaagatgggg

SEQ ID NO: 287860 - DNA, 20 bp, Artificial Sequence
  Description of Artificial Sequence: Synthetic oligonucleotide
  Target: ATXN1; (+) strand; PAM type: YTN; PAM sequence: CTA
caccagtgctgaaaaaaaag

SEQ ID NO: 287861 - DNA, 20 bp, Artificial Sequence
  Description of Artificial Sequence: Synthetic oligonucleotide
  Target: ATXN1; (+) strand; PAM type: YTN; PAM sequence: CTG
aaaaaaaaggagggcaccca

SEQ ID NO: 287862 - DNA, 20 bp, Artificial Sequence
  Description of Artificial Sequence: Synthetic oligonucleotide
  Target: ATXN1; (+) strand; PAM type: YTN; PAM sequence: TTT
ttaacattaagacattttgt

SEQ ID NO: 287863 - DNA, 20 bp, Artificial Sequence
  Description of Artificial Sequence: Synthetic oligonucleotide
  Target: ATXN1; (+) strand; PAM type: YTN; PAM sequence: TTT
taacattaagacattttgtt

SEQ ID NO: 287864 - DNA, 20 bp, Artificial Sequence
  Description of Artificial Sequence: Synthetic oligonucleotide
  Target: ATXN1; (+) strand; PAM type: YTN; PAM sequence: TTT
aacattaagacattttgtta

SEQ ID NO: 287865 - DNA, 20 bp, Artificial Sequence
  Description of Artificial Sequence: Synthetic oligonucleotide
  Target: ATXN1; (+) strand; PAM type: YTN; PAM sequence: TTA
acattaagacattttgttag

SEQ ID NO: 287866 - DNA, 20 bp, Artificial Sequence
  Description of Artificial Sequence: Synthetic oligonucleotide
  Target: ATXN1; (+) strand; PAM type: YTN; PAM sequence: TTA
agacattttgttagatagac

SEQ ID NO: 287867 - DNA, 20 bp, Artificial Sequence
  Description of Artificial Sequence: Synthetic oligonucleotide
  Target: ATXN1; (+) strand; PAM type: YTN; PAM sequence: TTT
tgttagatagaccagagaaa

SEQ ID NO: 287868 - DNA, 20 bp, Artificial Sequence
  Description of Artificial Sequence: Synthetic oligonucleotide
  Target: ATXN1; (+) strand; PAM type: YTN; PAM sequence: TTT
gttagatagaccagagaaag

SEQ ID NO: 287869 - DNA, 20 bp, Artificial Sequence
  Description of Artificial Sequence: Synthetic oligonucleotide
  Target: ATXN1; (+) strand; PAM type: YTN; PAM sequence: TTG
ttagatagaccagagaaagc

SEQ ID NO: 287870 - DNA, 20 bp, Artificial Sequence
  Description of Artificial Sequence: Synthetic oligonucleotide
  Target: ATXN1; (+) strand; PAM type: YTN; PAM sequence: TTA
gatagaccagagaaagcatc

SEQ ID NO: 287871 - DNA, 20 bp, Artificial Sequence
  Description of Artificial Sequence: Synthetic oligonucleotide
  Target: ATXN1; (+) strand; PAM type: YTN; PAM sequence: CTG
aatcagaaatgtgtgttggg

SEQ ID NO: 287872 - DNA, 20 bp, Artificial Sequence
  Description of Artificial Sequence: Synthetic oligonucleotide
  Target: ATXN1; (+) strand; PAM type: YTN; PAM sequence: TTG
ggattctctttcttgaaaag

SEQ ID NO: 287873 - DNA, 20 bp, Artificial Sequence
  Description of Artificial Sequence: Synthetic oligonucleotide
  Target: ATXN1; (+) strand; PAM type: YTN; PAM sequence: TTC
tctttcttgaaaaggtggca

SEQ ID NO: 287874 - DNA, 20 bp, Artificial Sequence
  Description of Artificial Sequence: Synthetic oligonucleotide
  Target: ATXN1; (+) strand; PAM type: YTN; PAM sequence: CTC
tttcttgaaaaggtggcaca

SEQ ID NO: 287875 - DNA, 20 bp, Artificial Sequence
  Description of Artificial Sequence: Synthetic oligonucleotide
  Target: ATXN1; (+) strand; PAM type: YTN; PAM sequence: CTT
tcttgaaaaggtggcacagc

SEQ ID NO: 287876 - DNA, 20 bp, Artificial Sequence
  Description of Artificial Sequence: Synthetic oligonucleotide
  Target: ATXN1; (+) strand; PAM type: YTN; PAM sequence: TTT
cttgaaaaggtggcacagca

SEQ ID NO: 287877 - DNA, 20 bp, Artificial Sequence
  Description of Artificial Sequence: Synthetic oligonucleotide
  Target: ATXN1; (+) strand; PAM type: YTN; PAM sequence: TTC
ttgaaaaggtggcacagcac

SEQ ID NO: 287878 - DNA, 20 bp, Artificial Sequence
  Description of Artificial Sequence: Synthetic oligonucleotide
  Target: ATXN1; (+) strand; PAM type: YTN; PAM sequence: CTT
gaaaaggtggcacagcactg

SEQ ID NO: 287879 - DNA, 20 bp, Artificial Sequence
  Description of Artificial Sequence: Synthetic oligonucleotide
  Target: ATXN1; (+) strand; PAM type: YTN; PAM sequence: TTG
aaaaggtggcacagcactgt

SEQ ID NO: 287880 - DNA, 20 bp, Artificial Sequence
  Description of Artificial Sequence: Synthetic oligonucleotide
  Target: ATXN1; (+) strand; PAM type: YTN; PAM sequence: CTG
tgagaagaaacaagaagaga

SEQ ID NO: 287881 - DNA, 20 bp, Artificial Sequence
  Description of Artificial Sequence: Synthetic oligonucleotide
  Target: ATXN1; (+) strand; PAM type: YTN; PAM sequence: TTC
tgacagagcactggttagaa

SEQ ID NO: 287882 - DNA, 20 bp, Artificial Sequence
  Description of Artificial Sequence: Synthetic oligonucleotide
  Target: ATXN1; (+) strand; PAM type: YTN; PAM sequence: CTG
acagagcactggttagaaat

SEQ ID NO: 287883 - DNA, 20 bp, Artificial Sequence
  Description of Artificial Sequence: Synthetic oligonucleotide
  Target: ATXN1; (+) strand; PAM type: YTN; PAM sequence: CTG
gttagaaatcttcctaaaat

SEQ ID NO: 287884 - DNA, 20 bp, Artificial Sequence
  Description of Artificial Sequence: Synthetic oligonucleotide
  Target: ATXN1; (+) strand; PAM type: YTN; PAM sequence: TTA
gaaatcttcctaaaatggac

SEQ ID NO: 287885 - DNA, 20 bp, Artificial Sequence
  Description of Artificial Sequence: Synthetic oligonucleotide
  Target: ATXN1; (+) strand; PAM type: YTN; PAM sequence: CTT
cctaaaatggactgaacgct

SEQ ID NO: 287886 - DNA, 20 bp, Artificial Sequence
  Description of Artificial Sequence: Synthetic oligonucleotide
  Target: ATXN1; (+) strand; PAM type: YTN; PAM sequence: TTC
ctaaaatggactgaacgctg

SEQ ID NO: 287887 - DNA, 20 bp, Artificial Sequence
  Description of Artificial Sequence: Synthetic oligonucleotide
  Target: ATXN1; (+) strand; PAM type: YTN; PAM sequence: CTA
aaatggactgaacgctggag

SEQ ID NO: 287888 - DNA, 20 bp, Artificial Sequence
  Description of Artificial Sequence: Synthetic oligonucleotide
  Target: ATXN1; (+) strand; PAM type: YTN; PAM sequence: CTG
aacgctggaggtgagagcag

SEQ ID NO: 287889 - DNA, 20 bp, Artificial Sequence
  Description of Artificial Sequence: Synthetic oligonucleotide
  Target: ATXN1; (+) strand; PAM type: YTN; PAM sequence: CTG
gaggtgagagcaggctagca

SEQ ID NO: 287890 - DNA, 20 bp, Artificial Sequence
  Description of Artificial Sequence: Synthetic oligonucleotide
  Target: ATXN1; (+) strand; PAM type: YTN; PAM sequence: CTA
gcaaaccagatagtgtctgg

SEQ ID NO: 287891 - DNA, 20 bp, Artificial Sequence
  Description of Artificial Sequence: Synthetic oligonucleotide
  Target: ATXN1; (+) strand; PAM type: YTN; PAM sequence: CTG
gtgtccagggcattcacatt

SEQ ID NO: 287892 - DNA, 20 bp, Artificial Sequence
  Description of Artificial Sequence: Synthetic oligonucleotide
  Target: ATXN1; (+) strand; PAM type: YTN; PAM sequence: TTC
acattcggaaggcactaaga

SEQ ID NO: 287893 - DNA, 20 bp, Artificial Sequence
  Description of Artificial Sequence: Synthetic oligonucleotide
  Target: ATXN1; (+) strand; PAM type: YTN; PAM sequence: TTC
ggaaggcactaagaagagaa

SEQ ID NO: 287894 - DNA, 20 bp, Artificial Sequence
  Description of Artificial Sequence: Synthetic oligonucleotide
  Target: ATXN1; (+) strand; PAM type: YTN; PAM sequence: CTA
agaagagaaccaagcataag

SEQ ID NO: 287895 - DNA, 20 bp, Artificial Sequence
  Description of Artificial Sequence: Synthetic oligonucleotide
  Target: ATXN1; (+) strand; PAM type: YTN; PAM sequence: CTC
catgcccatggccatctggt

SEQ ID NO: 287896 - DNA, 20 bp, Artificial Sequence
  Description of Artificial Sequence: Synthetic oligonucleotide
  Target: ATXN1; (+) strand; PAM type: YTN; PAM sequence: CTG
gtgggatgtgagatgtctct

SEQ ID NO: 287897 - DNA, 20 bp, Artificial Sequence
  Description of Artificial Sequence: Synthetic oligonucleotide
  Target: ATXN1; (+) strand; PAM type: YTN; PAM sequence: CTC
tctacatagcaggactctga

SEQ ID NO: 287898 - DNA, 20 bp, Artificial Sequence
  Description of Artificial Sequence: Synthetic oligonucleotide
  Target: ATXN1; (+) strand; PAM type: YTN; PAM sequence: CTC
tacatagcaggactctgatg

SEQ ID NO: 287899 - DNA, 20 bp, Artificial Sequence
  Description of Artificial Sequence: Synthetic oligonucleotide
  Target: ATXN1; (+) strand; PAM type: YTN; PAM sequence: CTA
catagcaggactctgatgcc

SEQ ID NO: 287900 - DNA, 20 bp, Artificial Sequence
  Description of Artificial Sequence: Synthetic oligonucleotide
  Target: ATXN1; (+) strand; PAM type: YTN; PAM sequence: CTC
tgatgccagaaaaatgcatc

SEQ ID NO: 287901 - DNA, 20 bp, Artificial Sequence
  Description of Artificial Sequence: Synthetic oligonucleotide
  Target: ATXN1; (+) strand; PAM type: YTN; PAM sequence: CTG
atgccagaaaaatgcatcct

SEQ ID NO: 287902 - DNA, 20 bp, Artificial Sequence
  Description of Artificial Sequence: Synthetic oligonucleotide
  Target: ATXN1; (+) strand; PAM type: YTN; PAM sequence: CTC
tgctacaaagggggcttgga

SEQ ID NO: 287903 - DNA, 20 bp, Artificial Sequence
  Description of Artificial Sequence: Synthetic oligonucleotide
  Target: ATXN1; (+) strand; PAM type: YTN; PAM sequence: CTG
ctacaaagggggcttggagt

SEQ ID NO: 287904 - DNA, 20 bp, Artificial Sequence
  Description of Artificial Sequence: Synthetic oligonucleotide
  Target: ATXN1; (+) strand; PAM type: YTN; PAM sequence: CTA
caaagggggcttggagtgaa

SEQ ID NO: 287905 - DNA, 20 bp, Artificial Sequence
  Description of Artificial Sequence: Synthetic oligonucleotide
  Target: ATXN1; (+) strand; PAM type: YTN; PAM sequence: CTT
ggagtgaagctagggtcagg

SEQ ID NO: 287906 - DNA, 20 bp, Artificial Sequence
  Description of Artificial Sequence: Synthetic oligonucleotide
  Target: ATXN1; (+) strand; PAM type: YTN; PAM sequence: TTG
gagtgaagctagggtcaggg

SEQ ID NO: 287907 - DNA, 20 bp, Artificial Sequence
  Description of Artificial Sequence: Synthetic oligonucleotide
  Target: ATXN1; (+) strand; PAM type: YTN; PAM sequence: CTA
gggtcagggagaagttcaga

SEQ ID NO: 287908 - DNA, 20 bp, Artificial Sequence
  Description of Artificial Sequence: Synthetic oligonucleotide
  Target: ATXN1; (+) strand; PAM type: YTN; PAM sequence: TTC
agaatgagaaccactgtctc

SEQ ID NO: 287909 - DNA, 20 bp, Artificial Sequence
  Description of Artificial Sequence: Synthetic oligonucleotide
  Target: ATXN1; (+) strand; PAM type: YTN; PAM sequence: CTG
tctcttgcacgatggcttca

SEQ ID NO: 287910 - DNA, 20 bp, Artificial Sequence
  Description of Artificial Sequence: Synthetic oligonucleotide
  Target: ATXN1; (+) strand; PAM type: YTN; PAM sequence: CTC
ttgcacgatggcttcaccca

SEQ ID NO: 287911 - DNA, 20 bp, Artificial Sequence
  Description of Artificial Sequence: Synthetic oligonucleotide
  Target: ATXN1; (+) strand; PAM type: YTN; PAM sequence: CTT
gcacgatggcttcacccatt

SEQ ID NO: 287912 - DNA, 20 bp, Artificial Sequence
  Description of Artificial Sequence: Synthetic oligonucleotide
  Target: ATXN1; (+) strand; PAM type: YTN; PAM sequence: TTG
cacgatggcttcacccattg

SEQ ID NO: 287913 - DNA, 20 bp, Artificial Sequence
  Description of Artificial Sequence: Synthetic oligonucleotide
  Target: ATXN1; (+) strand; PAM type: YTN; PAM sequence: CTT
cacccattgccaagcagcaa

SEQ ID NO: 287914 - DNA, 20 bp, Artificial Sequence
  Description of Artificial Sequence: Synthetic oligonucleotide
  Target: ATXN1; (+) strand; PAM type: YTN; PAM sequence: TTC
acccattgccaagcagcaac

SEQ ID NO: 287915 - DNA, 20 bp, Artificial Sequence
  Description of Artificial Sequence: Synthetic oligonucleotide
  Target: ATXN1; (+) strand; PAM type: YTN; PAM sequence: TTG
ccaagcagcaaccatgcaag

SEQ ID NO: 287916 - DNA, 20 bp, Artificial Sequence
  Description of Artificial Sequence: Synthetic oligonucleotide
  Target: ATXN1; (+) strand; PAM type: YTN; PAM sequence: TTG
ccctgtggctccagctccct

SEQ ID NO: 287917 - DNA, 20 bp, Artificial Sequence
  Description of Artificial Sequence: Synthetic oligonucleotide
  Target: ATXN1; (+) strand; PAM type: YTN; PAM sequence: CTG
tggctccagctccctacaaa

SEQ ID NO: 287918 - DNA, 20 bp, Artificial Sequence
  Description of Artificial Sequence: Synthetic oligonucleotide
  Target: ATXN1; (+) strand; PAM type: YTN; PAM sequence: CTC
cagctccctacaaatttgtg

SEQ ID NO: 287919 - DNA, 20 bp, Artificial Sequence
  Description of Artificial Sequence: Synthetic oligonucleotide
  Target: ATXN1; (+) strand; PAM type: YTN; PAM sequence: CTC
cctacaaatttgtgcagctg

SEQ ID NO: 287920 - DNA, 20 bp, Artificial Sequence
  Description of Artificial Sequence: Synthetic oligonucleotide
  Target: ATXN1; (+) strand; PAM type: YTN; PAM sequence: CTA
caaatttgtgcagctgctga

SEQ ID NO: 287921 - DNA, 20 bp, Artificial Sequence
  Description of Artificial Sequence: Synthetic oligonucleotide
  Target: ATXN1; (+) strand; PAM type: YTN; PAM sequence: TTT
gtgcagctgctgaaaaacac

SEQ ID NO: 287922 - DNA, 20 bp, Artificial Sequence
  Description of Artificial Sequence: Synthetic oligonucleotide
  Target: ATXN1; (+) strand; PAM type: YTN; PAM sequence: TTG
tgcagctgctgaaaaacaca

SEQ ID NO: 287923 - DNA, 20 bp, Artificial Sequence
  Description of Artificial Sequence: Synthetic oligonucleotide
  Target: ATXN1; (+) strand; PAM type: YTN; PAM sequence: CTG
ctgaaaaacacacctggtct

SEQ ID NO: 287924 - DNA, 20 bp, Artificial Sequence
  Description of Artificial Sequence: Synthetic oligonucleotide
  Target: ATXN1; (+) strand; PAM type: YTN; PAM sequence: CTG
aaaaacacacctggtctagt

SEQ ID NO: 287925 - DNA, 20 bp, Artificial Sequence
  Description of Artificial Sequence: Synthetic oligonucleotide
  Target: ATXN1; (+) strand; PAM type: YTN; PAM sequence: CTG
gtctagtacatttttaagaa

SEQ ID NO: 287926 - DNA, 20 bp, Artificial Sequence
  Description of Artificial Sequence: Synthetic oligonucleotide
  Target: ATXN1; (+) strand; PAM type: YTN; PAM sequence: CTA
gtacatttttaagaacaaag

SEQ ID NO: 287927 - DNA, 20 bp, Artificial Sequence
  Description of Artificial Sequence: Synthetic oligonucleotide
  Target: ATXN1; (+) strand; PAM type: YTN; PAM sequence: TTT
ttaagaacaaagccttcagc

SEQ ID NO: 287928 - DNA, 20 bp, Artificial Sequence
  Description of Artificial Sequence: Synthetic oligonucleotide
  Target: ATXN1; (+) strand; PAM type: YTN; PAM sequence: TTT
taagaacaaagccttcagct

SEQ ID NO: 287929 - DNA, 20 bp, Artificial Sequence
  Description of Artificial Sequence: Synthetic oligonucleotide
  Target: ATXN1; (+) strand; PAM type: YTN; PAM sequence: TTT
aagaacaaagccttcagctt

SEQ ID NO: 287930 - DNA, 20 bp, Artificial Sequence
  Description of Artificial Sequence: Synthetic oligonucleotide
  Target: ATXN1; (+) strand; PAM type: YTN; PAM sequence: TTA
agaacaaagccttcagctta

SEQ ID NO: 287931 - DNA, 20 bp, Artificial Sequence
  Description of Artificial Sequence: Synthetic oligonucleotide
  Target: ATXN1; (+) strand; PAM type: YTN; PAM sequence: CTT
cagcttaagaccgaggaaag

SEQ ID NO: 287932 - DNA, 20 bp, Artificial Sequence
  Description of Artificial Sequence: Synthetic oligonucleotide
  Target: ATXN1; (+) strand; PAM type: YTN; PAM sequence: TTC
agcttaagaccgaggaaagg

SEQ ID NO: 287933 - DNA, 20 bp, Artificial Sequence
  Description of Artificial Sequence: Synthetic oligonucleotide
  Target: ATXN1; (+) strand; PAM type: YTN; PAM sequence: CTT
aagaccgaggaaaggagtcc

SEQ ID NO: 287934 - DNA, 20 bp, Artificial Sequence
  Description of Artificial Sequence: Synthetic oligonucleotide
  Target: ATXN1; (+) strand; PAM type: YTN; PAM sequence: TTA
agaccgaggaaaggagtcca

SEQ ID NO: 287935 - DNA, 20 bp, Artificial Sequence
  Description of Artificial Sequence: Synthetic oligonucleotide
  Target: ATXN1; (+) strand; PAM type: YTN; PAM sequence: CTT
tccctaatggtacagagatt

SEQ ID NO: 287936 - DNA, 20 bp, Artificial Sequence
  Description of Artificial Sequence: Synthetic oligonucleotide
  Target: ATXN1; (+) strand; PAM type: YTN; PAM sequence: TTT
ccctaatggtacagagatta

SEQ ID NO: 287937 - DNA, 20 bp, Artificial Sequence
  Description of Artificial Sequence: Synthetic oligonucleotide
  Target: ATXN1; (+) strand; PAM type: YTN; PAM sequence: TTC
cctaatggtacagagattat

SEQ ID NO: 287938 - DNA, 20 bp, Artificial Sequence
  Description of Artificial Sequence: Synthetic oligonucleotide
  Target: ATXN1; (+) strand; PAM type: YTN; PAM sequence: CTA
atggtacagagattatttga

SEQ ID NO: 287939 - DNA, 20 bp, Artificial Sequence
  Description of Artificial Sequence: Synthetic oligonucleotide
  Target: ATXN1; (+) strand; PAM type: YTN; PAM sequence: TTA
tttgagaacaatttccaggg

SEQ ID NO: 287940 - DNA, 20 bp, Artificial Sequence
  Description of Artificial Sequence: Synthetic oligonucleotide
  Target: ATXN1; (+) strand; PAM type: YTN; PAM sequence: TTT
gagaacaatttccagggcgg

SEQ ID NO: 287941 - DNA, 20 bp, Artificial Sequence
  Description of Artificial Sequence: Synthetic oligonucleotide
  Target: ATXN1; (+) strand; PAM type: YTN; PAM sequence: TTG
agaacaatttccagggcggg

SEQ ID NO: 287942 - DNA, 20 bp, Artificial Sequence
  Description of Artificial Sequence: Synthetic oligonucleotide
  Target: ATXN1; (+) strand; PAM type: YTN; PAM sequence: TTT
ccagggcgggctagccctcc

SEQ ID NO: 287943 - DNA, 20 bp, Artificial Sequence
  Description of Artificial Sequence: Synthetic oligonucleotide
  Target: ATXN1; (+) strand; PAM type: YTN; PAM sequence: TTC
cagggcgggctagccctccc

SEQ ID NO: 287944 - DNA, 20 bp, Artificial Sequence
  Description of Artificial Sequence: Synthetic oligonucleotide
  Target: ATXN1; (+) strand; PAM type: YTN; PAM sequence: CTA
gccctcccatcattcaatga

SEQ ID NO: 287945 - DNA, 20 bp, Artificial Sequence
  Description of Artificial Sequence: Synthetic oligonucleotide
  Target: ATXN1; (+) strand; PAM type: YTN; PAM sequence: CTC
ccatcattcaatgatgagca

SEQ ID NO: 287946 - DNA, 20 bp, Artificial Sequence
  Description of Artificial Sequence: Synthetic oligonucleotide
  Target: ATXN1; (+) strand; PAM type: YTN; PAM sequence: TTC
aatgatgagcagacccaaaa

SEQ ID NO: 287947 - DNA, 20 bp, Artificial Sequence
  Description of Artificial Sequence: Synthetic oligonucleotide
  Target: ATXN1; (+) strand; PAM type: YTN; PAM sequence: CTG
gcaacattgggcttataagg

SEQ ID NO: 287948 - DNA, 20 bp, Artificial Sequence
  Description of Artificial Sequence: Synthetic oligonucleotide
  Target: ATXN1; (+) strand; PAM type: YTN; PAM sequence: TTG
ggcttataaggacttggtta

SEQ ID NO: 287949 - DNA, 20 bp, Artificial Sequence
  Description of Artificial Sequence: Synthetic oligonucleotide
  Target: ATXN1; (+) strand; PAM type: YTN; PAM sequence: CTT
ataaggacttggttaacaaa

SEQ ID NO: 287950 - DNA, 20 bp, Artificial Sequence
  Description of Artificial Sequence: Synthetic oligonucleotide
  Target: ATXN1; (+) strand; PAM type: YTN; PAM sequence: TTA
taaggacttggttaacaaaa

SEQ ID NO: 287951 - DNA, 20 bp, Artificial Sequence
  Description of Artificial Sequence: Synthetic oligonucleotide
  Target: ATXN1; (+) strand; PAM type: YTN; PAM sequence: CTT
ggttaacaaaacaagaaaca

SEQ ID NO: 287952 - DNA, 20 bp, Artificial Sequence
  Description of Artificial Sequence: Synthetic oligonucleotide
  Target: ATXN1; (+) strand; PAM type: YTN; PAM sequence: TTG
gttaacaaaacaagaaacat

SEQ ID NO: 287953 - DNA, 20 bp, Artificial Sequence
  Description of Artificial Sequence: Synthetic oligonucleotide
  Target: ATXN1; (+) strand; PAM type: YTN; PAM sequence: TTA
acaaaacaagaaacatccaa

SEQ ID NO: 287954 - DNA, 20 bp, Artificial Sequence
  Description of Artificial Sequence: Synthetic oligonucleotide
  Target: ATXN1; (+) strand; PAM type: YTN; PAM sequence: TTT
caaaaaatatttactactgg

SEQ ID NO: 287955 - DNA, 20 bp, Artificial Sequence
  Description of Artificial Sequence: Synthetic oligonucleotide
  Target: ATXN1; (+) strand; PAM type: YTN; PAM sequence: TTC
aaaaaatatttactactgga

SEQ ID NO: 287956 - DNA, 20 bp, Artificial Sequence
  Description of Artificial Sequence: Synthetic oligonucleotide
  Target: ATXN1; (+) strand; PAM type: YTN; PAM sequence: TTT
actactggaaatagaaacaa

SEQ ID NO: 287957 - DNA, 20 bp, Artificial Sequence
  Description of Artificial Sequence: Synthetic oligonucleotide
  Target: ATXN1; (+) strand; PAM type: YTN; PAM sequence: TTA
ctactggaaatagaaacaag

SEQ ID NO: 287958 - DNA, 20 bp, Artificial Sequence
  Description of Artificial Sequence: Synthetic oligonucleotide
  Target: ATXN1; (+) strand; PAM type: YTN; PAM sequence: CTA
ctggaaatagaaacaagttt

SEQ ID NO: 287959 - DNA, 20 bp, Artificial Sequence
  Description of Artificial Sequence: Synthetic oligonucleotide
  Target: ATXN1; (+) strand; PAM type: YTN; PAM sequence: CTG
gaaatagaaacaagtttcag

SEQ ID NO: 287960 - DNA, 20 bp, Artificial Sequence
  Description of Artificial Sequence: Synthetic oligonucleotide
  Target: ATXN1; (+) strand; PAM type: YTN; PAM sequence: TTT
cagacaagatgtgatttgca

SEQ ID NO: 287961 - DNA, 20 bp, Artificial Sequence
  Description of Artificial Sequence: Synthetic oligonucleotide
  Target: ATXN1; (+) strand; PAM type: YTN; PAM sequence: TTC
agacaagatgtgatttgcac

SEQ ID NO: 287962 - DNA, 20 bp, Artificial Sequence
  Description of Artificial Sequence: Synthetic oligonucleotide
  Target: ATXN1; (+) strand; PAM type: YTN; PAM sequence: TTT
gcacctttgaagaaggagga

SEQ ID NO: 287963 - DNA, 20 bp, Artificial Sequence
  Description of Artificial Sequence: Synthetic oligonucleotide
  Target: ATXN1; (+) strand; PAM type: YTN; PAM sequence: TTG
cacctttgaagaaggaggag

SEQ ID NO: 287964 - DNA, 20 bp, Artificial Sequence
  Description of Artificial Sequence: Synthetic oligonucleotide
  Target: ATXN1; (+) strand; PAM type: YTN; PAM sequence: CTT
tgaagaaggaggaggaaaaa

SEQ ID NO: 287965 - DNA, 20 bp, Artificial Sequence
  Description of Artificial Sequence: Synthetic oligonucleotide
  Target: ATXN1; (+) strand; PAM type: YTN; PAM sequence: TTT
gaagaaggaggaggaaaaag

SEQ ID NO: 287966 - DNA, 20 bp, Artificial Sequence
  Description of Artificial Sequence: Synthetic oligonucleotide
  Target: ATXN1; (+) strand; PAM type: YTN; PAM sequence: TTG
aagaaggaggaggaaaaaga

SEQ ID NO: 287967 - DNA, 20 bp, Artificial Sequence
  Description of Artificial Sequence: Synthetic oligonucleotide
  Target: ATXN1; (+) strand; PAM type: YTN; PAM sequence: CTT
aggcgtgaatgacaagtaaa

SEQ ID NO: 287968 - DNA, 20 bp, Artificial Sequence
  Description of Artificial Sequence: Synthetic oligonucleotide
  Target: ATXN1; (+) strand; PAM type: YTN; PAM sequence: TTA
ggcgtgaatgacaagtaaat

SEQ ID NO: 287969 - DNA, 20 bp, Artificial Sequence
  Description of Artificial Sequence: Synthetic oligonucleotide
  Target: ATXN1; (+) strand; PAM type: YTN; PAM sequence: CTT
acaaaaaaaaattaggattt

SEQ ID NO: 287970 - DNA, 20 bp, Artificial Sequence
  Description of Artificial Sequence: Synthetic oligonucleotide
  Target: ATXN1; (+) strand; PAM type: YTN; PAM sequence: TTA
caaaaaaaaattaggatttt

SEQ ID NO: 287971 - DNA, 20 bp, Artificial Sequence
  Description of Artificial Sequence: Synthetic oligonucleotide
  Target: ATXN1; (+) strand; PAM type: YTN; PAM sequence: TTA
ggattttttttcaatgactg

SEQ ID NO: 287972 - DNA, 20 bp, Artificial Sequence
  Description of Artificial Sequence: Synthetic oligonucleotide
  Target: ATXN1; (+) strand; PAM type: YTN; PAM sequence: TTT
tttttcaatgactgattttc

SEQ ID NO: 287973 - DNA, 20 bp, Artificial Sequence
  Description of Artificial Sequence: Synthetic oligonucleotide
  Target: ATXN1; (+) strand; PAM type: YTN; PAM sequence: TTT
ttttcaatgactgattttcc

SEQ ID NO: 287974 - DNA, 20 bp, Artificial Sequence
  Description of Artificial Sequence: Synthetic oligonucleotide
  Target: ATXN1; (+) strand; PAM type: YTN; PAM sequence: TTT
tttcaatgactgattttcca

SEQ ID NO: 287975 - DNA, 20 bp, Artificial Sequence
  Description of Artificial Sequence: Synthetic oligonucleotide
  Target: ATXN1; (+) strand; PAM type: YTN; PAM sequence: TTT
ttcaatgactgattttccaa

SEQ ID NO: 287976 - DNA, 20 bp, Artificial Sequence
  Description of Artificial Sequence: Synthetic oligonucleotide
  Target: ATXN1; (+) strand; PAM type: YTN; PAM sequence: TTT
tcaatgactgattttccaaa

SEQ ID NO: 287977 - DNA, 20 bp, Artificial Sequence
  Description of Artificial Sequence: Synthetic oligonucleotide
  Target: ATXN1; (+) strand; PAM type: YTN; PAM sequence: TTT
caatgactgattttccaaag

SEQ ID NO: 287978 - DNA, 20 bp, Artificial Sequence
  Description of Artificial Sequence: Synthetic oligonucleotide
  Target: ATXN1; (+) strand; PAM type: YTN; PAM sequence: TTC
aatgactgattttccaaagt

SEQ ID NO: 287979 - DNA, 20 bp, Artificial Sequence
  Description of Artificial Sequence: Synthetic oligonucleotide
  Target: ATXN1; (+) strand; PAM type: YTN; PAM sequence: CTG
attttccaaagtattattta

SEQ ID NO: 287980 - DNA, 20 bp, Artificial Sequence
  Description of Artificial Sequence: Synthetic oligonucleotide
  Target: ATXN1; (+) strand; PAM type: YTN; PAM sequence: TTT
tccaaagtattatttaaaac

SEQ ID NO: 287981 - DNA, 20 bp, Artificial Sequence
  Description of Artificial Sequence: Synthetic oligonucleotide
  Target: ATXN1; (+) strand; PAM type: YTN; PAM sequence: TTT
ccaaagtattatttaaaact

SEQ ID NO: 287982 - DNA, 20 bp, Artificial Sequence
  Description of Artificial Sequence: Synthetic oligonucleotide
  Target: ATXN1; (+) strand; PAM type: YTN; PAM sequence: TTC
caaagtattatttaaaacta

SEQ ID NO: 287983 - DNA, 20 bp, Artificial Sequence
  Description of Artificial Sequence: Synthetic oligonucleotide
  Target: ATXN1; (+) strand; PAM type: YTN; PAM sequence: TTA
tttaaaactacattcgatgc

SEQ ID NO: 287984 - DNA, 20 bp, Artificial Sequence
  Description of Artificial Sequence: Synthetic oligonucleotide
  Target: ATXN1; (+) strand; PAM type: YTN; PAM sequence: TTT
aaaactacattcgatgcaat

SEQ ID NO: 287985 - DNA, 20 bp, Artificial Sequence
  Description of Artificial Sequence: Synthetic oligonucleotide
  Target: ATXN1; (+) strand; PAM type: YTN; PAM sequence: TTA
aaactacattcgatgcaatg

SEQ ID NO: 287986 - DNA, 20 bp, Artificial Sequence
  Description of Artificial Sequence: Synthetic oligonucleotide
  Target: ATXN1; (+) strand; PAM type: YTN; PAM sequence: CTA
cattcgatgcaatgaaaagg

SEQ ID NO: 287987 - DNA, 20 bp, Artificial Sequence
  Description of Artificial Sequence: Synthetic oligonucleotide
  Target: ATXN1; (+) strand; PAM type: YTN; PAM sequence: TTC
gatgcaatgaaaaggaaaaa

SEQ ID NO: 287988 - DNA, 20 bp, Artificial Sequence
  Description of Artificial Sequence: Synthetic oligonucleotide
  Target: ATXN1; (+) strand; PAM type: YTN; PAM sequence: CTT
tggagcatcaaaccagcaag

SEQ ID NO: 287989 - DNA, 20 bp, Artificial Sequence
  Description of Artificial Sequence: Synthetic oligonucleotide
  Target: ATXN1; (+) strand; PAM type: YTN; PAM sequence: TTT
ggagcatcaaaccagcaagt

SEQ ID NO: 287990 - DNA, 20 bp, Artificial Sequence
  Description of Artificial Sequence: Synthetic oligonucleotide
  Target: ATXN1; (+) strand; PAM type: YTN; PAM sequence: TTG
gagcatcaaaccagcaagtg

SEQ ID NO: 287991 - DNA, 20 bp, Artificial Sequence
  Description of Artificial Sequence: Synthetic oligonucleotide
  Target: ATXN1; (+) strand; PAM type: YTN; PAM sequence: CTG
aaaaagtctcccaaaaggca

SEQ ID NO: 287992 - DNA, 20 bp, Artificial Sequence
  Description of Artificial Sequence: Synthetic oligonucleotide
  Target: ATXN1; (+) strand; PAM type: YTN; PAM sequence: CTC
ccaaaaggcactggaaaaaa

SEQ ID NO: 287993 - DNA, 20 bp, Artificial Sequence
  Description of Artificial Sequence: Synthetic oligonucleotide
  Target: ATXN1; (+) strand; PAM type: YTN; PAM sequence: CTG
gaaaaaagatgaaaagtata

SEQ ID NO: 287994 - DNA, 20 bp, Artificial Sequence
  Description of Artificial Sequence: Synthetic oligonucleotide
  Target: ATXN1; (+) strand; PAM type: YTN; PAM sequence: CTA
atggatacaggagacaaagt

SEQ ID NO: 287995 - DNA, 20 bp, Artificial Sequence
  Description of Artificial Sequence: Synthetic oligonucleotide
  Target: ATXN1; (+) strand; PAM type: YTN; PAM sequence: TTG
atgcatagtcaaagtaaata

SEQ ID NO: 287996 - DNA, 20 bp, Artificial Sequence
  Description of Artificial Sequence: Synthetic oligonucleotide
  Target: ATXN1; (+) strand; PAM type: YTN; PAM sequence: TTA
ttaaagaaataatgaaagaa

SEQ ID NO: 287997 - DNA, 20 bp, Artificial Sequence
  Description of Artificial Sequence: Synthetic oligonucleotide
  Target: ATXN1; (+) strand; PAM type: YTN; PAM sequence: TTA
aagaaataatgaaagaaaat

SEQ ID NO: 287998 - DNA, 20 bp, Artificial Sequence
  Description of Artificial Sequence: Synthetic oligonucleotide
  Target: ATXN1; (+) strand; PAM type: YTN; PAM sequence: TTT
ttctaaactgaagaaataca

SEQ ID NO: 287999 - DNA, 20 bp, Artificial Sequence
  Description of Artificial Sequence: Synthetic oligonucleotide
  Target: ATXN1; (+) strand; PAM type: YTN; PAM sequence: TTT
tctaaactgaagaaatacag

SEQ ID NO: 288000 - DNA, 20 bp, Artificial Sequence
  Description of Artificial Sequence: Synthetic oligonucleotide
  Target: ATXN1; (+) strand; PAM type: YTN; PAM sequence: TTT
ctaaactgaagaaatacaga

SEQ ID NO: 288001 - DNA, 20 bp, Artificial Sequence
  Description of Artificial Sequence: Synthetic oligonucleotide
  Target: ATXN1; (+) strand; PAM type: YTN; PAM sequence: TTC
taaactgaagaaatacagag

SEQ ID NO: 288002 - DNA, 20 bp, Artificial Sequence
  Description of Artificial Sequence: Synthetic oligonucleotide
  Target: ATXN1; (+) strand; PAM type: YTN; PAM sequence: CTA
aactgaagaaatacagagta

SEQ ID NO: 288003 - DNA, 20 bp, Artificial Sequence
  Description of Artificial Sequence: Synthetic oligonucleotide
  Target: ATXN1; (+) strand; PAM type: YTN; PAM sequence: CTG
aagaaatacagagtaaacca

SEQ ID NO: 288004 - DNA, 20 bp, Artificial Sequence
  Description of Artificial Sequence: Synthetic oligonucleotide
  Target: ATXN1; (+) strand; PAM type: YTN; PAM sequence: CTC
actctatacaagaagaaaaa

SEQ ID NO: 288005 - DNA, 20 bp, Artificial Sequence
  Description of Artificial Sequence: Synthetic oligonucleotide
  Target: ATXN1; (+) strand; PAM type: YTN; PAM sequence: CTC
tatacaagaagaaaaaaatg

SEQ ID NO: 288006 - DNA, 20 bp, Artificial Sequence
  Description of Artificial Sequence: Synthetic oligonucleotide
  Target: ATXN1; (+) strand; PAM type: YTN; PAM sequence: CTA
tacaagaagaaaaaaatgaa

SEQ ID NO: 288007 - DNA, 20 bp, Artificial Sequence
  Description of Artificial Sequence: Synthetic oligonucleotide
  Target: ATXN1; (+) strand; PAM type: YTN; PAM sequence: CTG
atataaatattaatataaat

SEQ ID NO: 288008 - DNA, 20 bp, Artificial Sequence
  Description of Artificial Sequence: Synthetic oligonucleotide
  Target: ATXN1; (+) strand; PAM type: YTN; PAM sequence: TTA
atataaattaataaattaaa

SEQ ID NO: 288009 - DNA, 20 bp, Artificial Sequence
  Description of Artificial Sequence: Synthetic oligonucleotide
  Target: ATXN1; (+) strand; PAM type: YTN; PAM sequence: TTA
ataaattaaagaaaacttcc

SEQ ID NO: 288010 - DNA, 20 bp, Artificial Sequence
  Description of Artificial Sequence: Synthetic oligonucleotide
  Target: ATXN1; (+) strand; PAM type: YTN; PAM sequence: TTA
aagaaaacttccatctattt

SEQ ID NO: 288011 - DNA, 20 bp, Artificial Sequence
  Description of Artificial Sequence: Synthetic oligonucleotide
  Target: ATXN1; (+) strand; PAM type: YTN; PAM sequence: CTT
ccatctatttatttaccttc

SEQ ID NO: 288012 - DNA, 20 bp, Artificial Sequence
  Description of Artificial Sequence: Synthetic oligonucleotide
  Target: ATXN1; (+) strand; PAM type: YTN; PAM sequence: TTC
catctatttatttaccttct

SEQ ID NO: 288013 - DNA, 20 bp, Artificial Sequence
  Description of Artificial Sequence: Synthetic oligonucleotide
  Target: ATXN1; (+) strand; PAM type: YTN; PAM sequence: CTA
tttatttaccttctggtgca

SEQ ID NO: 288014 - DNA, 20 bp, Artificial Sequence
  Description of Artificial Sequence: Synthetic oligonucleotide
  Target: ATXN1; (+) strand; PAM type: YTN; PAM sequence: TTT
atttaccttctggtgcaact

SEQ ID NO: 288015 - DNA, 20 bp, Artificial Sequence
  Description of Artificial Sequence: Synthetic oligonucleotide
  Target: ATXN1; (+) strand; PAM type: YTN; PAM sequence: TTA
tttaccttctggtgcaactt

SEQ ID NO: 288016 - DNA, 20 bp, Artificial Sequence
  Description of Artificial Sequence: Synthetic oligonucleotide
  Target: ATXN1; (+) strand; PAM type: YTN; PAM sequence: TTT
accttctggtgcaacttttg

SEQ ID NO: 288017 - DNA, 20 bp, Artificial Sequence
  Description of Artificial Sequence: Synthetic oligonucleotide
  Target: ATXN1; (+) strand; PAM type: YTN; PAM sequence: TTA
ccttctggtgcaacttttga

SEQ ID NO: 288018 - DNA, 20 bp, Artificial Sequence
  Description of Artificial Sequence: Synthetic oligonucleotide
  Target: ATXN1; (+) strand; PAM type: YTN; PAM sequence: CTT
ctggtgcaacttttgaggtc

SEQ ID NO: 288019 - DNA, 20 bp, Artificial Sequence
  Description of Artificial Sequence: Synthetic oligonucleotide
  Target: ATXN1; (+) strand; PAM type: YTN; PAM sequence: TTC
tggtgcaacttttgaggtca

SEQ ID NO: 288020 - DNA, 20 bp, Artificial Sequence
  Description of Artificial Sequence: Synthetic oligonucleotide
  Target: ATXN1; (+) strand; PAM type: YTN; PAM sequence: CTG
gtgcaacttttgaggtcaaa

SEQ ID NO: 288021 - DNA, 20 bp, Artificial Sequence
  Description of Artificial Sequence: Synthetic oligonucleotide
  Target: ATXN1; (+) strand; PAM type: YTN; PAM sequence: CTT
ttgaggtcaaaacaactcat

SEQ ID NO: 288022 - DNA, 20 bp, Artificial Sequence
  Description of Artificial Sequence: Synthetic oligonucleotide
  Target: ATXN1; (+) strand; PAM type: YTN; PAM sequence: TTT
tgaggtcaaaacaactcata

SEQ ID NO: 288023 - DNA, 20 bp, Artificial Sequence
  Description of Artificial Sequence: Synthetic oligonucleotide
  Target: ATXN1; (+) strand; PAM type: YTN; PAM sequence: TTT
gaggtcaaaacaactcataa

SEQ ID NO: 288024 - DNA, 20 bp, Artificial Sequence
  Description of Artificial Sequence: Synthetic oligonucleotide
  Target: ATXN1; (+) strand; PAM type: YTN; PAM sequence: TTG
aggtcaaaacaactcataag

SEQ ID NO: 288025 - DNA, 20 bp, Artificial Sequence
  Description of Artificial Sequence: Synthetic oligonucleotide
  Target: ATXN1; (+) strand; PAM type: YTN; PAM sequence: CTC
ataagcattcagtgaggagg

SEQ ID NO: 288026 - DNA, 20 bp, Artificial Sequence
  Description of Artificial Sequence: Synthetic oligonucleotide
  Target: ATXN1; (+) strand; PAM type: YTN; PAM sequence: TTC
agtgaggaggaaaagaaata

SEQ ID NO: 288027 - DNA, 20 bp, Artificial Sequence
  Description of Artificial Sequence: Synthetic oligonucleotide
  Target: ATXN1; (+) strand; PAM type: YTN; PAM sequence: TTT
ctgacaatagaagaaataaa

SEQ ID NO: 288028 - DNA, 20 bp, Artificial Sequence
  Description of Artificial Sequence: Synthetic oligonucleotide
  Target: ATXN1; (+) strand; PAM type: YTN; PAM sequence: TTC
tgacaatagaagaaataaaa

SEQ ID NO: 288029 - DNA, 20 bp, Artificial Sequence
  Description of Artificial Sequence: Synthetic oligonucleotide
  Target: ATXN1; (+) strand; PAM type: YTN; PAM sequence: CTG
acaatagaagaaataaaaca

SEQ ID NO: 288030 - DNA, 20 bp, Artificial Sequence
  Description of Artificial Sequence: Synthetic oligonucleotide
  Target: ATXN1; (+) strand; PAM type: YTN; PAM sequence: CTA
cacagctctaatggcaaagg

SEQ ID NO: 288031 - DNA, 20 bp, Artificial Sequence
  Description of Artificial Sequence: Synthetic oligonucleotide
  Target: ATXN1; (+) strand; PAM type: YTN; PAM sequence: CTC
taatggcaaagggttctgat

SEQ ID NO: 288032 - DNA, 20 bp, Artificial Sequence
  Description of Artificial Sequence: Synthetic oligonucleotide
  Target: ATXN1; (+) strand; PAM type: YTN; PAM sequence: CTA
atggcaaagggttctgatac

SEQ ID NO: 288033 - DNA, 20 bp, Artificial Sequence
  Description of Artificial Sequence: Synthetic oligonucleotide
  Target: ATXN1; (+) strand; PAM type: YTN; PAM sequence: TTC
tgatacaaaaattccaaact

SEQ ID NO: 288034 - DNA, 20 bp, Artificial Sequence
  Description of Artificial Sequence: Synthetic oligonucleotide
  Target: ATXN1; (+) strand; PAM type: YTN; PAM sequence: CTG
atacaaaaattccaaactaa

SEQ ID NO: 288035 - DNA, 20 bp, Artificial Sequence
  Description of Artificial Sequence: Synthetic oligonucleotide
  Target: ATXN1; (+) strand; PAM type: YTN; PAM sequence: TTC
caaactaaccaactttccta

SEQ ID NO: 288036 - DNA, 20 bp, Artificial Sequence
  Description of Artificial Sequence: Synthetic oligonucleotide
  Target: ATXN1; (+) strand; PAM type: YTN; PAM sequence: CTA
accaactttcctactaaggt

SEQ ID NO: 288037 - DNA, 20 bp, Artificial Sequence
  Description of Artificial Sequence: Synthetic oligonucleotide
  Target: ATXN1; (+) strand; PAM type: YTN; PAM sequence: CTT
tcctactaaggtatgagagt

SEQ ID NO: 288038 - DNA, 20 bp, Artificial Sequence
  Description of Artificial Sequence: Synthetic oligonucleotide
  Target: ATXN1; (+) strand; PAM type: YTN; PAM sequence: TTT
cctactaaggtatgagagtt

SEQ ID NO: 288039 - DNA, 20 bp, Artificial Sequence
  Description of Artificial Sequence: Synthetic oligonucleotide
  Target: ATXN1; (+) strand; PAM type: YTN; PAM sequence: TTC
ctactaaggtatgagagtta

SEQ ID NO: 288040 - DNA, 20 bp, Artificial Sequence
  Description of Artificial Sequence: Synthetic oligonucleotide
  Target: ATXN1; (+) strand; PAM type: YTN; PAM sequence: CTA
ctaaggtatgagagttaaaa

SEQ ID NO: 288041 - DNA, 20 bp, Artificial Sequence
  Description of Artificial Sequence: Synthetic oligonucleotide
  Target: ATXN1; (+) strand; PAM type: YTN; PAM sequence: CTA
aggtatgagagttaaaaaat

SEQ ID NO: 288042 - DNA, 20 bp, Artificial Sequence
  Description of Artificial Sequence: Synthetic oligonucleotide
  Target: ATXN1; (+) strand; PAM type: YTN; PAM sequence: TTA
aaaaataaaaaaggcattct

SEQ ID NO: 288043 - DNA, 20 bp, Artificial Sequence
  Description of Artificial Sequence: Synthetic oligonucleotide
  Target: ATXN1; (+) strand; PAM type: YTN; PAM sequence: TTC
ttggatcccaaggagcaaca

SEQ ID NO: 288044 - DNA, 20 bp, Artificial Sequence
  Description of Artificial Sequence: Synthetic oligonucleotide
  Target: ATXN1; (+) strand; PAM type: YTN; PAM sequence: CTT
ggatcccaaggagcaacaaa

SEQ ID NO: 288045 - DNA, 20 bp, Artificial Sequence
  Description of Artificial Sequence: Synthetic oligonucleotide
  Target: ATXN1; (+) strand; PAM type: YTN; PAM sequence: TTG
gatcccaaggagcaacaaaa

SEQ ID NO: 288046 - DNA, 20 bp, Artificial Sequence
  Description of Artificial Sequence: Synthetic oligonucleotide
  Target: ATXN1; (+) strand; PAM type: YTN; PAM sequence: TTT
catagaatatatttgaagaa

SEQ ID NO: 288047 - DNA, 20 bp, Artificial Sequence
  Description of Artificial Sequence: Synthetic oligonucleotide
  Target: ATXN1; (+) strand; PAM type: YTN; PAM sequence: TTC
atagaatatatttgaagaag

SEQ ID NO: 288048 - DNA, 20 bp, Artificial Sequence
  Description of Artificial Sequence: Synthetic oligonucleotide
  Target: ATXN1; (+) strand; PAM type: YTN; PAM sequence: TTT
gaagaagctccctaatcaat

SEQ ID NO: 288049 - DNA, 20 bp, Artificial Sequence
  Description of Artificial Sequence: Synthetic oligonucleotide
  Target: ATXN1; (+) strand; PAM type: YTN; PAM sequence: TTG
aagaagctccctaatcaatc

SEQ ID NO: 288050 - DNA, 20 bp, Artificial Sequence
  Description of Artificial Sequence: Synthetic oligonucleotide
  Target: ATXN1; (+) strand; PAM type: YTN; PAM sequence: CTC
cctaatcaatcaaaaattta

SEQ ID NO: 288051 - DNA, 20 bp, Artificial Sequence
  Description of Artificial Sequence: Synthetic oligonucleotide
  Target: ATXN1; (+) strand; PAM type: YTN; PAM sequence: CTA
atcaatcaaaaatttaattt

SEQ ID NO: 288052 - DNA, 20 bp, Artificial Sequence
  Description of Artificial Sequence: Synthetic oligonucleotide
  Target: ATXN1; (+) strand; PAM type: YTN; PAM sequence: TTT
aattttaaacaataaagaaa

SEQ ID NO: 288053 - DNA, 20 bp, Artificial Sequence
  Description of Artificial Sequence: Synthetic oligonucleotide
  Target: ATXN1; (+) strand; PAM type: YTN; PAM sequence: TTA
attttaaacaataaagaaaa

SEQ ID NO: 288054 - DNA, 20 bp, Artificial Sequence
  Description of Artificial Sequence: Synthetic oligonucleotide
  Target: ATXN1; (+) strand; PAM type: YTN; PAM sequence: TTT
taaacaataaagaaaagggg

SEQ ID NO: 288055 - DNA, 20 bp, Artificial Sequence
  Description of Artificial Sequence: Synthetic oligonucleotide
  Target: ATXN1; (+) strand; PAM type: YTN; PAM sequence: TTT
aaacaataaagaaaaggggt

SEQ ID NO: 288056 - DNA, 20 bp, Artificial Sequence
  Description of Artificial Sequence: Synthetic oligonucleotide
  Target: ATXN1; (+) strand; PAM type: YTN; PAM sequence: TTA
aacaataaagaaaaggggta

SEQ ID NO: 288057 - DNA, 20 bp, Artificial Sequence
  Description of Artificial Sequence: Synthetic oligonucleotide
  Target: ATXN1; (+) strand; PAM type: YTN; PAM sequence: TTG
tgctttaaaacagttcacaa

SEQ ID NO: 288058 - DNA, 20 bp, Artificial Sequence
  Description of Artificial Sequence: Synthetic oligonucleotide
  Target: ATXN1; (+) strand; PAM type: YTN; PAM sequence: CTT
taaaacagttcacaatatgg

SEQ ID NO: 288059 - DNA, 20 bp, Artificial Sequence
  Description of Artificial Sequence: Synthetic oligonucleotide
  Target: ATXN1; (+) strand; PAM type: YTN; PAM sequence: TTT
aaaacagttcacaatatgga

SEQ ID NO: 288060 - DNA, 20 bp, Artificial Sequence
  Description of Artificial Sequence: Synthetic oligonucleotide
  Target: ATXN1; (+) strand; PAM type: YTN; PAM sequence: TTA
aaacagttcacaatatggat

SEQ ID NO: 288061 - DNA, 20 bp, Artificial Sequence
  Description of Artificial Sequence: Synthetic oligonucleotide
  Target: ATXN1; (+) strand; PAM type: YTN; PAM sequence: TTC
acaatatggattcaggccca

SEQ ID NO: 288062 - DNA, 20 bp, Artificial Sequence
  Description of Artificial Sequence: Synthetic oligonucleotide
  Target: ATXN1; (+) strand; PAM type: YTN; PAM sequence: TTC
aggcccagcacaggggctca

SEQ ID NO: 288063 - DNA, 20 bp, Artificial Sequence
  Description of Artificial Sequence: Synthetic oligonucleotide
  Target: ATXN1; (+) strand; PAM type: YTN; PAM sequence: CTC
atccctgtaatcccagaact

SEQ ID NO: 288064 - DNA, 20 bp, Artificial Sequence
  Description of Artificial Sequence: Synthetic oligonucleotide
  Target: ATXN1; (+) strand; PAM type: YTN; PAM sequence: CTG
taatcccagaactttgggag

SEQ ID NO: 288065 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggtgggagg

SEQ ID NO: 288066 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggtgggagga

SEQ ID NO: 288067 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggtgggaggat

SEQ ID NO: 288068 - DNA, 20 bp, Artificial Sequence
  Description of Artificial Sequence: Synthetic oligonucleotide
  Target: ATXN1; (+) strand; PAM type: YTN; PAM sequence: TTG
cttgaggccaagagtttaaa

SEQ ID NO: 288069 - DNA, 20 bp, Artificial Sequence
  Description of Artificial Sequence: Synthetic oligonucleotide
  Target: ATXN1; (+) strand; PAM type: YTN; PAM sequence: CTT
gaggccaagagtttaaaacc

SEQ ID NO: 288070 - DNA, 20 bp, Artificial Sequence
  Description of Artificial Sequence: Synthetic oligonucleotide
  Target: ATXN1; (+) strand; PAM type: YTN; PAM sequence: TTG
aggccaagagtttaaaacca

SEQ ID NO: 288071 - DNA, 20 bp, Artificial Sequence
  Description of Artificial Sequence: Synthetic oligonucleotide
  Target: ATXN1; (+) strand; PAM type: YTN; PAM sequence: TTT
aaaaccacccgggacaacac

SEQ ID NO: 288072 - DNA, 20 bp, Artificial Sequence
  Description of Artificial Sequence: Synthetic oligonucleotide
  Target: ATXN1; (+) strand; PAM type: YTN; PAM sequence: TTA
aaaccacccgggacaacaca

SEQ ID NO: 288073 - DNA, 20 bp, Artificial Sequence
  Description of Artificial Sequence: Synthetic oligonucleotide
  Target: ATXN1; (+) strand; PAM type: YTN; PAM sequence: CTA
taaaaaaaaaaaaaaaaaat

SEQ ID NO: 288074 - DNA, 20 bp, Artificial Sequence
  Description of Artificial Sequence: Synthetic oligonucleotide
  Target: ATXN1; (+) strand; PAM type: YTN; PAM sequence: TTA
gccaggcgtggggctgtgtg

SEQ ID NO: 288075 - DNA, 20 bp, Artificial Sequence
  Description of Artificial Sequence: Synthetic oligonucleotide
  Target: ATXN1; (+) strand; PAM type: YTN; PAM sequence: CTG
tgtgcctgtagtcccagcta

SEQ ID NO: 288076 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctacttaggag

SEQ ID NO: 288077 - DNA, 20 bp, Artificial Sequence
  Description of Artificial Sequence: Synthetic oligonucleotide
  Target: ATXN1; (+) strand; PAM type: YTN; PAM sequence: CTA
cttaggaggctgaggtgggg

SEQ ID NO: 288078 - DNA, 20 bp, Artificial Sequence
  Description of Artificial Sequence: Synthetic oligonucleotide
  Target: ATXN1; (+) strand; PAM type: YTN; PAM sequence: CTT
aggaggctgaggtgggggat

SEQ ID NO: 288079 - DNA, 20 bp, Artificial Sequence
  Description of Artificial Sequence: Synthetic oligonucleotide
  Target: ATXN1; (+) strand; PAM type: YTN; PAM sequence: TTA
ggaggctgaggtgggggatc

SEQ ID NO: 288080 - DNA, 20 bp, Artificial Sequence
  Description of Artificial Sequence: Synthetic oligonucleotide
  Target: ATXN1; (+) strand; PAM type: YTN; PAM sequence: CTG
aggtgggggatcctttagag

SEQ ID NO: 288081 - DNA, 20 bp, Artificial Sequence
  Description of Artificial Sequence: Synthetic oligonucleotide
  Target: ATXN1; (+) strand; PAM type: YTN; PAM sequence: CTT
tagagccaggaggtcaaggc

SEQ ID NO: 288082 - DNA, 20 bp, Artificial Sequence
  Description of Artificial Sequence: Synthetic oligonucleotide
  Target: ATXN1; (+) strand; PAM type: YTN; PAM sequence: TTT
agagccaggaggtcaaggct

SEQ ID NO: 288083 - DNA, 20 bp, Artificial Sequence
  Description of Artificial Sequence: Synthetic oligonucleotide
  Target: ATXN1; (+) strand; PAM type: YTN; PAM sequence: TTA
gagccaggaggtcaaggctg

SEQ ID NO: 288084 - DNA, 20 bp, Artificial Sequence
  Description of Artificial Sequence: Synthetic oligonucleotide
  Target: ATXN1; (+) strand; PAM type: YTN; PAM sequence: CTG
cagcgagttatgatcccacc

SEQ ID NO: 288085 - DNA, 20 bp, Artificial Sequence
  Description of Artificial Sequence: Synthetic oligonucleotide
  Target: ATXN1; (+) strand; PAM type: YTN; PAM sequence: TTA
tgatcccaccagtgcactcc

SEQ ID NO: 288086 - DNA, 20 bp, Artificial Sequence
  Description of Artificial Sequence: Synthetic oligonucleotide
  Target: ATXN1; (+) strand; PAM type: YTN; PAM sequence: CTC
caggctgcaccacagagcaa

SEQ ID NO: 288087 - DNA, 20 bp, Artificial Sequence
  Description of Artificial Sequence: Synthetic oligonucleotide
  Target: ATXN1; (+) strand; PAM type: YTN; PAM sequence: CTG
caccacagagcaagaccctg

SEQ ID NO: 288088 - DNA, 20 bp, Artificial Sequence
  Description of Artificial Sequence: Synthetic oligonucleotide
  Target: ATXN1; (+) strand; PAM type: YTN; PAM sequence: CTG
tctctagagaaaaatatata

SEQ ID NO: 288089 - DNA, 20 bp, Artificial Sequence
  Description of Artificial Sequence: Synthetic oligonucleotide
  Target: ATXN1; (+) strand; PAM type: YTN; PAM sequence: CTC
tagagaaaaatatatacaca

SEQ ID NO: 288090 - DNA, 20 bp, Artificial Sequence
  Description of Artificial Sequence: Synthetic oligonucleotide
  Target: ATXN1; (+) strand; PAM type: YTN; PAM sequence: CTA
gagaaaaatatatacacata

SEQ ID NO: 288091 - DNA, 20 bp, Artificial Sequence
  Description of Artificial Sequence: Synthetic oligonucleotide
  Target: ATXN1; (+) strand; PAM type: YTN; PAM sequence: CTG
aatatcgttataaaaaggaa

SEQ ID NO: 288092 - DNA, 20 bp, Artificial Sequence
  Description of Artificial Sequence: Synthetic oligonucleotide
  Target: ATXN1; (+) strand; PAM type: YTN; PAM sequence: TTA
taaaaaggaacacagatata

SEQ ID NO: 288093 - DNA, 20 bp, Artificial Sequence
  Description of Artificial Sequence: Synthetic oligonucleotide
  Target: ATXN1; (+) strand; PAM type: YTN; PAM sequence: CTT
attaagaaaagttacataat

SEQ ID NO: 288094 - DNA, 20 bp, Artificial Sequence
  Description of Artificial Sequence: Synthetic oligonucleotide
  Target: ATXN1; (+) strand; PAM type: YTN; PAM sequence: TTA
ttaagaaaagttacataata

SEQ ID NO: 288095 - DNA, 20 bp, Artificial Sequence
  Description of Artificial Sequence: Synthetic oligonucleotide
  Target: ATXN1; (+) strand; PAM type: YTN; PAM sequence: TTA
agaaaagttacataatattt

SEQ ID NO: 288096 - DNA, 20 bp, Artificial Sequence
  Description of Artificial Sequence: Synthetic oligonucleotide
  Target: ATXN1; (+) strand; PAM type: YTN; PAM sequence: TTA
cataatatttaaaagtaatc

SEQ ID NO: 288097 - DNA, 20 bp, Artificial Sequence
  Description of Artificial Sequence: Synthetic oligonucleotide
  Target: ATXN1; (+) strand; PAM type: YTN; PAM sequence: TTT
aaaagtaatcataaactgga

SEQ ID NO: 288098 - DNA, 20 bp, Artificial Sequence
  Description of Artificial Sequence: Synthetic oligonucleotide
  Target: ATXN1; (+) strand; PAM type: YTN; PAM sequence: TTA
aaagtaatcataaactggat

SEQ ID NO: 288099 - DNA, 20 bp, Artificial Sequence
  Description of Artificial Sequence: Synthetic oligonucleotide
  Target: ATXN1; (+) strand; PAM type: YTN; PAM sequence: CTG
gatcaaaacatctatatgtc

SEQ ID NO: 288100 - DNA, 20 bp, Artificial Sequence
  Description of Artificial Sequence: Synthetic oligonucleotide
  Target: ATXN1; (+) strand; PAM type: YTN; PAM sequence: CTA
tatgtctatatctaacttta

SEQ ID NO: 288101 - DNA, 20 bp, Artificial Sequence
  Description of Artificial Sequence: Synthetic oligonucleotide
  Target: ATXN1; (+) strand; PAM type: YTN; PAM sequence: CTA
tatctaactttaaaaaagaa

SEQ ID NO: 288102 - DNA, 20 bp, Artificial Sequence
  Description of Artificial Sequence: Synthetic oligonucleotide
  Target: ATXN1; (+) strand; PAM type: YTN; PAM sequence: CTA
actttaaaaaagaaaaggag

SEQ ID NO: 288103 - DNA, 20 bp, Artificial Sequence
  Description of Artificial Sequence: Synthetic oligonucleotide
  Target: ATXN1; (+) strand; PAM type: YTN; PAM sequence: CTT
taaaaaagaaaaggagaatt

SEQ ID NO: 288104 - DNA, 20 bp, Artificial Sequence
  Description of Artificial Sequence: Synthetic oligonucleotide
  Target: ATXN1; (+) strand; PAM type: YTN; PAM sequence: TTT
aaaaaagaaaaggagaattc

SEQ ID NO: 288105 - DNA, 20 bp, Artificial Sequence
  Description of Artificial Sequence: Synthetic oligonucleotide
  Target: ATXN1; (+) strand; PAM type: YTN; PAM sequence: TTA
aaaaagaaaaggagaattcc

SEQ ID NO: 288106 - DNA, 20 bp, Artificial Sequence
  Description of Artificial Sequence: Synthetic oligonucleotide
  Target: ATXN1; (+) strand; PAM type: YTN; PAM sequence: TTC
caaaggagaataaaatgtgt

SEQ ID NO: 288107 - DNA, 20 bp, Artificial Sequence
  Description of Artificial Sequence: Synthetic oligonucleotide
  Target: ATXN1; (+) strand; PAM type: YTN; PAM sequence: TTA
atcttatcttatacagggag

SEQ ID NO: 288108 - DNA, 20 bp, Artificial Sequence
  Description of Artificial Sequence: Synthetic oligonucleotide
  Target: ATXN1; (+) strand; PAM type: YTN; PAM sequence: CTT
atcttatacagggaggaggt

SEQ ID NO: 288109 - DNA, 20 bp, Artificial Sequence
  Description of Artificial Sequence: Synthetic oligonucleotide
  Target: ATXN1; (+) strand; PAM type: YTN; PAM sequence: TTA
tcttatacagggaggaggta

SEQ ID NO: 288110 - DNA, 20 bp, Artificial Sequence
  Description of Artificial Sequence: Synthetic oligonucleotide
  Target: ATXN1; (+) strand; PAM type: YTN; PAM sequence: CTT
atacagggaggaggtatggt

SEQ ID NO: 288111 - DNA, 20 bp, Artificial Sequence
  Description of Artificial Sequence: Synthetic oligonucleotide
  Target: ATXN1; (+) strand; PAM type: YTN; PAM sequence: TTA
tacagggaggaggtatggtc

SEQ ID NO: 288112 - DNA, 20 bp, Artificial Sequence
  Description of Artificial Sequence: Synthetic oligonucleotide
  Target: ATXN1; (+) strand; PAM type: YTN; PAM sequence: CTT
cctcactttgctcatacaga

SEQ ID NO: 288113 - DNA, 20 bp, Artificial Sequence
  Description of Artificial Sequence: Synthetic oligonucleotide
  Target: ATXN1; (+) strand; PAM type: YTN; PAM sequence: TTC
ctcactttgctcatacagaa

SEQ ID NO: 288114 - DNA, 20 bp, Artificial Sequence
  Description of Artificial Sequence: Synthetic oligonucleotide
  Target: ATXN1; (+) strand; PAM type: YTN; PAM sequence: CTC
actttgctcatacagaaata

SEQ ID NO: 288115 - DNA, 20 bp, Artificial Sequence
  Description of Artificial Sequence: Synthetic oligonucleotide
  Target: ATXN1; (+) strand; PAM type: YTN; PAM sequence: CTT
tgctcatacagaaatatagg

SEQ ID NO: 288116 - DNA, 20 bp, Artificial Sequence
  Description of Artificial Sequence: Synthetic oligonucleotide
  Target: ATXN1; (+) strand; PAM type: YTN; PAM sequence: TTT
gctcatacagaaatataggt

SEQ ID NO: 288117 - DNA, 20 bp, Artificial Sequence
  Description of Artificial Sequence: Synthetic oligonucleotide
  Target: ATXN1; (+) strand; PAM type: YTN; PAM sequence: TTG
ctcatacagaaatataggtc

SEQ ID NO: 288118 - DNA, 20 bp, Artificial Sequence
  Description of Artificial Sequence: Synthetic oligonucleotide
  Target: ATXN1; (+) strand; PAM type: YTN; PAM sequence: CTC
atacagaaatataggtcata

SEQ ID NO: 288119 - DNA, 20 bp, Artificial Sequence
  Description of Artificial Sequence: Synthetic oligonucleotide
  Target: ATXN1; (+) strand; PAM type: YTN; PAM sequence: TTT
agtcaaatttaagaagacaa

SEQ ID NO: 288120 - DNA, 20 bp, Artificial Sequence
  Description of Artificial Sequence: Synthetic oligonucleotide
  Target: ATXN1; (+) strand; PAM type: YTN; PAM sequence: TTA
gtcaaatttaagaagacaac

SEQ ID NO: 288121 - DNA, 20 bp, Artificial Sequence
  Description of Artificial Sequence: Synthetic oligonucleotide
  Target: ATXN1; (+) strand; PAM type: YTN; PAM sequence: TTT
aagaagacaactagaagatt

SEQ ID NO: 288122 - DNA, 20 bp, Artificial Sequence
  Description of Artificial Sequence: Synthetic oligonucleotide
  Target: ATXN1; (+) strand; PAM type: YTN; PAM sequence: TTA
agaagacaactagaagatta

SEQ ID NO: 288123 - DNA, 20 bp, Artificial Sequence
  Description of Artificial Sequence: Synthetic oligonucleotide
  Target: ATXN1; (+) strand; PAM type: YTN; PAM sequence: CTA
gaagattaaatataaggtat

SEQ ID NO: 288124 - DNA, 20 bp, Artificial Sequence
  Description of Artificial Sequence: Synthetic oligonucleotide
  Target: ATXN1; (+) strand; PAM type: YTN; PAM sequence: TTA
aatataaggtatgagtatta

SEQ ID NO: 288125 - DNA, 20 bp, Artificial Sequence
  Description of Artificial Sequence: Synthetic oligonucleotide
  Target: ATXN1; (+) strand; PAM type: YTN; PAM sequence: TTA
cagacagtaaatcatatcac

SEQ ID NO: 288126 - DNA, 20 bp, Artificial Sequence
  Description of Artificial Sequence: Synthetic oligonucleotide
  Target: ATXN1; (+) strand; PAM type: YTN; PAM sequence: TTA
gaataagcgtatcaacattg

SEQ ID NO: 288127 - DNA, 20 bp, Artificial Sequence
  Description of Artificial Sequence: Synthetic oligonucleotide
  Target: ATXN1; (+) strand; PAM type: YTN; PAM sequence: TTG
aagacaggtattaattcgtt

SEQ ID NO: 288128 - DNA, 20 bp, Artificial Sequence
  Description of Artificial Sequence: Synthetic oligonucleotide
  Target: ATXN1; (+) strand; PAM type: YTN; PAM sequence: TTA
attcgttttgaaaagcaaaa

SEQ ID NO: 288129 - DNA, 20 bp, Artificial Sequence
  Description of Artificial Sequence: Synthetic oligonucleotide
  Target: ATXN1; (+) strand; PAM type: YTN; PAM sequence: TTC
gttttgaaaagcaaaagaat

SEQ ID NO: 288130 - DNA, 20 bp, Artificial Sequence
  Description of Artificial Sequence: Synthetic oligonucleotide
  Target: ATXN1; (+) strand; PAM type: YTN; PAM sequence: TTT
tgaaaagcaaaagaatctca

SEQ ID NO: 288131 - DNA, 20 bp, Artificial Sequence
  Description of Artificial Sequence: Synthetic oligonucleotide
  Target: ATXN1; (+) strand; PAM type: YTN; PAM sequence: TTT
gaaaagcaaaagaatctcag

SEQ ID NO: 288132 - DNA, 20 bp, Artificial Sequence
  Description of Artificial Sequence: Synthetic oligonucleotide
  Target: ATXN1; (+) strand; PAM type: YTN; PAM sequence: TTG
aaaagcaaaagaatctcaga

SEQ ID NO: 288133 - DNA, 20 bp, Artificial Sequence
  Description of Artificial Sequence: Synthetic oligonucleotide
  Target: ATXN1; (+) strand; PAM type: YTN; PAM sequence: CTC
agatggtgtcataaattaag

SEQ ID NO: 288134 - DNA, 20 bp, Artificial Sequence
  Description of Artificial Sequence: Synthetic oligonucleotide
  Target: ATXN1; (+) strand; PAM type: YTN; PAM sequence: TTA
agaatgcccttagactatct

SEQ ID NO: 288135 - DNA, 20 bp, Artificial Sequence
  Description of Artificial Sequence: Synthetic oligonucleotide
  Target: ATXN1; (+) strand; PAM type: YTN; PAM sequence: CTT
agactatctgcaagaaaccc

SEQ ID NO: 288136 - DNA, 20 bp, Artificial Sequence
  Description of Artificial Sequence: Synthetic oligonucleotide
  Target: ATXN1; (+) strand; PAM type: YTN; PAM sequence: TTA
gactatctgcaagaaaccca

SEQ ID NO: 288137 - DNA, 20 bp, Artificial Sequence
  Description of Artificial Sequence: Synthetic oligonucleotide
  Target: ATXN1; (+) strand; PAM type: YTN; PAM sequence: CTA
tctgcaagaaacccataaaa

SEQ ID NO: 288138 - DNA, 20 bp, Artificial Sequence
  Description of Artificial Sequence: Synthetic oligonucleotide
  Target: ATXN1; (+) strand; PAM type: YTN; PAM sequence: CTG
caagaaacccataaaagtta

SEQ ID NO: 288139 - DNA, 20 bp, Artificial Sequence
  Description of Artificial Sequence: Synthetic oligonucleotide
  Target: ATXN1; (+) strand; PAM type: YTN; PAM sequence: TTA
caagaagattggggcaaagg

SEQ ID NO: 288140 - DNA, 20 bp, Artificial Sequence
  Description of Artificial Sequence: Synthetic oligonucleotide
  Target: ATXN1; (+) strand; PAM type: YTN; PAM sequence: TTG
gggcaaaggaataccaggaa

SEQ ID NO: 288141 - DNA, 20 bp, Artificial Sequence
  Description of Artificial Sequence: Synthetic oligonucleotide
  Target: ATXN1; (+) strand; PAM type: YTN; PAM sequence: CTG
cacatttagaagtgacagtt

SEQ ID NO: 288142 - DNA, 20 bp, Artificial Sequence
  Description of Artificial Sequence: Synthetic oligonucleotide
  Target: ATXN1; (+) strand; PAM type: YTN; PAM sequence: TTT
agaagtgacagttttacaac

SEQ ID NO: 288143 - DNA, 20 bp, Artificial Sequence
  Description of Artificial Sequence: Synthetic oligonucleotide
  Target: ATXN1; (+) strand; PAM type: YTN; PAM sequence: TTA
gaagtgacagttttacaact

SEQ ID NO: 288144 - DNA, 20 bp, Artificial Sequence
  Description of Artificial Sequence: Synthetic oligonucleotide
  Target: ATXN1; (+) strand; PAM type: YTN; PAM sequence: TTT
tacaactgttaatacaaaat

SEQ ID NO: 288145 - DNA, 20 bp, Artificial Sequence
  Description of Artificial Sequence: Synthetic oligonucleotide
  Target: ATXN1; (+) strand; PAM type: YTN; PAM sequence: TTT
acaactgttaatacaaaatc

SEQ ID NO: 288146 - DNA, 20 bp, Artificial Sequence
  Description of Artificial Sequence: Synthetic oligonucleotide
  Target: ATXN1; (+) strand; PAM type: YTN; PAM sequence: TTA
caactgttaatacaaaatca

SEQ ID NO: 288147 - DNA, 20 bp, Artificial Sequence
  Description of Artificial Sequence: Synthetic oligonucleotide
  Target: ATXN1; (+) strand; PAM type: YTN; PAM sequence: CTG
ttaatacaaaatcagtatta

SEQ ID NO: 288148 - DNA, 20 bp, Artificial Sequence
  Description of Artificial Sequence: Synthetic oligonucleotide
  Target: ATXN1; (+) strand; PAM type: YTN; PAM sequence: TTA
atacaaaatcagtattacat

SEQ ID NO: 288149 - DNA, 20 bp, Artificial Sequence
  Description of Artificial Sequence: Synthetic oligonucleotide
  Target: ATXN1; (+) strand; PAM type: YTN; PAM sequence: TTA
catatctaaagcattcaaca

SEQ ID NO: 288150 - DNA, 20 bp, Artificial Sequence
  Description of Artificial Sequence: Synthetic oligonucleotide
  Target: ATXN1; (+) strand; PAM type: YTN; PAM sequence: CTA
aagcattcaacaggggtgaa

SEQ ID NO: 288151 - DNA, 20 bp, Artificial Sequence
  Description of Artificial Sequence: Synthetic oligonucleotide
  Target: ATXN1; (+) strand; PAM type: YTN; PAM sequence: TTC
aacaggggtgaaatttttac

SEQ ID NO: 288152 - DNA, 20 bp, Artificial Sequence
  Description of Artificial Sequence: Synthetic oligonucleotide
  Target: ATXN1; (+) strand; PAM type: YTN; PAM sequence: TTT
ttactgacaagagatacatt

SEQ ID NO: 288153 - DNA, 20 bp, Artificial Sequence
  Description of Artificial Sequence: Synthetic oligonucleotide
  Target: ATXN1; (+) strand; PAM type: YTN; PAM sequence: TTT
tactgacaagagatacattc

SEQ ID NO: 288154 - DNA, 20 bp, Artificial Sequence
  Description of Artificial Sequence: Synthetic oligonucleotide
  Target: ATXN1; (+) strand; PAM type: YTN; PAM sequence: TTT
actgacaagagatacattcc

SEQ ID NO: 288155 - DNA, 20 bp, Artificial Sequence
  Description of Artificial Sequence: Synthetic oligonucleotide
  Target: ATXN1; (+) strand; PAM type: YTN; PAM sequence: TTA
ctgacaagagatacattcca

SEQ ID NO: 288156 - DNA, 20 bp, Artificial Sequence
  Description of Artificial Sequence: Synthetic oligonucleotide
  Target: ATXN1; (+) strand; PAM type: YTN; PAM sequence: CTG
acaagagatacattccaaag

SEQ ID NO: 288157 - DNA, 20 bp, Artificial Sequence
  Description of Artificial Sequence: Synthetic oligonucleotide
  Target: ATXN1; (+) strand; PAM type: YTN; PAM sequence: TTC
caaagaattaagtcaaaatt

SEQ ID NO: 288158 - DNA, 20 bp, Artificial Sequence
  Description of Artificial Sequence: Synthetic oligonucleotide
  Target: ATXN1; (+) strand; PAM type: YTN; PAM sequence: TTA
agtcaaaattgtatgtgtca

SEQ ID NO: 288159 - DNA, 20 bp, Artificial Sequence
  Description of Artificial Sequence: Synthetic oligonucleotide
  Target: ATXN1; (+) strand; PAM type: YTN; PAM sequence: TTG
tatgtgtcaagatagtagag

SEQ ID NO: 288160 - DNA, 20 bp, Artificial Sequence
  Description of Artificial Sequence: Synthetic oligonucleotide
  Target: ATXN1; (+) strand; PAM type: YTN; PAM sequence: TTG
agagacatgcaataatgtta

SEQ ID NO: 288161 - DNA, 20 bp, Artificial Sequence
  Description of Artificial Sequence: Synthetic oligonucleotide
  Target: ATXN1; (+) strand; PAM type: YTN; PAM sequence: TTA
aagtctaccccactgcattc

SEQ ID NO: 288162 - DNA, 20 bp, Artificial Sequence
  Description of Artificial Sequence: Synthetic oligonucleotide
  Target: ATXN1; (+) strand; PAM type: YTN; PAM sequence: CTA
ccccactgcattcagtcctt

SEQ ID NO: 288163 - DNA, 20 bp, Artificial Sequence
  Description of Artificial Sequence: Synthetic oligonucleotide
  Target: ATXN1; (+) strand; PAM type: YTN; PAM sequence: CTG
cattcagtccttggaaaaat

SEQ ID NO: 288164 - DNA, 20 bp, Artificial Sequence
  Description of Artificial Sequence: Synthetic oligonucleotide
  Target: ATXN1; (+) strand; PAM type: YTN; PAM sequence: TTC
agtccttggaaaaataagca

SEQ ID NO: 288165 - DNA, 20 bp, Artificial Sequence
  Description of Artificial Sequence: Synthetic oligonucleotide
  Target: ATXN1; (+) strand; PAM type: YTN; PAM sequence: CTT
ggaaaaataagcagatgaaa

SEQ ID NO: 288166 - DNA, 20 bp, Artificial Sequence
  Description of Artificial Sequence: Synthetic oligonucleotide
  Target: ATXN1; (+) strand; PAM type: YTN; PAM sequence: TTG
gaaaaataagcagatgaaat

SEQ ID NO: 288167 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 288168 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 288169 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 288170 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 288171 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 288172 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 288173 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttg

SEQ ID NO: 288174 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttttga

SEQ ID NO: 288175 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttgag

SEQ ID NO: 288176 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttgaga

SEQ ID NO: 288177 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttgagac

SEQ ID NO: 288178 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttgagaca

SEQ ID NO: 288179 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgagacag

SEQ ID NO: 288180 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgagacaga

SEQ ID NO: 288181 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgagacagag

SEQ ID NO: 288182 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgagacagagt

SEQ ID NO: 288183 - DNA, 20 bp, Artificial Sequence
  Description of Artificial Sequence: Synthetic oligonucleotide
  Target: ATXN1; (+) strand; PAM type: YTN; PAM sequence: TTT
tttttttttgagacagagtc

SEQ ID NO: 288184 - DNA, 20 bp, Artificial Sequence
  Description of Artificial Sequence: Synthetic oligonucleotide
  Target: ATXN1; (+) strand; PAM type: YTN; PAM sequence: TTT
ttttttttgagacagagtct

SEQ ID NO: 288185 - DNA, 20 bp, Artificial Sequence
  Description of Artificial Sequence: Synthetic oligonucleotide
  Target: ATXN1; (+) strand; PAM type: YTN; PAM sequence: TTT
tttttttgagacagagtctc

SEQ ID NO: 288186 - DNA, 20 bp, Artificial Sequence
  Description of Artificial Sequence: Synthetic oligonucleotide
  Target: ATXN1; (+) strand; PAM type: YTN; PAM sequence: TTT
ttttttgagacagagtctca

SEQ ID NO: 288187 - DNA, 20 bp, Artificial Sequence
  Description of Artificial Sequence: Synthetic oligonucleotide
  Target: ATXN1; (+) strand; PAM type: YTN; PAM sequence: TTT
tttttgagacagagtctcac

SEQ ID NO: 288188 - DNA, 20 bp, Artificial Sequence
  Description of Artificial Sequence: Synthetic oligonucleotide
  Target: ATXN1; (+) strand; PAM type: YTN; PAM sequence: TTT
ttttgagacagagtctcact

SEQ ID NO: 288189 - DNA, 20 bp, Artificial Sequence
  Description of Artificial Sequence: Synthetic oligonucleotide
  Target: ATXN1; (+) strand; PAM type: YTN; PAM sequence: TTT
tttgagacagagtctcactc

SEQ ID NO: 288190 - DNA, 20 bp, Artificial Sequence
  Description of Artificial Sequence: Synthetic oligonucleotide
  Target: ATXN1; (+) strand; PAM type: YTN; PAM sequence: TTT
ttgagacagagtctcactct

SEQ ID NO: 288191 - DNA, 20 bp, Artificial Sequence
  Description of Artificial Sequence: Synthetic oligonucleotide
  Target: ATXN1; (+) strand; PAM type: YTN; PAM sequence: TTT
tgagacagagtctcactctg

SEQ ID NO: 288192 - DNA, 20 bp, Artificial Sequence
  Description of Artificial Sequence: Synthetic oligonucleotide
  Target: ATXN1; (+) strand; PAM type: YTN; PAM sequence: TTT
gagacagagtctcactctgt

SEQ ID NO: 288193 - DNA, 20 bp, Artificial Sequence
  Description of Artificial Sequence: Synthetic oligonucleotide
  Target: ATXN1; (+) strand; PAM type: YTN; PAM sequence: TTG
agacagagtctcactctgtt

SEQ ID NO: 288194 - DNA, 20 bp, Artificial Sequence
  Description of Artificial Sequence: Synthetic oligonucleotide
  Target: ATXN1; (+) strand; PAM type: YTN; PAM sequence: CTC
actctgttgcccattctgga

SEQ ID NO: 288195 - DNA, 20 bp, Artificial Sequence
  Description of Artificial Sequence: Synthetic oligonucleotide
  Target: ATXN1; (+) strand; PAM type: YTN; PAM sequence: CTC
tgttgcccattctggagtgc

SEQ ID NO: 288196 - DNA, 20 bp, Artificial Sequence
  Description of Artificial Sequence: Synthetic oligonucleotide
  Target: ATXN1; (+) strand; PAM type: YTN; PAM sequence: CTG
ttgcccattctggagtgcag

SEQ ID NO: 288197 - DNA, 20 bp, Artificial Sequence
  Description of Artificial Sequence: Synthetic oligonucleotide
  Target: ATXN1; (+) strand; PAM type: YTN; PAM sequence: TTG
cccattctggagtgcagtgg

SEQ ID NO: 288198 - DNA, 20 bp, Artificial Sequence
  Description of Artificial Sequence: Synthetic oligonucleotide
  Target: ATXN1; (+) strand; PAM type: YTN; PAM sequence: TTC
tggagtgcagtggctccatc

SEQ ID NO: 288199 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggctccatctc

SEQ ID NO: 288200 - DNA, 20 bp, Artificial Sequence
  Description of Artificial Sequence: Synthetic oligonucleotide
  Target: ATXN1; (+) strand; PAM type: YTN; PAM sequence: CTC
catctcggctcactgcaagc

SEQ ID NO: 288201 - DNA, 20 bp, Artificial Sequence
  Description of Artificial Sequence: Synthetic oligonucleotide
  Target: ATXN1; (+) strand; PAM type: YTN; PAM sequence: CTC
ggctcactgcaagctccgcc

SEQ ID NO: 288202 - DNA, 20 bp, Artificial Sequence
  Description of Artificial Sequence: Synthetic oligonucleotide
  Target: ATXN1; (+) strand; PAM type: YTN; PAM sequence: CTC
actgcaagctccgcctcctg

SEQ ID NO: 288203 - DNA, 20 bp, Artificial Sequence
  Description of Artificial Sequence: Synthetic oligonucleotide
  Target: ATXN1; (+) strand; PAM type: YTN; PAM sequence: CTG
caagctccgcctcctgggtt

SEQ ID NO: 288204 - DNA, 20 bp, Artificial Sequence
  Description of Artificial Sequence: Synthetic oligonucleotide
  Target: ATXN1; (+) strand; PAM type: YTN; PAM sequence: CTC
cgcctcctgggttcatgcca

SEQ ID NO: 288205 - DNA, 20 bp, Artificial Sequence
  Description of Artificial Sequence: Synthetic oligonucleotide
  Target: ATXN1; (+) strand; PAM type: YTN; PAM sequence: CTC
ctgggttcatgccattctcc

SEQ ID NO: 288206 - DNA, 20 bp, Artificial Sequence
  Description of Artificial Sequence: Synthetic oligonucleotide
  Target: ATXN1; (+) strand; PAM type: YTN; PAM sequence: CTG
ggttcatgccattctcctgc

SEQ ID NO: 288207 - DNA, 20 bp, Artificial Sequence
  Description of Artificial Sequence: Synthetic oligonucleotide
  Target: ATXN1; (+) strand; PAM type: YTN; PAM sequence: TTC
atgccattctcctgcctcag

SEQ ID NO: 288208 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctttcgag

SEQ ID NO: 288209 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctttcgagta

SEQ ID NO: 288210 - DNA, 20 bp, Artificial Sequence
  Description of Artificial Sequence: Synthetic oligonucleotide
  Target: ATXN1; (+) strand; PAM type: YTN; PAM sequence: CTG
cctcagcctttcgagtagct

SEQ ID NO: 288211 - DNA, 20 bp, Artificial Sequence
  Description of Artificial Sequence: Synthetic oligonucleotide
  Target: ATXN1; (+) strand; PAM type: YTN; PAM sequence: CTC
agcctttcgagtagctggga

SEQ ID NO: 288212 - DNA, 20 bp, Artificial Sequence
  Description of Artificial Sequence: Synthetic oligonucleotide
  Target: ATXN1; (+) strand; PAM type: YTN; PAM sequence: CTT
tcgagtagctgggactacag

SEQ ID NO: 288213 - DNA, 20 bp, Artificial Sequence
  Description of Artificial Sequence: Synthetic oligonucleotide
  Target: ATXN1; (+) strand; PAM type: YTN; PAM sequence: TTT
cgagtagctgggactacagg

SEQ ID NO: 288214 - DNA, 20 bp, Artificial Sequence
  Description of Artificial Sequence: Synthetic oligonucleotide
  Target: ATXN1; (+) strand; PAM type: YTN; PAM sequence: TTC
gagtagctgggactacaggt

SEQ ID NO: 288215 - DNA, 20 bp, Artificial Sequence
  Description of Artificial Sequence: Synthetic oligonucleotide
  Target: ATXN1; (+) strand; PAM type: YTN; PAM sequence: CTG
ggactacaggtgcccgccac

SEQ ID NO: 288216 - DNA, 20 bp, Artificial Sequence
  Description of Artificial Sequence: Synthetic oligonucleotide
  Target: ATXN1; (+) strand; PAM type: YTN; PAM sequence: CTA
caggtgcccgccaccacacc

SEQ ID NO: 288217 - DNA, 20 bp, Artificial Sequence
  Description of Artificial Sequence: Synthetic oligonucleotide
  Target: ATXN1; (+) strand; PAM type: YTN; PAM sequence: CTA
attttttgtatttttagtag

SEQ ID NO: 288218 - DNA, 20 bp, Artificial Sequence
  Description of Artificial Sequence: Synthetic oligonucleotide
  Target: ATXN1; (+) strand; PAM type: YTN; PAM sequence: TTT
tttgtatttttagtagagac

SEQ ID NO: 288219 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagacg

SEQ ID NO: 288220 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagacgg

SEQ ID NO: 288221 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagacggg

SEQ ID NO: 288222 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagacgggg

SEQ ID NO: 288223 - DNA, 20 bp, Artificial Sequence
  Description of Artificial Sequence: Synthetic oligonucleotide
  Target: ATXN1; (+) strand; PAM type: YTN; PAM sequence: TTT
ttagtagagacggggtttca

SEQ ID NO: 288224 - DNA, 20 bp, Artificial Sequence
  Description of Artificial Sequence: Synthetic oligonucleotide
  Target: ATXN1; (+) strand; PAM type: YTN; PAM sequence: TTT
tagtagagacggggtttcac

SEQ ID NO: 288225 - DNA, 20 bp, Artificial Sequence
  Description of Artificial Sequence: Synthetic oligonucleotide
  Target: ATXN1; (+) strand; PAM type: YTN; PAM sequence: TTT
agtagagacggggtttcacc

SEQ ID NO: 288226 - DNA, 20 bp, Artificial Sequence
  Description of Artificial Sequence: Synthetic oligonucleotide
  Target: ATXN1; (+) strand; PAM type: YTN; PAM sequence: TTA
gtagagacggggtttcacca

SEQ ID NO: 288227 - DNA, 20 bp, Artificial Sequence
  Description of Artificial Sequence: Synthetic oligonucleotide
  Target: ATXN1; (+) strand; PAM type: YTN; PAM sequence: TTT
caccatgttagtcaggacgg

SEQ ID NO: 288228 - DNA, 20 bp, Artificial Sequence
  Description of Artificial Sequence: Synthetic oligonucleotide
  Target: ATXN1; (+) strand; PAM type: YTN; PAM sequence: TTC
accatgttagtcaggacggt

SEQ ID NO: 288229 - DNA, 20 bp, Artificial Sequence
  Description of Artificial Sequence: Synthetic oligonucleotide
  Target: ATXN1; (+) strand; PAM type: YTN; PAM sequence: TTA
gtcaggacggtctcgatctc

SEQ ID NO: 288230 - DNA, 20 bp, Artificial Sequence
  Description of Artificial Sequence: Synthetic oligonucleotide
  Target: ATXN1; (+) strand; PAM type: YTN; PAM sequence: CTC
gatctcctgacctcatgatg

SEQ ID NO: 288231 - DNA, 20 bp, Artificial Sequence
  Description of Artificial Sequence: Synthetic oligonucleotide
  Target: ATXN1; (+) strand; PAM type: YTN; PAM sequence: CTC
ctgacctcatgatgcgcctg

SEQ ID NO: 288232 - DNA, 20 bp, Artificial Sequence
  Description of Artificial Sequence: Synthetic oligonucleotide
  Target: ATXN1; (+) strand; PAM type: YTN; PAM sequence: CTG
acctcatgatgcgcctgcct

SEQ ID NO: 288233 - DNA, 20 bp, Artificial Sequence
  Description of Artificial Sequence: Synthetic oligonucleotide
  Target: ATXN1; (+) strand; PAM type: YTN; PAM sequence: CTC
atgatgcgcctgcctcagcc

SEQ ID NO: 288234 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaaagtgct

SEQ ID NO: 288235 - DNA, 20 bp, Artificial Sequence
  Description of Artificial Sequence: Synthetic oligonucleotide
  Target: ATXN1; (+) strand; PAM type: YTN; PAM sequence: CTC
agcctcccaaagtgctggga

SEQ ID NO: 288236 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattacag

SEQ ID NO: 288237 - DNA, 20 bp, Artificial Sequence
  Description of Artificial Sequence: Synthetic oligonucleotide
  Target: ATXN1; (+) strand; PAM type: YTN; PAM sequence: CTG
ggattacaggtgtgagccac

SEQ ID NO: 288238 - DNA, 20 bp, Artificial Sequence
  Description of Artificial Sequence: Synthetic oligonucleotide
  Target: ATXN1; (+) strand; PAM type: YTN; PAM sequence: TTA
caggtgtgagccaccgcgcc

SEQ ID NO: 288239 - DNA, 20 bp, Artificial Sequence
  Description of Artificial Sequence: Synthetic oligonucleotide
  Target: ATXN1; (+) strand; PAM type: YTN; PAM sequence: TTT
aataaagatatagagaagta

SEQ ID NO: 288240 - DNA, 20 bp, Artificial Sequence
  Description of Artificial Sequence: Synthetic oligonucleotide
  Target: ATXN1; (+) strand; PAM type: YTN; PAM sequence: TTA
ataaagatatagagaagtag

SEQ ID NO: 288241 - DNA, 20 bp, Artificial Sequence
  Description of Artificial Sequence: Synthetic oligonucleotide
  Target: ATXN1; (+) strand; PAM type: YTN; PAM sequence: CTG
atgacaagataagcctgatt

SEQ ID NO: 288242 - DNA, 20 bp, Artificial Sequence
  Description of Artificial Sequence: Synthetic oligonucleotide
  Target: ATXN1; (+) strand; PAM type: YTN; PAM sequence: CTG
attagatttaattagagcat

SEQ ID NO: 288243 - DNA, 20 bp, Artificial Sequence
  Description of Artificial Sequence: Synthetic oligonucleotide
  Target: ATXN1; (+) strand; PAM type: YTN; PAM sequence: TTA
gatttaattagagcatgcat

SEQ ID NO: 288244 - DNA, 20 bp, Artificial Sequence
  Description of Artificial Sequence: Synthetic oligonucleotide
  Target: ATXN1; (+) strand; PAM type: YTN; PAM sequence: TTT
aattagagcatgcatcttct

SEQ ID NO: 288245 - DNA, 20 bp, Artificial Sequence
  Description of Artificial Sequence: Synthetic oligonucleotide
  Target: ATXN1; (+) strand; PAM type: YTN; PAM sequence: TTA
attagagcatgcatcttcta

SEQ ID NO: 288246 - DNA, 20 bp, Artificial Sequence
  Description of Artificial Sequence: Synthetic oligonucleotide
  Target: ATXN1; (+) strand; PAM type: YTN; PAM sequence: TTA
gagcatgcatcttctataca

SEQ ID NO: 288247 - DNA, 20 bp, Artificial Sequence
  Description of Artificial Sequence: Synthetic oligonucleotide
  Target: ATXN1; (+) strand; PAM type: YTN; PAM sequence: CTT
ctatacaggggctcatggaa

SEQ ID NO: 288248 - DNA, 20 bp, Artificial Sequence
  Description of Artificial Sequence: Synthetic oligonucleotide
  Target: ATXN1; (+) strand; PAM type: YTN; PAM sequence: TTC
tatacaggggctcatggaac

SEQ ID NO: 288249 - DNA, 20 bp, Artificial Sequence
  Description of Artificial Sequence: Synthetic oligonucleotide
  Target: ATXN1; (+) strand; PAM type: YTN; PAM sequence: CTA
tacaggggctcatggaacat

SEQ ID NO: 288250 - DNA, 20 bp, Artificial Sequence
  Description of Artificial Sequence: Synthetic oligonucleotide
  Target: ATXN1; (+) strand; PAM type: YTN; PAM sequence: CTC
atggaacattaacaaaaatg

SEQ ID NO: 288251 - DNA, 20 bp, Artificial Sequence
  Description of Artificial Sequence: Synthetic oligonucleotide
  Target: ATXN1; (+) strand; PAM type: YTN; PAM sequence: TTA
acaaaaatgaatcctgtatt

SEQ ID NO: 288252 - DNA, 20 bp, Artificial Sequence
  Description of Artificial Sequence: Synthetic oligonucleotide
  Target: ATXN1; (+) strand; PAM type: YTN; PAM sequence: CTG
tattggaacataaaataaat

SEQ ID NO: 288253 - DNA, 20 bp, Artificial Sequence
  Description of Artificial Sequence: Synthetic oligonucleotide
  Target: ATXN1; (+) strand; PAM type: YTN; PAM sequence: TTG
gaacataaaataaattttac

SEQ ID NO: 288254 - DNA, 20 bp, Artificial Sequence
  Description of Artificial Sequence: Synthetic oligonucleotide
  Target: ATXN1; (+) strand; PAM type: YTN; PAM sequence: TTT
tactacctttcaatattctg

SEQ ID NO: 288255 - DNA, 20 bp, Artificial Sequence
  Description of Artificial Sequence: Synthetic oligonucleotide
  Target: ATXN1; (+) strand; PAM type: YTN; PAM sequence: TTT
actacctttcaatattctgt

SEQ ID NO: 288256 - DNA, 20 bp, Artificial Sequence
  Description of Artificial Sequence: Synthetic oligonucleotide
  Target: ATXN1; (+) strand; PAM type: YTN; PAM sequence: TTA
ctacctttcaatattctgtg

SEQ ID NO: 288257 - DNA, 20 bp, Artificial Sequence
  Description of Artificial Sequence: Synthetic oligonucleotide
  Target: ATXN1; (+) strand; PAM type: YTN; PAM sequence: CTA
cctttcaatattctgtgacc

SEQ ID NO: 288258 - DNA, 20 bp, Artificial Sequence
  Description of Artificial Sequence: Synthetic oligonucleotide
  Target: ATXN1; (+) strand; PAM type: YTN; PAM sequence: CTT
tcaatattctgtgaccacaa

SEQ ID NO: 288259 - DNA, 20 bp, Artificial Sequence
  Description of Artificial Sequence: Synthetic oligonucleotide
  Target: ATXN1; (+) strand; PAM type: YTN; PAM sequence: TTT
caatattctgtgaccacaat

SEQ ID NO: 288260 - DNA, 20 bp, Artificial Sequence
  Description of Artificial Sequence: Synthetic oligonucleotide
  Target: ATXN1; (+) strand; PAM type: YTN; PAM sequence: TTC
aatattctgtgaccacaatg

SEQ ID NO: 288261 - DNA, 20 bp, Artificial Sequence
  Description of Artificial Sequence: Synthetic oligonucleotide
  Target: ATXN1; (+) strand; PAM type: YTN; PAM sequence: TTC
tgtgaccacaatgcaacaaa

SEQ ID NO: 288262 - DNA, 20 bp, Artificial Sequence
  Description of Artificial Sequence: Synthetic oligonucleotide
  Target: ATXN1; (+) strand; PAM type: YTN; PAM sequence: CTG
tgaccacaatgcaacaaaac

SEQ ID NO: 288263 - DNA, 20 bp, Artificial Sequence
  Description of Artificial Sequence: Synthetic oligonucleotide
  Target: ATXN1; (+) strand; PAM type: YTN; PAM sequence: CTC
attaatagacagaagtgtaa

SEQ ID NO: 288264 - DNA, 20 bp, Artificial Sequence
  Description of Artificial Sequence: Synthetic oligonucleotide
  Target: ATXN1; (+) strand; PAM type: YTN; PAM sequence: TTA
atagacagaagtgtaaacaa

SEQ ID NO: 288265 - DNA, 20 bp, Artificial Sequence
  Description of Artificial Sequence: Synthetic oligonucleotide
  Target: ATXN1; (+) strand; PAM type: YTN; PAM sequence: TTC
aaattaacttgtacattcaa

SEQ ID NO: 288266 - DNA, 20 bp, Artificial Sequence
  Description of Artificial Sequence: Synthetic oligonucleotide
  Target: ATXN1; (+) strand; PAM type: YTN; PAM sequence: TTA
acttgtacattcaaaaagaa

SEQ ID NO: 288267 - DNA, 20 bp, Artificial Sequence
  Description of Artificial Sequence: Synthetic oligonucleotide
  Target: ATXN1; (+) strand; PAM type: YTN; PAM sequence: CTT
gtacattcaaaaagaattct

SEQ ID NO: 288268 - DNA, 20 bp, Artificial Sequence
  Description of Artificial Sequence: Synthetic oligonucleotide
  Target: ATXN1; (+) strand; PAM type: YTN; PAM sequence: TTG
tacattcaaaaagaattctt

SEQ ID NO: 288269 - DNA, 20 bp, Artificial Sequence
  Description of Artificial Sequence: Synthetic oligonucleotide
  Target: ATXN1; (+) strand; PAM type: YTN; PAM sequence: TTC
aaaaagaattcttctaaata

SEQ ID NO: 288270 - DNA, 20 bp, Artificial Sequence
  Description of Artificial Sequence: Synthetic oligonucleotide
  Target: ATXN1; (+) strand; PAM type: YTN; PAM sequence: TTC
ttctaaataggtgtagagta

SEQ ID NO: 288271 - DNA, 20 bp, Artificial Sequence
  Description of Artificial Sequence: Synthetic oligonucleotide
  Target: ATXN1; (+) strand; PAM type: YTN; PAM sequence: CTT
ctaaataggtgtagagtata

SEQ ID NO: 288272 - DNA, 20 bp, Artificial Sequence
  Description of Artificial Sequence: Synthetic oligonucleotide
  Target: ATXN1; (+) strand; PAM type: YTN; PAM sequence: TTC
taaataggtgtagagtataa

SEQ ID NO: 288273 - DNA, 20 bp, Artificial Sequence
  Description of Artificial Sequence: Synthetic oligonucleotide
  Target: ATXN1; (+) strand; PAM type: YTN; PAM sequence: CTA
aataggtgtagagtataaaa

SEQ ID NO: 288274 - DNA, 20 bp, Artificial Sequence
  Description of Artificial Sequence: Synthetic oligonucleotide
  Target: ATXN1; (+) strand; PAM type: YTN; PAM sequence: TTA
tggaatcacagactgagaca

SEQ ID NO: 288275 - DNA, 20 bp, Artificial Sequence
  Description of Artificial Sequence: Synthetic oligonucleotide
  Target: ATXN1; (+) strand; PAM type: YTN; PAM sequence: CTG
agacaataaagataatgaga

SEQ ID NO: 288276 - DNA, 20 bp, Artificial Sequence
  Description of Artificial Sequence: Synthetic oligonucleotide
  Target: ATXN1; (+) strand; PAM type: YTN; PAM sequence: TTA
tgtatcaaagtgtaggcagc

SEQ ID NO: 288277 - DNA, 20 bp, Artificial Sequence
  Description of Artificial Sequence: Synthetic oligonucleotide
  Target: ATXN1; (+) strand; PAM type: YTN; PAM sequence: CTT
acagtcagaggcaaatatct

SEQ ID NO: 288278 - DNA, 20 bp, Artificial Sequence
  Description of Artificial Sequence: Synthetic oligonucleotide
  Target: ATXN1; (+) strand; PAM type: YTN; PAM sequence: TTA
cagtcagaggcaaatatctt

SEQ ID NO: 288279 - DNA, 20 bp, Artificial Sequence
  Description of Artificial Sequence: Synthetic oligonucleotide
  Target: ATXN1; (+) strand; PAM type: YTN; PAM sequence: CTT
tagtatttttatcattaaga

SEQ ID NO: 288280 - DNA, 20 bp, Artificial Sequence
  Description of Artificial Sequence: Synthetic oligonucleotide
  Target: ATXN1; (+) strand; PAM type: YTN; PAM sequence: TTT
agtatttttatcattaagaa

SEQ ID NO: 288281 - DNA, 20 bp, Artificial Sequence
  Description of Artificial Sequence: Synthetic oligonucleotide
  Target: ATXN1; (+) strand; PAM type: YTN; PAM sequence: TTA
gtatttttatcattaagaaa

SEQ ID NO: 288282 - DNA, 20 bp, Artificial Sequence
  Description of Artificial Sequence: Synthetic oligonucleotide
  Target: ATXN1; (+) strand; PAM type: YTN; PAM sequence: TTT
ttatcattaagaaaaattaa

SEQ ID NO: 288283 - DNA, 20 bp, Artificial Sequence
  Description of Artificial Sequence: Synthetic oligonucleotide
  Target: ATXN1; (+) strand; PAM type: YTN; PAM sequence: TTT
tatcattaagaaaaattaaa

SEQ ID NO: 288284 - DNA, 20 bp, Artificial Sequence
  Description of Artificial Sequence: Synthetic oligonucleotide
  Target: ATXN1; (+) strand; PAM type: YTN; PAM sequence: TTT
atcattaagaaaaattaaaa

SEQ ID NO: 288285 - DNA, 20 bp, Artificial Sequence
  Description of Artificial Sequence: Synthetic oligonucleotide
  Target: ATXN1; (+) strand; PAM type: YTN; PAM sequence: TTA
tcattaagaaaaattaaaaa

SEQ ID NO: 288286 - DNA, 20 bp, Artificial Sequence
  Description of Artificial Sequence: Synthetic oligonucleotide
  Target: ATXN1; (+) strand; PAM type: YTN; PAM sequence: TTA
agaaaaattaaaaataaaag

SEQ ID NO: 288287 - DNA, 20 bp, Artificial Sequence
  Description of Artificial Sequence: Synthetic oligonucleotide
  Target: ATXN1; (+) strand; PAM type: YTN; PAM sequence: TTA
aaaataaaagatcaactcaa

SEQ ID NO: 288288 - DNA, 20 bp, Artificial Sequence
  Description of Artificial Sequence: Synthetic oligonucleotide
  Target: ATXN1; (+) strand; PAM type: YTN; PAM sequence: CTC
aataaattagaaaagggggt

SEQ ID NO: 288289 - DNA, 20 bp, Artificial Sequence
  Description of Artificial Sequence: Synthetic oligonucleotide
  Target: ATXN1; (+) strand; PAM type: YTN; PAM sequence: TTA
gaaaagggggtgggacacgg

SEQ ID NO: 288290 - DNA, 20 bp, Artificial Sequence
  Description of Artificial Sequence: Synthetic oligonucleotide
  Target: ATXN1; (+) strand; PAM type: YTN; PAM sequence: CTC
acacctttgtaatcccagca

SEQ ID NO: 288291 - DNA, 20 bp, Artificial Sequence
  Description of Artificial Sequence: Synthetic oligonucleotide
  Target: ATXN1; (+) strand; PAM type: YTN; PAM sequence: CTT
tgtaatcccagcactttggg

SEQ ID NO: 288292 - DNA, 20 bp, Artificial Sequence
  Description of Artificial Sequence: Synthetic oligonucleotide
  Target: ATXN1; (+) strand; PAM type: YTN; PAM sequence: TTT
gtaatcccagcactttggga

SEQ ID NO: 288293 - DNA, 20 bp, Artificial Sequence
  Description of Artificial Sequence: Synthetic oligonucleotide
  Target: ATXN1; (+) strand; PAM type: YTN; PAM sequence: TTG
taatcccagcactttgggag

SEQ ID NO: 288294 - DNA, 20 bp, Artificial Sequence
  Description of Artificial Sequence: Synthetic oligonucleotide
  Target: ATXN1; (+) strand; PAM type: YTN; PAM sequence: CTT
tgggaggtcgggcaggcaga

SEQ ID NO: 288295 - DNA, 20 bp, Artificial Sequence
  Description of Artificial Sequence: Synthetic oligonucleotide
  Target: ATXN1; (+) strand; PAM type: YTN; PAM sequence: TTT
gggaggtcgggcaggcagat

SEQ ID NO: 288296 - DNA, 20 bp, Artificial Sequence
  Description of Artificial Sequence: Synthetic oligonucleotide
  Target: ATXN1; (+) strand; PAM type: YTN; PAM sequence: TTG
ggaggtcgggcaggcagatc

SEQ ID NO: 288297 - DNA, 20 bp, Artificial Sequence
  Description of Artificial Sequence: Synthetic oligonucleotide
  Target: ATXN1; (+) strand; PAM type: YTN; PAM sequence: TTG
agaccatcctggccaacatg

SEQ ID NO: 288298 - DNA, 20 bp, Artificial Sequence
  Description of Artificial Sequence: Synthetic oligonucleotide
  Target: ATXN1; (+) strand; PAM type: YTN; PAM sequence: CTG
gccaacatggcaaaactcca

SEQ ID NO: 288299 - DNA, 20 bp, Artificial Sequence
  Description of Artificial Sequence: Synthetic oligonucleotide
  Target: ATXN1; (+) strand; PAM type: YTN; PAM sequence: CTC
catctgtactaaaaatacaa

SEQ ID NO: 288300 - DNA, 20 bp, Artificial Sequence
  Description of Artificial Sequence: Synthetic oligonucleotide
  Target: ATXN1; (+) strand; PAM type: YTN; PAM sequence: CTG
tactaaaaatacaaaaatta

SEQ ID NO: 288301 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagctgg

SEQ ID NO: 288302 - DNA, 20 bp, Artificial Sequence
  Description of Artificial Sequence: Synthetic oligonucleotide
  Target: ATXN1; (+) strand; PAM type: YTN; PAM sequence: TTA
gctgggcatggtggcacgca

SEQ ID NO: 288303 - DNA, 20 bp, Artificial Sequence
  Description of Artificial Sequence: Synthetic oligonucleotide
  Target: ATXN1; (+) strand; PAM type: YTN; PAM sequence: CTG
ggcatggtggcacgcacctg

SEQ ID NO: 288304 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctacttgggag

SEQ ID NO: 288305 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgaggcagga

SEQ ID NO: 288306 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggcaggagaa

SEQ ID NO: 288307 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggagaat

SEQ ID NO: 288308 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcacttgaa

SEQ ID NO: 288309 - DNA, 20 bp, Artificial Sequence
  Description of Artificial Sequence: Synthetic oligonucleotide
  Target: ATXN1; (+) strand; PAM type: YTN; PAM sequence: CTT
gaacccgtaaggtggaggtt

SEQ ID NO: 288310 - DNA, 20 bp, Artificial Sequence
  Description of Artificial Sequence: Synthetic oligonucleotide
  Target: ATXN1; (+) strand; PAM type: YTN; PAM sequence: TTG
aacccgtaaggtggaggttg

SEQ ID NO: 288311 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagagtgcacc

SEQ ID NO: 288312 - DNA, 20 bp, Artificial Sequence
  Description of Artificial Sequence: Synthetic oligonucleotide
  Target: ATXN1; (+) strand; PAM type: YTN; PAM sequence: CTG
cactccagcctggtgacaga

SEQ ID NO: 288313 - DNA, 20 bp, Artificial Sequence
  Description of Artificial Sequence: Synthetic oligonucleotide
  Target: ATXN1; (+) strand; PAM type: YTN; PAM sequence: CTC
cagcctggtgacagagagag

SEQ ID NO: 288314 - DNA, 20 bp, Artificial Sequence
  Description of Artificial Sequence: Synthetic oligonucleotide
  Target: ATXN1; (+) strand; PAM type: YTN; PAM sequence: CTG
gtgacagagagagactctgt

SEQ ID NO: 288315 - DNA, 20 bp, Artificial Sequence
  Description of Artificial Sequence: Synthetic oligonucleotide
  Target: ATXN1; (+) strand; PAM type: YTN; PAM sequence: CTC
tgtcttaaaaaaaaaaaaaa

SEQ ID NO: 288316 - DNA, 20 bp, Artificial Sequence
  Description of Artificial Sequence: Synthetic oligonucleotide
  Target: ATXN1; (+) strand; PAM type: YTN; PAM sequence: CTG
tcttaaaaaaaaaaaaaaag

SEQ ID NO: 288317 - DNA, 20 bp, Artificial Sequence
  Description of Artificial Sequence: Synthetic oligonucleotide
  Target: ATXN1; (+) strand; PAM type: YTN; PAM sequence: CTT
aaaaaaaaaaaaaaagaaag

SEQ ID NO: 288318 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaaaaaaaagaaagg

SEQ ID NO: 288319 - DNA, 20 bp, Artificial Sequence
  Description of Artificial Sequence: Synthetic oligonucleotide
  Target: ATXN1; (+) strand; PAM type: YTN; PAM sequence: CTA
agaaaagcaatataaaggaa

SEQ ID NO: 288320 - DNA, 20 bp, Artificial Sequence
  Description of Artificial Sequence: Synthetic oligonucleotide
  Target: ATXN1; (+) strand; PAM type: YTN; PAM sequence: CTA
tccaaatgtgagataaaaat

SEQ ID NO: 288321 - DNA, 20 bp, Artificial Sequence
  Description of Artificial Sequence: Synthetic oligonucleotide
  Target: ATXN1; (+) strand; PAM type: YTN; PAM sequence: TTA
ttttggccgggcgcggtggc

SEQ ID NO: 288322 - DNA, 20 bp, Artificial Sequence
  Description of Artificial Sequence: Synthetic oligonucleotide
  Target: ATXN1; (+) strand; PAM type: YTN; PAM sequence: TTT
tggccgggcgcggtggctca

SEQ ID NO: 288323 - DNA, 20 bp, Artificial Sequence
  Description of Artificial Sequence: Synthetic oligonucleotide
  Target: ATXN1; (+) strand; PAM type: YTN; PAM sequence: TTT
ggccgggcgcggtggctcac

SEQ ID NO: 288324 - DNA, 20 bp, Artificial Sequence
  Description of Artificial Sequence: Synthetic oligonucleotide
  Target: ATXN1; (+) strand; PAM type: YTN; PAM sequence: TTG
gccgggcgcggtggctcacg

SEQ ID NO: 288325 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 288326 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 288327 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggcgggtgg

SEQ ID NO: 288328 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggcgggtgga

SEQ ID NO: 288329 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggcgggtggat

SEQ ID NO: 288330 - DNA, 20 bp, Artificial Sequence
  Description of Artificial Sequence: Synthetic oligonucleotide
  Target: ATXN1; (+) strand; PAM type: YTN; PAM sequence: CTG
gctaacaaggtgaaaccccg

SEQ ID NO: 288331 - DNA, 20 bp, Artificial Sequence
  Description of Artificial Sequence: Synthetic oligonucleotide
  Target: ATXN1; (+) strand; PAM type: YTN; PAM sequence: CTA
acaaggtgaaaccccgtctc

SEQ ID NO: 288332 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaaatt

SEQ ID NO: 288333 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaaattag

SEQ ID NO: 288334 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaaattagccg

SEQ ID NO: 288335 - DNA, 20 bp, Artificial Sequence
  Description of Artificial Sequence: Synthetic oligonucleotide
  Target: ATXN1; (+) strand; PAM type: YTN; PAM sequence: TTA
gccgggcgcggtggcgggcg

SEQ ID NO: 288336 - DNA, 20 bp, Artificial Sequence
  Description of Artificial Sequence: Synthetic oligonucleotide
  Target: ATXN1; (+) strand; PAM type: YTN; PAM sequence: CTG
tagtcccagccactcgggag

SEQ ID NO: 288337 - DNA, 20 bp, Artificial Sequence
  Description of Artificial Sequence: Synthetic oligonucleotide
  Target: ATXN1; (+) strand; PAM type: YTN; PAM sequence: CTC
gggaggctgaggcaggagaa

SEQ ID NO: 288338 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatggcgtgaa

SEQ ID NO: 288339 - DNA, 20 bp, Artificial Sequence
  Description of Artificial Sequence: Synthetic oligonucleotide
  Target: ATXN1; (+) strand; PAM type: YTN; PAM sequence: CTT
gcagtgagccgagattgtgc

SEQ ID NO: 288340 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagattgtgcc

SEQ ID NO: 288341 - DNA, 20 bp, Artificial Sequence
  Description of Artificial Sequence: Synthetic oligonucleotide
  Target: ATXN1; (+) strand; PAM type: YTN; PAM sequence: TTG
tgccactgcagtccgcagtc

SEQ ID NO: 288342 - DNA, 20 bp, Artificial Sequence
  Description of Artificial Sequence: Synthetic oligonucleotide
  Target: ATXN1; (+) strand; PAM type: YTN; PAM sequence: CTG
cagtccgcagtccggcctgg

SEQ ID NO: 288343 - DNA, 20 bp, Artificial Sequence
  Description of Artificial Sequence: Synthetic oligonucleotide
  Target: ATXN1; (+) strand; PAM type: YTN; PAM sequence: CTG
ggcgacagagcgagactccg

SEQ ID NO: 288344 - DNA, 20 bp, Artificial Sequence
  Description of Artificial Sequence: Synthetic oligonucleotide
  Target: ATXN1; (+) strand; PAM type: YTN; PAM sequence: CTC
cgtctcaaaaaaaaaaaaaa

SEQ ID NO: 288345 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaaaaa

SEQ ID NO: 288346 - DNA, 20 bp, Artificial Sequence
  Description of Artificial Sequence: Synthetic oligonucleotide
  Target: ATXN1; (+) strand; PAM type: YTN; PAM sequence: TTA
ttttaaaaggctattaatta

SEQ ID NO: 288347 - DNA, 20 bp, Artificial Sequence
  Description of Artificial Sequence: Synthetic oligonucleotide
  Target: ATXN1; (+) strand; PAM type: YTN; PAM sequence: TTT
taaaaggctattaattagct

SEQ ID NO: 288348 - DNA, 20 bp, Artificial Sequence
  Description of Artificial Sequence: Synthetic oligonucleotide
  Target: ATXN1; (+) strand; PAM type: YTN; PAM sequence: TTT
aaaaggctattaattagcta

SEQ ID NO: 288349 - DNA, 20 bp, Artificial Sequence
  Description of Artificial Sequence: Synthetic oligonucleotide
  Target: ATXN1; (+) strand; PAM type: YTN; PAM sequence: TTA
aaaggctattaattagctag

SEQ ID NO: 288350 - DNA, 20 bp, Artificial Sequence
  Description of Artificial Sequence: Synthetic oligonucleotide
  Target: ATXN1; (+) strand; PAM type: YTN; PAM sequence: CTA
ttaattagctagcagtaagt

SEQ ID NO: 288351 - DNA, 20 bp, Artificial Sequence
  Description of Artificial Sequence: Synthetic oligonucleotide
  Target: ATXN1; (+) strand; PAM type: YTN; PAM sequence: TTA
attagctagcagtaagtcta

SEQ ID NO: 288352 - DNA, 20 bp, Artificial Sequence
  Description of Artificial Sequence: Synthetic oligonucleotide
  Target: ATXN1; (+) strand; PAM type: YTN; PAM sequence: TTA
gctagcagtaagtctatctt

SEQ ID NO: 288353 - DNA, 20 bp, Artificial Sequence
  Description of Artificial Sequence: Synthetic oligonucleotide
  Target: ATXN1; (+) strand; PAM type: YTN; PAM sequence: CTA
gcagtaagtctatcttattt

SEQ ID NO: 288354 - DNA, 20 bp, Artificial Sequence
  Description of Artificial Sequence: Synthetic oligonucleotide
  Target: ATXN1; (+) strand; PAM type: YTN; PAM sequence: CTA
tcttatttttgcatatattt

SEQ ID NO: 288355 - DNA, 20 bp, Artificial Sequence
  Description of Artificial Sequence: Synthetic oligonucleotide
  Target: ATXN1; (+) strand; PAM type: YTN; PAM sequence: CTT
atttttgcatatattttaaa

SEQ ID NO: 288356 - DNA, 20 bp, Artificial Sequence
  Description of Artificial Sequence: Synthetic oligonucleotide
  Target: ATXN1; (+) strand; PAM type: YTN; PAM sequence: TTA
tttttgcatatattttaaaa

SEQ ID NO: 288357 - DNA, 20 bp, Artificial Sequence
  Description of Artificial Sequence: Synthetic oligonucleotide
  Target: ATXN1; (+) strand; PAM type: YTN; PAM sequence: TTT
ttgcatatattttaaaatat

SEQ ID NO: 288358 - DNA, 20 bp, Artificial Sequence
  Description of Artificial Sequence: Synthetic oligonucleotide
  Target: ATXN1; (+) strand; PAM type: YTN; PAM sequence: TTT
tgcatatattttaaaatata

SEQ ID NO: 288359 - DNA, 20 bp, Artificial Sequence
  Description of Artificial Sequence: Synthetic oligonucleotide
  Target: ATXN1; (+) strand; PAM type: YTN; PAM sequence: TTT
gcatatattttaaaatatat

SEQ ID NO: 288360 - DNA, 20 bp, Artificial Sequence
  Description of Artificial Sequence: Synthetic oligonucleotide
  Target: ATXN1; (+) strand; PAM type: YTN; PAM sequence: TTG
catatattttaaaatatata

SEQ ID NO: 288361 - DNA, 20 bp, Artificial Sequence
  Description of Artificial Sequence: Synthetic oligonucleotide
  Target: ATXN1; (+) strand; PAM type: YTN; PAM sequence: TTT
taaaatatatacaaaatgtt

SEQ ID NO: 288362 - DNA, 20 bp, Artificial Sequence
  Description of Artificial Sequence: Synthetic oligonucleotide
  Target: ATXN1; (+) strand; PAM type: YTN; PAM sequence: TTT
aaaatatatacaaaatgttt

SEQ ID NO: 288363 - DNA, 20 bp, Artificial Sequence
  Description of Artificial Sequence: Synthetic oligonucleotide
  Target: ATXN1; (+) strand; PAM type: YTN; PAM sequence: TTA
aaatatatacaaaatgtttt

SEQ ID NO: 288364 - DNA, 20 bp, Artificial Sequence
  Description of Artificial Sequence: Synthetic oligonucleotide
  Target: ATXN1; (+) strand; PAM type: YTN; PAM sequence: TTT
taaaatatatacaaaaataa

SEQ ID NO: 288365 - DNA, 20 bp, Artificial Sequence
  Description of Artificial Sequence: Synthetic oligonucleotide
  Target: ATXN1; (+) strand; PAM type: YTN; PAM sequence: TTT
aaaatatatacaaaaataag

SEQ ID NO: 288366 - DNA, 20 bp, Artificial Sequence
  Description of Artificial Sequence: Synthetic oligonucleotide
  Target: ATXN1; (+) strand; PAM type: YTN; PAM sequence: TTA
aaatatatacaaaaataaga

SEQ ID NO: 288367 - DNA, 20 bp, Artificial Sequence
  Description of Artificial Sequence: Synthetic oligonucleotide
  Target: ATXN1; (+) strand; PAM type: YTN; PAM sequence: TTG
acttactgctagctaatctt

SEQ ID NO: 288368 - DNA, 20 bp, Artificial Sequence
  Description of Artificial Sequence: Synthetic oligonucleotide
  Target: ATXN1; (+) strand; PAM type: YTN; PAM sequence: CTT
actgctagctaatcttaagt

SEQ ID NO: 288369 - DNA, 20 bp, Artificial Sequence
  Description of Artificial Sequence: Synthetic oligonucleotide
  Target: ATXN1; (+) strand; PAM type: YTN; PAM sequence: TTA
ctgctagctaatcttaagtt

SEQ ID NO: 288370 - DNA, 20 bp, Artificial Sequence
  Description of Artificial Sequence: Synthetic oligonucleotide
  Target: ATXN1; (+) strand; PAM type: YTN; PAM sequence: CTG
ctagctaatcttaagtttca

SEQ ID NO: 288371 - DNA, 20 bp, Artificial Sequence
  Description of Artificial Sequence: Synthetic oligonucleotide
  Target: ATXN1; (+) strand; PAM type: YTN; PAM sequence: CTA
gctaatcttaagtttcagag

SEQ ID NO: 288372 - DNA, 20 bp, Artificial Sequence
  Description of Artificial Sequence: Synthetic oligonucleotide
  Target: ATXN1; (+) strand; PAM type: YTN; PAM sequence: CTA
atcttaagtttcagagaaca

SEQ ID NO: 288373 - DNA, 20 bp, Artificial Sequence
  Description of Artificial Sequence: Synthetic oligonucleotide
  Target: ATXN1; (+) strand; PAM type: YTN; PAM sequence: CTT
aagtttcagagaacaaacca

SEQ ID NO: 288374 - DNA, 20 bp, Artificial Sequence
  Description of Artificial Sequence: Synthetic oligonucleotide
  Target: ATXN1; (+) strand; PAM type: YTN; PAM sequence: TTA
agtttcagagaacaaaccaa

SEQ ID NO: 288375 - DNA, 20 bp, Artificial Sequence
  Description of Artificial Sequence: Synthetic oligonucleotide
  Target: ATXN1; (+) strand; PAM type: YTN; PAM sequence: TTT
cagagaacaaaccaaattaa

SEQ ID NO: 288376 - DNA, 20 bp, Artificial Sequence
  Description of Artificial Sequence: Synthetic oligonucleotide
  Target: ATXN1; (+) strand; PAM type: YTN; PAM sequence: TTC
agagaacaaaccaaattaaa

SEQ ID NO: 288377 - DNA, 20 bp, Artificial Sequence
  Description of Artificial Sequence: Synthetic oligonucleotide
  Target: ATXN1; (+) strand; PAM type: YTN; PAM sequence: TTA
aaaataagaagtggaataaa

SEQ ID NO: 288378 - DNA, 20 bp, Artificial Sequence
  Description of Artificial Sequence: Synthetic oligonucleotide
  Target: ATXN1; (+) strand; PAM type: YTN; PAM sequence: TTC
acaaatattgagaatgtttt

SEQ ID NO: 288379 - DNA, 20 bp, Artificial Sequence
  Description of Artificial Sequence: Synthetic oligonucleotide
  Target: ATXN1; (+) strand; PAM type: YTN; PAM sequence: TTG
agaatgttttaaatttttaa

SEQ ID NO: 288380 - DNA, 20 bp, Artificial Sequence
  Description of Artificial Sequence: Synthetic oligonucleotide
  Target: ATXN1; (+) strand; PAM type: YTN; PAM sequence: TTT
taaatttttaaaatatgtaa

SEQ ID NO: 288381 - DNA, 20 bp, Artificial Sequence
  Description of Artificial Sequence: Synthetic oligonucleotide
  Target: ATXN1; (+) strand; PAM type: YTN; PAM sequence: TTT
aaatttttaaaatatgtaat

SEQ ID NO: 288382 - DNA, 20 bp, Artificial Sequence
  Description of Artificial Sequence: Synthetic oligonucleotide
  Target: ATXN1; (+) strand; PAM type: YTN; PAM sequence: TTA
aatttttaaaatatgtaata

SEQ ID NO: 288383 - DNA, 20 bp, Artificial Sequence
  Description of Artificial Sequence: Synthetic oligonucleotide
  Target: ATXN1; (+) strand; PAM type: YTN; PAM sequence: TTT
ttaaaatatgtaatatttga

SEQ ID NO: 288384 - DNA, 20 bp, Artificial Sequence
  Description of Artificial Sequence: Synthetic oligonucleotide
  Target: ATXN1; (+) strand; PAM type: YTN; PAM sequence: TTT
taaaatatgtaatatttgac

SEQ ID NO: 288385 - DNA, 20 bp, Artificial Sequence
  Description of Artificial Sequence: Synthetic oligonucleotide
  Target: ATXN1; (+) strand; PAM type: YTN; PAM sequence: TTT
aaaatatgtaatatttgact

SEQ ID NO: 288386 - DNA, 20 bp, Artificial Sequence
  Description of Artificial Sequence: Synthetic oligonucleotide
  Target: ATXN1; (+) strand; PAM type: YTN; PAM sequence: TTA
aaatatgtaatatttgactg

SEQ ID NO: 288387 - DNA, 20 bp, Artificial Sequence
  Description of Artificial Sequence: Synthetic oligonucleotide
  Target: ATXN1; (+) strand; PAM type: YTN; PAM sequence: TTT
gactgtgttaacaaaatttt

SEQ ID NO: 288388 - DNA, 20 bp, Artificial Sequence
  Description of Artificial Sequence: Synthetic oligonucleotide
  Target: ATXN1; (+) strand; PAM type: YTN; PAM sequence: TTG
actgtgttaacaaaattttg

SEQ ID NO: 288389 - DNA, 20 bp, Artificial Sequence
  Description of Artificial Sequence: Synthetic oligonucleotide
  Target: ATXN1; (+) strand; PAM type: YTN; PAM sequence: CTG
tgttaacaaaattttgaata

SEQ ID NO: 288390 - DNA, 20 bp, Artificial Sequence
  Description of Artificial Sequence: Synthetic oligonucleotide
  Target: ATXN1; (+) strand; PAM type: YTN; PAM sequence: TTA
acaaaattttgaatatagaa

SEQ ID NO: 288391 - DNA, 20 bp, Artificial Sequence
  Description of Artificial Sequence: Synthetic oligonucleotide
  Target: ATXN1; (+) strand; PAM type: YTN; PAM sequence: TTT
tgaatatagaaatggtcagg

SEQ ID NO: 288392 - DNA, 20 bp, Artificial Sequence
  Description of Artificial Sequence: Synthetic oligonucleotide
  Target: ATXN1; (+) strand; PAM type: YTN; PAM sequence: TTT
gaatatagaaatggtcaggt

SEQ ID NO: 288393 - DNA, 20 bp, Artificial Sequence
  Description of Artificial Sequence: Synthetic oligonucleotide
  Target: ATXN1; (+) strand; PAM type: YTN; PAM sequence: TTG
aatatagaaatggtcaggtc

SEQ ID NO: 288394 - DNA, 20 bp, Artificial Sequence
  Description of Artificial Sequence: Synthetic oligonucleotide
  Target: ATXN1; (+) strand; PAM type: YTN; PAM sequence: CTC
acacctgtaatccccatgct

SEQ ID NO: 288395 - DNA, 20 bp, Artificial Sequence
  Description of Artificial Sequence: Synthetic oligonucleotide
  Target: ATXN1; (+) strand; PAM type: YTN; PAM sequence: CTG
taatccccatgctttgggag

SEQ ID NO: 288396 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgaggcaggatt

SEQ ID NO: 288397 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaggcaggattg

SEQ ID NO: 288398 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggattgc

SEQ ID NO: 288399 - DNA, 20 bp, Artificial Sequence
  Description of Artificial Sequence: Synthetic oligonucleotide
  Target: ATXN1; (+) strand; PAM type: YTN; PAM sequence: CTG
aggcaggattgctcaaggca

SEQ ID NO: 288400 - DNA, 20 bp, Artificial Sequence
  Description of Artificial Sequence: Synthetic oligonucleotide
  Target: ATXN1; (+) strand; PAM type: YTN; PAM sequence: TTG
ctcaaggcaggagtttgaga

SEQ ID NO: 288401 - DNA, 20 bp, Artificial Sequence
  Description of Artificial Sequence: Synthetic oligonucleotide
  Target: ATXN1; (+) strand; PAM type: YTN; PAM sequence: CTC
aaggcaggagtttgagacca

SEQ ID NO: 288402 - DNA, 20 bp, Artificial Sequence
  Description of Artificial Sequence: Synthetic oligonucleotide
  Target: ATXN1; (+) strand; PAM type: YTN; PAM sequence: TTT
gagaccagcctgagcaatat

SEQ ID NO: 288403 - DNA, 20 bp, Artificial Sequence
  Description of Artificial Sequence: Synthetic oligonucleotide
  Target: ATXN1; (+) strand; PAM type: YTN; PAM sequence: TTG
agaccagcctgagcaatata

SEQ ID NO: 288404 - DNA, 20 bp, Artificial Sequence
  Description of Artificial Sequence: Synthetic oligonucleotide
  Target: ATXN1; (+) strand; PAM type: YTN; PAM sequence: CTG
agcaatatagtgagacccca

SEQ ID NO: 288405 - DNA, 20 bp, Artificial Sequence
  Description of Artificial Sequence: Synthetic oligonucleotide
  Target: ATXN1; (+) strand; PAM type: YTN; PAM sequence: CTC
tacaaaaaagttaaaaaaga

SEQ ID NO: 288406 - DNA, 20 bp, Artificial Sequence
  Description of Artificial Sequence: Synthetic oligonucleotide
  Target: ATXN1; (+) strand; PAM type: YTN; PAM sequence: CTA
caaaaaagttaaaaaagaaa

SEQ ID NO: 288407 - DNA, 20 bp, Artificial Sequence
  Description of Artificial Sequence: Synthetic oligonucleotide
  Target: ATXN1; (+) strand; PAM type: YTN; PAM sequence: TTA
aaaaagaaaaagagccaggc

SEQ ID NO: 288408 - DNA, 20 bp, Artificial Sequence
  Description of Artificial Sequence: Synthetic oligonucleotide
  Target: ATXN1; (+) strand; PAM type: YTN; PAM sequence: CTG
cagtcccagctacttgggag

SEQ ID NO: 288409 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgaggcggga

SEQ ID NO: 288410 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggcgggagga

SEQ ID NO: 288411 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcgggaggat

SEQ ID NO: 288412 - DNA, 20 bp, Artificial Sequence
  Description of Artificial Sequence: Synthetic oligonucleotide
  Target: ATXN1; (+) strand; PAM type: YTN; PAM sequence: CTG
aggcgggaggattgcttgag

SEQ ID NO: 288413 - DNA, 20 bp, Artificial Sequence
  Description of Artificial Sequence: Synthetic oligonucleotide
  Target: ATXN1; (+) strand; PAM type: YTN; PAM sequence: TTG
cttgagcccaggggttcaag

SEQ ID NO: 288414 - DNA, 20 bp, Artificial Sequence
  Description of Artificial Sequence: Synthetic oligonucleotide
  Target: ATXN1; (+) strand; PAM type: YTN; PAM sequence: CTT
gagcccaggggttcaaggtt

SEQ ID NO: 288415 - DNA, 20 bp, Artificial Sequence
  Description of Artificial Sequence: Synthetic oligonucleotide
  Target: ATXN1; (+) strand; PAM type: YTN; PAM sequence: TTG
agcccaggggttcaaggttg

SEQ ID NO: 288416 - DNA, 20 bp, Artificial Sequence
  Description of Artificial Sequence: Synthetic oligonucleotide
  Target: ATXN1; (+) strand; PAM type: YTN; PAM sequence: TTC
aaggttgcagtgagctatga

SEQ ID NO: 288417 - DNA, 20 bp, Artificial Sequence
  Description of Artificial Sequence: Synthetic oligonucleotide
  Target: ATXN1; (+) strand; PAM type: YTN; PAM sequence: TTG
cagtgagctatgactgcacc

SEQ ID NO: 288418 - DNA, 20 bp, Artificial Sequence
  Description of Artificial Sequence: Synthetic oligonucleotide
  Target: ATXN1; (+) strand; PAM type: YTN; PAM sequence: CTA
tgactgcaccactgcactcc

SEQ ID NO: 288419 - DNA, 20 bp, Artificial Sequence
  Description of Artificial Sequence: Synthetic oligonucleotide
  Target: ATXN1; (+) strand; PAM type: YTN; PAM sequence: CTG
caccactgcactccagcctg

SEQ ID NO: 288420 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggcaacag

SEQ ID NO: 288421 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcaacagagcaa

SEQ ID NO: 288422 - DNA, 20 bp, Artificial Sequence
  Description of Artificial Sequence: Synthetic oligonucleotide
  Target: ATXN1; (+) strand; PAM type: YTN; PAM sequence: CTG
ggcaacagagcaagaccctg

SEQ ID NO: 288423 - DNA, 20 bp, Artificial Sequence
  Description of Artificial Sequence: Synthetic oligonucleotide
  Target: ATXN1; (+) strand; PAM type: YTN; PAM sequence: CTG
tcttgataaaataaaataat

SEQ ID NO: 288424 - DNA, 20 bp, Artificial Sequence
  Description of Artificial Sequence: Synthetic oligonucleotide
  Target: ATXN1; (+) strand; PAM type: YTN; PAM sequence: CTT
gataaaataaaataatataa

SEQ ID NO: 288425 - DNA, 20 bp, Artificial Sequence
  Description of Artificial Sequence: Synthetic oligonucleotide
  Target: ATXN1; (+) strand; PAM type: YTN; PAM sequence: TTG
ataaaataaaataatataaa

SEQ ID NO: 288426 - DNA, 20 bp, Artificial Sequence
  Description of Artificial Sequence: Synthetic oligonucleotide
  Target: ATXN1; (+) strand; PAM type: YTN; PAM sequence: TTT
tctagaaacattaaaatgct

SEQ ID NO: 288427 - DNA, 20 bp, Artificial Sequence
  Description of Artificial Sequence: Synthetic oligonucleotide
  Target: ATXN1; (+) strand; PAM type: YTN; PAM sequence: TTT
ctagaaacattaaaatgctt

SEQ ID NO: 288428 - DNA, 20 bp, Artificial Sequence
  Description of Artificial Sequence: Synthetic oligonucleotide
  Target: ATXN1; (+) strand; PAM type: YTN; PAM sequence: TTC
tagaaacattaaaatgcttt

SEQ ID NO: 288429 - DNA, 20 bp, Artificial Sequence
  Description of Artificial Sequence: Synthetic oligonucleotide
  Target: ATXN1; (+) strand; PAM type: YTN; PAM sequence: CTA
gaaacattaaaatgctttaa

SEQ ID NO: 288430 - DNA, 20 bp, Artificial Sequence
  Description of Artificial Sequence: Synthetic oligonucleotide
  Target: ATXN1; (+) strand; PAM type: YTN; PAM sequence: TTA
aaatgctttaatattaattt

SEQ ID NO: 288431 - DNA, 20 bp, Artificial Sequence
  Description of Artificial Sequence: Synthetic oligonucleotide
  Target: ATXN1; (+) strand; PAM type: YTN; PAM sequence: CTT
taatattaatttaagaagta

SEQ ID NO: 288432 - DNA, 20 bp, Artificial Sequence
  Description of Artificial Sequence: Synthetic oligonucleotide
  Target: ATXN1; (+) strand; PAM type: YTN; PAM sequence: TTT
aatattaatttaagaagtaa

SEQ ID NO: 288433 - DNA, 20 bp, Artificial Sequence
  Description of Artificial Sequence: Synthetic oligonucleotide
  Target: ATXN1; (+) strand; PAM type: YTN; PAM sequence: TTA
atattaatttaagaagtaaa

SEQ ID NO: 288434 - DNA, 20 bp, Artificial Sequence
  Description of Artificial Sequence: Synthetic oligonucleotide
  Target: ATXN1; (+) strand; PAM type: YTN; PAM sequence: TTA
atttaagaagtaaaaatcct

SEQ ID NO: 288435 - DNA, 20 bp, Artificial Sequence
  Description of Artificial Sequence: Synthetic oligonucleotide
  Target: ATXN1; (+) strand; PAM type: YTN; PAM sequence: TTT
aagaagtaaaaatcctgatc

SEQ ID NO: 288436 - DNA, 20 bp, Artificial Sequence
  Description of Artificial Sequence: Synthetic oligonucleotide
  Target: ATXN1; (+) strand; PAM type: YTN; PAM sequence: TTA
agaagtaaaaatcctgatca

SEQ ID NO: 288437 - DNA, 20 bp, Artificial Sequence
  Description of Artificial Sequence: Synthetic oligonucleotide
  Target: ATXN1; (+) strand; PAM type: YTN; PAM sequence: CTG
atcaaaaaaattattataga

SEQ ID NO: 288438 - DNA, 20 bp, Artificial Sequence
  Description of Artificial Sequence: Synthetic oligonucleotide
  Target: ATXN1; (+) strand; PAM type: YTN; PAM sequence: TTA
ttatagacaaacttttaggg

SEQ ID NO: 288439 - DNA, 20 bp, Artificial Sequence
  Description of Artificial Sequence: Synthetic oligonucleotide
  Target: ATXN1; (+) strand; PAM type: YTN; PAM sequence: TTA
tagacaaacttttaggggtg

SEQ ID NO: 288440 - DNA, 20 bp, Artificial Sequence
  Description of Artificial Sequence: Synthetic oligonucleotide
  Target: ATXN1; (+) strand; PAM type: YTN; PAM sequence: CTT
ttaggggtggggaggctttc

SEQ ID NO: 288441 - DNA, 20 bp, Artificial Sequence
  Description of Artificial Sequence: Synthetic oligonucleotide
  Target: ATXN1; (+) strand; PAM type: YTN; PAM sequence: TTT
taggggtggggaggctttca

SEQ ID NO: 288442 - DNA, 20 bp, Artificial Sequence
  Description of Artificial Sequence: Synthetic oligonucleotide
  Target: ATXN1; (+) strand; PAM type: YTN; PAM sequence: TTT
aggggtggggaggctttcat

SEQ ID NO: 288443 - DNA, 20 bp, Artificial Sequence
  Description of Artificial Sequence: Synthetic oligonucleotide
  Target: ATXN1; (+) strand; PAM type: YTN; PAM sequence: TTA
ggggtggggaggctttcata

SEQ ID NO: 288444 - DNA, 20 bp, Artificial Sequence
  Description of Artificial Sequence: Synthetic oligonucleotide
  Target: ATXN1; (+) strand; PAM type: YTN; PAM sequence: CTT
tcataatataacaaccaaaa

SEQ ID NO: 288445 - DNA, 20 bp, Artificial Sequence
  Description of Artificial Sequence: Synthetic oligonucleotide
  Target: ATXN1; (+) strand; PAM type: YTN; PAM sequence: TTT
cataatataacaaccaaaaa

SEQ ID NO: 288446 - DNA, 20 bp, Artificial Sequence
  Description of Artificial Sequence: Synthetic oligonucleotide
  Target: ATXN1; (+) strand; PAM type: YTN; PAM sequence: TTC
ataatataacaaccaaaaaa

SEQ ID NO: 288447 - DNA, 20 bp, Artificial Sequence
  Description of Artificial Sequence: Synthetic oligonucleotide
  Target: ATXN1; (+) strand; PAM type: YTN; PAM sequence: TTC
taataactttggggacaggt

SEQ ID NO: 288448 - DNA, 20 bp, Artificial Sequence
  Description of Artificial Sequence: Synthetic oligonucleotide
  Target: ATXN1; (+) strand; PAM type: YTN; PAM sequence: CTA
ataactttggggacaggtaa

SEQ ID NO: 288449 - DNA, 20 bp, Artificial Sequence
  Description of Artificial Sequence: Synthetic oligonucleotide
  Target: ATXN1; (+) strand; PAM type: YTN; PAM sequence: CTT
tggggacaggtaatttcaaa

SEQ ID NO: 288450 - DNA, 20 bp, Artificial Sequence
  Description of Artificial Sequence: Synthetic oligonucleotide
  Target: ATXN1; (+) strand; PAM type: YTN; PAM sequence: TTT
ggggacaggtaatttcaaag

SEQ ID NO: 288451 - DNA, 20 bp, Artificial Sequence
  Description of Artificial Sequence: Synthetic oligonucleotide
  Target: ATXN1; (+) strand; PAM type: YTN; PAM sequence: TTG
gggacaggtaatttcaaagc

SEQ ID NO: 288452 - DNA, 20 bp, Artificial Sequence
  Description of Artificial Sequence: Synthetic oligonucleotide
  Target: ATXN1; (+) strand; PAM type: YTN; PAM sequence: TTT
caaagcttccaggatgctac

SEQ ID NO: 288453 - DNA, 20 bp, Artificial Sequence
  Description of Artificial Sequence: Synthetic oligonucleotide
  Target: ATXN1; (+) strand; PAM type: YTN; PAM sequence: TTC
aaagcttccaggatgctaca

SEQ ID NO: 288454 - DNA, 20 bp, Artificial Sequence
  Description of Artificial Sequence: Synthetic oligonucleotide
  Target: ATXN1; (+) strand; PAM type: YTN; PAM sequence: CTT
ccaggatgctacatgtgcct

SEQ ID NO: 288455 - DNA, 20 bp, Artificial Sequence
  Description of Artificial Sequence: Synthetic oligonucleotide
  Target: ATXN1; (+) strand; PAM type: YTN; PAM sequence: TTC
caggatgctacatgtgcctt

SEQ ID NO: 288456 - DNA, 20 bp, Artificial Sequence
  Description of Artificial Sequence: Synthetic oligonucleotide
  Target: ATXN1; (+) strand; PAM type: YTN; PAM sequence: CTA
catgtgccttaatgggggca

SEQ ID NO: 288457 - DNA, 20 bp, Artificial Sequence
  Description of Artificial Sequence: Synthetic oligonucleotide
  Target: ATXN1; (+) strand; PAM type: YTN; PAM sequence: CTT
aatgggggcaaaggtaccct

SEQ ID NO: 288458 - DNA, 20 bp, Artificial Sequence
  Description of Artificial Sequence: Synthetic oligonucleotide
  Target: ATXN1; (+) strand; PAM type: YTN; PAM sequence: TTA
atgggggcaaaggtaccctt

SEQ ID NO: 288459 - DNA, 20 bp, Artificial Sequence
  Description of Artificial Sequence: Synthetic oligonucleotide
  Target: ATXN1; (+) strand; PAM type: YTN; PAM sequence: CTT
cctttctctcacttttcttc

SEQ ID NO: 288460 - DNA, 20 bp, Artificial Sequence
  Description of Artificial Sequence: Synthetic oligonucleotide
  Target: ATXN1; (+) strand; PAM type: YTN; PAM sequence: TTC
ctttctctcacttttcttct

SEQ ID NO: 288461 - DNA, 20 bp, Artificial Sequence
  Description of Artificial Sequence: Synthetic oligonucleotide
  Target: ATXN1; (+) strand; PAM type: YTN; PAM sequence: CTT
tctctcacttttcttctcct

SEQ ID NO: 288462 - DNA, 20 bp, Artificial Sequence
  Description of Artificial Sequence: Synthetic oligonucleotide
  Target: ATXN1; (+) strand; PAM type: YTN; PAM sequence: TTT
ctctcacttttcttctcctt

SEQ ID NO: 288463 - DNA, 20 bp, Artificial Sequence
  Description of Artificial Sequence: Synthetic oligonucleotide
  Target: ATXN1; (+) strand; PAM type: YTN; PAM sequence: TTC
tctcacttttcttctccttg

SEQ ID NO: 288464 - DNA, 20 bp, Artificial Sequence
  Description of Artificial Sequence: Synthetic oligonucleotide
  Target: ATXN1; (+) strand; PAM type: YTN; PAM sequence: CTC
tcacttttcttctccttgag

SEQ ID NO: 288465 - DNA, 20 bp, Artificial Sequence
  Description of Artificial Sequence: Synthetic oligonucleotide
  Target: ATXN1; (+) strand; PAM type: YTN; PAM sequence: CTC
acttttcttctccttgaggc

SEQ ID NO: 288466 - DNA, 20 bp, Artificial Sequence
  Description of Artificial Sequence: Synthetic oligonucleotide
  Target: ATXN1; (+) strand; PAM type: YTN; PAM sequence: CTT
ttcttctccttgaggcaact

SEQ ID NO: 288467 - DNA, 20 bp, Artificial Sequence
  Description of Artificial Sequence: Synthetic oligonucleotide
  Target: ATXN1; (+) strand; PAM type: YTN; PAM sequence: TTT
tcttctccttgaggcaactc

SEQ ID NO: 288468 - DNA, 20 bp, Artificial Sequence
  Description of Artificial Sequence: Synthetic oligonucleotide
  Target: ATXN1; (+) strand; PAM type: YTN; PAM sequence: TTT
cttctccttgaggcaactca

SEQ ID NO: 288469 - DNA, 20 bp, Artificial Sequence
  Description of Artificial Sequence: Synthetic oligonucleotide
  Target: ATXN1; (+) strand; PAM type: YTN; PAM sequence: TTC
ttctccttgaggcaactcag

SEQ ID NO: 288470 - DNA, 20 bp, Artificial Sequence
  Description of Artificial Sequence: Synthetic oligonucleotide
  Target: ATXN1; (+) strand; PAM type: YTN; PAM sequence: CTT
ctccttgaggcaactcagag

SEQ ID NO: 288471 - DNA, 20 bp, Artificial Sequence
  Description of Artificial Sequence: Synthetic oligonucleotide
  Target: ATXN1; (+) strand; PAM type: YTN; PAM sequence: TTC
tccttgaggcaactcagagg

SEQ ID NO: 288472 - DNA, 20 bp, Artificial Sequence
  Description of Artificial Sequence: Synthetic oligonucleotide
  Target: ATXN1; (+) strand; PAM type: YTN; PAM sequence: CTC
cttgaggcaactcagaggag

SEQ ID NO: 288473 - DNA, 20 bp, Artificial Sequence
  Description of Artificial Sequence: Synthetic oligonucleotide
  Target: ATXN1; (+) strand; PAM type: YTN; PAM sequence: CTT
gaggcaactcagaggagcga

SEQ ID NO: 288474 - DNA, 20 bp, Artificial Sequence
  Description of Artificial Sequence: Synthetic oligonucleotide
  Target: ATXN1; (+) strand; PAM type: YTN; PAM sequence: TTG
aggcaactcagaggagcgat

SEQ ID NO: 288475 - DNA, 20 bp, Artificial Sequence
  Description of Artificial Sequence: Synthetic oligonucleotide
  Target: ATXN1; (+) strand; PAM type: YTN; PAM sequence: CTC
agaggagcgattgtggaaat

SEQ ID NO: 288476 - DNA, 20 bp, Artificial Sequence
  Description of Artificial Sequence: Synthetic oligonucleotide
  Target: ATXN1; (+) strand; PAM type: YTN; PAM sequence: TTG
tggaaatttccgaagctgct

SEQ ID NO: 288477 - DNA, 20 bp, Artificial Sequence
  Description of Artificial Sequence: Synthetic oligonucleotide
  Target: ATXN1; (+) strand; PAM type: YTN; PAM sequence: TTT
ccgaagctgctatatgtcag

SEQ ID NO: 288478 - DNA, 20 bp, Artificial Sequence
  Description of Artificial Sequence: Synthetic oligonucleotide
  Target: ATXN1; (+) strand; PAM type: YTN; PAM sequence: TTC
cgaagctgctatatgtcagc

SEQ ID NO: 288479 - DNA, 20 bp, Artificial Sequence
  Description of Artificial Sequence: Synthetic oligonucleotide
  Target: ATXN1; (+) strand; PAM type: YTN; PAM sequence: CTG
ctatatgtcagcttgcccat

SEQ ID NO: 288480 - DNA, 20 bp, Artificial Sequence
  Description of Artificial Sequence: Synthetic oligonucleotide
  Target: ATXN1; (+) strand; PAM type: YTN; PAM sequence: CTA
tatgtcagcttgcccatttg

SEQ ID NO: 288481 - DNA, 20 bp, Artificial Sequence
  Description of Artificial Sequence: Synthetic oligonucleotide
  Target: ATXN1; (+) strand; PAM type: YTN; PAM sequence: CTT
gcccatttgtatggaatttc

SEQ ID NO: 288482 - DNA, 20 bp, Artificial Sequence
  Description of Artificial Sequence: Synthetic oligonucleotide
  Target: ATXN1; (+) strand; PAM type: YTN; PAM sequence: TTG
cccatttgtatggaatttca

SEQ ID NO: 288483 - DNA, 20 bp, Artificial Sequence
  Description of Artificial Sequence: Synthetic oligonucleotide
  Target: ATXN1; (+) strand; PAM type: YTN; PAM sequence: TTT
gtatggaatttcatggtttt

SEQ ID NO: 288484 - DNA, 20 bp, Artificial Sequence
  Description of Artificial Sequence: Synthetic oligonucleotide
  Target: ATXN1; (+) strand; PAM type: YTN; PAM sequence: TTG
tatggaatttcatggttttt

SEQ ID NO: 288485 - DNA, 20 bp, Artificial Sequence
  Description of Artificial Sequence: Synthetic oligonucleotide
  Target: ATXN1; (+) strand; PAM type: YTN; PAM sequence: TTT
catggtttttttgacaagtc

SEQ ID NO: 288486 - DNA, 20 bp, Artificial Sequence
  Description of Artificial Sequence: Synthetic oligonucleotide
  Target: ATXN1; (+) strand; PAM type: YTN; PAM sequence: TTC
atggtttttttgacaagtca

SEQ ID NO: 288487 - DNA, 20 bp, Artificial Sequence
  Description of Artificial Sequence: Synthetic oligonucleotide
  Target: ATXN1; (+) strand; PAM type: YTN; PAM sequence: TTT
ttttgacaagtcagtctttt

SEQ ID NO: 288488 - DNA, 20 bp, Artificial Sequence
  Description of Artificial Sequence: Synthetic oligonucleotide
  Target: ATXN1; (+) strand; PAM type: YTN; PAM sequence: TTT
tttgacaagtcagtcttttt

SEQ ID NO: 288489 - DNA, 20 bp, Artificial Sequence
  Description of Artificial Sequence: Synthetic oligonucleotide
  Target: ATXN1; (+) strand; PAM type: YTN; PAM sequence: TTT
ttgacaagtcagtctttttg

SEQ ID NO: 288490 - DNA, 20 bp, Artificial Sequence
  Description of Artificial Sequence: Synthetic oligonucleotide
  Target: ATXN1; (+) strand; PAM type: YTN; PAM sequence: TTT
tgacaagtcagtctttttgt

SEQ ID NO: 288491 - DNA, 20 bp, Artificial Sequence
  Description of Artificial Sequence: Synthetic oligonucleotide
  Target: ATXN1; (+) strand; PAM type: YTN; PAM sequence: TTT
gacaagtcagtctttttgtc

SEQ ID NO: 288492 - DNA, 20 bp, Artificial Sequence
  Description of Artificial Sequence: Synthetic oligonucleotide
  Target: ATXN1; (+) strand; PAM type: YTN; PAM sequence: TTG
acaagtcagtctttttgtca

SEQ ID NO: 288493 - DNA, 20 bp, Artificial Sequence
  Description of Artificial Sequence: Synthetic oligonucleotide
  Target: ATXN1; (+) strand; PAM type: YTN; PAM sequence: CTT
tttgtcatcatcgcatcttg

SEQ ID NO: 288494 - DNA, 20 bp, Artificial Sequence
  Description of Artificial Sequence: Synthetic oligonucleotide
  Target: ATXN1; (+) strand; PAM type: YTN; PAM sequence: TTT
ttgtcatcatcgcatcttga

SEQ ID NO: 288495 - DNA, 20 bp, Artificial Sequence
  Description of Artificial Sequence: Synthetic oligonucleotide
  Target: ATXN1; (+) strand; PAM type: YTN; PAM sequence: TTT
tgtcatcatcgcatcttgag

SEQ ID NO: 288496 - DNA, 20 bp, Artificial Sequence
  Description of Artificial Sequence: Synthetic oligonucleotide
  Target: ATXN1; (+) strand; PAM type: YTN; PAM sequence: TTT
gtcatcatcgcatcttgaga

SEQ ID NO: 288497 - DNA, 20 bp, Artificial Sequence
  Description of Artificial Sequence: Synthetic oligonucleotide
  Target: ATXN1; (+) strand; PAM type: YTN; PAM sequence: TTG
tcatcatcgcatcttgagag

SEQ ID NO: 288498 - DNA, 20 bp, Artificial Sequence
  Description of Artificial Sequence: Synthetic oligonucleotide
  Target: ATXN1; (+) strand; PAM type: YTN; PAM sequence: CTT
gagagtagagaggaagggaa

SEQ ID NO: 288499 - DNA, 20 bp, Artificial Sequence
  Description of Artificial Sequence: Synthetic oligonucleotide
  Target: ATXN1; (+) strand; PAM type: YTN; PAM sequence: TTG
agagtagagaggaagggaat

SEQ ID NO: 288500 - DNA, 20 bp, Artificial Sequence
  Description of Artificial Sequence: Synthetic oligonucleotide
  Target: ATXN1; (+) strand; PAM type: YTN; PAM sequence: CTG
ttactatcagaggcttctgg

SEQ ID NO: 288501 - DNA, 20 bp, Artificial Sequence
  Description of Artificial Sequence: Synthetic oligonucleotide
  Target: ATXN1; (+) strand; PAM type: YTN; PAM sequence: TTA
ctatcagaggcttctggaaa

SEQ ID NO: 288502 - DNA, 20 bp, Artificial Sequence
  Description of Artificial Sequence: Synthetic oligonucleotide
  Target: ATXN1; (+) strand; PAM type: YTN; PAM sequence: CTA
tcagaggcttctggaaatcc

SEQ ID NO: 288503 - DNA, 20 bp, Artificial Sequence
  Description of Artificial Sequence: Synthetic oligonucleotide
  Target: ATXN1; (+) strand; PAM type: YTN; PAM sequence: CTT
ctggaaatccccgcttgatg

SEQ ID NO: 288504 - DNA, 20 bp, Artificial Sequence
  Description of Artificial Sequence: Synthetic oligonucleotide
  Target: ATXN1; (+) strand; PAM type: YTN; PAM sequence: TTC
tggaaatccccgcttgatgg

SEQ ID NO: 288505 - DNA, 20 bp, Artificial Sequence
  Description of Artificial Sequence: Synthetic oligonucleotide
  Target: ATXN1; (+) strand; PAM type: YTN; PAM sequence: CTG
gaaatccccgcttgatggta

SEQ ID NO: 288506 - DNA, 20 bp, Artificial Sequence
  Description of Artificial Sequence: Synthetic oligonucleotide
  Target: ATXN1; (+) strand; PAM type: YTN; PAM sequence: CTT
gatggtacatgactctttct

SEQ ID NO: 288507 - DNA, 20 bp, Artificial Sequence
  Description of Artificial Sequence: Synthetic oligonucleotide
  Target: ATXN1; (+) strand; PAM type: YTN; PAM sequence: TTG
atggtacatgactctttctt

SEQ ID NO: 288508 - DNA, 20 bp, Artificial Sequence
  Description of Artificial Sequence: Synthetic oligonucleotide
  Target: ATXN1; (+) strand; PAM type: YTN; PAM sequence: CTC
tttcttaagaatggttctct

SEQ ID NO: 288509 - DNA, 20 bp, Artificial Sequence
  Description of Artificial Sequence: Synthetic oligonucleotide
  Target: ATXN1; (+) strand; PAM type: YTN; PAM sequence: CTT
tcttaagaatggttctcttt

SEQ ID NO: 288510 - DNA, 20 bp, Artificial Sequence
  Description of Artificial Sequence: Synthetic oligonucleotide
  Target: ATXN1; (+) strand; PAM type: YTN; PAM sequence: TTT
cttaagaatggttctctttt

SEQ ID NO: 288511 - DNA, 20 bp, Artificial Sequence
  Description of Artificial Sequence: Synthetic oligonucleotide
  Target: ATXN1; (+) strand; PAM type: YTN; PAM sequence: TTC
ttaagaatggttctctttta

SEQ ID NO: 288512 - DNA, 20 bp, Artificial Sequence
  Description of Artificial Sequence: Synthetic oligonucleotide
  Target: ATXN1; (+) strand; PAM type: YTN; PAM sequence: CTT
aagaatggttctcttttatg

SEQ ID NO: 288513 - DNA, 20 bp, Artificial Sequence
  Description of Artificial Sequence: Synthetic oligonucleotide
  Target: ATXN1; (+) strand; PAM type: YTN; PAM sequence: TTA
agaatggttctcttttatgg

SEQ ID NO: 288514 - DNA, 20 bp, Artificial Sequence
  Description of Artificial Sequence: Synthetic oligonucleotide
  Target: ATXN1; (+) strand; PAM type: YTN; PAM sequence: TTC
tcttttatgggttgccattt

SEQ ID NO: 288515 - DNA, 20 bp, Artificial Sequence
  Description of Artificial Sequence: Synthetic oligonucleotide
  Target: ATXN1; (+) strand; PAM type: YTN; PAM sequence: CTC
ttttatgggttgccattttg

SEQ ID NO: 288516 - DNA, 20 bp, Artificial Sequence
  Description of Artificial Sequence: Synthetic oligonucleotide
  Target: ATXN1; (+) strand; PAM type: YTN; PAM sequence: CTT
ttatgggttgccattttggt

SEQ ID NO: 288517 - DNA, 20 bp, Artificial Sequence
  Description of Artificial Sequence: Synthetic oligonucleotide
  Target: ATXN1; (+) strand; PAM type: YTN; PAM sequence: TTT
tatgggttgccattttggtg

SEQ ID NO: 288518 - DNA, 20 bp, Artificial Sequence
  Description of Artificial Sequence: Synthetic oligonucleotide
  Target: ATXN1; (+) strand; PAM type: YTN; PAM sequence: TTT
atgggttgccattttggtga

SEQ ID NO: 288519 - DNA, 20 bp, Artificial Sequence
  Description of Artificial Sequence: Synthetic oligonucleotide
  Target: ATXN1; (+) strand; PAM type: YTN; PAM sequence: TTA
tgggttgccattttggtgac

SEQ ID NO: 288520 - DNA, 20 bp, Artificial Sequence
  Description of Artificial Sequence: Synthetic oligonucleotide
  Target: ATXN1; (+) strand; PAM type: YTN; PAM sequence: TTG
ccattttggtgacaattggt

SEQ ID NO: 288521 - DNA, 20 bp, Artificial Sequence
  Description of Artificial Sequence: Synthetic oligonucleotide
  Target: ATXN1; (+) strand; PAM type: YTN; PAM sequence: TTT
tggtgacaattggtgcactc

SEQ ID NO: 288522 - DNA, 20 bp, Artificial Sequence
  Description of Artificial Sequence: Synthetic oligonucleotide
  Target: ATXN1; (+) strand; PAM type: YTN; PAM sequence: TTT
ggtgacaattggtgcactca

SEQ ID NO: 288523 - DNA, 20 bp, Artificial Sequence
  Description of Artificial Sequence: Synthetic oligonucleotide
  Target: ATXN1; (+) strand; PAM type: YTN; PAM sequence: TTG
gtgacaattggtgcactcag

SEQ ID NO: 288524 - DNA, 20 bp, Artificial Sequence
  Description of Artificial Sequence: Synthetic oligonucleotide
  Target: ATXN1; (+) strand; PAM type: YTN; PAM sequence: TTG
gtgcactcagctctacctct

SEQ ID NO: 288525 - DNA, 20 bp, Artificial Sequence
  Description of Artificial Sequence: Synthetic oligonucleotide
  Target: ATXN1; (+) strand; PAM type: YTN; PAM sequence: CTC
agctctacctcttggtgggc

SEQ ID NO: 288526 - DNA, 20 bp, Artificial Sequence
  Description of Artificial Sequence: Synthetic oligonucleotide
  Target: ATXN1; (+) strand; PAM type: YTN; PAM sequence: CTC
tacctcttggtgggccccag

SEQ ID NO: 288527 - DNA, 20 bp, Artificial Sequence
  Description of Artificial Sequence: Synthetic oligonucleotide
  Target: ATXN1; (+) strand; PAM type: YTN; PAM sequence: CTA
cctcttggtgggccccagtg

SEQ ID NO: 288528 - DNA, 20 bp, Artificial Sequence
  Description of Artificial Sequence: Synthetic oligonucleotide
  Target: ATXN1; (+) strand; PAM type: YTN; PAM sequence: CTC
ttggtgggccccagtgtact

SEQ ID NO: 288529 - DNA, 20 bp, Artificial Sequence
  Description of Artificial Sequence: Synthetic oligonucleotide
  Target: ATXN1; (+) strand; PAM type: YTN; PAM sequence: CTT
ggtgggccccagtgtacttc

SEQ ID NO: 288530 - DNA, 20 bp, Artificial Sequence
  Description of Artificial Sequence: Synthetic oligonucleotide
  Target: ATXN1; (+) strand; PAM type: YTN; PAM sequence: TTG
gtgggccccagtgtacttca

SEQ ID NO: 288531 - DNA, 20 bp, Artificial Sequence
  Description of Artificial Sequence: Synthetic oligonucleotide
  Target: ATXN1; (+) strand; PAM type: YTN; PAM sequence: CTT
cagcatgatctcagttcttt

SEQ ID NO: 288532 - DNA, 20 bp, Artificial Sequence
  Description of Artificial Sequence: Synthetic oligonucleotide
  Target: ATXN1; (+) strand; PAM type: YTN; PAM sequence: TTC
agcatgatctcagttctttc

SEQ ID NO: 288533 - DNA, 20 bp, Artificial Sequence
  Description of Artificial Sequence: Synthetic oligonucleotide
  Target: ATXN1; (+) strand; PAM type: YTN; PAM sequence: CTC
agttctttctttctctacca

SEQ ID NO: 288534 - DNA, 20 bp, Artificial Sequence
  Description of Artificial Sequence: Synthetic oligonucleotide
  Target: ATXN1; (+) strand; PAM type: YTN; PAM sequence: TTC
tttctttctctaccagtttc

SEQ ID NO: 288535 - DNA, 20 bp, Artificial Sequence
  Description of Artificial Sequence: Synthetic oligonucleotide
  Target: ATXN1; (+) strand; PAM type: YTN; PAM sequence: CTT
tctttctctaccagtttcca

SEQ ID NO: 288536 - DNA, 20 bp, Artificial Sequence
  Description of Artificial Sequence: Synthetic oligonucleotide
  Target: ATXN1; (+) strand; PAM type: YTN; PAM sequence: TTT
ctttctctaccagtttccat

SEQ ID NO: 288537 - DNA, 20 bp, Artificial Sequence
  Description of Artificial Sequence: Synthetic oligonucleotide
  Target: ATXN1; (+) strand; PAM type: YTN; PAM sequence: TTC
tttctctaccagtttccatg

SEQ ID NO: 288538 - DNA, 20 bp, Artificial Sequence
  Description of Artificial Sequence: Synthetic oligonucleotide
  Target: ATXN1; (+) strand; PAM type: YTN; PAM sequence: CTT
tctctaccagtttccatgat

SEQ ID NO: 288539 - DNA, 20 bp, Artificial Sequence
  Description of Artificial Sequence: Synthetic oligonucleotide
  Target: ATXN1; (+) strand; PAM type: YTN; PAM sequence: TTT
ctctaccagtttccatgata

SEQ ID NO: 288540 - DNA, 20 bp, Artificial Sequence
  Description of Artificial Sequence: Synthetic oligonucleotide
  Target: ATXN1; (+) strand; PAM type: YTN; PAM sequence: TTC
tctaccagtttccatgatac

SEQ ID NO: 288541 - DNA, 20 bp, Artificial Sequence
  Description of Artificial Sequence: Synthetic oligonucleotide
  Target: ATXN1; (+) strand; PAM type: YTN; PAM sequence: CTC
taccagtttccatgatacat

SEQ ID NO: 288542 - DNA, 20 bp, Artificial Sequence
  Description of Artificial Sequence: Synthetic oligonucleotide
  Target: ATXN1; (+) strand; PAM type: YTN; PAM sequence: CTA
ccagtttccatgatacatac

SEQ ID NO: 288543 - DNA, 20 bp, Artificial Sequence
  Description of Artificial Sequence: Synthetic oligonucleotide
  Target: ATXN1; (+) strand; PAM type: YTN; PAM sequence: TTT
ccatgatacatacatcctga

SEQ ID NO: 288544 - DNA, 20 bp, Artificial Sequence
  Description of Artificial Sequence: Synthetic oligonucleotide
  Target: ATXN1; (+) strand; PAM type: YTN; PAM sequence: TTC
catgatacatacatcctgaa

SEQ ID NO: 288545 - DNA, 20 bp, Artificial Sequence
  Description of Artificial Sequence: Synthetic oligonucleotide
  Target: ATXN1; (+) strand; PAM type: YTN; PAM sequence: CTG
aaaatcacagcatcaccatt

SEQ ID NO: 288546 - DNA, 20 bp, Artificial Sequence
  Description of Artificial Sequence: Synthetic oligonucleotide
  Target: ATXN1; (+) strand; PAM type: YTN; PAM sequence: TTC
aatagacaaaaattatcatt

SEQ ID NO: 288547 - DNA, 20 bp, Artificial Sequence
  Description of Artificial Sequence: Synthetic oligonucleotide
  Target: ATXN1; (+) strand; PAM type: YTN; PAM sequence: TTA
tcattatcaaagcggccaaa

SEQ ID NO: 288548 - DNA, 20 bp, Artificial Sequence
  Description of Artificial Sequence: Synthetic oligonucleotide
  Target: ATXN1; (+) strand; PAM type: YTN; PAM sequence: TTA
tcaaagcggccaaaaaggtt

SEQ ID NO: 288549 - DNA, 20 bp, Artificial Sequence
  Description of Artificial Sequence: Synthetic oligonucleotide
  Target: ATXN1; (+) strand; PAM type: YTN; PAM sequence: TTT
tctcttaaatattctgtggg

SEQ ID NO: 288550 - DNA, 20 bp, Artificial Sequence
  Description of Artificial Sequence: Synthetic oligonucleotide
  Target: ATXN1; (+) strand; PAM type: YTN; PAM sequence: TTT
ctcttaaatattctgtggga

SEQ ID NO: 288551 - DNA, 20 bp, Artificial Sequence
  Description of Artificial Sequence: Synthetic oligonucleotide
  Target: ATXN1; (+) strand; PAM type: YTN; PAM sequence: TTC
tcttaaatattctgtgggaa

SEQ ID NO: 288552 - DNA, 20 bp, Artificial Sequence
  Description of Artificial Sequence: Synthetic oligonucleotide
  Target: ATXN1; (+) strand; PAM type: YTN; PAM sequence: CTC
ttaaatattctgtgggaaag

SEQ ID NO: 288553 - DNA, 20 bp, Artificial Sequence
  Description of Artificial Sequence: Synthetic oligonucleotide
  Target: ATXN1; (+) strand; PAM type: YTN; PAM sequence: CTT
aaatattctgtgggaaagag

SEQ ID NO: 288554 - DNA, 20 bp, Artificial Sequence
  Description of Artificial Sequence: Synthetic oligonucleotide
  Target: ATXN1; (+) strand; PAM type: YTN; PAM sequence: TTA
aatattctgtgggaaagagg

SEQ ID NO: 288555 - DNA, 20 bp, Artificial Sequence
  Description of Artificial Sequence: Synthetic oligonucleotide
  Target: ATXN1; (+) strand; PAM type: YTN; PAM sequence: TTC
tgtgggaaagagggttgaaa

SEQ ID NO: 288556 - DNA, 20 bp, Artificial Sequence
  Description of Artificial Sequence: Synthetic oligonucleotide
  Target: ATXN1; (+) strand; PAM type: YTN; PAM sequence: CTG
tgggaaagagggttgaaaat

SEQ ID NO: 288557 - DNA, 20 bp, Artificial Sequence
  Description of Artificial Sequence: Synthetic oligonucleotide
  Target: ATXN1; (+) strand; PAM type: YTN; PAM sequence: TTG
aaaattagaatagaatacta

SEQ ID NO: 288558 - DNA, 20 bp, Artificial Sequence
  Description of Artificial Sequence: Synthetic oligonucleotide
  Target: ATXN1; (+) strand; PAM type: YTN; PAM sequence: TTA
gaatagaatactatgtattt

SEQ ID NO: 288559 - DNA, 20 bp, Artificial Sequence
  Description of Artificial Sequence: Synthetic oligonucleotide
  Target: ATXN1; (+) strand; PAM type: YTN; PAM sequence: CTA
tgtatttgccacagtaaaag

SEQ ID NO: 288560 - DNA, 20 bp, Artificial Sequence
  Description of Artificial Sequence: Synthetic oligonucleotide
  Target: ATXN1; (+) strand; PAM type: YTN; PAM sequence: TTT
gccacagtaaaagatatcta

SEQ ID NO: 288561 - DNA, 20 bp, Artificial Sequence
  Description of Artificial Sequence: Synthetic oligonucleotide
  Target: ATXN1; (+) strand; PAM type: YTN; PAM sequence: TTG
ccacagtaaaagatatctac

SEQ ID NO: 288562 - DNA, 20 bp, Artificial Sequence
  Description of Artificial Sequence: Synthetic oligonucleotide
  Target: ATXN1; (+) strand; PAM type: YTN; PAM sequence: CTA
ccacaaaccagtagccaata

SEQ ID NO: 288563 - DNA, 20 bp, Artificial Sequence
  Description of Artificial Sequence: Synthetic oligonucleotide
  Target: ATXN1; (+) strand; PAM type: YTN; PAM sequence: TTA
tattaaaagttaaaaacaag

SEQ ID NO: 288564 - DNA, 20 bp, Artificial Sequence
  Description of Artificial Sequence: Synthetic oligonucleotide
  Target: ATXN1; (+) strand; PAM type: YTN; PAM sequence: TTA
aaagttaaaaacaagagtca

SEQ ID NO: 288565 - DNA, 20 bp, Artificial Sequence
  Description of Artificial Sequence: Synthetic oligonucleotide
  Target: ATXN1; (+) strand; PAM type: YTN; PAM sequence: TTA
aaaacaagagtcaatgatta

SEQ ID NO: 288566 - DNA, 20 bp, Artificial Sequence
  Description of Artificial Sequence: Synthetic oligonucleotide
  Target: ATXN1; (+) strand; PAM type: YTN; PAM sequence: TTA
aattcaggccacatgcggtg

SEQ ID NO: 288567 - DNA, 20 bp, Artificial Sequence
  Description of Artificial Sequence: Synthetic oligonucleotide
  Target: ATXN1; (+) strand; PAM type: YTN; PAM sequence: TTC
aggccacatgcggtggctca

SEQ ID NO: 288568 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaaccccagcact

SEQ ID NO: 288569 - DNA, 20 bp, Artificial Sequence
  Description of Artificial Sequence: Synthetic oligonucleotide
  Target: ATXN1; (+) strand; PAM type: YTN; PAM sequence: CTG
taaccccagcactttgggag

SEQ ID NO: 288570 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgaagcgggtgg

SEQ ID NO: 288571 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaagcgggtgga

SEQ ID NO: 288572 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaagcgggtggat

SEQ ID NO: 288573 - DNA, 20 bp, Artificial Sequence
  Description of Artificial Sequence: Synthetic oligonucleotide
  Target: ATXN1; (+) strand; PAM type: YTN; PAM sequence: CTG
aagcgggtggatcacttgag

SEQ ID NO: 288574 - DNA, 20 bp, Artificial Sequence
  Description of Artificial Sequence: Synthetic oligonucleotide
  Target: ATXN1; (+) strand; PAM type: YTN; PAM sequence: CTT
gaggtcaggagtttgagacc

SEQ ID NO: 288575 - DNA, 20 bp, Artificial Sequence
  Description of Artificial Sequence: Synthetic oligonucleotide
  Target: ATXN1; (+) strand; PAM type: YTN; PAM sequence: TTG
aggtcaggagtttgagacca

SEQ ID NO: 288576 - DNA, 20 bp, Artificial Sequence
  Description of Artificial Sequence: Synthetic oligonucleotide
  Target: ATXN1; (+) strand; PAM type: YTN; PAM sequence: TTT
gagaccagcctggcgaacat

SEQ ID NO: 288577 - DNA, 20 bp, Artificial Sequence
  Description of Artificial Sequence: Synthetic oligonucleotide
  Target: ATXN1; (+) strand; PAM type: YTN; PAM sequence: TTG
agaccagcctggcgaacatg

SEQ ID NO: 288578 - DNA, 20 bp, Artificial Sequence
  Description of Artificial Sequence: Synthetic oligonucleotide
  Target: ATXN1; (+) strand; PAM type: YTN; PAM sequence: CTG
gcgaacatggtgaaactccg

SEQ ID NO: 288579 - DNA, 20 bp, Artificial Sequence
  Description of Artificial Sequence: Synthetic oligonucleotide
  Target: ATXN1; (+) strand; PAM type: YTN; PAM sequence: CTC
cgtctctactaaaaatacaa

SEQ ID NO: 288580 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 288581 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 288582 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagccag

SEQ ID NO: 288583 - DNA, 20 bp, Artificial Sequence
  Description of Artificial Sequence: Synthetic oligonucleotide
  Target: ATXN1; (+) strand; PAM type: YTN; PAM sequence: TTA
gccaggcgtggtgttgcatg

SEQ ID NO: 288584 - DNA, 20 bp, Artificial Sequence
  Description of Artificial Sequence: Synthetic oligonucleotide
  Target: ATXN1; (+) strand; PAM type: YTN; PAM sequence: TTG
catgcctgtaatcccagata

SEQ ID NO: 288585 - DNA, 20 bp, Artificial Sequence
  Description of Artificial Sequence: Synthetic oligonucleotide
  Target: ATXN1; (+) strand; PAM type: YTN; PAM sequence: CTG
taatcccagatacttgggag

SEQ ID NO: 288586 - DNA, 20 bp, Artificial Sequence
  Description of Artificial Sequence: Synthetic oligonucleotide
  Target: ATXN1; (+) strand; PAM type: YTN; PAM sequence: CTT
gggagtctgaggccggagaa

SEQ ID NO: 288587 - DNA, 20 bp, Artificial Sequence
  Description of Artificial Sequence: Synthetic oligonucleotide
  Target: ATXN1; (+) strand; PAM type: YTN; PAM sequence: TTG
ggagtctgaggccggagaat

SEQ ID NO: 288588 - DNA, 20 bp, Artificial Sequence
  Description of Artificial Sequence: Synthetic oligonucleotide
  Target: ATXN1; (+) strand; PAM type: YTN; PAM sequence: CTG
aggccggagaatcacttgag

SEQ ID NO: 288589 - DNA, 20 bp, Artificial Sequence
  Description of Artificial Sequence: Synthetic oligonucleotide
  Target: ATXN1; (+) strand; PAM type: YTN; PAM sequence: CTT
gagcctgggaggcagaggtt

SEQ ID NO: 288590 - DNA, 20 bp, Artificial Sequence
  Description of Artificial Sequence: Synthetic oligonucleotide
  Target: ATXN1; (+) strand; PAM type: YTN; PAM sequence: TTG
agcctgggaggcagaggttg

SEQ ID NO: 288591 - DNA, 20 bp, Artificial Sequence
  Description of Artificial Sequence: Synthetic oligonucleotide
  Target: ATXN1; (+) strand; PAM type: YTN; PAM sequence: CTG
ggaggcagaggttgcaatga

SEQ ID NO: 288592 - DNA, 20 bp, Artificial Sequence
  Description of Artificial Sequence: Synthetic oligonucleotide
  Target: ATXN1; (+) strand; PAM type: YTN; PAM sequence: TTG
caatgagccaagatcgtgtg

SEQ ID NO: 288593 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggcaacag

SEQ ID NO: 288594 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcaacagagcaa

SEQ ID NO: 288595 - DNA, 20 bp, Artificial Sequence
  Description of Artificial Sequence: Synthetic oligonucleotide
  Target: ATXN1; (+) strand; PAM type: YTN; PAM sequence: CTG
ggcaacagagcaagaccctg

SEQ ID NO: 288596 - DNA, 20 bp, Artificial Sequence
  Description of Artificial Sequence: Synthetic oligonucleotide
  Target: ATXN1; (+) strand; PAM type: YTN; PAM sequence: CTG
tcttgataaaataaaatgaa

SEQ ID NO: 288597 - DNA, 20 bp, Artificial Sequence
  Description of Artificial Sequence: Synthetic oligonucleotide
  Target: ATXN1; (+) strand; PAM type: YTN; PAM sequence: CTT
gataaaataaaatgaaataa

SEQ ID NO: 288598 - DNA, 20 bp, Artificial Sequence
  Description of Artificial Sequence: Synthetic oligonucleotide
  Target: ATXN1; (+) strand; PAM type: YTN; PAM sequence: TTG
ataaaataaaatgaaataaa

SEQ ID NO: 288599 - DNA, 20 bp, Artificial Sequence
  Description of Artificial Sequence: Synthetic oligonucleotide
  Target: ATXN1; (+) strand; PAM type: YTN; PAM sequence: TTT
tctagaaacattaaaatgct

SEQ ID NO: 288600 - DNA, 20 bp, Artificial Sequence
  Description of Artificial Sequence: Synthetic oligonucleotide
  Target: ATXN1; (+) strand; PAM type: YTN; PAM sequence: TTT
ctagaaacattaaaatgctt

SEQ ID NO: 288601 - DNA, 20 bp, Artificial Sequence
  Description of Artificial Sequence: Synthetic oligonucleotide
  Target: ATXN1; (+) strand; PAM type: YTN; PAM sequence: TTC
tagaaacattaaaatgcttt

SEQ ID NO: 288602 - DNA, 20 bp, Artificial Sequence
  Description of Artificial Sequence: Synthetic oligonucleotide
  Target: ATXN1; (+) strand; PAM type: YTN; PAM sequence: CTA
gaaacattaaaatgctttaa

SEQ ID NO: 288603 - DNA, 20 bp, Artificial Sequence
  Description of Artificial Sequence: Synthetic oligonucleotide
  Target: ATXN1; (+) strand; PAM type: YTN; PAM sequence: TTA
aaatgctttaatattaattt

SEQ ID NO: 288604 - DNA, 20 bp, Artificial Sequence
  Description of Artificial Sequence: Synthetic oligonucleotide
  Target: ATXN1; (+) strand; PAM type: YTN; PAM sequence: CTT
taatattaatttaagaagta

SEQ ID NO: 288605 - DNA, 20 bp, Artificial Sequence
  Description of Artificial Sequence: Synthetic oligonucleotide
  Target: ATXN1; (+) strand; PAM type: YTN; PAM sequence: TTT
aatattaatttaagaagtaa

SEQ ID NO: 288606 - DNA, 20 bp, Artificial Sequence
  Description of Artificial Sequence: Synthetic oligonucleotide
  Target: ATXN1; (+) strand; PAM type: YTN; PAM sequence: TTA
atattaatttaagaagtaaa

SEQ ID NO: 288607 - DNA, 20 bp, Artificial Sequence
  Description of Artificial Sequence: Synthetic oligonucleotide
  Target: ATXN1; (+) strand; PAM type: YTN; PAM sequence: TTA
atttaagaagtaaaaatcct

SEQ ID NO: 288608 - DNA, 20 bp, Artificial Sequence
  Description of Artificial Sequence: Synthetic oligonucleotide
  Target: ATXN1; (+) strand; PAM type: YTN; PAM sequence: TTT
aagaagtaaaaatcctgatc

SEQ ID NO: 288609 - DNA, 20 bp, Artificial Sequence
  Description of Artificial Sequence: Synthetic oligonucleotide
  Target: ATXN1; (+) strand; PAM type: YTN; PAM sequence: TTA
agaagtaaaaatcctgatca

SEQ ID NO: 288610 - DNA, 20 bp, Artificial Sequence
  Description of Artificial Sequence: Synthetic oligonucleotide
  Target: ATXN1; (+) strand; PAM type: YTN; PAM sequence: CTG
atcaaaaaaattattataga

SEQ ID NO: 288611 - DNA, 20 bp, Artificial Sequence
  Description of Artificial Sequence: Synthetic oligonucleotide
  Target: ATXN1; (+) strand; PAM type: YTN; PAM sequence: TTA
ttatagacaaacttttaggg

SEQ ID NO: 288612 - DNA, 20 bp, Artificial Sequence
  Description of Artificial Sequence: Synthetic oligonucleotide
  Target: ATXN1; (+) strand; PAM type: YTN; PAM sequence: TTA
tagacaaacttttaggggtg

SEQ ID NO: 288613 - DNA, 20 bp, Artificial Sequence
  Description of Artificial Sequence: Synthetic oligonucleotide
  Target: ATXN1; (+) strand; PAM type: YTN; PAM sequence: CTT
ttaggggtggggaggctttc

SEQ ID NO: 288614 - DNA, 20 bp, Artificial Sequence
  Description of Artificial Sequence: Synthetic oligonucleotide
  Target: ATXN1; (+) strand; PAM type: YTN; PAM sequence: TTT
taggggtggggaggctttca

SEQ ID NO: 288615 - DNA, 20 bp, Artificial Sequence
  Description of Artificial Sequence: Synthetic oligonucleotide
  Target: ATXN1; (+) strand; PAM type: YTN; PAM sequence: TTT
aggggtggggaggctttcat

SEQ ID NO: 288616 - DNA, 20 bp, Artificial Sequence
  Description of Artificial Sequence: Synthetic oligonucleotide
  Target: ATXN1; (+) strand; PAM type: YTN; PAM sequence: TTA
ggggtggggaggctttcata

SEQ ID NO: 288617 - DNA, 20 bp, Artificial Sequence
  Description of Artificial Sequence: Synthetic oligonucleotide
  Target: ATXN1; (+) strand; PAM type: YTN; PAM sequence: CTT
tcataatataacaaccaaaa

SEQ ID NO: 288618 - DNA, 20 bp, Artificial Sequence
  Description of Artificial Sequence: Synthetic oligonucleotide
  Target: ATXN1; (+) strand; PAM type: YTN; PAM sequence: TTT
cataatataacaaccaaaaa

SEQ ID NO: 288619 - DNA, 20 bp, Artificial Sequence
  Description of Artificial Sequence: Synthetic oligonucleotide
  Target: ATXN1; (+) strand; PAM type: YTN; PAM sequence: TTC
ataatataacaaccaaaaaa

SEQ ID NO: 288620 - DNA, 20 bp, Artificial Sequence
  Description of Artificial Sequence: Synthetic oligonucleotide
  Target: ATXN1; (+) strand; PAM type: YTN; PAM sequence: TTC
taataactttggggacaggt

SEQ ID NO: 288621 - DNA, 20 bp, Artificial Sequence
  Description of Artificial Sequence: Synthetic oligonucleotide
  Target: ATXN1; (+) strand; PAM type: YTN; PAM sequence: CTA
ataactttggggacaggtaa

SEQ ID NO: 288622 - DNA, 20 bp, Artificial Sequence
  Description of Artificial Sequence: Synthetic oligonucleotide
  Target: ATXN1; (+) strand; PAM type: YTN; PAM sequence: CTT
tggggacaggtaatttcaaa

SEQ ID NO: 288623 - DNA, 20 bp, Artificial Sequence
  Description of Artificial Sequence: Synthetic oligonucleotide
  Target: ATXN1; (+) strand; PAM type: YTN; PAM sequence: TTT
ggggacaggtaatttcaaag

SEQ ID NO: 288624 - DNA, 20 bp, Artificial Sequence
  Description of Artificial Sequence: Synthetic oligonucleotide
  Target: ATXN1; (+) strand; PAM type: YTN; PAM sequence: TTG
gggacaggtaatttcaaagc

SEQ ID NO: 288625 - DNA, 20 bp, Artificial Sequence
  Description of Artificial Sequence: Synthetic oligonucleotide
  Target: ATXN1; (+) strand; PAM type: YTN; PAM sequence: TTT
caaagcttccaggatgctac

SEQ ID NO: 288626 - DNA, 20 bp, Artificial Sequence
  Description of Artificial Sequence: Synthetic oligonucleotide
  Target: ATXN1; (+) strand; PAM type: YTN; PAM sequence: TTC
aaagcttccaggatgctaca

SEQ ID NO: 288627 - DNA, 20 bp, Artificial Sequence
  Description of Artificial Sequence: Synthetic oligonucleotide
  Target: ATXN1; (+) strand; PAM type: YTN; PAM sequence: CTT
ccaggatgctacatgtgcct

SEQ ID NO: 288628 - DNA, 20 bp, Artificial Sequence
  Description of Artificial Sequence: Synthetic oligonucleotide
  Target: ATXN1; (+) strand; PAM type: YTN; PAM sequence: TTC
caggatgctacatgtgcctt

SEQ ID NO: 288629 - DNA, 20 bp, Artificial Sequence
  Description of Artificial Sequence: Synthetic oligonucleotide
  Target: ATXN1; (+) strand; PAM type: YTN; PAM sequence: CTA
catgtgccttaatgggggca

SEQ ID NO: 288630 - DNA, 20 bp, Artificial Sequence
  Description of Artificial Sequence: Synthetic oligonucleotide
  Target: ATXN1; (+) strand; PAM type: YTN; PAM sequence: CTT
aatgggggcaaaggtaccct

SEQ ID NO: 288631 - DNA, 20 bp, Artificial Sequence
  Description of Artificial Sequence: Synthetic oligonucleotide
  Target: ATXN1; (+) strand; PAM type: YTN; PAM sequence: TTA
atgggggcaaaggtaccctt

SEQ ID NO: 288632 - DNA, 20 bp, Artificial Sequence
  Description of Artificial Sequence: Synthetic oligonucleotide
  Target: ATXN1; (+) strand; PAM type: YTN; PAM sequence: CTT
cctttctctcacttttcttc

SEQ ID NO: 288633 - DNA, 20 bp, Artificial Sequence
  Description of Artificial Sequence: Synthetic oligonucleotide
  Target: ATXN1; (+) strand; PAM type: YTN; PAM sequence: TTC
ctttctctcacttttcttct

SEQ ID NO: 288634 - DNA, 20 bp, Artificial Sequence
  Description of Artificial Sequence: Synthetic oligonucleotide
  Target: ATXN1; (+) strand; PAM type: YTN; PAM sequence: CTT
tctctcacttttcttctcct

SEQ ID NO: 288635 - DNA, 20 bp, Artificial Sequence
  Description of Artificial Sequence: Synthetic oligonucleotide
  Target: ATXN1; (+) strand; PAM type: YTN; PAM sequence: TTT
ctctcacttttcttctcctt

SEQ ID NO: 288636 - DNA, 20 bp, Artificial Sequence
  Description of Artificial Sequence: Synthetic oligonucleotide
  Target: ATXN1; (+) strand; PAM type: YTN; PAM sequence: TTC
tctcacttttcttctccttg

SEQ ID NO: 288637 - DNA, 20 bp, Artificial Sequence
  Description of Artificial Sequence: Synthetic oligonucleotide
  Target: ATXN1; (+) strand; PAM type: YTN; PAM sequence: CTC
tcacttttcttctccttgag

SEQ ID NO: 288638 - DNA, 20 bp, Artificial Sequence
  Description of Artificial Sequence: Synthetic oligonucleotide
  Target: ATXN1; (+) strand; PAM type: YTN; PAM sequence: CTC
acttttcttctccttgaggc

SEQ ID NO: 288639 - DNA, 20 bp, Artificial Sequence
  Description of Artificial Sequence: Synthetic oligonucleotide
  Target: ATXN1; (+) strand; PAM type: YTN; PAM sequence: CTT
ttcttctccttgaggcaact

SEQ ID NO: 288640 - DNA, 20 bp, Artificial Sequence
  Description of Artificial Sequence: Synthetic oligonucleotide
  Target: ATXN1; (+) strand; PAM type: YTN; PAM sequence: TTT
tcttctccttgaggcaactc

SEQ ID NO: 288641 - DNA, 20 bp, Artificial Sequence
  Description of Artificial Sequence: Synthetic oligonucleotide
  Target: ATXN1; (+) strand; PAM type: YTN; PAM sequence: TTT
cttctccttgaggcaactca

SEQ ID NO: 288642 - DNA, 20 bp, Artificial Sequence
  Description of Artificial Sequence: Synthetic oligonucleotide
  Target: ATXN1; (+) strand; PAM type: YTN; PAM sequence: TTC
ttctccttgaggcaactcag

SEQ ID NO: 288643 - DNA, 20 bp, Artificial Sequence
  Description of Artificial Sequence: Synthetic oligonucleotide
  Target: ATXN1; (+) strand; PAM type: YTN; PAM sequence: CTT
ctccttgaggcaactcagag

SEQ ID NO: 288644 - DNA, 20 bp, Artificial Sequence
  Description of Artificial Sequence: Synthetic oligonucleotide
  Target: ATXN1; (+) strand; PAM type: YTN; PAM sequence: TTC
tccttgaggcaactcagagg

SEQ ID NO: 288645 - DNA, 20 bp, Artificial Sequence
  Description of Artificial Sequence: Synthetic oligonucleotide
  Target: ATXN1; (+) strand; PAM type: YTN; PAM sequence: CTC
cttgaggcaactcagaggag

SEQ ID NO: 288646 - DNA, 20 bp, Artificial Sequence
  Description of Artificial Sequence: Synthetic oligonucleotide
  Target: ATXN1; (+) strand; PAM type: YTN; PAM sequence: CTT
gaggcaactcagaggagcga

SEQ ID NO: 288647 - DNA, 20 bp, Artificial Sequence
  Description of Artificial Sequence: Synthetic oligonucleotide
  Target: ATXN1; (+) strand; PAM type: YTN; PAM sequence: TTG
aggcaactcagaggagcgat

SEQ ID NO: 288648 - DNA, 20 bp, Artificial Sequence
  Description of Artificial Sequence: Synthetic oligonucleotide
  Target: ATXN1; (+) strand; PAM type: YTN; PAM sequence: CTC
agaggagcgattgtggaaat

SEQ ID NO: 288649 - DNA, 20 bp, Artificial Sequence
  Description of Artificial Sequence: Synthetic oligonucleotide
  Target: ATXN1; (+) strand; PAM type: YTN; PAM sequence: TTG
tggaaatttccgaagctgct

SEQ ID NO: 288650 - DNA, 20 bp, Artificial Sequence
  Description of Artificial Sequence: Synthetic oligonucleotide
  Target: ATXN1; (+) strand; PAM type: YTN; PAM sequence: TTT
ccgaagctgctatatgtcag

SEQ ID NO: 288651 - DNA, 20 bp, Artificial Sequence
  Description of Artificial Sequence: Synthetic oligonucleotide
  Target: ATXN1; (+) strand; PAM type: YTN; PAM sequence: TTC
cgaagctgctatatgtcagc

SEQ ID NO: 288652 - DNA, 20 bp, Artificial Sequence
  Description of Artificial Sequence: Synthetic oligonucleotide
  Target: ATXN1; (+) strand; PAM type: YTN; PAM sequence: CTG
ctatatgtcagcttgcccat

SEQ ID NO: 288653 - DNA, 20 bp, Artificial Sequence
  Description of Artificial Sequence: Synthetic oligonucleotide
  Target: ATXN1; (+) strand; PAM type: YTN; PAM sequence: CTA
tatgtcagcttgcccatttg

SEQ ID NO: 288654 - DNA, 20 bp, Artificial Sequence
  Description of Artificial Sequence: Synthetic oligonucleotide
  Target: ATXN1; (+) strand; PAM type: YTN; PAM sequence: CTT
gcccatttgtatggaatttc

SEQ ID NO: 288655 - DNA, 20 bp, Artificial Sequence
  Description of Artificial Sequence: Synthetic oligonucleotide
  Target: ATXN1; (+) strand; PAM type: YTN; PAM sequence: TTG
cccatttgtatggaatttca

SEQ ID NO: 288656 - DNA, 20 bp, Artificial Sequence
  Description of Artificial Sequence: Synthetic oligonucleotide
  Target: ATXN1; (+) strand; PAM type: YTN; PAM sequence: TTT
gtatggaatttcatggtttt

SEQ ID NO: 288657 - DNA, 20 bp, Artificial Sequence
  Description of Artificial Sequence: Synthetic oligonucleotide
  Target: ATXN1; (+) strand; PAM type: YTN; PAM sequence: TTG
tatggaatttcatggttttt

SEQ ID NO: 288658 - DNA, 20 bp, Artificial Sequence
  Description of Artificial Sequence: Synthetic oligonucleotide
  Target: ATXN1; (+) strand; PAM type: YTN; PAM sequence: TTT
catggtttttttgacaagtc

SEQ ID NO: 288659 - DNA, 20 bp, Artificial Sequence
  Description of Artificial Sequence: Synthetic oligonucleotide
  Target: ATXN1; (+) strand; PAM type: YTN; PAM sequence: TTC
atggtttttttgacaagtca

SEQ ID NO: 288660 - DNA, 20 bp, Artificial Sequence
  Description of Artificial Sequence: Synthetic oligonucleotide
  Target: ATXN1; (+) strand; PAM type: YTN; PAM sequence: TTT
ttttgacaagtcagtctttt

SEQ ID NO: 288661 - DNA, 20 bp, Artificial Sequence
  Description of Artificial Sequence: Synthetic oligonucleotide
  Target: ATXN1; (+) strand; PAM type: YTN; PAM sequence: TTT
tttgacaagtcagtcttttt

SEQ ID NO: 288662 - DNA, 20 bp, Artificial Sequence
  Description of Artificial Sequence: Synthetic oligonucleotide
  Target: ATXN1; (+) strand; PAM type: YTN; PAM sequence: TTT
ttgacaagtcagtctttttg

SEQ ID NO: 288663 - DNA, 20 bp, Artificial Sequence
  Description of Artificial Sequence: Synthetic oligonucleotide
  Target: ATXN1; (+) strand; PAM type: YTN; PAM sequence: TTT
tgacaagtcagtctttttgt

SEQ ID NO: 288664 - DNA, 20 bp, Artificial Sequence
  Description of Artificial Sequence: Synthetic oligonucleotide
  Target: ATXN1; (+) strand; PAM type: YTN; PAM sequence: TTT
gacaagtcagtctttttgtc

SEQ ID NO: 288665 - DNA, 20 bp, Artificial Sequence
  Description of Artificial Sequence: Synthetic oligonucleotide
  Target: ATXN1; (+) strand; PAM type: YTN; PAM sequence: TTG
acaagtcagtctttttgtca

SEQ ID NO: 288666 - DNA, 20 bp, Artificial Sequence
  Description of Artificial Sequence: Synthetic oligonucleotide
  Target: ATXN1; (+) strand; PAM type: YTN; PAM sequence: CTT
tttgtcatcatcgcatcttg

SEQ ID NO: 288667 - DNA, 20 bp, Artificial Sequence
  Description of Artificial Sequence: Synthetic oligonucleotide
  Target: ATXN1; (+) strand; PAM type: YTN; PAM sequence: TTT
ttgtcatcatcgcatcttga

SEQ ID NO: 288668 - DNA, 20 bp, Artificial Sequence
  Description of Artificial Sequence: Synthetic oligonucleotide
  Target: ATXN1; (+) strand; PAM type: YTN; PAM sequence: TTT
tgtcatcatcgcatcttgaa

SEQ ID NO: 288669 - DNA, 20 bp, Artificial Sequence
  Description of Artificial Sequence: Synthetic oligonucleotide
  Target: ATXN1; (+) strand; PAM type: YTN; PAM sequence: TTT
gtcatcatcgcatcttgaaa

SEQ ID NO: 288670 - DNA, 20 bp, Artificial Sequence
  Description of Artificial Sequence: Synthetic oligonucleotide
  Target: ATXN1; (+) strand; PAM type: YTN; PAM sequence: TTG
tcatcatcgcatcttgaaag

SEQ ID NO: 288671 - DNA, 20 bp, Artificial Sequence
  Description of Artificial Sequence: Synthetic oligonucleotide
  Target: ATXN1; (+) strand; PAM type: YTN; PAM sequence: CTT
gaaagtagagaggaaaggaa

SEQ ID NO: 288672 - DNA, 20 bp, Artificial Sequence
  Description of Artificial Sequence: Synthetic oligonucleotide
  Target: ATXN1; (+) strand; PAM type: YTN; PAM sequence: TTG
aaagtagagaggaaaggaat

SEQ ID NO: 288673 - DNA, 20 bp, Artificial Sequence
  Description of Artificial Sequence: Synthetic oligonucleotide
  Target: ATXN1; (+) strand; PAM type: YTN; PAM sequence: CTG
ttactatcagaggcttctgg

SEQ ID NO: 288674 - DNA, 20 bp, Artificial Sequence
  Description of Artificial Sequence: Synthetic oligonucleotide
  Target: ATXN1; (+) strand; PAM type: YTN; PAM sequence: TTA
ctatcagaggcttctggaaa

SEQ ID NO: 288675 - DNA, 20 bp, Artificial Sequence
  Description of Artificial Sequence: Synthetic oligonucleotide
  Target: ATXN1; (+) strand; PAM type: YTN; PAM sequence: CTA
tcagaggcttctggaaatcc

SEQ ID NO: 288676 - DNA, 20 bp, Artificial Sequence
  Description of Artificial Sequence: Synthetic oligonucleotide
  Target: ATXN1; (+) strand; PAM type: YTN; PAM sequence: CTT
ctggaaatccccgcttgatg

SEQ ID NO: 288677 - DNA, 20 bp, Artificial Sequence
  Description of Artificial Sequence: Synthetic oligonucleotide
  Target: ATXN1; (+) strand; PAM type: YTN; PAM sequence: TTC
tggaaatccccgcttgatgg

SEQ ID NO: 288678 - DNA, 20 bp, Artificial Sequence
  Description of Artificial Sequence: Synthetic oligonucleotide
  Target: ATXN1; (+) strand; PAM type: YTN; PAM sequence: CTG
gaaatccccgcttgatggta

SEQ ID NO: 288679 - DNA, 20 bp, Artificial Sequence
  Description of Artificial Sequence: Synthetic oligonucleotide
  Target: ATXN1; (+) strand; PAM type: YTN; PAM sequence: CTT
gatggtacatgactctttct

SEQ ID NO: 288680 - DNA, 20 bp, Artificial Sequence
  Description of Artificial Sequence: Synthetic oligonucleotide
  Target: ATXN1; (+) strand; PAM type: YTN; PAM sequence: TTG
atggtacatgactctttctt

SEQ ID NO: 288681 - DNA, 20 bp, Artificial Sequence
  Description of Artificial Sequence: Synthetic oligonucleotide
  Target: ATXN1; (+) strand; PAM type: YTN; PAM sequence: CTC
tttcttaagaatggttctct

SEQ ID NO: 288682 - DNA, 20 bp, Artificial Sequence
  Description of Artificial Sequence: Synthetic oligonucleotide
  Target: ATXN1; (+) strand; PAM type: YTN; PAM sequence: CTT
tcttaagaatggttctcttt

SEQ ID NO: 288683 - DNA, 20 bp, Artificial Sequence
  Description of Artificial Sequence: Synthetic oligonucleotide
  Target: ATXN1; (+) strand; PAM type: YTN; PAM sequence: TTT
cttaagaatggttctctttt

SEQ ID NO: 288684 - DNA, 20 bp, Artificial Sequence
  Description of Artificial Sequence: Synthetic oligonucleotide
  Target: ATXN1; (+) strand; PAM type: YTN; PAM sequence: TTC
ttaagaatggttctctttta

SEQ ID NO: 288685 - DNA, 20 bp, Artificial Sequence
  Description of Artificial Sequence: Synthetic oligonucleotide
  Target: ATXN1; (+) strand; PAM type: YTN; PAM sequence: CTT
aagaatggttctcttttacg

SEQ ID NO: 288686 - DNA, 20 bp, Artificial Sequence
  Description of Artificial Sequence: Synthetic oligonucleotide
  Target: ATXN1; (+) strand; PAM type: YTN; PAM sequence: TTA
agaatggttctcttttacgg

SEQ ID NO: 288687 - DNA, 20 bp, Artificial Sequence
  Description of Artificial Sequence: Synthetic oligonucleotide
  Target: ATXN1; (+) strand; PAM type: YTN; PAM sequence: TTC
tcttttacgggttgccattt

SEQ ID NO: 288688 - DNA, 20 bp, Artificial Sequence
  Description of Artificial Sequence: Synthetic oligonucleotide
  Target: ATXN1; (+) strand; PAM type: YTN; PAM sequence: CTC
ttttacgggttgccattttg

SEQ ID NO: 288689 - DNA, 20 bp, Artificial Sequence
  Description of Artificial Sequence: Synthetic oligonucleotide
  Target: ATXN1; (+) strand; PAM type: YTN; PAM sequence: CTT
ttacgggttgccattttggt

SEQ ID NO: 288690 - DNA, 20 bp, Artificial Sequence
  Description of Artificial Sequence: Synthetic oligonucleotide
  Target: ATXN1; (+) strand; PAM type: YTN; PAM sequence: TTT
tacgggttgccattttggtg

SEQ ID NO: 288691 - DNA, 20 bp, Artificial Sequence
  Description of Artificial Sequence: Synthetic oligonucleotide
  Target: ATXN1; (+) strand; PAM type: YTN; PAM sequence: TTT
acgggttgccattttggtga

SEQ ID NO: 288692 - DNA, 20 bp, Artificial Sequence
  Description of Artificial Sequence: Synthetic oligonucleotide
  Target: ATXN1; (+) strand; PAM type: YTN; PAM sequence: TTA
cgggttgccattttggtgac

SEQ ID NO: 288693 - DNA, 20 bp, Artificial Sequence
  Description of Artificial Sequence: Synthetic oligonucleotide
  Target: ATXN1; (+) strand; PAM type: YTN; PAM sequence: TTG
ccattttggtgacaattggt

SEQ ID NO: 288694 - DNA, 20 bp, Artificial Sequence
  Description of Artificial Sequence: Synthetic oligonucleotide
  Target: ATXN1; (+) strand; PAM type: YTN; PAM sequence: TTT
tggtgacaattggtgcactc

SEQ ID NO: 288695 - DNA, 20 bp, Artificial Sequence
  Description of Artificial Sequence: Synthetic oligonucleotide
  Target: ATXN1; (+) strand; PAM type: YTN; PAM sequence: TTT
ggtgacaattggtgcactca

SEQ ID NO: 288696 - DNA, 20 bp, Artificial Sequence
  Description of Artificial Sequence: Synthetic oligonucleotide
  Target: ATXN1; (+) strand; PAM type: YTN; PAM sequence: TTG
gtgacaattggtgcactcag

SEQ ID NO: 288697 - DNA, 20 bp, Artificial Sequence
  Description of Artificial Sequence: Synthetic oligonucleotide
  Target: ATXN1; (+) strand; PAM type: YTN; PAM sequence: TTG
gtgcactcagctctacctct

SEQ ID NO: 288698 - DNA, 20 bp, Artificial Sequence
  Description of Artificial Sequence: Synthetic oligonucleotide
  Target: ATXN1; (+) strand; PAM type: YTN; PAM sequence: CTC
agctctacctcttggtgggc

SEQ ID NO: 288699 - DNA, 20 bp, Artificial Sequence
  Description of Artificial Sequence: Synthetic oligonucleotide
  Target: ATXN1; (+) strand; PAM type: YTN; PAM sequence: CTC
tacctcttggtgggccccag

SEQ ID NO: 288700 - DNA, 20 bp, Artificial Sequence
  Description of Artificial Sequence: Synthetic oligonucleotide
  Target: ATXN1; (+) strand; PAM type: YTN; PAM sequence: CTA
cctcttggtgggccccagta

SEQ ID NO: 288701 - DNA, 20 bp, Artificial Sequence
  Description of Artificial Sequence: Synthetic oligonucleotide
  Target: ATXN1; (+) strand; PAM type: YTN; PAM sequence: CTC
ttggtgggccccagtatact

SEQ ID NO: 288702 - DNA, 20 bp, Artificial Sequence
  Description of Artificial Sequence: Synthetic oligonucleotide
  Target: ATXN1; (+) strand; PAM type: YTN; PAM sequence: CTT
ggtgggccccagtatacttc

SEQ ID NO: 288703 - DNA, 20 bp, Artificial Sequence
  Description of Artificial Sequence: Synthetic oligonucleotide
  Target: ATXN1; (+) strand; PAM type: YTN; PAM sequence: TTG
gtgggccccagtatacttca

SEQ ID NO: 288704 - DNA, 20 bp, Artificial Sequence
  Description of Artificial Sequence: Synthetic oligonucleotide
  Target: ATXN1; (+) strand; PAM type: YTN; PAM sequence: CTT
cagcatgatctcagttcttt

SEQ ID NO: 288705 - DNA, 20 bp, Artificial Sequence
  Description of Artificial Sequence: Synthetic oligonucleotide
  Target: ATXN1; (+) strand; PAM type: YTN; PAM sequence: TTC
agcatgatctcagttctttc

SEQ ID NO: 288706 - DNA, 20 bp, Artificial Sequence
  Description of Artificial Sequence: Synthetic oligonucleotide
  Target: ATXN1; (+) strand; PAM type: YTN; PAM sequence: CTC
agttctttctttctctacca

SEQ ID NO: 288707 - DNA, 20 bp, Artificial Sequence
  Description of Artificial Sequence: Synthetic oligonucleotide
  Target: ATXN1; (+) strand; PAM type: YTN; PAM sequence: TTC
tttctttctctaccagtttc

SEQ ID NO: 288708 - DNA, 20 bp, Artificial Sequence
  Description of Artificial Sequence: Synthetic oligonucleotide
  Target: ATXN1; (+) strand; PAM type: YTN; PAM sequence: CTT
tctttctctaccagtttcca

SEQ ID NO: 288709 - DNA, 20 bp, Artificial Sequence
  Description of Artificial Sequence: Synthetic oligonucleotide
  Target: ATXN1; (+) strand; PAM type: YTN; PAM sequence: TTT
ctttctctaccagtttccat

SEQ ID NO: 288710 - DNA, 20 bp, Artificial Sequence
  Description of Artificial Sequence: Synthetic oligonucleotide
  Target: ATXN1; (+) strand; PAM type: YTN; PAM sequence: TTC
tttctctaccagtttccatg

SEQ ID NO: 288711 - DNA, 20 bp, Artificial Sequence
  Description of Artificial Sequence: Synthetic oligonucleotide
  Target: ATXN1; (+) strand; PAM type: YTN; PAM sequence: CTT
tctctaccagtttccatgat

SEQ ID NO: 288712 - DNA, 20 bp, Artificial Sequence
  Description of Artificial Sequence: Synthetic oligonucleotide
  Target: ATXN1; (+) strand; PAM type: YTN; PAM sequence: TTT
ctctaccagtttccatgata

SEQ ID NO: 288713 - DNA, 20 bp, Artificial Sequence
  Description of Artificial Sequence: Synthetic oligonucleotide
  Target: ATXN1; (+) strand; PAM type: YTN; PAM sequence: TTC
tctaccagtttccatgatac

SEQ ID NO: 288714 - DNA, 20 bp, Artificial Sequence
  Description of Artificial Sequence: Synthetic oligonucleotide
  Target: ATXN1; (+) strand; PAM type: YTN; PAM sequence: CTC
taccagtttccatgatacat

SEQ ID NO: 288715 - DNA, 20 bp, Artificial Sequence
  Description of Artificial Sequence: Synthetic oligonucleotide
  Target: ATXN1; (+) strand; PAM type: YTN; PAM sequence: CTA
ccagtttccatgatacatac

SEQ ID NO: 288716 - DNA, 20 bp, Artificial Sequence
  Description of Artificial Sequence: Synthetic oligonucleotide
  Target: ATXN1; (+) strand; PAM type: YTN; PAM sequence: TTT
ccatgatacatacatcctga

SEQ ID NO: 288717 - DNA, 20 bp, Artificial Sequence
  Description of Artificial Sequence: Synthetic oligonucleotide
  Target: ATXN1; (+) strand; PAM type: YTN; PAM sequence: TTC
catgatacatacatcctgaa

SEQ ID NO: 288718 - DNA, 20 bp, Artificial Sequence
  Description of Artificial Sequence: Synthetic oligonucleotide
  Target: ATXN1; (+) strand; PAM type: YTN; PAM sequence: CTG
aaaatcacagcatcaccatt

SEQ ID NO: 288719 - DNA, 20 bp, Artificial Sequence
  Description of Artificial Sequence: Synthetic oligonucleotide
  Target: ATXN1; (+) strand; PAM type: YTN; PAM sequence: TTC
aatagacaaaaattatcatt

SEQ ID NO: 288720 - DNA, 20 bp, Artificial Sequence
  Description of Artificial Sequence: Synthetic oligonucleotide
  Target: ATXN1; (+) strand; PAM type: YTN; PAM sequence: TTA
tcattatcaaagcggccaaa

SEQ ID NO: 288721 - DNA, 20 bp, Artificial Sequence
  Description of Artificial Sequence: Synthetic oligonucleotide
  Target: ATXN1; (+) strand; PAM type: YTN; PAM sequence: TTA
tcaaagcggccaaaaaggtt

SEQ ID NO: 288722 - DNA, 20 bp, Artificial Sequence
  Description of Artificial Sequence: Synthetic oligonucleotide
  Target: ATXN1; (+) strand; PAM type: YTN; PAM sequence: TTT
tctcttaaatattctgtggg

SEQ ID NO: 288723 - DNA, 20 bp, Artificial Sequence
  Description of Artificial Sequence: Synthetic oligonucleotide
  Target: ATXN1; (+) strand; PAM type: YTN; PAM sequence: TTT
ctcttaaatattctgtggga

SEQ ID NO: 288724 - DNA, 20 bp, Artificial Sequence
  Description of Artificial Sequence: Synthetic oligonucleotide
  Target: ATXN1; (+) strand; PAM type: YTN; PAM sequence: TTC
tcttaaatattctgtgggaa

SEQ ID NO: 288725 - DNA, 20 bp, Artificial Sequence
  Description of Artificial Sequence: Synthetic oligonucleotide
  Target: ATXN1; (+) strand; PAM type: YTN; PAM sequence: CTC
ttaaatattctgtgggaaag

SEQ ID NO: 288726 - DNA, 20 bp, Artificial Sequence
  Description of Artificial Sequence: Synthetic oligonucleotide
  Target: ATXN1; (+) strand; PAM type: YTN; PAM sequence: CTT
aaatattctgtgggaaagag

SEQ ID NO: 288727 - DNA, 20 bp, Artificial Sequence
  Description of Artificial Sequence: Synthetic oligonucleotide
  Target: ATXN1; (+) strand; PAM type: YTN; PAM sequence: TTA
aatattctgtgggaaagagg

SEQ ID NO: 288728 - DNA, 20 bp, Artificial Sequence
  Description of Artificial Sequence: Synthetic oligonucleotide
  Target: ATXN1; (+) strand; PAM type: YTN; PAM sequence: TTC
tgtgggaaagagggttgaaa

SEQ ID NO: 288729 - DNA, 20 bp, Artificial Sequence
  Description of Artificial Sequence: Synthetic oligonucleotide
  Target: ATXN1; (+) strand; PAM type: YTN; PAM sequence: CTG
tgggaaagagggttgaaaat

SEQ ID NO: 288730 - DNA, 20 bp, Artificial Sequence
  Description of Artificial Sequence: Synthetic oligonucleotide
  Target: ATXN1; (+) strand; PAM type: YTN; PAM sequence: TTG
aaaattagaatagaatacta

SEQ ID NO: 288731 - DNA, 20 bp, Artificial Sequence
  Description of Artificial Sequence: Synthetic oligonucleotide
  Target: ATXN1; (+) strand; PAM type: YTN; PAM sequence: TTA
gaatagaatactatgtattt

SEQ ID NO: 288732 - DNA, 20 bp, Artificial Sequence
  Description of Artificial Sequence: Synthetic oligonucleotide
  Target: ATXN1; (+) strand; PAM type: YTN; PAM sequence: CTA
tgtatttgccacagtaaaag

SEQ ID NO: 288733 - DNA, 20 bp, Artificial Sequence
  Description of Artificial Sequence: Synthetic oligonucleotide
  Target: ATXN1; (+) strand; PAM type: YTN; PAM sequence: TTT
gccacagtaaaagataccta

SEQ ID NO: 288734 - DNA, 20 bp, Artificial Sequence
  Description of Artificial Sequence: Synthetic oligonucleotide
  Target: ATXN1; (+) strand; PAM type: YTN; PAM sequence: TTG
ccacagtaaaagatacctac

SEQ ID NO: 288735 - DNA, 20 bp, Artificial Sequence
  Description of Artificial Sequence: Synthetic oligonucleotide
  Target: ATXN1; (+) strand; PAM type: YTN; PAM sequence: CTA
ccacaaaccagtagccaata

SEQ ID NO: 288736 - DNA, 20 bp, Artificial Sequence
  Description of Artificial Sequence: Synthetic oligonucleotide
  Target: ATXN1; (+) strand; PAM type: YTN; PAM sequence: TTA
tattaaaagttaaaaacaag

SEQ ID NO: 288737 - DNA, 20 bp, Artificial Sequence
  Description of Artificial Sequence: Synthetic oligonucleotide
  Target: ATXN1; (+) strand; PAM type: YTN; PAM sequence: TTA
aaagttaaaaacaagagtca

SEQ ID NO: 288738 - DNA, 20 bp, Artificial Sequence
  Description of Artificial Sequence: Synthetic oligonucleotide
  Target: ATXN1; (+) strand; PAM type: YTN; PAM sequence: TTA
aaaacaagagtcaatgatta

SEQ ID NO: 288739 - DNA, 20 bp, Artificial Sequence
  Description of Artificial Sequence: Synthetic oligonucleotide
  Target: ATXN1; (+) strand; PAM type: YTN; PAM sequence: TTA
aattcaggctgcatgcggtg

SEQ ID NO: 288740 - DNA, 20 bp, Artificial Sequence
  Description of Artificial Sequence: Synthetic oligonucleotide
  Target: ATXN1; (+) strand; PAM type: YTN; PAM sequence: TTC
aggctgcatgcggtggctca

SEQ ID NO: 288741 - DNA, 20 bp, Artificial Sequence
  Description of Artificial Sequence: Synthetic oligonucleotide
  Target: ATXN1; (+) strand; PAM type: YTN; PAM sequence: CTG
catgcggtggctcatgcctg

SEQ ID NO: 288742 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaaccccagcact

SEQ ID NO: 288743 - DNA, 20 bp, Artificial Sequence
  Description of Artificial Sequence: Synthetic oligonucleotide
  Target: ATXN1; (+) strand; PAM type: YTN; PAM sequence: CTG
taaccccagcactttgggag

SEQ ID NO: 288744 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgagcgggtgga

SEQ ID NO: 288745 - DNA, 20 bp, Artificial Sequence
  Description of Artificial Sequence: Synthetic oligonucleotide
  Target: ATXN1; (+) strand; PAM type: YTN; PAM sequence: TTT
gggaggctgagcgggtggat

SEQ ID NO: 288746 - DNA, 20 bp, Artificial Sequence
  Description of Artificial Sequence: Synthetic oligonucleotide
  Target: ATXN1; (+) strand; PAM type: YTN; PAM sequence: TTG
ggaggctgagcgggtggatc

SEQ ID NO: 288747 - DNA, 20 bp, Artificial Sequence
  Description of Artificial Sequence: Synthetic oligonucleotide
  Target: ATXN1; (+) strand; PAM type: YTN; PAM sequence: CTG
agcgggtggatcacttgagg

SEQ ID NO: 288748 - DNA, 20 bp, Artificial Sequence
  Description of Artificial Sequence: Synthetic oligonucleotide
  Target: ATXN1; (+) strand; PAM type: YTN; PAM sequence: CTT
gaggtcaggagtttgagacc

SEQ ID NO: 288749 - DNA, 20 bp, Artificial Sequence
  Description of Artificial Sequence: Synthetic oligonucleotide
  Target: ATXN1; (+) strand; PAM type: YTN; PAM sequence: TTG
aggtcaggagtttgagacca

SEQ ID NO: 288750 - DNA, 20 bp, Artificial Sequence
  Description of Artificial Sequence: Synthetic oligonucleotide
  Target: ATXN1; (+) strand; PAM type: YTN; PAM sequence: TTT
gagaccagcctggtgaacat

SEQ ID NO: 288751 - DNA, 20 bp, Artificial Sequence
  Description of Artificial Sequence: Synthetic oligonucleotide
  Target: ATXN1; (+) strand; PAM type: YTN; PAM sequence: TTG
agaccagcctggtgaacatg

SEQ ID NO: 288752 - DNA, 20 bp, Artificial Sequence
  Description of Artificial Sequence: Synthetic oligonucleotide
  Target: ATXN1; (+) strand; PAM type: YTN; PAM sequence: CTG
gtgaacatggtgaaactccg

SEQ ID NO: 288753 - DNA, 20 bp, Artificial Sequence
  Description of Artificial Sequence: Synthetic oligonucleotide
  Target: ATXN1; (+) strand; PAM type: YTN; PAM sequence: CTC
cgtctctactaaaaatacaa

SEQ ID NO: 288754 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 288755 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 288756 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagccag

SEQ ID NO: 288757 - DNA, 20 bp, Artificial Sequence
  Description of Artificial Sequence: Synthetic oligonucleotide
  Target: ATXN1; (+) strand; PAM type: YTN; PAM sequence: TTA
gccaggcatggtgttgcatg

SEQ ID NO: 288758 - DNA, 20 bp, Artificial Sequence
  Description of Artificial Sequence: Synthetic oligonucleotide
  Target: ATXN1; (+) strand; PAM type: YTN; PAM sequence: TTG
catgcctgtaatcccagata

SEQ ID NO: 288759 - DNA, 20 bp, Artificial Sequence
  Description of Artificial Sequence: Synthetic oligonucleotide
  Target: ATXN1; (+) strand; PAM type: YTN; PAM sequence: CTG
taatcccagatatttgggag

SEQ ID NO: 288760 - DNA, 20 bp, Artificial Sequence
  Description of Artificial Sequence: Synthetic oligonucleotide
  Target: ATXN1; (+) strand; PAM type: YTN; PAM sequence: TTT
gggagtctgtggccggagaa

SEQ ID NO: 288761 - DNA, 20 bp, Artificial Sequence
  Description of Artificial Sequence: Synthetic oligonucleotide
  Target: ATXN1; (+) strand; PAM type: YTN; PAM sequence: TTG
ggagtctgtggccggagaat

SEQ ID NO: 288762 - DNA, 20 bp, Artificial Sequence
  Description of Artificial Sequence: Synthetic oligonucleotide
  Target: ATXN1; (+) strand; PAM type: YTN; PAM sequence: CTG
tggccggagaatcacttgag

SEQ ID NO: 288763 - DNA, 20 bp, Artificial Sequence
  Description of Artificial Sequence: Synthetic oligonucleotide
  Target: ATXN1; (+) strand; PAM type: YTN; PAM sequence: CTT
gagcctgggaggcagaggtt

SEQ ID NO: 288764 - DNA, 20 bp, Artificial Sequence
  Description of Artificial Sequence: Synthetic oligonucleotide
  Target: ATXN1; (+) strand; PAM type: YTN; PAM sequence: TTG
agcctgggaggcagaggttg

SEQ ID NO: 288765 - DNA, 20 bp, Artificial Sequence
  Description of Artificial Sequence: Synthetic oligonucleotide
  Target: ATXN1; (+) strand; PAM type: YTN; PAM sequence: CTG
ggaggcagaggttgcaatga

SEQ ID NO: 288766 - DNA, 20 bp, Artificial Sequence
  Description of Artificial Sequence: Synthetic oligonucleotide
  Target: ATXN1; (+) strand; PAM type: YTN; PAM sequence: TTG
caatgagccaagatcgtgcg

SEQ ID NO: 288767 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggtgacag

SEQ ID NO: 288768 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgacagagcaa

SEQ ID NO: 288769 - DNA, 20 bp, Artificial Sequence
  Description of Artificial Sequence: Synthetic oligonucleotide
  Target: ATXN1; (+) strand; PAM type: YTN; PAM sequence: CTG
ggtgacagagcaagactctg

SEQ ID NO: 288770 - DNA, 20 bp, Artificial Sequence
  Description of Artificial Sequence: Synthetic oligonucleotide
  Target: ATXN1; (+) strand; PAM type: YTN; PAM sequence: CTC
tgtctcaagaaaaaaaaaaa

SEQ ID NO: 288771 - DNA, 20 bp, Artificial Sequence
  Description of Artificial Sequence: Synthetic oligonucleotide
  Target: ATXN1; (+) strand; PAM type: YTN; PAM sequence: CTG
tctcaagaaaaaaaaaaatt

SEQ ID NO: 288772 - DNA, 20 bp, Artificial Sequence
  Description of Artificial Sequence: Synthetic oligonucleotide
  Target: ATXN1; (+) strand; PAM type: YTN; PAM sequence: CTC
aagaaaaaaaaaaattaaat

SEQ ID NO: 288773 - DNA, 20 bp, Artificial Sequence
  Description of Artificial Sequence: Synthetic oligonucleotide
  Target: ATXN1; (+) strand; PAM type: YTN; PAM sequence: TTA
aattcaggaataaagtcaag

SEQ ID NO: 288774 - DNA, 20 bp, Artificial Sequence
  Description of Artificial Sequence: Synthetic oligonucleotide
  Target: ATXN1; (+) strand; PAM type: YTN; PAM sequence: TTC
aggaataaagtcaagtgtat

SEQ ID NO: 288775 - DNA, 20 bp, Artificial Sequence
  Description of Artificial Sequence: Synthetic oligonucleotide
  Target: ATXN1; (+) strand; PAM type: YTN; PAM sequence: TTT
gtatctgctcttccattatt

SEQ ID NO: 288776 - DNA, 20 bp, Artificial Sequence
  Description of Artificial Sequence: Synthetic oligonucleotide
  Target: ATXN1; (+) strand; PAM type: YTN; PAM sequence: TTG
tatctgctcttccattatta

SEQ ID NO: 288777 - DNA, 20 bp, Artificial Sequence
  Description of Artificial Sequence: Synthetic oligonucleotide
  Target: ATXN1; (+) strand; PAM type: YTN; PAM sequence: CTG
ctcttccattattatttggc

SEQ ID NO: 288778 - DNA, 20 bp, Artificial Sequence
  Description of Artificial Sequence: Synthetic oligonucleotide
  Target: ATXN1; (+) strand; PAM type: YTN; PAM sequence: CTC
ttccattattatttggcata

SEQ ID NO: 288779 - DNA, 20 bp, Artificial Sequence
  Description of Artificial Sequence: Synthetic oligonucleotide
  Target: ATXN1; (+) strand; PAM type: YTN; PAM sequence: CTT
ccattattatttggcatacc

SEQ ID NO: 288780 - DNA, 20 bp, Artificial Sequence
  Description of Artificial Sequence: Synthetic oligonucleotide
  Target: ATXN1; (+) strand; PAM type: YTN; PAM sequence: TTC
cattattatttggcatacca

SEQ ID NO: 288781 - DNA, 20 bp, Artificial Sequence
  Description of Artificial Sequence: Synthetic oligonucleotide
  Target: ATXN1; (+) strand; PAM type: YTN; PAM sequence: TTA
ttatttggcataccatcagg

SEQ ID NO: 288782 - DNA, 20 bp, Artificial Sequence
  Description of Artificial Sequence: Synthetic oligonucleotide
  Target: ATXN1; (+) strand; PAM type: YTN; PAM sequence: TTA
tttggcataccatcaggatg

SEQ ID NO: 288783 - DNA, 20 bp, Artificial Sequence
  Description of Artificial Sequence: Synthetic oligonucleotide
  Target: ATXN1; (+) strand; PAM type: YTN; PAM sequence: TTT
ggcataccatcaggatgctg

SEQ ID NO: 288784 - DNA, 20 bp, Artificial Sequence
  Description of Artificial Sequence: Synthetic oligonucleotide
  Target: ATXN1; (+) strand; PAM type: YTN; PAM sequence: TTG
gcataccatcaggatgctgt

SEQ ID NO: 288785 - DNA, 20 bp, Artificial Sequence
  Description of Artificial Sequence: Synthetic oligonucleotide
  Target: ATXN1; (+) strand; PAM type: YTN; PAM sequence: CTG
tagaagaaataaaagttaaa

SEQ ID NO: 288786 - DNA, 20 bp, Artificial Sequence
  Description of Artificial Sequence: Synthetic oligonucleotide
  Target: ATXN1; (+) strand; PAM type: YTN; PAM sequence: TTA
aaaatattaaaatacaggag

SEQ ID NO: 288787 - DNA, 20 bp, Artificial Sequence
  Description of Artificial Sequence: Synthetic oligonucleotide
  Target: ATXN1; (+) strand; PAM type: YTN; PAM sequence: TTA
aaatacaggagacaaaatta

SEQ ID NO: 288788 - DNA, 20 bp, Artificial Sequence
  Description of Artificial Sequence: Synthetic oligonucleotide
  Target: ATXN1; (+) strand; PAM type: YTN; PAM sequence: TTA
tcattattggaaatgttatt

SEQ ID NO: 288789 - DNA, 20 bp, Artificial Sequence
  Description of Artificial Sequence: Synthetic oligonucleotide
  Target: ATXN1; (+) strand; PAM type: YTN; PAM sequence: TTA
ttggaaatgttattgtctac

SEQ ID NO: 288790 - DNA, 20 bp, Artificial Sequence
  Description of Artificial Sequence: Synthetic oligonucleotide
  Target: ATXN1; (+) strand; PAM type: YTN; PAM sequence: TTG
gaaatgttattgtctactta

SEQ ID NO: 288791 - DNA, 20 bp, Artificial Sequence
  Description of Artificial Sequence: Synthetic oligonucleotide
  Target: ATXN1; (+) strand; PAM type: YTN; PAM sequence: TTA
ttgtctacttagaatatcta

SEQ ID NO: 288792 - DNA, 20 bp, Artificial Sequence
  Description of Artificial Sequence: Synthetic oligonucleotide
  Target: ATXN1; (+) strand; PAM type: YTN; PAM sequence: TTG
tctacttagaatatctaagg

SEQ ID NO: 288793 - DNA, 20 bp, Artificial Sequence
  Description of Artificial Sequence: Synthetic oligonucleotide
  Target: ATXN1; (+) strand; PAM type: YTN; PAM sequence: CTA
cttagaatatctaagggaat

SEQ ID NO: 288794 - DNA, 20 bp, Artificial Sequence
  Description of Artificial Sequence: Synthetic oligonucleotide
  Target: ATXN1; (+) strand; PAM type: YTN; PAM sequence: CTT
agaatatctaagggaattag

SEQ ID NO: 288795 - DNA, 20 bp, Artificial Sequence
  Description of Artificial Sequence: Synthetic oligonucleotide
  Target: ATXN1; (+) strand; PAM type: YTN; PAM sequence: TTA
gaatatctaagggaattagc

SEQ ID NO: 288796 - DNA, 20 bp, Artificial Sequence
  Description of Artificial Sequence: Synthetic oligonucleotide
  Target: ATXN1; (+) strand; PAM type: YTN; PAM sequence: CTA
agggaattagctgaaagact

SEQ ID NO: 288797 - DNA, 20 bp, Artificial Sequence
  Description of Artificial Sequence: Synthetic oligonucleotide
  Target: ATXN1; (+) strand; PAM type: YTN; PAM sequence: TTA
gctgaaagactctagaactg

SEQ ID NO: 288798 - DNA, 20 bp, Artificial Sequence
  Description of Artificial Sequence: Synthetic oligonucleotide
  Target: ATXN1; (+) strand; PAM type: YTN; PAM sequence: CTG
aaagactctagaactgagat

SEQ ID NO: 288799 - DNA, 20 bp, Artificial Sequence
  Description of Artificial Sequence: Synthetic oligonucleotide
  Target: ATXN1; (+) strand; PAM type: YTN; PAM sequence: CTC
tagaactgagatcaatatta

SEQ ID NO: 288800 - DNA, 20 bp, Artificial Sequence
  Description of Artificial Sequence: Synthetic oligonucleotide
  Target: ATXN1; (+) strand; PAM type: YTN; PAM sequence: CTA
gaactgagatcaatattatg

SEQ ID NO: 288801 - DNA, 20 bp, Artificial Sequence
  Description of Artificial Sequence: Synthetic oligonucleotide
  Target: ATXN1; (+) strand; PAM type: YTN; PAM sequence: CTG
agatcaatattatggtcagt

SEQ ID NO: 288802 - DNA, 20 bp, Artificial Sequence
  Description of Artificial Sequence: Synthetic oligonucleotide
  Target: ATXN1; (+) strand; PAM type: YTN; PAM sequence: TTA
tggtcagttgaccaggcaca

SEQ ID NO: 288803 - DNA, 20 bp, Artificial Sequence
  Description of Artificial Sequence: Synthetic oligonucleotide
  Target: ATXN1; (+) strand; PAM type: YTN; PAM sequence: TTG
accaggcacagtggctcata

SEQ ID NO: 288804 - DNA, 20 bp, Artificial Sequence
  Description of Artificial Sequence: Synthetic oligonucleotide
  Target: ATXN1; (+) strand; PAM type: YTN; PAM sequence: CTC
atatctgtaatcccagcatt

SEQ ID NO: 288805 - DNA, 20 bp, Artificial Sequence
  Description of Artificial Sequence: Synthetic oligonucleotide
  Target: ATXN1; (+) strand; PAM type: YTN; PAM sequence: CTG
taatcccagcattttgggag

SEQ ID NO: 288806 - DNA, 20 bp, Artificial Sequence
  Description of Artificial Sequence: Synthetic oligonucleotide
  Target: ATXN1; (+) strand; PAM type: YTN; PAM sequence: TTT
tgggaggccaaggtgggtgg

SEQ ID NO: 288807 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggtgggtggc

SEQ ID NO: 288808 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggtgggtggct

SEQ ID NO: 288809 - DNA, 20 bp, Artificial Sequence
  Description of Artificial Sequence: Synthetic oligonucleotide
  Target: ATXN1; (+) strand; PAM type: YTN; PAM sequence: CTC
acctgaggtcaggggtttga

SEQ ID NO: 288810 - DNA, 20 bp, Artificial Sequence
  Description of Artificial Sequence: Synthetic oligonucleotide
  Target: ATXN1; (+) strand; PAM type: YTN; PAM sequence: CTG
aggtcaggggtttgagacca

SEQ ID NO: 288811 - DNA, 20 bp, Artificial Sequence
  Description of Artificial Sequence: Synthetic oligonucleotide
  Target: ATXN1; (+) strand; PAM type: YTN; PAM sequence: TTT
gagaccagcctggctaacat

SEQ ID NO: 288812 - DNA, 20 bp, Artificial Sequence
  Description of Artificial Sequence: Synthetic oligonucleotide
  Target: ATXN1; (+) strand; PAM type: YTN; PAM sequence: TTG
agaccagcctggctaacatg

SEQ ID NO: 288813 - DNA, 20 bp, Artificial Sequence
  Description of Artificial Sequence: Synthetic oligonucleotide
  Target: ATXN1; (+) strand; PAM type: YTN; PAM sequence: CTG
gctaacatggtgaaaccctg

SEQ ID NO: 288814 - DNA, 20 bp, Artificial Sequence
  Description of Artificial Sequence: Synthetic oligonucleotide
  Target: ATXN1; (+) strand; PAM type: YTN; PAM sequence: CTA
acatggtgaaaccctgtctc

SEQ ID NO: 288815 - DNA, 20 bp, Artificial Sequence
  Description of Artificial Sequence: Synthetic oligonucleotide
  Target: ATXN1; (+) strand; PAM type: YTN; PAM sequence: CTG
tctctactaaaaatacaaaa

SEQ ID NO: 288816 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 288817 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 288818 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagccag

SEQ ID NO: 288819 - DNA, 20 bp, Artificial Sequence
  Description of Artificial Sequence: Synthetic oligonucleotide
  Target: ATXN1; (+) strand; PAM type: YTN; PAM sequence: TTA
gccaggtgtggtggtacaca

SEQ ID NO: 288820 - DNA, 20 bp, Artificial Sequence
  Description of Artificial Sequence: Synthetic oligonucleotide
  Target: ATXN1; (+) strand; PAM type: YTN; PAM sequence: CTG
taatcccagatacttgggag

SEQ ID NO: 288821 - DNA, 20 bp, Artificial Sequence
  Description of Artificial Sequence: Synthetic oligonucleotide
  Target: ATXN1; (+) strand; PAM type: YTN; PAM sequence: CTT
gggaggctgagacagaagaa

SEQ ID NO: 288822 - DNA, 20 bp, Artificial Sequence
  Description of Artificial Sequence: Synthetic oligonucleotide
  Target: ATXN1; (+) strand; PAM type: YTN; PAM sequence: TTG
ggaggctgagacagaagaat

SEQ ID NO: 288823 - DNA, 20 bp, Artificial Sequence
  Description of Artificial Sequence: Synthetic oligonucleotide
  Target: ATXN1; (+) strand; PAM type: YTN; PAM sequence: CTG
agacagaagaatcacttgaa

SEQ ID NO: 288824 - DNA, 20 bp, Artificial Sequence
  Description of Artificial Sequence: Synthetic oligonucleotide
  Target: ATXN1; (+) strand; PAM type: YTN; PAM sequence: CTT
gaacctgggaggcagaggct

SEQ ID NO: 288825 - DNA, 20 bp, Artificial Sequence
  Description of Artificial Sequence: Synthetic oligonucleotide
  Target: ATXN1; (+) strand; PAM type: YTN; PAM sequence: TTG
aacctgggaggcagaggctg

SEQ ID NO: 288826 - DNA, 20 bp, Artificial Sequence
  Description of Artificial Sequence: Synthetic oligonucleotide
  Target: ATXN1; (+) strand; PAM type: YTN; PAM sequence: CTG
ggaggcagaggctgcaggga

SEQ ID NO: 288827 - DNA, 20 bp, Artificial Sequence
  Description of Artificial Sequence: Synthetic oligonucleotide
  Target: ATXN1; (+) strand; PAM type: YTN; PAM sequence: CTG
cagggagctgagatcatgcc

SEQ ID NO: 288828 - DNA, 20 bp, Artificial Sequence
  Description of Artificial Sequence: Synthetic oligonucleotide
  Target: ATXN1; (+) strand; PAM type: YTN; PAM sequence: CTG
agatcatgccactgcactcc

SEQ ID NO: 288829 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggtgacag

SEQ ID NO: 288830 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgacagaagga

SEQ ID NO: 288831 - DNA, 20 bp, Artificial Sequence
  Description of Artificial Sequence: Synthetic oligonucleotide
  Target: ATXN1; (+) strand; PAM type: YTN; PAM sequence: CTG
ggtgacagaaggagactgtg

SEQ ID NO: 288832 - DNA, 20 bp, Artificial Sequence
  Description of Artificial Sequence: Synthetic oligonucleotide
  Target: ATXN1; (+) strand; PAM type: YTN; PAM sequence: CTG
tgtctcaaaaaatatatata

SEQ ID NO: 288833 - DNA, 20 bp, Artificial Sequence
  Description of Artificial Sequence: Synthetic oligonucleotide
  Target: ATXN1; (+) strand; PAM type: YTN; PAM sequence: CTC
aaaaaatatatataatatat

SEQ ID NO: 288834 - DNA, 20 bp, Artificial Sequence
  Description of Artificial Sequence: Synthetic oligonucleotide
  Target: ATXN1; (+) strand; PAM type: YTN; PAM sequence: TTT
tatatatagtatataatata

SEQ ID NO: 288835 - DNA, 20 bp, Artificial Sequence
  Description of Artificial Sequence: Synthetic oligonucleotide
  Target: ATXN1; (+) strand; PAM type: YTN; PAM sequence: TTT
atatatagtatataatatat

SEQ ID NO: 288836 - DNA, 20 bp, Artificial Sequence
  Description of Artificial Sequence: Synthetic oligonucleotide
  Target: ATXN1; (+) strand; PAM type: YTN; PAM sequence: TTA
tatatagtatataatatatt

SEQ ID NO: 288837 - DNA, 20 bp, Artificial Sequence
  Description of Artificial Sequence: Synthetic oligonucleotide
  Target: ATXN1; (+) strand; PAM type: YTN; PAM sequence: TTT
tataatatattatatactat

SEQ ID NO: 288838 - DNA, 20 bp, Artificial Sequence
  Description of Artificial Sequence: Synthetic oligonucleotide
  Target: ATXN1; (+) strand; PAM type: YTN; PAM sequence: TTT
ataatatattatatactata

SEQ ID NO: 288839 - DNA, 20 bp, Artificial Sequence
  Description of Artificial Sequence: Synthetic oligonucleotide
  Target: ATXN1; (+) strand; PAM type: YTN; PAM sequence: TTA
taatatattatatactatat

SEQ ID NO: 288840 - DNA, 20 bp, Artificial Sequence
  Description of Artificial Sequence: Synthetic oligonucleotide
  Target: ATXN1; (+) strand; PAM type: YTN; PAM sequence: TTA
tatactatatataaaatatt

SEQ ID NO: 288841 - DNA, 20 bp, Artificial Sequence
  Description of Artificial Sequence: Synthetic oligonucleotide
  Target: ATXN1; (+) strand; PAM type: YTN; PAM sequence: CTA
tatataaaatattttatata

SEQ ID NO: 288842 - DNA, 20 bp, Artificial Sequence
  Description of Artificial Sequence: Synthetic oligonucleotide
  Target: ATXN1; (+) strand; PAM type: YTN; PAM sequence: TTT
tatatatttatataaaatat

SEQ ID NO: 288843 - DNA, 20 bp, Artificial Sequence
  Description of Artificial Sequence: Synthetic oligonucleotide
  Target: ATXN1; (+) strand; PAM type: YTN; PAM sequence: TTT
atatatttatataaaatata

SEQ ID NO: 288844 - DNA, 20 bp, Artificial Sequence
  Description of Artificial Sequence: Synthetic oligonucleotide
  Target: ATXN1; (+) strand; PAM type: YTN; PAM sequence: TTA
tatatttatataaaatatat

SEQ ID NO: 288845 - DNA, 20 bp, Artificial Sequence
  Description of Artificial Sequence: Synthetic oligonucleotide
  Target: ATXN1; (+) strand; PAM type: YTN; PAM sequence: TTT
atataaaatatattatataa

SEQ ID NO: 288846 - DNA, 20 bp, Artificial Sequence
  Description of Artificial Sequence: Synthetic oligonucleotide
  Target: ATXN1; (+) strand; PAM type: YTN; PAM sequence: TTA
tataaaatatattatataat

SEQ ID NO: 288847 - DNA, 20 bp, Artificial Sequence
  Description of Artificial Sequence: Synthetic oligonucleotide
  Target: ATXN1; (+) strand; PAM type: YTN; PAM sequence: TTA
tataatgtataatataaaat

SEQ ID NO: 288848 - DNA, 20 bp, Artificial Sequence
  Description of Artificial Sequence: Synthetic oligonucleotide
  Target: ATXN1; (+) strand; PAM type: YTN; PAM sequence: TTA
tatatattatatattaataa

SEQ ID NO: 288849 - DNA, 20 bp, Artificial Sequence
  Description of Artificial Sequence: Synthetic oligonucleotide
  Target: ATXN1; (+) strand; PAM type: YTN; PAM sequence: TTA
tatattaataattatatata

SEQ ID NO: 288850 - DNA, 20 bp, Artificial Sequence
  Description of Artificial Sequence: Synthetic oligonucleotide
  Target: ATXN1; (+) strand; PAM type: YTN; PAM sequence: TTA
ataattatatataatggtca

SEQ ID NO: 288851 - DNA, 20 bp, Artificial Sequence
  Description of Artificial Sequence: Synthetic oligonucleotide
  Target: ATXN1; (+) strand; PAM type: YTN; PAM sequence: TTA
tatataatggtcagttacta

SEQ ID NO: 288852 - DNA, 20 bp, Artificial Sequence
  Description of Artificial Sequence: Synthetic oligonucleotide
  Target: ATXN1; (+) strand; PAM type: YTN; PAM sequence: TTA
ctagaagatatacatatacc

SEQ ID NO: 288853 - DNA, 20 bp, Artificial Sequence
  Description of Artificial Sequence: Synthetic oligonucleotide
  Target: ATXN1; (+) strand; PAM type: YTN; PAM sequence: CTA
gaagatatacatatacccct

SEQ ID NO: 288854 - DNA, 20 bp, Artificial Sequence
  Description of Artificial Sequence: Synthetic oligonucleotide
  Target: ATXN1; (+) strand; PAM type: YTN; PAM sequence: CTC
cacacacacttacatagaca

SEQ ID NO: 288855 - DNA, 20 bp, Artificial Sequence
  Description of Artificial Sequence: Synthetic oligonucleotide
  Target: ATXN1; (+) strand; PAM type: YTN; PAM sequence: CTT
acatagacatactaatagtt

SEQ ID NO: 288856 - DNA, 20 bp, Artificial Sequence
  Description of Artificial Sequence: Synthetic oligonucleotide
  Target: ATXN1; (+) strand; PAM type: YTN; PAM sequence: TTA
catagacatactaatagttt

SEQ ID NO: 288857 - DNA, 20 bp, Artificial Sequence
  Description of Artificial Sequence: Synthetic oligonucleotide
  Target: ATXN1; (+) strand; PAM type: YTN; PAM sequence: CTA
atagttttcctaaaacgcaa

SEQ ID NO: 288858 - DNA, 20 bp, Artificial Sequence
  Description of Artificial Sequence: Synthetic oligonucleotide
  Target: ATXN1; (+) strand; PAM type: YTN; PAM sequence: TTT
tcctaaaacgcaatgataat

SEQ ID NO: 288859 - DNA, 20 bp, Artificial Sequence
  Description of Artificial Sequence: Synthetic oligonucleotide
  Target: ATXN1; (+) strand; PAM type: YTN; PAM sequence: TTT
cctaaaacgcaatgataatc

SEQ ID NO: 288860 - DNA, 20 bp, Artificial Sequence
  Description of Artificial Sequence: Synthetic oligonucleotide
  Target: ATXN1; (+) strand; PAM type: YTN; PAM sequence: TTC
ctaaaacgcaatgataatca

SEQ ID NO: 288861 - DNA, 20 bp, Artificial Sequence
  Description of Artificial Sequence: Synthetic oligonucleotide
  Target: ATXN1; (+) strand; PAM type: YTN; PAM sequence: CTA
aaacgcaatgataatcaggt

SEQ ID NO: 288862 - DNA, 20 bp, Artificial Sequence
  Description of Artificial Sequence: Synthetic oligonucleotide
  Target: ATXN1; (+) strand; PAM type: YTN; PAM sequence: TTT
cccttatacagtagtctccc

SEQ ID NO: 288863 - DNA, 20 bp, Artificial Sequence
  Description of Artificial Sequence: Synthetic oligonucleotide
  Target: ATXN1; (+) strand; PAM type: YTN; PAM sequence: TTC
ccttatacagtagtctcccc

SEQ ID NO: 288864 - DNA, 20 bp, Artificial Sequence
  Description of Artificial Sequence: Synthetic oligonucleotide
  Target: ATXN1; (+) strand; PAM type: YTN; PAM sequence: CTT
atacagtagtctccccatag

SEQ ID NO: 288865 - DNA, 20 bp, Artificial Sequence
  Description of Artificial Sequence: Synthetic oligonucleotide
  Target: ATXN1; (+) strand; PAM type: YTN; PAM sequence: TTA
tacagtagtctccccatagc

SEQ ID NO: 288866 - DNA, 20 bp, Artificial Sequence
  Description of Artificial Sequence: Synthetic oligonucleotide
  Target: ATXN1; (+) strand; PAM type: YTN; PAM sequence: CTC
cccatagccacggttttgct

SEQ ID NO: 288867 - DNA, 20 bp, Artificial Sequence
  Description of Artificial Sequence: Synthetic oligonucleotide
  Target: ATXN1; (+) strand; PAM type: YTN; PAM sequence: TTT
tgctttccatggttttattt

SEQ ID NO: 288868 - DNA, 20 bp, Artificial Sequence
  Description of Artificial Sequence: Synthetic oligonucleotide
  Target: ATXN1; (+) strand; PAM type: YTN; PAM sequence: TTT
gctttccatggttttattta

SEQ ID NO: 288869 - DNA, 20 bp, Artificial Sequence
  Description of Artificial Sequence: Synthetic oligonucleotide
  Target: ATXN1; (+) strand; PAM type: YTN; PAM sequence: TTG
ctttccatggttttatttat

SEQ ID NO: 288870 - DNA, 20 bp, Artificial Sequence
  Description of Artificial Sequence: Synthetic oligonucleotide
  Target: ATXN1; (+) strand; PAM type: YTN; PAM sequence: CTT
tccatggttttatttattgg

SEQ ID NO: 288871 - DNA, 20 bp, Artificial Sequence
  Description of Artificial Sequence: Synthetic oligonucleotide
  Target: ATXN1; (+) strand; PAM type: YTN; PAM sequence: TTT
ccatggttttatttattggt

SEQ ID NO: 288872 - DNA, 20 bp, Artificial Sequence
  Description of Artificial Sequence: Synthetic oligonucleotide
  Target: ATXN1; (+) strand; PAM type: YTN; PAM sequence: TTC
catggttttatttattggtc

SEQ ID NO: 288873 - DNA, 20 bp, Artificial Sequence
  Description of Artificial Sequence: Synthetic oligonucleotide
  Target: ATXN1; (+) strand; PAM type: YTN; PAM sequence: TTT
tatttattggtcaatttgct

SEQ ID NO: 288874 - DNA, 20 bp, Artificial Sequence
  Description of Artificial Sequence: Synthetic oligonucleotide
  Target: ATXN1; (+) strand; PAM type: YTN; PAM sequence: TTT
atttattggtcaatttgctg

SEQ ID NO: 288875 - DNA, 20 bp, Artificial Sequence
  Description of Artificial Sequence: Synthetic oligonucleotide
  Target: ATXN1; (+) strand; PAM type: YTN; PAM sequence: TTA
tttattggtcaatttgctgt

SEQ ID NO: 288876 - DNA, 20 bp, Artificial Sequence
  Description of Artificial Sequence: Synthetic oligonucleotide
  Target: ATXN1; (+) strand; PAM type: YTN; PAM sequence: TTT
attggtcaatttgctgtctg

SEQ ID NO: 288877 - DNA, 20 bp, Artificial Sequence
  Description of Artificial Sequence: Synthetic oligonucleotide
  Target: ATXN1; (+) strand; PAM type: YTN; PAM sequence: TTA
ttggtcaatttgctgtctga

SEQ ID NO: 288878 - DNA, 20 bp, Artificial Sequence
  Description of Artificial Sequence: Synthetic oligonucleotide
  Target: ATXN1; (+) strand; PAM type: YTN; PAM sequence: TTG
gtcaatttgctgtctgaaaa

SEQ ID NO: 288879 - DNA, 20 bp, Artificial Sequence
  Description of Artificial Sequence: Synthetic oligonucleotide
  Target: ATXN1; (+) strand; PAM type: YTN; PAM sequence: TTT
gctgtctgaaaataggcgag

SEQ ID NO: 288880 - DNA, 20 bp, Artificial Sequence
  Description of Artificial Sequence: Synthetic oligonucleotide
  Target: ATXN1; (+) strand; PAM type: YTN; PAM sequence: TTG
ctgtctgaaaataggcgagt

SEQ ID NO: 288881 - DNA, 20 bp, Artificial Sequence
  Description of Artificial Sequence: Synthetic oligonucleotide
  Target: ATXN1; (+) strand; PAM type: YTN; PAM sequence: CTG
tctgaaaataggcgagtaca

SEQ ID NO: 288882 - DNA, 20 bp, Artificial Sequence
  Description of Artificial Sequence: Synthetic oligonucleotide
  Target: ATXN1; (+) strand; PAM type: YTN; PAM sequence: CTG
aaaataggcgagtacagtac

SEQ ID NO: 288883 - DNA, 20 bp, Artificial Sequence
  Description of Artificial Sequence: Synthetic oligonucleotide
  Target: ATXN1; (+) strand; PAM type: YTN; PAM sequence: TTT
ggagactgagagagatcaca

SEQ ID NO: 288884 - DNA, 20 bp, Artificial Sequence
  Description of Artificial Sequence: Synthetic oligonucleotide
  Target: ATXN1; (+) strand; PAM type: YTN; PAM sequence: TTG
gagactgagagagatcacat

SEQ ID NO: 288885 - DNA, 20 bp, Artificial Sequence
  Description of Artificial Sequence: Synthetic oligonucleotide
  Target: ATXN1; (+) strand; PAM type: YTN; PAM sequence: CTG
agagagatcacatccacata

SEQ ID NO: 288886 - DNA, 20 bp, Artificial Sequence
  Description of Artificial Sequence: Synthetic oligonucleotide
  Target: ATXN1; (+) strand; PAM type: YTN; PAM sequence: CTT
ttattatagtatatttttat

SEQ ID NO: 288887 - DNA, 20 bp, Artificial Sequence
  Description of Artificial Sequence: Synthetic oligonucleotide
  Target: ATXN1; (+) strand; PAM type: YTN; PAM sequence: TTT
tattatagtatatttttata

SEQ ID NO: 288888 - DNA, 20 bp, Artificial Sequence
  Description of Artificial Sequence: Synthetic oligonucleotide
  Target: ATXN1; (+) strand; PAM type: YTN; PAM sequence: TTT
attatagtatatttttatat

SEQ ID NO: 288889 - DNA, 20 bp, Artificial Sequence
  Description of Artificial Sequence: Synthetic oligonucleotide
  Target: ATXN1; (+) strand; PAM type: YTN; PAM sequence: TTA
ttatagtatatttttatata

SEQ ID NO: 288890 - DNA, 20 bp, Artificial Sequence
  Description of Artificial Sequence: Synthetic oligonucleotide
  Target: ATXN1; (+) strand; PAM type: YTN; PAM sequence: TTA
tagtatatttttatataagt

SEQ ID NO: 288891 - DNA, 20 bp, Artificial Sequence
  Description of Artificial Sequence: Synthetic oligonucleotide
  Target: ATXN1; (+) strand; PAM type: YTN; PAM sequence: TTT
ttatataagtattttatttg

SEQ ID NO: 288892 - DNA, 20 bp, Artificial Sequence
  Description of Artificial Sequence: Synthetic oligonucleotide
  Target: ATXN1; (+) strand; PAM type: YTN; PAM sequence: TTT
tatataagtattttatttga

SEQ ID NO: 288893 - DNA, 20 bp, Artificial Sequence
  Description of Artificial Sequence: Synthetic oligonucleotide
  Target: ATXN1; (+) strand; PAM type: YTN; PAM sequence: TTT
atataagtattttatttgat

SEQ ID NO: 288894 - DNA, 20 bp, Artificial Sequence
  Description of Artificial Sequence: Synthetic oligonucleotide
  Target: ATXN1; (+) strand; PAM type: YTN; PAM sequence: TTA
tataagtattttatttgatt

SEQ ID NO: 288895 - DNA, 20 bp, Artificial Sequence
  Description of Artificial Sequence: Synthetic oligonucleotide
  Target: ATXN1; (+) strand; PAM type: YTN; PAM sequence: TTT
tatttgattattagttattg

SEQ ID NO: 288896 - DNA, 20 bp, Artificial Sequence
  Description of Artificial Sequence: Synthetic oligonucleotide
  Target: ATXN1; (+) strand; PAM type: YTN; PAM sequence: TTT
atttgattattagttattgt

SEQ ID NO: 288897 - DNA, 20 bp, Artificial Sequence
  Description of Artificial Sequence: Synthetic oligonucleotide
  Target: ATXN1; (+) strand; PAM type: YTN; PAM sequence: TTA
tttgattattagttattgtt

SEQ ID NO: 288898 - DNA, 20 bp, Artificial Sequence
  Description of Artificial Sequence: Synthetic oligonucleotide
  Target: ATXN1; (+) strand; PAM type: YTN; PAM sequence: TTT
gattattagttattgttgtt

SEQ ID NO: 288899 - DNA, 20 bp, Artificial Sequence
  Description of Artificial Sequence: Synthetic oligonucleotide
  Target: ATXN1; (+) strand; PAM type: YTN; PAM sequence: TTG
attattagttattgttgtta

SEQ ID NO: 288900 - DNA, 20 bp, Artificial Sequence
  Description of Artificial Sequence: Synthetic oligonucleotide
  Target: ATXN1; (+) strand; PAM type: YTN; PAM sequence: TTA
ttagttattgttgttaatct

SEQ ID NO: 288901 - DNA, 20 bp, Artificial Sequence
  Description of Artificial Sequence: Synthetic oligonucleotide
  Target: ATXN1; (+) strand; PAM type: YTN; PAM sequence: TTA
gttattgttgttaatctcta

SEQ ID NO: 288902 - DNA, 20 bp, Artificial Sequence
  Description of Artificial Sequence: Synthetic oligonucleotide
  Target: ATXN1; (+) strand; PAM type: YTN; PAM sequence: TTA
ttgttgttaatctctaattt

SEQ ID NO: 288903 - DNA, 20 bp, Artificial Sequence
  Description of Artificial Sequence: Synthetic oligonucleotide
  Target: ATXN1; (+) strand; PAM type: YTN; PAM sequence: TTG
ttgttaatctctaatttata

SEQ ID NO: 288904 - DNA, 20 bp, Artificial Sequence
  Description of Artificial Sequence: Synthetic oligonucleotide
  Target: ATXN1; (+) strand; PAM type: YTN; PAM sequence: TTG
ttaatctctaatttatacat

SEQ ID NO: 288905 - DNA, 20 bp, Artificial Sequence
  Description of Artificial Sequence: Synthetic oligonucleotide
  Target: ATXN1; (+) strand; PAM type: YTN; PAM sequence: TTA
atctctaatttatacattga

SEQ ID NO: 288906 - DNA, 20 bp, Artificial Sequence
  Description of Artificial Sequence: Synthetic oligonucleotide
  Target: ATXN1; (+) strand; PAM type: YTN; PAM sequence: CTC
taatttatacattgaatttt

SEQ ID NO: 288907 - DNA, 20 bp, Artificial Sequence
  Description of Artificial Sequence: Synthetic oligonucleotide
  Target: ATXN1; (+) strand; PAM type: YTN; PAM sequence: CTA
atttatacattgaattttat

SEQ ID NO: 288908 - DNA, 20 bp, Artificial Sequence
  Description of Artificial Sequence: Synthetic oligonucleotide
  Target: ATXN1; (+) strand; PAM type: YTN; PAM sequence: TTT
atacattgaattttatcatg

SEQ ID NO: 288909 - DNA, 20 bp, Artificial Sequence
  Description of Artificial Sequence: Synthetic oligonucleotide
  Target: ATXN1; (+) strand; PAM type: YTN; PAM sequence: TTA
tacattgaattttatcatgg

SEQ ID NO: 288910 - DNA, 20 bp, Artificial Sequence
  Description of Artificial Sequence: Synthetic oligonucleotide
  Target: ATXN1; (+) strand; PAM type: YTN; PAM sequence: TTG
aattttatcatggtgtgtac

SEQ ID NO: 288911 - DNA, 20 bp, Artificial Sequence
  Description of Artificial Sequence: Synthetic oligonucleotide
  Target: ATXN1; (+) strand; PAM type: YTN; PAM sequence: TTT
tatcatggtgtgtacgtaca

SEQ ID NO: 288912 - DNA, 20 bp, Artificial Sequence
  Description of Artificial Sequence: Synthetic oligonucleotide
  Target: ATXN1; (+) strand; PAM type: YTN; PAM sequence: TTT
atcatggtgtgtacgtacag

SEQ ID NO: 288913 - DNA, 20 bp, Artificial Sequence
  Description of Artificial Sequence: Synthetic oligonucleotide
  Target: ATXN1; (+) strand; PAM type: YTN; PAM sequence: TTA
tcatggtgtgtacgtacagg

SEQ ID NO: 288914 - DNA, 20 bp, Artificial Sequence
  Description of Artificial Sequence: Synthetic oligonucleotide
  Target: ATXN1; (+) strand; PAM type: YTN; PAM sequence: CTA
tatagggtttggtactaact

SEQ ID NO: 288915 - DNA, 20 bp, Artificial Sequence
  Description of Artificial Sequence: Synthetic oligonucleotide
  Target: ATXN1; (+) strand; PAM type: YTN; PAM sequence: TTT
ggtactaactggcagtttca

SEQ ID NO: 288916 - DNA, 20 bp, Artificial Sequence
  Description of Artificial Sequence: Synthetic oligonucleotide
  Target: ATXN1; (+) strand; PAM type: YTN; PAM sequence: TTG
gtactaactggcagtttcag

SEQ ID NO: 288917 - DNA, 20 bp, Artificial Sequence
  Description of Artificial Sequence: Synthetic oligonucleotide
  Target: ATXN1; (+) strand; PAM type: YTN; PAM sequence: CTA
actggcagtttcaggaatcc

SEQ ID NO: 288918 - DNA, 20 bp, Artificial Sequence
  Description of Artificial Sequence: Synthetic oligonucleotide
  Target: ATXN1; (+) strand; PAM type: YTN; PAM sequence: CTG
gcagtttcaggaatccacca

SEQ ID NO: 288919 - DNA, 20 bp, Artificial Sequence
  Description of Artificial Sequence: Synthetic oligonucleotide
  Target: ATXN1; (+) strand; PAM type: YTN; PAM sequence: TTT
caggaatccaccaggggtat

SEQ ID NO: 288920 - DNA, 20 bp, Artificial Sequence
  Description of Artificial Sequence: Synthetic oligonucleotide
  Target: ATXN1; (+) strand; PAM type: YTN; PAM sequence: TTC
aggaatccaccaggggtatg

SEQ ID NO: 288921 - DNA, 20 bp, Artificial Sequence
  Description of Artificial Sequence: Synthetic oligonucleotide
  Target: ATXN1; (+) strand; PAM type: YTN; PAM sequence: TTG
atcggggggactactgtata

SEQ ID NO: 288922 - DNA, 20 bp, Artificial Sequence
  Description of Artificial Sequence: Synthetic oligonucleotide
  Target: ATXN1; (+) strand; PAM type: YTN; PAM sequence: CTA
ctgtataaggaaaataaaga

SEQ ID NO: 288923 - DNA, 20 bp, Artificial Sequence
  Description of Artificial Sequence: Synthetic oligonucleotide
  Target: ATXN1; (+) strand; PAM type: YTN; PAM sequence: CTG
tataaggaaaataaagatta

SEQ ID NO: 288924 - DNA, 20 bp, Artificial Sequence
  Description of Artificial Sequence: Synthetic oligonucleotide
  Target: ATXN1; (+) strand; PAM type: YTN; PAM sequence: TTA
agtgcacaattataaccaac

SEQ ID NO: 288925 - DNA, 20 bp, Artificial Sequence
  Description of Artificial Sequence: Synthetic oligonucleotide
  Target: ATXN1; (+) strand; PAM type: YTN; PAM sequence: TTA
taaccaacactgtaaaatct

SEQ ID NO: 288926 - DNA, 20 bp, Artificial Sequence
  Description of Artificial Sequence: Synthetic oligonucleotide
  Target: ATXN1; (+) strand; PAM type: YTN; PAM sequence: CTG
taaaatctctaaagaaaaca

SEQ ID NO: 288927 - DNA, 20 bp, Artificial Sequence
  Description of Artificial Sequence: Synthetic oligonucleotide
  Target: ATXN1; (+) strand; PAM type: YTN; PAM sequence: CTC
taaagaaaacaagaactgct

SEQ ID NO: 288928 - DNA, 20 bp, Artificial Sequence
  Description of Artificial Sequence: Synthetic oligonucleotide
  Target: ATXN1; (+) strand; PAM type: YTN; PAM sequence: CTA
aagaaaacaagaactgctca

SEQ ID NO: 288929 - DNA, 20 bp, Artificial Sequence
  Description of Artificial Sequence: Synthetic oligonucleotide
  Target: ATXN1; (+) strand; PAM type: YTN; PAM sequence: CTG
ctcagattctataaaaacag

SEQ ID NO: 288930 - DNA, 20 bp, Artificial Sequence
  Description of Artificial Sequence: Synthetic oligonucleotide
  Target: ATXN1; (+) strand; PAM type: YTN; PAM sequence: CTC
agattctataaaaacagaaa

SEQ ID NO: 288931 - DNA, 20 bp, Artificial Sequence
  Description of Artificial Sequence: Synthetic oligonucleotide
  Target: ATXN1; (+) strand; PAM type: YTN; PAM sequence: TTC
tataaaaacagaaaatgcat

SEQ ID NO: 288932 - DNA, 20 bp, Artificial Sequence
  Description of Artificial Sequence: Synthetic oligonucleotide
  Target: ATXN1; (+) strand; PAM type: YTN; PAM sequence: CTA
taaaaacagaaaatgcatta

SEQ ID NO: 288933 - DNA, 20 bp, Artificial Sequence
  Description of Artificial Sequence: Synthetic oligonucleotide
  Target: ATXN1; (+) strand; PAM type: YTN; PAM sequence: TTA
ctaaaaaactaaaggaaaaa

SEQ ID NO: 288934 - DNA, 20 bp, Artificial Sequence
  Description of Artificial Sequence: Synthetic oligonucleotide
  Target: ATXN1; (+) strand; PAM type: YTN; PAM sequence: CTA
aaaaactaaaggaaaaacat

SEQ ID NO: 288935 - DNA, 20 bp, Artificial Sequence
  Description of Artificial Sequence: Synthetic oligonucleotide
  Target: ATXN1; (+) strand; PAM type: YTN; PAM sequence: CTA
aaggaaaaacattgtgcatg

SEQ ID NO: 288936 - DNA, 20 bp, Artificial Sequence
  Description of Artificial Sequence: Synthetic oligonucleotide
  Target: ATXN1; (+) strand; PAM type: YTN; PAM sequence: TTG
tgcatggatcaaaaattaca

SEQ ID NO: 288937 - DNA, 20 bp, Artificial Sequence
  Description of Artificial Sequence: Synthetic oligonucleotide
  Target: ATXN1; (+) strand; PAM type: YTN; PAM sequence: TTA
caagagttcagtaaagactt

SEQ ID NO: 288938 - DNA, 20 bp, Artificial Sequence
  Description of Artificial Sequence: Synthetic oligonucleotide
  Target: ATXN1; (+) strand; PAM type: YTN; PAM sequence: TTC
agtaaagacttccattctct

SEQ ID NO: 288939 - DNA, 20 bp, Artificial Sequence
  Description of Artificial Sequence: Synthetic oligonucleotide
  Target: ATXN1; (+) strand; PAM type: YTN; PAM sequence: CTT
ccattctctctgaattgata

SEQ ID NO: 288940 - DNA, 20 bp, Artificial Sequence
  Description of Artificial Sequence: Synthetic oligonucleotide
  Target: ATXN1; (+) strand; PAM type: YTN; PAM sequence: TTC
cattctctctgaattgatat

SEQ ID NO: 288941 - DNA, 20 bp, Artificial Sequence
  Description of Artificial Sequence: Synthetic oligonucleotide
  Target: ATXN1; (+) strand; PAM type: YTN; PAM sequence: TTC
tctctgaattgatatctaat

SEQ ID NO: 288942 - DNA, 20 bp, Artificial Sequence
  Description of Artificial Sequence: Synthetic oligonucleotide
  Target: ATXN1; (+) strand; PAM type: YTN; PAM sequence: CTC
tctgaattgatatctaatct

SEQ ID NO: 288943 - DNA, 20 bp, Artificial Sequence
  Description of Artificial Sequence: Synthetic oligonucleotide
  Target: ATXN1; (+) strand; PAM type: YTN; PAM sequence: CTC
tgaattgatatctaatctat

SEQ ID NO: 288944 - DNA, 20 bp, Artificial Sequence
  Description of Artificial Sequence: Synthetic oligonucleotide
  Target: ATXN1; (+) strand; PAM type: YTN; PAM sequence: CTG
aattgatatctaatctatta

SEQ ID NO: 288945 - DNA, 20 bp, Artificial Sequence
  Description of Artificial Sequence: Synthetic oligonucleotide
  Target: ATXN1; (+) strand; PAM type: YTN; PAM sequence: TTG
atatctaatctattaaatta

SEQ ID NO: 288946 - DNA, 20 bp, Artificial Sequence
  Description of Artificial Sequence: Synthetic oligonucleotide
  Target: ATXN1; (+) strand; PAM type: YTN; PAM sequence: CTA
atctattaaattaaatttta

SEQ ID NO: 288947 - DNA, 20 bp, Artificial Sequence
  Description of Artificial Sequence: Synthetic oligonucleotide
  Target: ATXN1; (+) strand; PAM type: YTN; PAM sequence: CTA
ttaaattaaattttattttg

SEQ ID NO: 288948 - DNA, 20 bp, Artificial Sequence
  Description of Artificial Sequence: Synthetic oligonucleotide
  Target: ATXN1; (+) strand; PAM type: YTN; PAM sequence: TTA
aattaaattttattttgaaa

SEQ ID NO: 288949 - DNA, 20 bp, Artificial Sequence
  Description of Artificial Sequence: Synthetic oligonucleotide
  Target: ATXN1; (+) strand; PAM type: YTN; PAM sequence: TTA
aattttattttgaaaagatg

SEQ ID NO: 288950 - DNA, 20 bp, Artificial Sequence
  Description of Artificial Sequence: Synthetic oligonucleotide
  Target: ATXN1; (+) strand; PAM type: YTN; PAM sequence: TTT
tattttgaaaagatgtttta

SEQ ID NO: 288951 - DNA, 20 bp, Artificial Sequence
  Description of Artificial Sequence: Synthetic oligonucleotide
  Target: ATXN1; (+) strand; PAM type: YTN; PAM sequence: TTT
attttgaaaagatgttttaa

SEQ ID NO: 288952 - DNA, 20 bp, Artificial Sequence
  Description of Artificial Sequence: Synthetic oligonucleotide
  Target: ATXN1; (+) strand; PAM type: YTN; PAM sequence: TTA
ttttgaaaagatgttttaaa

SEQ ID NO: 288953 - DNA, 20 bp, Artificial Sequence
  Description of Artificial Sequence: Synthetic oligonucleotide
  Target: ATXN1; (+) strand; PAM type: YTN; PAM sequence: TTT
tgaaaagatgttttaaaatc

SEQ ID NO: 288954 - DNA, 20 bp, Artificial Sequence
  Description of Artificial Sequence: Synthetic oligonucleotide
  Target: ATXN1; (+) strand; PAM type: YTN; PAM sequence: TTT
gaaaagatgttttaaaatct

SEQ ID NO: 288955 - DNA, 20 bp, Artificial Sequence
  Description of Artificial Sequence: Synthetic oligonucleotide
  Target: ATXN1; (+) strand; PAM type: YTN; PAM sequence: TTG
aaaagatgttttaaaatctg

SEQ ID NO: 288956 - DNA, 20 bp, Artificial Sequence
  Description of Artificial Sequence: Synthetic oligonucleotide
  Target: ATXN1; (+) strand; PAM type: YTN; PAM sequence: TTT
taaaatctgactaaattagt

SEQ ID NO: 288957 - DNA, 20 bp, Artificial Sequence
  Description of Artificial Sequence: Synthetic oligonucleotide
  Target: ATXN1; (+) strand; PAM type: YTN; PAM sequence: TTT
aaaatctgactaaattagtc

SEQ ID NO: 288958 - DNA, 20 bp, Artificial Sequence
  Description of Artificial Sequence: Synthetic oligonucleotide
  Target: ATXN1; (+) strand; PAM type: YTN; PAM sequence: TTA
aaatctgactaaattagtct

SEQ ID NO: 288959 - DNA, 20 bp, Artificial Sequence
  Description of Artificial Sequence: Synthetic oligonucleotide
  Target: ATXN1; (+) strand; PAM type: YTN; PAM sequence: CTG
actaaattagtctatgtaca

SEQ ID NO: 288960 - DNA, 20 bp, Artificial Sequence
  Description of Artificial Sequence: Synthetic oligonucleotide
  Target: ATXN1; (+) strand; PAM type: YTN; PAM sequence: CTA
aattagtctatgtacacatg

SEQ ID NO: 288961 - DNA, 20 bp, Artificial Sequence
  Description of Artificial Sequence: Synthetic oligonucleotide
  Target: ATXN1; (+) strand; PAM type: YTN; PAM sequence: TTA
gtctatgtacacatgaaaga

SEQ ID NO: 288962 - DNA, 20 bp, Artificial Sequence
  Description of Artificial Sequence: Synthetic oligonucleotide
  Target: ATXN1; (+) strand; PAM type: YTN; PAM sequence: CTA
tgtacacatgaaagaataaa

SEQ ID NO: 288963 - DNA, 20 bp, Artificial Sequence
  Description of Artificial Sequence: Synthetic oligonucleotide
  Target: ATXN1; (+) strand; PAM type: YTN; PAM sequence: CTA
aaaatagctaataaatgctg

SEQ ID NO: 288964 - DNA, 20 bp, Artificial Sequence
  Description of Artificial Sequence: Synthetic oligonucleotide
  Target: ATXN1; (+) strand; PAM type: YTN; PAM sequence: CTA
ataaatgctgaaaaaaaata

SEQ ID NO: 288965 - DNA, 20 bp, Artificial Sequence
  Description of Artificial Sequence: Synthetic oligonucleotide
  Target: ATXN1; (+) strand; PAM type: YTN; PAM sequence: CTG
aaaaaaaatatatgaaagaa

SEQ ID NO: 288966 - DNA, 20 bp, Artificial Sequence
  Description of Artificial Sequence: Synthetic oligonucleotide
  Target: ATXN1; (+) strand; PAM type: YTN; PAM sequence: CTA
attatattaaaatcttctaa

SEQ ID NO: 288967 - DNA, 20 bp, Artificial Sequence
  Description of Artificial Sequence: Synthetic oligonucleotide
  Target: ATXN1; (+) strand; PAM type: YTN; PAM sequence: TTA
tattaaaatcttctaaactc

SEQ ID NO: 288968 - DNA, 20 bp, Artificial Sequence
  Description of Artificial Sequence: Synthetic oligonucleotide
  Target: ATXN1; (+) strand; PAM type: YTN; PAM sequence: TTA
aaatcttctaaactcataga

SEQ ID NO: 288969 - DNA, 20 bp, Artificial Sequence
  Description of Artificial Sequence: Synthetic oligonucleotide
  Target: ATXN1; (+) strand; PAM type: YTN; PAM sequence: CTT
ctaaactcatagaatcaaaa

SEQ ID NO: 288970 - DNA, 20 bp, Artificial Sequence
  Description of Artificial Sequence: Synthetic oligonucleotide
  Target: ATXN1; (+) strand; PAM type: YTN; PAM sequence: TTC
taaactcatagaatcaaaag

SEQ ID NO: 288971 - DNA, 20 bp, Artificial Sequence
  Description of Artificial Sequence: Synthetic oligonucleotide
  Target: ATXN1; (+) strand; PAM type: YTN; PAM sequence: CTA
aactcatagaatcaaaagca

SEQ ID NO: 288972 - DNA, 20 bp, Artificial Sequence
  Description of Artificial Sequence: Synthetic oligonucleotide
  Target: ATXN1; (+) strand; PAM type: YTN; PAM sequence: CTC
atagaatcaaaagcaaaata

SEQ ID NO: 288973 - DNA, 20 bp, Artificial Sequence
  Description of Artificial Sequence: Synthetic oligonucleotide
  Target: ATXN1; (+) strand; PAM type: YTN; PAM sequence: CTT
agaaatgcggatcacgaggt

SEQ ID NO: 288974 - DNA, 20 bp, Artificial Sequence
  Description of Artificial Sequence: Synthetic oligonucleotide
  Target: ATXN1; (+) strand; PAM type: YTN; PAM sequence: TTA
gaaatgcggatcacgaggtc

SEQ ID NO: 288975 - DNA, 20 bp, Artificial Sequence
  Description of Artificial Sequence: Synthetic oligonucleotide
  Target: ATXN1; (+) strand; PAM type: YTN; PAM sequence: CTG
gctaacacagtgaaaccccg

SEQ ID NO: 288976 - DNA, 20 bp, Artificial Sequence
  Description of Artificial Sequence: Synthetic oligonucleotide
  Target: ATXN1; (+) strand; PAM type: YTN; PAM sequence: CTA
acacagtgaaaccccgtctc

SEQ ID NO: 288977 - DNA, 20 bp, Artificial Sequence
  Description of Artificial Sequence: Synthetic oligonucleotide
  Target: ATXN1; (+) strand; PAM type: YTN; PAM sequence: CTC
tactaaaaacacacacaaaa

SEQ ID NO: 288978 - DNA, 20 bp, Artificial Sequence
  Description of Artificial Sequence: Synthetic oligonucleotide
  Target: ATXN1; (+) strand; PAM type: YTN; PAM sequence: CTA
ctaaaaacacacacaaaaat

SEQ ID NO: 288979 - DNA, 20 bp, Artificial Sequence
  Description of Artificial Sequence: Synthetic oligonucleotide
  Target: ATXN1; (+) strand; PAM type: YTN; PAM sequence: CTA
aaaacacacacaaaaattag

SEQ ID NO: 288980 - DNA, 20 bp, Artificial Sequence
  Description of Artificial Sequence: Synthetic oligonucleotide
  Target: ATXN1; (+) strand; PAM type: YTN; PAM sequence: TTA
gccgggcgtggtggcgggcg

SEQ ID NO: 288981 - DNA, 20 bp, Artificial Sequence
  Description of Artificial Sequence: Synthetic oligonucleotide
  Target: ATXN1; (+) strand; PAM type: YTN; PAM sequence: CTG
cagtcccagctactcgggag

SEQ ID NO: 288982 - DNA, 20 bp, Artificial Sequence
  Description of Artificial Sequence: Synthetic oligonucleotide
  Target: ATXN1; (+) strand; PAM type: YTN; PAM sequence: CTA
ctcgggaggctgaggcagga

SEQ ID NO: 288983 - DNA, 20 bp, Artificial Sequence
  Description of Artificial Sequence: Synthetic oligonucleotide
  Target: ATXN1; (+) strand; PAM type: YTN; PAM sequence: CTC
gggaggctgaggcaggagaa

SEQ ID NO: 288984 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatggcctgaa

SEQ ID NO: 288985 - DNA, 20 bp, Artificial Sequence
  Description of Artificial Sequence: Synthetic oligonucleotide
  Target: ATXN1; (+) strand; PAM type: YTN; PAM sequence: CTG
aacccgtgaggcggagcttg

SEQ ID NO: 288986 - DNA, 20 bp, Artificial Sequence
  Description of Artificial Sequence: Synthetic oligonucleotide
  Target: ATXN1; (+) strand; PAM type: YTN; PAM sequence: CTT
gcagtgagccgagatcacgc

SEQ ID NO: 288987 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagatcacgcc

SEQ ID NO: 288988 - DNA, 20 bp, Artificial Sequence
  Description of Artificial Sequence: Synthetic oligonucleotide
  Target: ATXN1; (+) strand; PAM type: YTN; PAM sequence: CTG
cactcctgcctgggcaatag

SEQ ID NO: 288989 - DNA, 20 bp, Artificial Sequence
  Description of Artificial Sequence: Synthetic oligonucleotide
  Target: ATXN1; (+) strand; PAM type: YTN; PAM sequence: CTC
ctgcctgggcaatagagaga

SEQ ID NO: 288990 - DNA, 20 bp, Artificial Sequence
  Description of Artificial Sequence: Synthetic oligonucleotide
  Target: ATXN1; (+) strand; PAM type: YTN; PAM sequence: CTG
cctgggcaatagagagaaac

SEQ ID NO: 288991 - DNA, 20 bp, Artificial Sequence
  Description of Artificial Sequence: Synthetic oligonucleotide
  Target: ATXN1; (+) strand; PAM type: YTN; PAM sequence: CTG
ggcaatagagagaaactctg

SEQ ID NO: 288992 - DNA, 20 bp, Artificial Sequence
  Description of Artificial Sequence: Synthetic oligonucleotide
  Target: ATXN1; (+) strand; PAM type: YTN; PAM sequence: CTC
tgtctcaaaaaaaaaaaaaa

SEQ ID NO: 288993 - DNA, 20 bp, Artificial Sequence
  Description of Artificial Sequence: Synthetic oligonucleotide
  Target: ATXN1; (+) strand; PAM type: YTN; PAM sequence: CTG
tctcaaaaaaaaaaaaaaaa

SEQ ID NO: 288994 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaagaaa

SEQ ID NO: 288995 - DNA, 20 bp, Artificial Sequence
  Description of Artificial Sequence: Synthetic oligonucleotide
  Target: ATXN1; (+) strand; PAM type: YTN; PAM sequence: CTC
atgtttctaaaaacatttag

SEQ ID NO: 288996 - DNA, 20 bp, Artificial Sequence
  Description of Artificial Sequence: Synthetic oligonucleotide
  Target: ATXN1; (+) strand; PAM type: YTN; PAM sequence: TTT
ctaaaaacatttagttttta

SEQ ID NO: 288997 - DNA, 20 bp, Artificial Sequence
  Description of Artificial Sequence: Synthetic oligonucleotide
  Target: ATXN1; (+) strand; PAM type: YTN; PAM sequence: TTC
taaaaacatttagtttttat

SEQ ID NO: 288998 - DNA, 20 bp, Artificial Sequence
  Description of Artificial Sequence: Synthetic oligonucleotide
  Target: ATXN1; (+) strand; PAM type: YTN; PAM sequence: CTA
aaaacatttagtttttatta

SEQ ID NO: 288999 - DNA, 20 bp, Artificial Sequence
  Description of Artificial Sequence: Synthetic oligonucleotide
  Target: ATXN1; (+) strand; PAM type: YTN; PAM sequence: TTT
agtttttattagtacttaat

SEQ ID NO: 289000 - DNA, 20 bp, Artificial Sequence
  Description of Artificial Sequence: Synthetic oligonucleotide
  Target: ATXN1; (+) strand; PAM type: YTN; PAM sequence: TTA
gtttttattagtacttaata

SEQ ID NO: 289001 - DNA, 20 bp, Artificial Sequence
  Description of Artificial Sequence: Synthetic oligonucleotide
  Target: ATXN1; (+) strand; PAM type: YTN; PAM sequence: TTT
ttattagtacttaataaaga

SEQ ID NO: 289002 - DNA, 20 bp, Artificial Sequence
  Description of Artificial Sequence: Synthetic oligonucleotide
  Target: ATXN1; (+) strand; PAM type: YTN; PAM sequence: TTT
tattagtacttaataaagat

SEQ ID NO: 289003 - DNA, 20 bp, Artificial Sequence
  Description of Artificial Sequence: Synthetic oligonucleotide
  Target: ATXN1; (+) strand; PAM type: YTN; PAM sequence: TTT
attagtacttaataaagatg

SEQ ID NO: 289004 - DNA, 20 bp, Artificial Sequence
  Description of Artificial Sequence: Synthetic oligonucleotide
  Target: ATXN1; (+) strand; PAM type: YTN; PAM sequence: TTA
ttagtacttaataaagatga

SEQ ID NO: 289005 - DNA, 20 bp, Artificial Sequence
  Description of Artificial Sequence: Synthetic oligonucleotide
  Target: ATXN1; (+) strand; PAM type: YTN; PAM sequence: TTA
gtacttaataaagatgatgt

SEQ ID NO: 289006 - DNA, 20 bp, Artificial Sequence
  Description of Artificial Sequence: Synthetic oligonucleotide
  Target: ATXN1; (+) strand; PAM type: YTN; PAM sequence: CTT
aataaagatgatgtctcctc

SEQ ID NO: 289007 - DNA, 20 bp, Artificial Sequence
  Description of Artificial Sequence: Synthetic oligonucleotide
  Target: ATXN1; (+) strand; PAM type: YTN; PAM sequence: TTA
ataaagatgatgtctcctct

SEQ ID NO: 289008 - DNA, 20 bp, Artificial Sequence
  Description of Artificial Sequence: Synthetic oligonucleotide
  Target: ATXN1; (+) strand; PAM type: YTN; PAM sequence: CTC
ctctcagtggggcaaaagac

SEQ ID NO: 289009 - DNA, 20 bp, Artificial Sequence
  Description of Artificial Sequence: Synthetic oligonucleotide
  Target: ATXN1; (+) strand; PAM type: YTN; PAM sequence: CTC
tcagtggggcaaaagactaa

SEQ ID NO: 289010 - DNA, 20 bp, Artificial Sequence
  Description of Artificial Sequence: Synthetic oligonucleotide
  Target: ATXN1; (+) strand; PAM type: YTN; PAM sequence: CTC
agtggggcaaaagactaata

SEQ ID NO: 289011 - DNA, 20 bp, Artificial Sequence
  Description of Artificial Sequence: Synthetic oligonucleotide
  Target: ATXN1; (+) strand; PAM type: YTN; PAM sequence: CTA
ataaatacataatgtgagaa

SEQ ID NO: 289012 - DNA, 20 bp, Artificial Sequence
  Description of Artificial Sequence: Synthetic oligonucleotide
  Target: ATXN1; (+) strand; PAM type: YTN; PAM sequence: CTG
atctaatatttgacaaaagt

SEQ ID NO: 289013 - DNA, 20 bp, Artificial Sequence
  Description of Artificial Sequence: Synthetic oligonucleotide
  Target: ATXN1; (+) strand; PAM type: YTN; PAM sequence: CTA
atatttgacaaaagttcatt

SEQ ID NO: 289014 - DNA, 20 bp, Artificial Sequence
  Description of Artificial Sequence: Synthetic oligonucleotide
  Target: ATXN1; (+) strand; PAM type: YTN; PAM sequence: TTT
gacaaaagttcattgaatcc

SEQ ID NO: 289015 - DNA, 20 bp, Artificial Sequence
  Description of Artificial Sequence: Synthetic oligonucleotide
  Target: ATXN1; (+) strand; PAM type: YTN; PAM sequence: TTG
acaaaagttcattgaatcct

SEQ ID NO: 289016 - DNA, 20 bp, Artificial Sequence
  Description of Artificial Sequence: Synthetic oligonucleotide
  Target: ATXN1; (+) strand; PAM type: YTN; PAM sequence: TTC
attgaatcctcatgtctaag

SEQ ID NO: 289017 - DNA, 20 bp, Artificial Sequence
  Description of Artificial Sequence: Synthetic oligonucleotide
  Target: ATXN1; (+) strand; PAM type: YTN; PAM sequence: TTG
aatcctcatgtctaagatcg

SEQ ID NO: 289018 - DNA, 20 bp, Artificial Sequence
  Description of Artificial Sequence: Synthetic oligonucleotide
  Target: ATXN1; (+) strand; PAM type: YTN; PAM sequence: CTC
atgtctaagatcgcacatca

SEQ ID NO: 289019 - DNA, 20 bp, Artificial Sequence
  Description of Artificial Sequence: Synthetic oligonucleotide
  Target: ATXN1; (+) strand; PAM type: YTN; PAM sequence: CTA
agatcgcacatcaaaataaa

SEQ ID NO: 289020 - DNA, 20 bp, Artificial Sequence
  Description of Artificial Sequence: Synthetic oligonucleotide
  Target: ATXN1; (+) strand; PAM type: YTN; PAM sequence: CTA
tgagataataaagaactaca

SEQ ID NO: 289021 - DNA, 20 bp, Artificial Sequence
  Description of Artificial Sequence: Synthetic oligonucleotide
  Target: ATXN1; (+) strand; PAM type: YTN; PAM sequence: CTA
caataaattgtgggtaaata

SEQ ID NO: 289022 - DNA, 20 bp, Artificial Sequence
  Description of Artificial Sequence: Synthetic oligonucleotide
  Target: ATXN1; (+) strand; PAM type: YTN; PAM sequence: TTG
tgggtaaatagttatctgac

SEQ ID NO: 289023 - DNA, 20 bp, Artificial Sequence
  Description of Artificial Sequence: Synthetic oligonucleotide
  Target: ATXN1; (+) strand; PAM type: YTN; PAM sequence: TTA
tctgaccctagtgaatggaa

SEQ ID NO: 289024 - DNA, 20 bp, Artificial Sequence
  Description of Artificial Sequence: Synthetic oligonucleotide
  Target: ATXN1; (+) strand; PAM type: YTN; PAM sequence: CTG
accctagtgaatggaaggct

SEQ ID NO: 289025 - DNA, 20 bp, Artificial Sequence
  Description of Artificial Sequence: Synthetic oligonucleotide
  Target: ATXN1; (+) strand; PAM type: YTN; PAM sequence: CTA
gtgaatggaaggcttttcta

SEQ ID NO: 289026 - DNA, 20 bp, Artificial Sequence
  Description of Artificial Sequence: Synthetic oligonucleotide
  Target: ATXN1; (+) strand; PAM type: YTN; PAM sequence: CTT
ttctaggtataaaagcaaaa

SEQ ID NO: 289027 - DNA, 20 bp, Artificial Sequence
  Description of Artificial Sequence: Synthetic oligonucleotide
  Target: ATXN1; (+) strand; PAM type: YTN; PAM sequence: TTT
tctaggtataaaagcaaaaa

SEQ ID NO: 289028 - DNA, 20 bp, Artificial Sequence
  Description of Artificial Sequence: Synthetic oligonucleotide
  Target: ATXN1; (+) strand; PAM type: YTN; PAM sequence: TTT
ctaggtataaaagcaaaaaa

SEQ ID NO: 289029 - DNA, 20 bp, Artificial Sequence
  Description of Artificial Sequence: Synthetic oligonucleotide
  Target: ATXN1; (+) strand; PAM type: YTN; PAM sequence: TTC
taggtataaaagcaaaaaaa

SEQ ID NO: 289030 - DNA, 20 bp, Artificial Sequence
  Description of Artificial Sequence: Synthetic oligonucleotide
  Target: ATXN1; (+) strand; PAM type: YTN; PAM sequence: CTA
ggtataaaagcaaaaaaaaa

SEQ ID NO: 289031 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaattgcagccataa

SEQ ID NO: 289032 - DNA, 20 bp, Artificial Sequence
  Description of Artificial Sequence: Synthetic oligonucleotide
  Target: ATXN1; (+) strand; PAM type: YTN; PAM sequence: TTG
cagccataaaaaagaatgag

SEQ ID NO: 289033 - DNA, 20 bp, Artificial Sequence
  Description of Artificial Sequence: Synthetic oligonucleotide
  Target: ATXN1; (+) strand; PAM type: YTN; PAM sequence: CTT
tacagggacatggatgaagc

SEQ ID NO: 289034 - DNA, 20 bp, Artificial Sequence
  Description of Artificial Sequence: Synthetic oligonucleotide
  Target: ATXN1; (+) strand; PAM type: YTN; PAM sequence: TTT
acagggacatggatgaagct

SEQ ID NO: 289035 - DNA, 20 bp, Artificial Sequence
  Description of Artificial Sequence: Synthetic oligonucleotide
  Target: ATXN1; (+) strand; PAM type: YTN; PAM sequence: TTA
cagggacatggatgaagctg

SEQ ID NO: 289036 - DNA, 20 bp, Artificial Sequence
  Description of Artificial Sequence: Synthetic oligonucleotide
  Target: ATXN1; (+) strand; PAM type: YTN; PAM sequence: CTG
gaaaccatcattctcagcaa

SEQ ID NO: 289037 - DNA, 20 bp, Artificial Sequence
  Description of Artificial Sequence: Synthetic oligonucleotide
  Target: ATXN1; (+) strand; PAM type: YTN; PAM sequence: TTC
tcagcaaactaacccaggaa

SEQ ID NO: 289038 - DNA, 20 bp, Artificial Sequence
  Description of Artificial Sequence: Synthetic oligonucleotide
  Target: ATXN1; (+) strand; PAM type: YTN; PAM sequence: CTC
agcaaactaacccaggaaca

SEQ ID NO: 289039 - DNA, 20 bp, Artificial Sequence
  Description of Artificial Sequence: Synthetic oligonucleotide
  Target: ATXN1; (+) strand; PAM type: YTN; PAM sequence: CTA
acccaggaacagaaaaccaa

SEQ ID NO: 289040 - DNA, 20 bp, Artificial Sequence
  Description of Artificial Sequence: Synthetic oligonucleotide
  Target: ATXN1; (+) strand; PAM type: YTN; PAM sequence: TTC
tcactcataagtgggagttt

SEQ ID NO: 289041 - DNA, 20 bp, Artificial Sequence
  Description of Artificial Sequence: Synthetic oligonucleotide
  Target: ATXN1; (+) strand; PAM type: YTN; PAM sequence: CTC
actcataagtgggagtttaa

SEQ ID NO: 289042 - DNA, 20 bp, Artificial Sequence
  Description of Artificial Sequence: Synthetic oligonucleotide
  Target: ATXN1; (+) strand; PAM type: YTN; PAM sequence: CTC
ataagtgggagtttaacatt

SEQ ID NO: 289043 - DNA, 20 bp, Artificial Sequence
  Description of Artificial Sequence: Synthetic oligonucleotide
  Target: ATXN1; (+) strand; PAM type: YTN; PAM sequence: TTT
aacattgagaacacatggac

SEQ ID NO: 289044 - DNA, 20 bp, Artificial Sequence
  Description of Artificial Sequence: Synthetic oligonucleotide
  Target: ATXN1; (+) strand; PAM type: YTN; PAM sequence: TTA
acattgagaacacatggaca

SEQ ID NO: 289045 - DNA, 20 bp, Artificial Sequence
  Description of Artificial Sequence: Synthetic oligonucleotide
  Target: ATXN1; (+) strand; PAM type: YTN; PAM sequence: TTG
agaacacatggacacagaga

SEQ ID NO: 289046 - DNA, 20 bp, Artificial Sequence
  Description of Artificial Sequence: Synthetic oligonucleotide
  Target: ATXN1; (+) strand; PAM type: YTN; PAM sequence: CTG
tcggagggagggacaagggg

SEQ ID NO: 289047 - DNA, 20 bp, Artificial Sequence
  Description of Artificial Sequence: Synthetic oligonucleotide
  Target: ATXN1; (+) strand; PAM type: YTN; PAM sequence: TTA
agacaaataccgaatgcatg

SEQ ID NO: 289048 - DNA, 20 bp, Artificial Sequence
  Description of Artificial Sequence: Synthetic oligonucleotide
  Target: ATXN1; (+) strand; PAM type: YTN; PAM sequence: CTT
aaaacctagatgacaggttg

SEQ ID NO: 289049 - DNA, 20 bp, Artificial Sequence
  Description of Artificial Sequence: Synthetic oligonucleotide
  Target: ATXN1; (+) strand; PAM type: YTN; PAM sequence: TTA
aaacctagatgacaggttga

SEQ ID NO: 289050 - DNA, 20 bp, Artificial Sequence
  Description of Artificial Sequence: Synthetic oligonucleotide
  Target: ATXN1; (+) strand; PAM type: YTN; PAM sequence: CTA
gatgacaggttgataggtac

SEQ ID NO: 289051 - DNA, 20 bp, Artificial Sequence
  Description of Artificial Sequence: Synthetic oligonucleotide
  Target: ATXN1; (+) strand; PAM type: YTN; PAM sequence: TTG
ataggtacagcaaaccacta

SEQ ID NO: 289052 - DNA, 20 bp, Artificial Sequence
  Description of Artificial Sequence: Synthetic oligonucleotide
  Target: ATXN1; (+) strand; PAM type: YTN; PAM sequence: CTA
tggcacatgtatacctatgt

SEQ ID NO: 289053 - DNA, 20 bp, Artificial Sequence
  Description of Artificial Sequence: Synthetic oligonucleotide
  Target: ATXN1; (+) strand; PAM type: YTN; PAM sequence: CTA
tgtaacaaacctgcaagttc

SEQ ID NO: 289054 - DNA, 20 bp, Artificial Sequence
  Description of Artificial Sequence: Synthetic oligonucleotide
  Target: ATXN1; (+) strand; PAM type: YTN; PAM sequence: CTG
caagttctgcacgtgtatcc

SEQ ID NO: 289055 - DNA, 20 bp, Artificial Sequence
  Description of Artificial Sequence: Synthetic oligonucleotide
  Target: ATXN1; (+) strand; PAM type: YTN; PAM sequence: TTC
tgcacgtgtatcccagaact

SEQ ID NO: 289056 - DNA, 20 bp, Artificial Sequence
  Description of Artificial Sequence: Synthetic oligonucleotide
  Target: ATXN1; (+) strand; PAM type: YTN; PAM sequence: CTG
cacgtgtatcccagaactta

SEQ ID NO: 289057 - DNA, 20 bp, Artificial Sequence
  Description of Artificial Sequence: Synthetic oligonucleotide
  Target: ATXN1; (+) strand; PAM type: YTN; PAM sequence: CTT
aaagtaaaacaaacaaaaca

SEQ ID NO: 289058 - DNA, 20 bp, Artificial Sequence
  Description of Artificial Sequence: Synthetic oligonucleotide
  Target: ATXN1; (+) strand; PAM type: YTN; PAM sequence: TTA
aagtaaaacaaacaaaacaa

SEQ ID NO: 289059 - DNA, 20 bp, Artificial Sequence
  Description of Artificial Sequence: Synthetic oligonucleotide
  Target: ATXN1; (+) strand; PAM type: YTN; PAM sequence: TTC
aggcagggtgtggtggctca

SEQ ID NO: 289060 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatcccagcact

SEQ ID NO: 289061 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 289062 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggcagatgg

SEQ ID NO: 289063 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggcagatgga

SEQ ID NO: 289064 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggcagatggat

SEQ ID NO: 289065 - DNA, 20 bp, Artificial Sequence
  Description of Artificial Sequence: Synthetic oligonucleotide
  Target: ATXN1; (+) strand; PAM type: YTN; PAM sequence: CTG
aggtcacgagttcgtgacca

SEQ ID NO: 289066 - DNA, 20 bp, Artificial Sequence
  Description of Artificial Sequence: Synthetic oligonucleotide
  Target: ATXN1; (+) strand; PAM type: YTN; PAM sequence: TTC
gtgaccagcctggccaacat

SEQ ID NO: 289067 - DNA, 20 bp, Artificial Sequence
  Description of Artificial Sequence: Synthetic oligonucleotide
  Target: ATXN1; (+) strand; PAM type: YTN; PAM sequence: CTG
gccaacatggcgaaacccca

SEQ ID NO: 289068 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaagaaatt

SEQ ID NO: 289069 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaagaaattag

SEQ ID NO: 289070 - DNA, 20 bp, Artificial Sequence
  Description of Artificial Sequence: Synthetic oligonucleotide
  Target: ATXN1; (+) strand; PAM type: YTN; PAM sequence: CTA
aaaatacaagaaattagctg

SEQ ID NO: 289071 - DNA, 20 bp, Artificial Sequence
  Description of Artificial Sequence: Synthetic oligonucleotide
  Target: ATXN1; (+) strand; PAM type: YTN; PAM sequence: TTA
gctggacgtggtggtacaca

SEQ ID NO: 289072 - DNA, 20 bp, Artificial Sequence
  Description of Artificial Sequence: Synthetic oligonucleotide
  Target: ATXN1; (+) strand; PAM type: YTN; PAM sequence: CTG
gacgtggtggtacacacctg

SEQ ID NO: 289073 - DNA, 20 bp, Artificial Sequence
  Description of Artificial Sequence: Synthetic oligonucleotide
  Target: ATXN1; (+) strand; PAM type: YTN; PAM sequence: CTG
tagtctggaggctgaagcag

SEQ ID NO: 289074 - DNA, 20 bp, Artificial Sequence
  Description of Artificial Sequence: Synthetic oligonucleotide
  Target: ATXN1; (+) strand; PAM type: YTN; PAM sequence: CTG
gaggctgaagcaggagaatc

SEQ ID NO: 289075 - DNA, 20 bp, Artificial Sequence
  Description of Artificial Sequence: Synthetic oligonucleotide
  Target: ATXN1; (+) strand; PAM type: YTN; PAM sequence: CTG
aagcaggagaatcgcttgaa

SEQ ID NO: 289076 - DNA, 20 bp, Artificial Sequence
  Description of Artificial Sequence: Synthetic oligonucleotide
  Target: ATXN1; (+) strand; PAM type: YTN; PAM sequence: CTT
gaacccgggaggcggaggtt

SEQ ID NO: 289077 - DNA, 20 bp, Artificial Sequence
  Description of Artificial Sequence: Synthetic oligonucleotide
  Target: ATXN1; (+) strand; PAM type: YTN; PAM sequence: TTG
aacccgggaggcggaggttg

SEQ ID NO: 289078 - DNA, 20 bp, Artificial Sequence
  Description of Artificial Sequence: Synthetic oligonucleotide
  Target: ATXN1; (+) strand; PAM type: YTN; PAM sequence: TTG
cagtgagccaagatcgtgcc

SEQ ID NO: 289079 - DNA, 20 bp, Artificial Sequence
  Description of Artificial Sequence: Synthetic oligonucleotide
  Target: ATXN1; (+) strand; PAM type: YTN; PAM sequence: CTG
cactgcagcctgggtggcag

SEQ ID NO: 289080 - DNA, 20 bp, Artificial Sequence
  Description of Artificial Sequence: Synthetic oligonucleotide
  Target: ATXN1; (+) strand; PAM type: YTN; PAM sequence: CTG
cagcctgggtggcagagcga

SEQ ID NO: 289081 - DNA, 20 bp, Artificial Sequence
  Description of Artificial Sequence: Synthetic oligonucleotide
  Target: ATXN1; (+) strand; PAM type: YTN; PAM sequence: CTG
ggtggcagagcgagactccg

SEQ ID NO: 289082 - DNA, 20 bp, Artificial Sequence
  Description of Artificial Sequence: Synthetic oligonucleotide
  Target: ATXN1; (+) strand; PAM type: YTN; PAM sequence: CTC
cgtctcaaaaaaaaaaaaaa

SEQ ID NO: 289083 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaagga

SEQ ID NO: 289084 - DNA, 20 bp, Artificial Sequence
  Description of Artificial Sequence: Synthetic oligonucleotide
  Target: ATXN1; (+) strand; PAM type: YTN; PAM sequence: TTC
aactgtgggaaaaaaaaaaa

SEQ ID NO: 289085 - DNA, 20 bp, Artificial Sequence
  Description of Artificial Sequence: Synthetic oligonucleotide
  Target: ATXN1; (+) strand; PAM type: YTN; PAM sequence: CTG
tgggaaaaaaaaaaagcaaa

SEQ ID NO: 289086 - DNA, 20 bp, Artificial Sequence
  Description of Artificial Sequence: Synthetic oligonucleotide
  Target: ATXN1; (+) strand; PAM type: YTN; PAM sequence: CTT
tttgaaaattattaatatgc

SEQ ID NO: 289087 - DNA, 20 bp, Artificial Sequence
  Description of Artificial Sequence: Synthetic oligonucleotide
  Target: ATXN1; (+) strand; PAM type: YTN; PAM sequence: TTT
ttgaaaattattaatatgct

SEQ ID NO: 289088 - DNA, 20 bp, Artificial Sequence
  Description of Artificial Sequence: Synthetic oligonucleotide
  Target: ATXN1; (+) strand; PAM type: YTN; PAM sequence: TTT
tgaaaattattaatatgctt

SEQ ID NO: 289089 - DNA, 20 bp, Artificial Sequence
  Description of Artificial Sequence: Synthetic oligonucleotide
  Target: ATXN1; (+) strand; PAM type: YTN; PAM sequence: TTT
gaaaattattaatatgcttg

SEQ ID NO: 289090 - DNA, 20 bp, Artificial Sequence
  Description of Artificial Sequence: Synthetic oligonucleotide
  Target: ATXN1; (+) strand; PAM type: YTN; PAM sequence: TTG
aaaattattaatatgcttga

SEQ ID NO: 289091 - DNA, 20 bp, Artificial Sequence
  Description of Artificial Sequence: Synthetic oligonucleotide
  Target: ATXN1; (+) strand; PAM type: YTN; PAM sequence: TTA
ttaatatgcttgactacaca

SEQ ID NO: 289092 - DNA, 20 bp, Artificial Sequence
  Description of Artificial Sequence: Synthetic oligonucleotide
  Target: ATXN1; (+) strand; PAM type: YTN; PAM sequence: TTA
atatgcttgactacacagat

SEQ ID NO: 289093 - DNA, 20 bp, Artificial Sequence
  Description of Artificial Sequence: Synthetic oligonucleotide
  Target: ATXN1; (+) strand; PAM type: YTN; PAM sequence: CTT
gactacacagatattttgat

SEQ ID NO: 289094 - DNA, 20 bp, Artificial Sequence
  Description of Artificial Sequence: Synthetic oligonucleotide
  Target: ATXN1; (+) strand; PAM type: YTN; PAM sequence: TTG
actacacagatattttgatt

SEQ ID NO: 289095 - DNA, 20 bp, Artificial Sequence
  Description of Artificial Sequence: Synthetic oligonucleotide
  Target: ATXN1; (+) strand; PAM type: YTN; PAM sequence: CTA
cacagatattttgattttgt

SEQ ID NO: 289096 - DNA, 20 bp, Artificial Sequence
  Description of Artificial Sequence: Synthetic oligonucleotide
  Target: ATXN1; (+) strand; PAM type: YTN; PAM sequence: TTT
tgattttgtaaataaaaatc

SEQ ID NO: 289097 - DNA, 20 bp, Artificial Sequence
  Description of Artificial Sequence: Synthetic oligonucleotide
  Target: ATXN1; (+) strand; PAM type: YTN; PAM sequence: TTT
gattttgtaaataaaaatca

SEQ ID NO: 289098 - DNA, 20 bp, Artificial Sequence
  Description of Artificial Sequence: Synthetic oligonucleotide
  Target: ATXN1; (+) strand; PAM type: YTN; PAM sequence: TTG
attttgtaaataaaaatcaa

SEQ ID NO: 289099 - DNA, 20 bp, Artificial Sequence
  Description of Artificial Sequence: Synthetic oligonucleotide
  Target: ATXN1; (+) strand; PAM type: YTN; PAM sequence: TTT
tgtaaataaaaatcaacgta

SEQ ID NO: 289100 - DNA, 20 bp, Artificial Sequence
  Description of Artificial Sequence: Synthetic oligonucleotide
  Target: ATXN1; (+) strand; PAM type: YTN; PAM sequence: TTT
gtaaataaaaatcaacgtaa

SEQ ID NO: 289101 - DNA, 20 bp, Artificial Sequence
  Description of Artificial Sequence: Synthetic oligonucleotide
  Target: ATXN1; (+) strand; PAM type: YTN; PAM sequence: TTG
taaataaaaatcaacgtaag

SEQ ID NO: 289102 - DNA, 20 bp, Artificial Sequence
  Description of Artificial Sequence: Synthetic oligonucleotide
  Target: ATXN1; (+) strand; PAM type: YTN; PAM sequence: TTC
aaaggaaaatatcaaagtgg

SEQ ID NO: 289103 - DNA, 20 bp, Artificial Sequence
  Description of Artificial Sequence: Synthetic oligonucleotide
  Target: ATXN1; (+) strand; PAM type: YTN; PAM sequence: TTT
ccaataccattaaacaaaga

SEQ ID NO: 289104 - DNA, 20 bp, Artificial Sequence
  Description of Artificial Sequence: Synthetic oligonucleotide
  Target: ATXN1; (+) strand; PAM type: YTN; PAM sequence: TTC
caataccattaaacaaagag

SEQ ID NO: 289105 - DNA, 20 bp, Artificial Sequence
  Description of Artificial Sequence: Synthetic oligonucleotide
  Target: ATXN1; (+) strand; PAM type: YTN; PAM sequence: TTA
aacaaagagttaatatcctt

SEQ ID NO: 289106 - DNA, 20 bp, Artificial Sequence
  Description of Artificial Sequence: Synthetic oligonucleotide
  Target: ATXN1; (+) strand; PAM type: YTN; PAM sequence: TTA
atatccttaatacaaaataa

SEQ ID NO: 289107 - DNA, 20 bp, Artificial Sequence
  Description of Artificial Sequence: Synthetic oligonucleotide
  Target: ATXN1; (+) strand; PAM type: YTN; PAM sequence: CTT
aatacaaaataaatacatgt

SEQ ID NO: 289108 - DNA, 20 bp, Artificial Sequence
  Description of Artificial Sequence: Synthetic oligonucleotide
  Target: ATXN1; (+) strand; PAM type: YTN; PAM sequence: TTA
atacaaaataaatacatgta

SEQ ID NO: 289109 - DNA, 20 bp, Artificial Sequence
  Description of Artificial Sequence: Synthetic oligonucleotide
  Target: ATXN1; (+) strand; PAM type: YTN; PAM sequence: TTG
tgagtaaaaggaaaaacttt

SEQ ID NO: 289110 - DNA, 20 bp, Artificial Sequence
  Description of Artificial Sequence: Synthetic oligonucleotide
  Target: ATXN1; (+) strand; PAM type: YTN; PAM sequence: CTT
tctaagacaaaaataagcaa

SEQ ID NO: 289111 - DNA, 20 bp, Artificial Sequence
  Description of Artificial Sequence: Synthetic oligonucleotide
  Target: ATXN1; (+) strand; PAM type: YTN; PAM sequence: TTT
ctaagacaaaaataagcaat

SEQ ID NO: 289112 - DNA, 20 bp, Artificial Sequence
  Description of Artificial Sequence: Synthetic oligonucleotide
  Target: ATXN1; (+) strand; PAM type: YTN; PAM sequence: TTC
taagacaaaaataagcaatg

SEQ ID NO: 289113 - DNA, 20 bp, Artificial Sequence
  Description of Artificial Sequence: Synthetic oligonucleotide
  Target: ATXN1; (+) strand; PAM type: YTN; PAM sequence: CTA
agacaaaaataagcaatgaa

SEQ ID NO: 289114 - DNA, 20 bp, Artificial Sequence
  Description of Artificial Sequence: Synthetic oligonucleotide
  Target: ATXN1; (+) strand; PAM type: YTN; PAM sequence: TTT
aaaaaagaaatgtaaaaaac

SEQ ID NO: 289115 - DNA, 20 bp, Artificial Sequence
  Description of Artificial Sequence: Synthetic oligonucleotide
  Target: ATXN1; (+) strand; PAM type: YTN; PAM sequence: TTA
aaaaagaaatgtaaaaaaca

SEQ ID NO: 289116 - DNA, 20 bp, Artificial Sequence
  Description of Artificial Sequence: Synthetic oligonucleotide
  Target: ATXN1; (+) strand; PAM type: YTN; PAM sequence: CTC
acttgaaactacactaaaaa

SEQ ID NO: 289117 - DNA, 20 bp, Artificial Sequence
  Description of Artificial Sequence: Synthetic oligonucleotide
  Target: ATXN1; (+) strand; PAM type: YTN; PAM sequence: CTT
gaaactacactaaaaaaagc

SEQ ID NO: 289118 - DNA, 20 bp, Artificial Sequence
  Description of Artificial Sequence: Synthetic oligonucleotide
  Target: ATXN1; (+) strand; PAM type: YTN; PAM sequence: TTG
aaactacactaaaaaaagca

SEQ ID NO: 289119 - DNA, 20 bp, Artificial Sequence
  Description of Artificial Sequence: Synthetic oligonucleotide
  Target: ATXN1; (+) strand; PAM type: YTN; PAM sequence: CTA
cactaaaaaaagcaaattaa

SEQ ID NO: 289120 - DNA, 20 bp, Artificial Sequence
  Description of Artificial Sequence: Synthetic oligonucleotide
  Target: ATXN1; (+) strand; PAM type: YTN; PAM sequence: CTA
aaaaaagcaaattaaaacaa

SEQ ID NO: 289121 - DNA, 20 bp, Artificial Sequence
  Description of Artificial Sequence: Synthetic oligonucleotide
  Target: ATXN1; (+) strand; PAM type: YTN; PAM sequence: TTA
aaacaagatataatttttaa

SEQ ID NO: 289122 - DNA, 20 bp, Artificial Sequence
  Description of Artificial Sequence: Synthetic oligonucleotide
  Target: ATXN1; (+) strand; PAM type: YTN; PAM sequence: TTT
ttaacttatcaaattggcag

SEQ ID NO: 289123 - DNA, 20 bp, Artificial Sequence
  Description of Artificial Sequence: Synthetic oligonucleotide
  Target: ATXN1; (+) strand; PAM type: YTN; PAM sequence: TTT
taacttatcaaattggcaga

SEQ ID NO: 289124 - DNA, 20 bp, Artificial Sequence
  Description of Artificial Sequence: Synthetic oligonucleotide
  Target: ATXN1; (+) strand; PAM type: YTN; PAM sequence: TTT
aacttatcaaattggcagag

SEQ ID NO: 289125 - DNA, 20 bp, Artificial Sequence
  Description of Artificial Sequence: Synthetic oligonucleotide
  Target: ATXN1; (+) strand; PAM type: YTN; PAM sequence: TTA
acttatcaaattggcagagt

SEQ ID NO: 289126 - DNA, 20 bp, Artificial Sequence
  Description of Artificial Sequence: Synthetic oligonucleotide
  Target: ATXN1; (+) strand; PAM type: YTN; PAM sequence: CTT
atcaaattggcagagttttt

SEQ ID NO: 289127 - DNA, 20 bp, Artificial Sequence
  Description of Artificial Sequence: Synthetic oligonucleotide
  Target: ATXN1; (+) strand; PAM type: YTN; PAM sequence: TTA
tcaaattggcagagtttttg

SEQ ID NO: 289128 - DNA, 20 bp, Artificial Sequence
  Description of Artificial Sequence: Synthetic oligonucleotide
  Target: ATXN1; (+) strand; PAM type: YTN; PAM sequence: TTG
gcagagtttttgtttgtttc

SEQ ID NO: 289129 - DNA, 20 bp, Artificial Sequence
  Description of Artificial Sequence: Synthetic oligonucleotide
  Target: ATXN1; (+) strand; PAM type: YTN; PAM sequence: TTT
ttgtttgtttcttttttttt

SEQ ID NO: 289130 - DNA, 20 bp, Artificial Sequence
  Description of Artificial Sequence: Synthetic oligonucleotide
  Target: ATXN1; (+) strand; PAM type: YTN; PAM sequence: TTT
tgtttgtttctttttttttt

SEQ ID NO: 289131 - DNA, 20 bp, Artificial Sequence
  Description of Artificial Sequence: Synthetic oligonucleotide
  Target: ATXN1; (+) strand; PAM type: YTN; PAM sequence: TTT
gtttgtttctttttttttta

SEQ ID NO: 289132 - DNA, 20 bp, Artificial Sequence
  Description of Artificial Sequence: Synthetic oligonucleotide
  Target: ATXN1; (+) strand; PAM type: YTN; PAM sequence: TTG
tttgtttcttttttttttaa

SEQ ID NO: 289133 - DNA, 20 bp, Artificial Sequence
  Description of Artificial Sequence: Synthetic oligonucleotide
  Target: ATXN1; (+) strand; PAM type: YTN; PAM sequence: TTT
gtttcttttttttttaatta

SEQ ID NO: 289134 - DNA, 20 bp, Artificial Sequence
  Description of Artificial Sequence: Synthetic oligonucleotide
  Target: ATXN1; (+) strand; PAM type: YTN; PAM sequence: TTG
tttcttttttttttaattac

SEQ ID NO: 289135 - DNA, 20 bp, Artificial Sequence
  Description of Artificial Sequence: Synthetic oligonucleotide
  Target: ATXN1; (+) strand; PAM type: YTN; PAM sequence: TTT
cttttttttttaattacagt

SEQ ID NO: 289136 - DNA, 20 bp, Artificial Sequence
  Description of Artificial Sequence: Synthetic oligonucleotide
  Target: ATXN1; (+) strand; PAM type: YTN; PAM sequence: TTC
ttttttttttaattacagta

SEQ ID NO: 289137 - DNA, 20 bp, Artificial Sequence
  Description of Artificial Sequence: Synthetic oligonucleotide
  Target: ATXN1; (+) strand; PAM type: YTN; PAM sequence: CTT
ttttttttaattacagtact

SEQ ID NO: 289138 - DNA, 20 bp, Artificial Sequence
  Description of Artificial Sequence: Synthetic oligonucleotide
  Target: ATXN1; (+) strand; PAM type: YTN; PAM sequence: TTT
tttttttaattacagtactt

SEQ ID NO: 289139 - DNA, 20 bp, Artificial Sequence
  Description of Artificial Sequence: Synthetic oligonucleotide
  Target: ATXN1; (+) strand; PAM type: YTN; PAM sequence: TTT
ttttttaattacagtactta

SEQ ID NO: 289140 - DNA, 20 bp, Artificial Sequence
  Description of Artificial Sequence: Synthetic oligonucleotide
  Target: ATXN1; (+) strand; PAM type: YTN; PAM sequence: TTT
tttttaattacagtacttag

SEQ ID NO: 289141 - DNA, 20 bp, Artificial Sequence
  Description of Artificial Sequence: Synthetic oligonucleotide
  Target: ATXN1; (+) strand; PAM type: YTN; PAM sequence: TTT
ttttaattacagtacttagt

SEQ ID NO: 289142 - DNA, 20 bp, Artificial Sequence
  Description of Artificial Sequence: Synthetic oligonucleotide
  Target: ATXN1; (+) strand; PAM type: YTN; PAM sequence: TTT
tttaattacagtacttagtg

SEQ ID NO: 289143 - DNA, 20 bp, Artificial Sequence
  Description of Artificial Sequence: Synthetic oligonucleotide
  Target: ATXN1; (+) strand; PAM type: YTN; PAM sequence: TTT
ttaattacagtacttagtgt

SEQ ID NO: 289144 - DNA, 20 bp, Artificial Sequence
  Description of Artificial Sequence: Synthetic oligonucleotide
  Target: ATXN1; (+) strand; PAM type: YTN; PAM sequence: TTT
taattacagtacttagtgtt

SEQ ID NO: 289145 - DNA, 20 bp, Artificial Sequence
  Description of Artificial Sequence: Synthetic oligonucleotide
  Target: ATXN1; (+) strand; PAM type: YTN; PAM sequence: TTT
aattacagtacttagtgttg

SEQ ID NO: 289146 - DNA, 20 bp, Artificial Sequence
  Description of Artificial Sequence: Synthetic oligonucleotide
  Target: ATXN1; (+) strand; PAM type: YTN; PAM sequence: TTA
attacagtacttagtgttgt

SEQ ID NO: 289147 - DNA, 20 bp, Artificial Sequence
  Description of Artificial Sequence: Synthetic oligonucleotide
  Target: ATXN1; (+) strand; PAM type: YTN; PAM sequence: TTA
cagtacttagtgttgtccag

SEQ ID NO: 289148 - DNA, 20 bp, Artificial Sequence
  Description of Artificial Sequence: Synthetic oligonucleotide
  Target: ATXN1; (+) strand; PAM type: YTN; PAM sequence: CTT
agtgttgtccagagtgcaga

SEQ ID NO: 289149 - DNA, 20 bp, Artificial Sequence
  Description of Artificial Sequence: Synthetic oligonucleotide
  Target: ATXN1; (+) strand; PAM type: YTN; PAM sequence: TTA
gtgttgtccagagtgcagac

SEQ ID NO: 289150 - DNA, 20 bp, Artificial Sequence
  Description of Artificial Sequence: Synthetic oligonucleotide
  Target: ATXN1; (+) strand; PAM type: YTN; PAM sequence: TTG
tccagagtgcagacacatga

SEQ ID NO: 289151 - DNA, 20 bp, Artificial Sequence
  Description of Artificial Sequence: Synthetic oligonucleotide
  Target: ATXN1; (+) strand; PAM type: YTN; PAM sequence: TTC
tttgtcatggttggcaagtg

SEQ ID NO: 289152 - DNA, 20 bp, Artificial Sequence
  Description of Artificial Sequence: Synthetic oligonucleotide
  Target: ATXN1; (+) strand; PAM type: YTN; PAM sequence: CTT
tgtcatggttggcaagtgct

SEQ ID NO: 289153 - DNA, 20 bp, Artificial Sequence
  Description of Artificial Sequence: Synthetic oligonucleotide
  Target: ATXN1; (+) strand; PAM type: YTN; PAM sequence: TTT
gtcatggttggcaagtgctc

SEQ ID NO: 289154 - DNA, 20 bp, Artificial Sequence
  Description of Artificial Sequence: Synthetic oligonucleotide
  Target: ATXN1; (+) strand; PAM type: YTN; PAM sequence: TTG
tcatggttggcaagtgctca

SEQ ID NO: 289155 - DNA, 20 bp, Artificial Sequence
  Description of Artificial Sequence: Synthetic oligonucleotide
  Target: ATXN1; (+) strand; PAM type: YTN; PAM sequence: TTG
gcaagtgctcaagaagagta

SEQ ID NO: 289156 - DNA, 20 bp, Artificial Sequence
  Description of Artificial Sequence: Synthetic oligonucleotide
  Target: ATXN1; (+) strand; PAM type: YTN; PAM sequence: CTC
aagaagagtaatttaataac

SEQ ID NO: 289157 - DNA, 20 bp, Artificial Sequence
  Description of Artificial Sequence: Synthetic oligonucleotide
  Target: ATXN1; (+) strand; PAM type: YTN; PAM sequence: TTT
aataacacatatcaaaagcc

SEQ ID NO: 289158 - DNA, 20 bp, Artificial Sequence
  Description of Artificial Sequence: Synthetic oligonucleotide
  Target: ATXN1; (+) strand; PAM type: YTN; PAM sequence: TTA
ataacacatatcaaaagcct

SEQ ID NO: 289159 - DNA, 20 bp, Artificial Sequence
  Description of Artificial Sequence: Synthetic oligonucleotide
  Target: ATXN1; (+) strand; PAM type: YTN; PAM sequence: CTT
ataaagggccttactatttg

SEQ ID NO: 289160 - DNA, 20 bp, Artificial Sequence
  Description of Artificial Sequence: Synthetic oligonucleotide
  Target: ATXN1; (+) strand; PAM type: YTN; PAM sequence: TTA
taaagggccttactatttga

SEQ ID NO: 289161 - DNA, 20 bp, Artificial Sequence
  Description of Artificial Sequence: Synthetic oligonucleotide
  Target: ATXN1; (+) strand; PAM type: YTN; PAM sequence: CTT
actatttgagccaccagctc

SEQ ID NO: 289162 - DNA, 20 bp, Artificial Sequence
  Description of Artificial Sequence: Synthetic oligonucleotide
  Target: ATXN1; (+) strand; PAM type: YTN; PAM sequence: TTA
ctatttgagccaccagctct

SEQ ID NO: 289163 - DNA, 20 bp, Artificial Sequence
  Description of Artificial Sequence: Synthetic oligonucleotide
  Target: ATXN1; (+) strand; PAM type: YTN; PAM sequence: CTA
tttgagccaccagctctagt

SEQ ID NO: 289164 - DNA, 20 bp, Artificial Sequence
  Description of Artificial Sequence: Synthetic oligonucleotide
  Target: ATXN1; (+) strand; PAM type: YTN; PAM sequence: TTT
gagccaccagctctagttct

SEQ ID NO: 289165 - DNA, 20 bp, Artificial Sequence
  Description of Artificial Sequence: Synthetic oligonucleotide
  Target: ATXN1; (+) strand; PAM type: YTN; PAM sequence: TTG
agccaccagctctagttctg

SEQ ID NO: 289166 - DNA, 20 bp, Artificial Sequence
  Description of Artificial Sequence: Synthetic oligonucleotide
  Target: ATXN1; (+) strand; PAM type: YTN; PAM sequence: CTC
tagttctggaaatttatcct

SEQ ID NO: 289167 - DNA, 20 bp, Artificial Sequence
  Description of Artificial Sequence: Synthetic oligonucleotide
  Target: ATXN1; (+) strand; PAM type: YTN; PAM sequence: CTA
gttctggaaatttatcctaa

SEQ ID NO: 289168 - DNA, 20 bp, Artificial Sequence
  Description of Artificial Sequence: Synthetic oligonucleotide
  Target: ATXN1; (+) strand; PAM type: YTN; PAM sequence: TTC
tggaaatttatcctaaggaa

SEQ ID NO: 289169 - DNA, 20 bp, Artificial Sequence
  Description of Artificial Sequence: Synthetic oligonucleotide
  Target: ATXN1; (+) strand; PAM type: YTN; PAM sequence: CTG
gaaatttatcctaaggaaac

SEQ ID NO: 289170 - DNA, 20 bp, Artificial Sequence
  Description of Artificial Sequence: Synthetic oligonucleotide
  Target: ATXN1; (+) strand; PAM type: YTN; PAM sequence: TTT
atcctaaggaaacaaccaga

SEQ ID NO: 289171 - DNA, 20 bp, Artificial Sequence
  Description of Artificial Sequence: Synthetic oligonucleotide
  Target: ATXN1; (+) strand; PAM type: YTN; PAM sequence: TTA
tcctaaggaaacaaccagag

SEQ ID NO: 289172 - DNA, 20 bp, Artificial Sequence
  Description of Artificial Sequence: Synthetic oligonucleotide
  Target: ATXN1; (+) strand; PAM type: YTN; PAM sequence: CTA
aggaaacaaccagagatgtt

SEQ ID NO: 289173 - DNA, 20 bp, Artificial Sequence
  Description of Artificial Sequence: Synthetic oligonucleotide
  Target: ATXN1; (+) strand; PAM type: YTN; PAM sequence: TTG
aaaaaagatatatatgttca

SEQ ID NO: 289174 - DNA, 20 bp, Artificial Sequence
  Description of Artificial Sequence: Synthetic oligonucleotide
  Target: ATXN1; (+) strand; PAM type: YTN; PAM sequence: TTC
aagaagtccagcacagcatc

SEQ ID NO: 289175 - DNA, 20 bp, Artificial Sequence
  Description of Artificial Sequence: Synthetic oligonucleotide
  Target: ATXN1; (+) strand; PAM type: YTN; PAM sequence: CTA
aacgatagcacaatatctgg

SEQ ID NO: 289176 - DNA, 20 bp, Artificial Sequence
  Description of Artificial Sequence: Synthetic oligonucleotide
  Target: ATXN1; (+) strand; PAM type: YTN; PAM sequence: CTG
gaaaattaaatgctagataa

SEQ ID NO: 289177 - DNA, 20 bp, Artificial Sequence
  Description of Artificial Sequence: Synthetic oligonucleotide
  Target: ATXN1; (+) strand; PAM type: YTN; PAM sequence: TTA
aatgctagataaatagatta

SEQ ID NO: 289178 - DNA, 20 bp, Artificial Sequence
  Description of Artificial Sequence: Synthetic oligonucleotide
  Target: ATXN1; (+) strand; PAM type: YTN; PAM sequence: CTA
gataaatagattatggatgg

SEQ ID NO: 289179 - DNA, 20 bp, Artificial Sequence
  Description of Artificial Sequence: Synthetic oligonucleotide
  Target: ATXN1; (+) strand; PAM type: YTN; PAM sequence: TTA
tggatggaaattacagtatc

SEQ ID NO: 289180 - DNA, 20 bp, Artificial Sequence
  Description of Artificial Sequence: Synthetic oligonucleotide
  Target: ATXN1; (+) strand; PAM type: YTN; PAM sequence: TTA
cagtatctatgagtgatgta

SEQ ID NO: 289181 - DNA, 20 bp, Artificial Sequence
  Description of Artificial Sequence: Synthetic oligonucleotide
  Target: ATXN1; (+) strand; PAM type: YTN; PAM sequence: CTA
tgagtgatgtaaaacttacg

SEQ ID NO: 289182 - DNA, 20 bp, Artificial Sequence
  Description of Artificial Sequence: Synthetic oligonucleotide
  Target: ATXN1; (+) strand; PAM type: YTN; PAM sequence: CTT
acgataggccctaagatcac

SEQ ID NO: 289183 - DNA, 20 bp, Artificial Sequence
  Description of Artificial Sequence: Synthetic oligonucleotide
  Target: ATXN1; (+) strand; PAM type: YTN; PAM sequence: TTA
cgataggccctaagatcaca

SEQ ID NO: 289184 - DNA, 20 bp, Artificial Sequence
  Description of Artificial Sequence: Synthetic oligonucleotide
  Target: ATXN1; (+) strand; PAM type: YTN; PAM sequence: CTA
agatcacactgtgtgggctt

SEQ ID NO: 289185 - DNA, 20 bp, Artificial Sequence
  Description of Artificial Sequence: Synthetic oligonucleotide
  Target: ATXN1; (+) strand; PAM type: YTN; PAM sequence: CTG
tgtgggcttgaaaatcacac

SEQ ID NO: 289186 - DNA, 20 bp, Artificial Sequence
  Description of Artificial Sequence: Synthetic oligonucleotide
  Target: ATXN1; (+) strand; PAM type: YTN; PAM sequence: CTT
gaaaatcacacagcagcatg

SEQ ID NO: 289187 - DNA, 20 bp, Artificial Sequence
  Description of Artificial Sequence: Synthetic oligonucleotide
  Target: ATXN1; (+) strand; PAM type: YTN; PAM sequence: TTG
aaaatcacacagcagcatgt

SEQ ID NO: 289188 - DNA, 20 bp, Artificial Sequence
  Description of Artificial Sequence: Synthetic oligonucleotide
  Target: ATXN1; (+) strand; PAM type: YTN; PAM sequence: TTT
acaatatacagacccctggt

SEQ ID NO: 289189 - DNA, 20 bp, Artificial Sequence
  Description of Artificial Sequence: Synthetic oligonucleotide
  Target: ATXN1; (+) strand; PAM type: YTN; PAM sequence: TTA
caatatacagacccctggta

SEQ ID NO: 289190 - DNA, 20 bp, Artificial Sequence
  Description of Artificial Sequence: Synthetic oligonucleotide
  Target: ATXN1; (+) strand; PAM type: YTN; PAM sequence: CTG
gtaaatatcaggcagctagc

SEQ ID NO: 289191 - DNA, 20 bp, Artificial Sequence
  Description of Artificial Sequence: Synthetic oligonucleotide
  Target: ATXN1; (+) strand; PAM type: YTN; PAM sequence: CTA
gctcacaaacagtaaatcag

SEQ ID NO: 289192 - DNA, 20 bp, Artificial Sequence
  Description of Artificial Sequence: Synthetic oligonucleotide
  Target: ATXN1; (+) strand; PAM type: YTN; PAM sequence: CTC
acaaacagtaaatcagcatg

SEQ ID NO: 289193 - DNA, 20 bp, Artificial Sequence
  Description of Artificial Sequence: Synthetic oligonucleotide
  Target: ATXN1; (+) strand; PAM type: YTN; PAM sequence: TTA
aaaaatctatatgactagag

SEQ ID NO: 289194 - DNA, 20 bp, Artificial Sequence
  Description of Artificial Sequence: Synthetic oligonucleotide
  Target: ATXN1; (+) strand; PAM type: YTN; PAM sequence: CTA
tatgactagagacactaaaa

SEQ ID NO: 289195 - DNA, 20 bp, Artificial Sequence
  Description of Artificial Sequence: Synthetic oligonucleotide
  Target: ATXN1; (+) strand; PAM type: YTN; PAM sequence: CTA
gagacactaaaaatgttcat

SEQ ID NO: 289196 - DNA, 20 bp, Artificial Sequence
  Description of Artificial Sequence: Synthetic oligonucleotide
  Target: ATXN1; (+) strand; PAM type: YTN; PAM sequence: CTA
aaaatgttcatatttatcgt

SEQ ID NO: 289197 - DNA, 20 bp, Artificial Sequence
  Description of Artificial Sequence: Synthetic oligonucleotide
  Target: ATXN1; (+) strand; PAM type: YTN; PAM sequence: TTC
atatttatcgtatgcgtgat

SEQ ID NO: 289198 - DNA, 20 bp, Artificial Sequence
  Description of Artificial Sequence: Synthetic oligonucleotide
  Target: ATXN1; (+) strand; PAM type: YTN; PAM sequence: TTT
atcgtatgcgtgatctgctc

SEQ ID NO: 289199 - DNA, 20 bp, Artificial Sequence
  Description of Artificial Sequence: Synthetic oligonucleotide
  Target: ATXN1; (+) strand; PAM type: YTN; PAM sequence: TTA
tcgtatgcgtgatctgctct

SEQ ID NO: 289200 - DNA, 20 bp, Artificial Sequence
  Description of Artificial Sequence: Synthetic oligonucleotide
  Target: ATXN1; (+) strand; PAM type: YTN; PAM sequence: CTG
ctctgcattcttttctgtat

SEQ ID NO: 289201 - DNA, 20 bp, Artificial Sequence
  Description of Artificial Sequence: Synthetic oligonucleotide
  Target: ATXN1; (+) strand; PAM type: YTN; PAM sequence: CTC
tgcattcttttctgtatttc

SEQ ID NO: 289202 - DNA, 20 bp, Artificial Sequence
  Description of Artificial Sequence: Synthetic oligonucleotide
  Target: ATXN1; (+) strand; PAM type: YTN; PAM sequence: CTG
cattcttttctgtatttcca

SEQ ID NO: 289203 - DNA, 20 bp, Artificial Sequence
  Description of Artificial Sequence: Synthetic oligonucleotide
  Target: ATXN1; (+) strand; PAM type: YTN; PAM sequence: TTC
ttttctgtatttccagtttt

SEQ ID NO: 289204 - DNA, 20 bp, Artificial Sequence
  Description of Artificial Sequence: Synthetic oligonucleotide
  Target: ATXN1; (+) strand; PAM type: YTN; PAM sequence: CTT
ttctgtatttccagtttttc

SEQ ID NO: 289205 - DNA, 20 bp, Artificial Sequence
  Description of Artificial Sequence: Synthetic oligonucleotide
  Target: ATXN1; (+) strand; PAM type: YTN; PAM sequence: TTT
tctgtatttccagtttttct

SEQ ID NO: 289206 - DNA, 20 bp, Artificial Sequence
  Description of Artificial Sequence: Synthetic oligonucleotide
  Target: ATXN1; (+) strand; PAM type: YTN; PAM sequence: TTT
ctgtatttccagtttttcta

SEQ ID NO: 289207 - DNA, 20 bp, Artificial Sequence
  Description of Artificial Sequence: Synthetic oligonucleotide
  Target: ATXN1; (+) strand; PAM type: YTN; PAM sequence: TTC
tgtatttccagtttttctaa

SEQ ID NO: 289208 - DNA, 20 bp, Artificial Sequence
  Description of Artificial Sequence: Synthetic oligonucleotide
  Target: ATXN1; (+) strand; PAM type: YTN; PAM sequence: CTG
tatttccagtttttctaaat

SEQ ID NO: 289209 - DNA, 20 bp, Artificial Sequence
  Description of Artificial Sequence: Synthetic oligonucleotide
  Target: ATXN1; (+) strand; PAM type: YTN; PAM sequence: TTT
ccagtttttctaaatgaata

SEQ ID NO: 289210 - DNA, 20 bp, Artificial Sequence
  Description of Artificial Sequence: Synthetic oligonucleotide
  Target: ATXN1; (+) strand; PAM type: YTN; PAM sequence: TTC
cagtttttctaaatgaatat

SEQ ID NO: 289211 - DNA, 20 bp, Artificial Sequence
  Description of Artificial Sequence: Synthetic oligonucleotide
  Target: ATXN1; (+) strand; PAM type: YTN; PAM sequence: TTT
ttctaaatgaatatatacat

SEQ ID NO: 289212 - DNA, 20 bp, Artificial Sequence
  Description of Artificial Sequence: Synthetic oligonucleotide
  Target: ATXN1; (+) strand; PAM type: YTN; PAM sequence: TTT
tctaaatgaatatatacatc

SEQ ID NO: 289213 - DNA, 20 bp, Artificial Sequence
  Description of Artificial Sequence: Synthetic oligonucleotide
  Target: ATXN1; (+) strand; PAM type: YTN; PAM sequence: TTT
ctaaatgaatatatacatcc

SEQ ID NO: 289214 - DNA, 20 bp, Artificial Sequence
  Description of Artificial Sequence: Synthetic oligonucleotide
  Target: ATXN1; (+) strand; PAM type: YTN; PAM sequence: TTC
taaatgaatatatacatccc

SEQ ID NO: 289215 - DNA, 20 bp, Artificial Sequence
  Description of Artificial Sequence: Synthetic oligonucleotide
  Target: ATXN1; (+) strand; PAM type: YTN; PAM sequence: CTA
aatgaatatatacatccctt

SEQ ID NO: 289216 - DNA, 20 bp, Artificial Sequence
  Description of Artificial Sequence: Synthetic oligonucleotide
  Target: ATXN1; (+) strand; PAM type: YTN; PAM sequence: CTT
ctgtgatcagggaaacaata

SEQ ID NO: 289217 - DNA, 20 bp, Artificial Sequence
  Description of Artificial Sequence: Synthetic oligonucleotide
  Target: ATXN1; (+) strand; PAM type: YTN; PAM sequence: TTC
tgtgatcagggaaacaataa

SEQ ID NO: 289218 - DNA, 20 bp, Artificial Sequence
  Description of Artificial Sequence: Synthetic oligonucleotide
  Target: ATXN1; (+) strand; PAM type: YTN; PAM sequence: CTG
tgatcagggaaacaataaac

SEQ ID NO: 289219 - DNA, 20 bp, Artificial Sequence
  Description of Artificial Sequence: Synthetic oligonucleotide
  Target: ATXN1; (+) strand; PAM type: YTN; PAM sequence: TTT
ctggggcatgccctggagtc

SEQ ID NO: 289220 - DNA, 20 bp, Artificial Sequence
  Description of Artificial Sequence: Synthetic oligonucleotide
  Target: ATXN1; (+) strand; PAM type: YTN; PAM sequence: TTC
tggggcatgccctggagtca

SEQ ID NO: 289221 - DNA, 20 bp, Artificial Sequence
  Description of Artificial Sequence: Synthetic oligonucleotide
  Target: ATXN1; (+) strand; PAM type: YTN; PAM sequence: CTG
gggcatgccctggagtcaga

SEQ ID NO: 289222 - DNA, 20 bp, Artificial Sequence
  Description of Artificial Sequence: Synthetic oligonucleotide
  Target: ATXN1; (+) strand; PAM type: YTN; PAM sequence: CTG
gagtcagactgcttggattc

SEQ ID NO: 289223 - DNA, 20 bp, Artificial Sequence
  Description of Artificial Sequence: Synthetic oligonucleotide
  Target: ATXN1; (+) strand; PAM type: YTN; PAM sequence: CTG
cttggattcaaatcatagct

SEQ ID NO: 289224 - DNA, 20 bp, Artificial Sequence
  Description of Artificial Sequence: Synthetic oligonucleotide
  Target: ATXN1; (+) strand; PAM type: YTN; PAM sequence: CTT
ggattcaaatcatagctcta

SEQ ID NO: 289225 - DNA, 20 bp, Artificial Sequence
  Description of Artificial Sequence: Synthetic oligonucleotide
  Target: ATXN1; (+) strand; PAM type: YTN; PAM sequence: TTG
gattcaaatcatagctctat

SEQ ID NO: 289226 - DNA, 20 bp, Artificial Sequence
  Description of Artificial Sequence: Synthetic oligonucleotide
  Target: ATXN1; (+) strand; PAM type: YTN; PAM sequence: TTC
aaatcatagctctatagcca

SEQ ID NO: 289227 - DNA, 20 bp, Artificial Sequence
  Description of Artificial Sequence: Synthetic oligonucleotide
  Target: ATXN1; (+) strand; PAM type: YTN; PAM sequence: CTC
tatagccatgcgtggcaaca

SEQ ID NO: 289228 - DNA, 20 bp, Artificial Sequence
  Description of Artificial Sequence: Synthetic oligonucleotide
  Target: ATXN1; (+) strand; PAM type: YTN; PAM sequence: CTA
tagccatgcgtggcaacatg

SEQ ID NO: 289229 - DNA, 20 bp, Artificial Sequence
  Description of Artificial Sequence: Synthetic oligonucleotide
  Target: ATXN1; (+) strand; PAM type: YTN; PAM sequence: CTA
tagtcccagctacacaggag

SEQ ID NO: 289230 - DNA, 20 bp, Artificial Sequence
  Description of Artificial Sequence: Synthetic oligonucleotide
  Target: ATXN1; (+) strand; PAM type: YTN; PAM sequence: CTA
cacaggaggctgaggggcaa

SEQ ID NO: 289231 - DNA, 20 bp, Artificial Sequence
  Description of Artificial Sequence: Synthetic oligonucleotide
  Target: ATXN1; (+) strand; PAM type: YTN; PAM sequence: CTG
aggggcaaggatcgcttgag

SEQ ID NO: 289232 - DNA, 20 bp, Artificial Sequence
  Description of Artificial Sequence: Synthetic oligonucleotide
  Target: ATXN1; (+) strand; PAM type: YTN; PAM sequence: CTT
gagcccaggagttggaggcc

SEQ ID NO: 289233 - DNA, 20 bp, Artificial Sequence
  Description of Artificial Sequence: Synthetic oligonucleotide
  Target: ATXN1; (+) strand; PAM type: YTN; PAM sequence: TTG
agcccaggagttggaggcca

SEQ ID NO: 289234 - DNA, 20 bp, Artificial Sequence
  Description of Artificial Sequence: Synthetic oligonucleotide
  Target: ATXN1; (+) strand; PAM type: YTN; PAM sequence: TTG
gaggccagcctgagcaacat

SEQ ID NO: 289235 - DNA, 20 bp, Artificial Sequence
  Description of Artificial Sequence: Synthetic oligonucleotide
  Target: ATXN1; (+) strand; PAM type: YTN; PAM sequence: CTG
agcaacataatgagactccg

SEQ ID NO: 289236 - DNA, 20 bp, Artificial Sequence
  Description of Artificial Sequence: Synthetic oligonucleotide
  Target: ATXN1; (+) strand; PAM type: YTN; PAM sequence: CTC
cgtctctaagggaaaaaaaa

SEQ ID NO: 289237 - DNA, 20 bp, Artificial Sequence
  Description of Artificial Sequence: Synthetic oligonucleotide
  Target: ATXN1; (+) strand; PAM type: YTN; PAM sequence: CTC
taagggaaaaaaaaaaagaa

SEQ ID NO: 289238 - DNA, 20 bp, Artificial Sequence
  Description of Artificial Sequence: Synthetic oligonucleotide
  Target: ATXN1; (+) strand; PAM type: YTN; PAM sequence: CTA
agggaaaaaaaaaaagaaaa

SEQ ID NO: 289239 - DNA, 20 bp, Artificial Sequence
  Description of Artificial Sequence: Synthetic oligonucleotide
  Target: ATXN1; (+) strand; PAM type: YTN; PAM sequence: CTC
tatcactttaagatctgcca

SEQ ID NO: 289240 - DNA, 20 bp, Artificial Sequence
  Description of Artificial Sequence: Synthetic oligonucleotide
  Target: ATXN1; (+) strand; PAM type: YTN; PAM sequence: CTA
tcactttaagatctgccacc

SEQ ID NO: 289241 - DNA, 20 bp, Artificial Sequence
  Description of Artificial Sequence: Synthetic oligonucleotide
  Target: ATXN1; (+) strand; PAM type: YTN; PAM sequence: CTT
taagatctgccaccttgggc

SEQ ID NO: 289242 - DNA, 20 bp, Artificial Sequence
  Description of Artificial Sequence: Synthetic oligonucleotide
  Target: ATXN1; (+) strand; PAM type: YTN; PAM sequence: TTT
aagatctgccaccttgggca

SEQ ID NO: 289243 - DNA, 20 bp, Artificial Sequence
  Description of Artificial Sequence: Synthetic oligonucleotide
  Target: ATXN1; (+) strand; PAM type: YTN; PAM sequence: TTA
agatctgccaccttgggcaa

SEQ ID NO: 289244 - DNA, 20 bp, Artificial Sequence
  Description of Artificial Sequence: Synthetic oligonucleotide
  Target: ATXN1; (+) strand; PAM type: YTN; PAM sequence: CTG
ccaccttgggcaagttgctt

SEQ ID NO: 289245 - DNA, 20 bp, Artificial Sequence
  Description of Artificial Sequence: Synthetic oligonucleotide
  Target: ATXN1; (+) strand; PAM type: YTN; PAM sequence: CTT
gggcaagttgcttatcctct

SEQ ID NO: 289246 - DNA, 20 bp, Artificial Sequence
  Description of Artificial Sequence: Synthetic oligonucleotide
  Target: ATXN1; (+) strand; PAM type: YTN; PAM sequence: TTG
ggcaagttgcttatcctctc

SEQ ID NO: 289247 - DNA, 20 bp, Artificial Sequence
  Description of Artificial Sequence: Synthetic oligonucleotide
  Target: ATXN1; (+) strand; PAM type: YTN; PAM sequence: TTG
cttatcctctctgagcctca

SEQ ID NO: 289248 - DNA, 20 bp, Artificial Sequence
  Description of Artificial Sequence: Synthetic oligonucleotide
  Target: ATXN1; (+) strand; PAM type: YTN; PAM sequence: CTT
atcctctctgagcctcaact

SEQ ID NO: 289249 - DNA, 20 bp, Artificial Sequence
  Description of Artificial Sequence: Synthetic oligonucleotide
  Target: ATXN1; (+) strand; PAM type: YTN; PAM sequence: TTA
tcctctctgagcctcaactt

SEQ ID NO: 289250 - DNA, 20 bp, Artificial Sequence
  Description of Artificial Sequence: Synthetic oligonucleotide
  Target: ATXN1; (+) strand; PAM type: YTN; PAM sequence: CTC
tctgagcctcaacttcctgt

SEQ ID NO: 289251 - DNA, 20 bp, Artificial Sequence
  Description of Artificial Sequence: Synthetic oligonucleotide
  Target: ATXN1; (+) strand; PAM type: YTN; PAM sequence: CTC
tgagcctcaacttcctgttc

SEQ ID NO: 289252 - DNA, 20 bp, Artificial Sequence
  Description of Artificial Sequence: Synthetic oligonucleotide
  Target: ATXN1; (+) strand; PAM type: YTN; PAM sequence: CTG
agcctcaacttcctgttctg

SEQ ID NO: 289253 - DNA, 20 bp, Artificial Sequence
  Description of Artificial Sequence: Synthetic oligonucleotide
  Target: ATXN1; (+) strand; PAM type: YTN; PAM sequence: CTC
aacttcctgttctgtcaaat

SEQ ID NO: 289254 - DNA, 20 bp, Artificial Sequence
  Description of Artificial Sequence: Synthetic oligonucleotide
  Target: ATXN1; (+) strand; PAM type: YTN; PAM sequence: CTT
cctgttctgtcaaatggggc

SEQ ID NO: 289255 - DNA, 20 bp, Artificial Sequence
  Description of Artificial Sequence: Synthetic oligonucleotide
  Target: ATXN1; (+) strand; PAM type: YTN; PAM sequence: TTC
ctgttctgtcaaatggggct

SEQ ID NO: 289256 - DNA, 20 bp, Artificial Sequence
  Description of Artificial Sequence: Synthetic oligonucleotide
  Target: ATXN1; (+) strand; PAM type: YTN; PAM sequence: CTG
ttctgtcaaatggggctaat

SEQ ID NO: 289257 - DNA, 20 bp, Artificial Sequence
  Description of Artificial Sequence: Synthetic oligonucleotide
  Target: ATXN1; (+) strand; PAM type: YTN; PAM sequence: TTC
tgtcaaatggggctaataac

SEQ ID NO: 289258 - DNA, 20 bp, Artificial Sequence
  Description of Artificial Sequence: Synthetic oligonucleotide
  Target: ATXN1; (+) strand; PAM type: YTN; PAM sequence: CTG
tcaaatggggctaataacac

SEQ ID NO: 289259 - DNA, 20 bp, Artificial Sequence
  Description of Artificial Sequence: Synthetic oligonucleotide
  Target: ATXN1; (+) strand; PAM type: YTN; PAM sequence: CTA
ataacactatgctgttgggc

SEQ ID NO: 289260 - DNA, 20 bp, Artificial Sequence
  Description of Artificial Sequence: Synthetic oligonucleotide
  Target: ATXN1; (+) strand; PAM type: YTN; PAM sequence: CTA
tgctgttgggctgctgtggc

SEQ ID NO: 289261 - DNA, 20 bp, Artificial Sequence
  Description of Artificial Sequence: Synthetic oligonucleotide
  Target: ATXN1; (+) strand; PAM type: YTN; PAM sequence: CTG
ttgggctgctgtggcaattg

SEQ ID NO: 289262 - DNA, 20 bp, Artificial Sequence
  Description of Artificial Sequence: Synthetic oligonucleotide
  Target: ATXN1; (+) strand; PAM type: YTN; PAM sequence: TTG
ggctgctgtggcaattgaat

SEQ ID NO: 289263 - DNA, 20 bp, Artificial Sequence
  Description of Artificial Sequence: Synthetic oligonucleotide
  Target: ATXN1; (+) strand; PAM type: YTN; PAM sequence: CTG
ctgtggcaattgaattttac

SEQ ID NO: 289264 - DNA, 20 bp, Artificial Sequence
  Description of Artificial Sequence: Synthetic oligonucleotide
  Target: ATXN1; (+) strand; PAM type: YTN; PAM sequence: CTG
tggcaattgaattttacatg

SEQ ID NO: 289265 - DNA, 20 bp, Artificial Sequence
  Description of Artificial Sequence: Synthetic oligonucleotide
  Target: ATXN1; (+) strand; PAM type: YTN; PAM sequence: TTG
aattttacatgtatgtaaag

SEQ ID NO: 289266 - DNA, 20 bp, Artificial Sequence
  Description of Artificial Sequence: Synthetic oligonucleotide
  Target: ATXN1; (+) strand; PAM type: YTN; PAM sequence: TTT
tacatgtatgtaaagcactt

SEQ ID NO: 289267 - DNA, 20 bp, Artificial Sequence
  Description of Artificial Sequence: Synthetic oligonucleotide
  Target: ATXN1; (+) strand; PAM type: YTN; PAM sequence: TTT
acatgtatgtaaagcactta

SEQ ID NO: 289268 - DNA, 20 bp, Artificial Sequence
  Description of Artificial Sequence: Synthetic oligonucleotide
  Target: ATXN1; (+) strand; PAM type: YTN; PAM sequence: TTA
catgtatgtaaagcacttag

SEQ ID NO: 289269 - DNA, 20 bp, Artificial Sequence
  Description of Artificial Sequence: Synthetic oligonucleotide
  Target: ATXN1; (+) strand; PAM type: YTN; PAM sequence: CTT
agtacagcatctggaccata

SEQ ID NO: 289270 - DNA, 20 bp, Artificial Sequence
  Description of Artificial Sequence: Synthetic oligonucleotide
  Target: ATXN1; (+) strand; PAM type: YTN; PAM sequence: TTA
gtacagcatctggaccataa

SEQ ID NO: 289271 - DNA, 20 bp, Artificial Sequence
  Description of Artificial Sequence: Synthetic oligonucleotide
  Target: ATXN1; (+) strand; PAM type: YTN; PAM sequence: CTG
gaccataataagagctcatt

SEQ ID NO: 289272 - DNA, 20 bp, Artificial Sequence
  Description of Artificial Sequence: Synthetic oligonucleotide
  Target: ATXN1; (+) strand; PAM type: YTN; PAM sequence: CTC
attatatattagtattattt

SEQ ID NO: 289273 - DNA, 20 bp, Artificial Sequence
  Description of Artificial Sequence: Synthetic oligonucleotide
  Target: ATXN1; (+) strand; PAM type: YTN; PAM sequence: TTA
tatattagtattattttgat

SEQ ID NO: 289274 - DNA, 20 bp, Artificial Sequence
  Description of Artificial Sequence: Synthetic oligonucleotide
  Target: ATXN1; (+) strand; PAM type: YTN; PAM sequence: TTA
gtattattttgattttaaaa

SEQ ID NO: 289275 - DNA, 20 bp, Artificial Sequence
  Description of Artificial Sequence: Synthetic oligonucleotide
  Target: ATXN1; (+) strand; PAM type: YTN; PAM sequence: TTA
ttttgattttaaaacaataa

SEQ ID NO: 289276 - DNA, 20 bp, Artificial Sequence
  Description of Artificial Sequence: Synthetic oligonucleotide
  Target: ATXN1; (+) strand; PAM type: YTN; PAM sequence: TTT
tgattttaaaacaataaccc

SEQ ID NO: 289277 - DNA, 20 bp, Artificial Sequence
  Description of Artificial Sequence: Synthetic oligonucleotide
  Target: ATXN1; (+) strand; PAM type: YTN; PAM sequence: TTT
gattttaaaacaataacccc

SEQ ID NO: 289278 - DNA, 20 bp, Artificial Sequence
  Description of Artificial Sequence: Synthetic oligonucleotide
  Target: ATXN1; (+) strand; PAM type: YTN; PAM sequence: TTG
attttaaaacaataaccccc

SEQ ID NO: 289279 - DNA, 20 bp, Artificial Sequence
  Description of Artificial Sequence: Synthetic oligonucleotide
  Target: ATXN1; (+) strand; PAM type: YTN; PAM sequence: TTT
taaaacaataacccccctca

SEQ ID NO: 289280 - DNA, 20 bp, Artificial Sequence
  Description of Artificial Sequence: Synthetic oligonucleotide
  Target: ATXN1; (+) strand; PAM type: YTN; PAM sequence: TTT
aaaacaataacccccctcaa

SEQ ID NO: 289281 - DNA, 20 bp, Artificial Sequence
  Description of Artificial Sequence: Synthetic oligonucleotide
  Target: ATXN1; (+) strand; PAM type: YTN; PAM sequence: TTA
aaacaataacccccctcaac

SEQ ID NO: 289282 - DNA, 20 bp, Artificial Sequence
  Description of Artificial Sequence: Synthetic oligonucleotide
  Target: ATXN1; (+) strand; PAM type: YTN; PAM sequence: CTC
aaccaaacttttacagtagg

SEQ ID NO: 289283 - DNA, 20 bp, Artificial Sequence
  Description of Artificial Sequence: Synthetic oligonucleotide
  Target: ATXN1; (+) strand; PAM type: YTN; PAM sequence: CTT
ttacagtaggagaaaccttg

SEQ ID NO: 289284 - DNA, 20 bp, Artificial Sequence
  Description of Artificial Sequence: Synthetic oligonucleotide
  Target: ATXN1; (+) strand; PAM type: YTN; PAM sequence: TTT
tacagtaggagaaaccttga

SEQ ID NO: 289285 - DNA, 20 bp, Artificial Sequence
  Description of Artificial Sequence: Synthetic oligonucleotide
  Target: ATXN1; (+) strand; PAM type: YTN; PAM sequence: TTT
acagtaggagaaaccttgat

SEQ ID NO: 289286 - DNA, 20 bp, Artificial Sequence
  Description of Artificial Sequence: Synthetic oligonucleotide
  Target: ATXN1; (+) strand; PAM type: YTN; PAM sequence: TTA
cagtaggagaaaccttgatc

SEQ ID NO: 289287 - DNA, 20 bp, Artificial Sequence
  Description of Artificial Sequence: Synthetic oligonucleotide
  Target: ATXN1; (+) strand; PAM type: YTN; PAM sequence: CTT
gatcttatttctatgctaga

SEQ ID NO: 289288 - DNA, 20 bp, Artificial Sequence
  Description of Artificial Sequence: Synthetic oligonucleotide
  Target: ATXN1; (+) strand; PAM type: YTN; PAM sequence: TTG
atcttatttctatgctagag

SEQ ID NO: 289289 - DNA, 20 bp, Artificial Sequence
  Description of Artificial Sequence: Synthetic oligonucleotide
  Target: ATXN1; (+) strand; PAM type: YTN; PAM sequence: CTT
atttctatgctagaggaaaa

SEQ ID NO: 289290 - DNA, 20 bp, Artificial Sequence
  Description of Artificial Sequence: Synthetic oligonucleotide
  Target: ATXN1; (+) strand; PAM type: YTN; PAM sequence: TTA
tttctatgctagaggaaaag

SEQ ID NO: 289291 - DNA, 20 bp, Artificial Sequence
  Description of Artificial Sequence: Synthetic oligonucleotide
  Target: ATXN1; (+) strand; PAM type: YTN; PAM sequence: TTT
ctatgctagaggaaaagcag

SEQ ID NO: 289292 - DNA, 20 bp, Artificial Sequence
  Description of Artificial Sequence: Synthetic oligonucleotide
  Target: ATXN1; (+) strand; PAM type: YTN; PAM sequence: TTC
tatgctagaggaaaagcagt

SEQ ID NO: 289293 - DNA, 20 bp, Artificial Sequence
  Description of Artificial Sequence: Synthetic oligonucleotide
  Target: ATXN1; (+) strand; PAM type: YTN; PAM sequence: CTA
tgctagaggaaaagcagtag

SEQ ID NO: 289294 - DNA, 20 bp, Artificial Sequence
  Description of Artificial Sequence: Synthetic oligonucleotide
  Target: ATXN1; (+) strand; PAM type: YTN; PAM sequence: CTA
gaggaaaagcagtagtcttc

SEQ ID NO: 289295 - DNA, 20 bp, Artificial Sequence
  Description of Artificial Sequence: Synthetic oligonucleotide
  Target: ATXN1; (+) strand; PAM type: YTN; PAM sequence: CTT
caaaggctgtaaacacaaaa

SEQ ID NO: 289296 - DNA, 20 bp, Artificial Sequence
  Description of Artificial Sequence: Synthetic oligonucleotide
  Target: ATXN1; (+) strand; PAM type: YTN; PAM sequence: TTC
aaaggctgtaaacacaaaat

SEQ ID NO: 289297 - DNA, 20 bp, Artificial Sequence
  Description of Artificial Sequence: Synthetic oligonucleotide
  Target: ATXN1; (+) strand; PAM type: YTN; PAM sequence: CTG
taaacacaaaatgttaaata

SEQ ID NO: 289298 - DNA, 20 bp, Artificial Sequence
  Description of Artificial Sequence: Synthetic oligonucleotide
  Target: ATXN1; (+) strand; PAM type: YTN; PAM sequence: TTA
aatattcacatacatattct

SEQ ID NO: 289299 - DNA, 20 bp, Artificial Sequence
  Description of Artificial Sequence: Synthetic oligonucleotide
  Target: ATXN1; (+) strand; PAM type: YTN; PAM sequence: TTC
acatacatattctctctctc

SEQ ID NO: 289300 - DNA, 20 bp, Artificial Sequence
  Description of Artificial Sequence: Synthetic oligonucleotide
  Target: ATXN1; (+) strand; PAM type: YTN; PAM sequence: TTC
tctctctctctctctgtctc

SEQ ID NO: 289301 - DNA, 20 bp, Artificial Sequence
  Description of Artificial Sequence: Synthetic oligonucleotide
  Target: ATXN1; (+) strand; PAM type: YTN; PAM sequence: CTC
tctctctctctctgtctctc

SEQ ID NO: 289302 - DNA, 20 bp, Artificial Sequence
  Description of Artificial Sequence: Synthetic oligonucleotide
  Target: ATXN1; (+) strand; PAM type: YTN; PAM sequence: CTC
tctctctctctgtctctcaa

SEQ ID NO: 289303 - DNA, 20 bp, Artificial Sequence
  Description of Artificial Sequence: Synthetic oligonucleotide
  Target: ATXN1; (+) strand; PAM type: YTN; PAM sequence: CTC
tctctctctgtctctcaaac

SEQ ID NO: 289304 - DNA, 20 bp, Artificial Sequence
  Description of Artificial Sequence: Synthetic oligonucleotide
  Target: ATXN1; (+) strand; PAM type: YTN; PAM sequence: CTC
tctctctgtctctcaaacac

SEQ ID NO: 289305 - DNA, 20 bp, Artificial Sequence
  Description of Artificial Sequence: Synthetic oligonucleotide
  Target: ATXN1; (+) strand; PAM type: YTN; PAM sequence: CTC
tctctgtctctcaaacacac

SEQ ID NO: 289306 - DNA, 20 bp, Artificial Sequence
  Description of Artificial Sequence: Synthetic oligonucleotide
  Target: ATXN1; (+) strand; PAM type: YTN; PAM sequence: CTC
tctgtctctcaaacacacac

SEQ ID NO: 289307 - DNA, 20 bp, Artificial Sequence
  Description of Artificial Sequence: Synthetic oligonucleotide
  Target: ATXN1; (+) strand; PAM type: YTN; PAM sequence: CTC
tgtctctcaaacacacacac

SEQ ID NO: 289308 - DNA, 20 bp, Artificial Sequence
  Description of Artificial Sequence: Synthetic oligonucleotide
  Target: ATXN1; (+) strand; PAM type: YTN; PAM sequence: CTG
tctctcaaacacacacacac

SEQ ID NO: 289309 - DNA, 20 bp, Artificial Sequence
  Description of Artificial Sequence: Synthetic oligonucleotide
  Target: ATXN1; (+) strand; PAM type: YTN; PAM sequence: CTC
tcaaacacacacacacacac

SEQ ID NO: 289310 - DNA, 20 bp, Artificial Sequence
  Description of Artificial Sequence: Synthetic oligonucleotide
  Target: ATXN1; (+) strand; PAM type: YTN; PAM sequence: CTC
aaacacacacacacacacac

SEQ ID NO: 289311 - DNA, 20 bp, Artificial Sequence
  Description of Artificial Sequence: Synthetic oligonucleotide
  Target: ATXN1; (+) strand; PAM type: YTN; PAM sequence: TTT
aacataactataatttccaa

SEQ ID NO: 289312 - DNA, 20 bp, Artificial Sequence
  Description of Artificial Sequence: Synthetic oligonucleotide
  Target: ATXN1; (+) strand; PAM type: YTN; PAM sequence: TTA
acataactataatttccaac

SEQ ID NO: 289313 - DNA, 20 bp, Artificial Sequence
  Description of Artificial Sequence: Synthetic oligonucleotide
  Target: ATXN1; (+) strand; PAM type: YTN; PAM sequence: CTA
taatttccaaccataatcta

SEQ ID NO: 289314 - DNA, 20 bp, Artificial Sequence
  Description of Artificial Sequence: Synthetic oligonucleotide
  Target: ATXN1; (+) strand; PAM type: YTN; PAM sequence: TTT
ccaaccataatctatttatc

SEQ ID NO: 289315 - DNA, 20 bp, Artificial Sequence
  Description of Artificial Sequence: Synthetic oligonucleotide
  Target: ATXN1; (+) strand; PAM type: YTN; PAM sequence: TTC
caaccataatctatttatct

SEQ ID NO: 289316 - DNA, 20 bp, Artificial Sequence
  Description of Artificial Sequence: Synthetic oligonucleotide
  Target: ATXN1; (+) strand; PAM type: YTN; PAM sequence: CTA
tttatctagcattcaattct

SEQ ID NO: 289317 - DNA, 20 bp, Artificial Sequence
  Description of Artificial Sequence: Synthetic oligonucleotide
  Target: ATXN1; (+) strand; PAM type: YTN; PAM sequence: TTT
atctagcattcaattctcca

SEQ ID NO: 289318 - DNA, 20 bp, Artificial Sequence
  Description of Artificial Sequence: Synthetic oligonucleotide
  Target: ATXN1; (+) strand; PAM type: YTN; PAM sequence: TTA
tctagcattcaattctccag

SEQ ID NO: 289319 - DNA, 20 bp, Artificial Sequence
  Description of Artificial Sequence: Synthetic oligonucleotide
  Target: ATXN1; (+) strand; PAM type: YTN; PAM sequence: CTA
gcattcaattctccagatat

SEQ ID NO: 289320 - DNA, 20 bp, Artificial Sequence
  Description of Artificial Sequence: Synthetic oligonucleotide
  Target: ATXN1; (+) strand; PAM type: YTN; PAM sequence: TTC
aattctccagatattgtgct

SEQ ID NO: 289321 - DNA, 20 bp, Artificial Sequence
  Description of Artificial Sequence: Synthetic oligonucleotide
  Target: ATXN1; (+) strand; PAM type: YTN; PAM sequence: TTC
tccagatattgtgctatcgt

SEQ ID NO: 289322 - DNA, 20 bp, Artificial Sequence
  Description of Artificial Sequence: Synthetic oligonucleotide
  Target: ATXN1; (+) strand; PAM type: YTN; PAM sequence: CTC
cagatattgtgctatcgttt

SEQ ID NO: 289323 - DNA, 20 bp, Artificial Sequence
  Description of Artificial Sequence: Synthetic oligonucleotide
  Target: ATXN1; (+) strand; PAM type: YTN; PAM sequence: TTG
tgctatcgtttagtgatgct

SEQ ID NO: 289324 - DNA, 20 bp, Artificial Sequence
  Description of Artificial Sequence: Synthetic oligonucleotide
  Target: ATXN1; (+) strand; PAM type: YTN; PAM sequence: CTA
tcgtttagtgatgctgtgct

SEQ ID NO: 289325 - DNA, 20 bp, Artificial Sequence
  Description of Artificial Sequence: Synthetic oligonucleotide
  Target: ATXN1; (+) strand; PAM type: YTN; PAM sequence: TTT
agtgatgctgtgctggactt

SEQ ID NO: 289326 - DNA, 20 bp, Artificial Sequence
  Description of Artificial Sequence: Synthetic oligonucleotide
  Target: ATXN1; (+) strand; PAM type: YTN; PAM sequence: TTA
gtgatgctgtgctggacttc

SEQ ID NO: 289327 - DNA, 20 bp, Artificial Sequence
  Description of Artificial Sequence: Synthetic oligonucleotide
  Target: ATXN1; (+) strand; PAM type: YTN; PAM sequence: CTG
tgctggacttcttgaacata

SEQ ID NO: 289328 - DNA, 20 bp, Artificial Sequence
  Description of Artificial Sequence: Synthetic oligonucleotide
  Target: ATXN1; (+) strand; PAM type: YTN; PAM sequence: CTG
gacttcttgaacatatatat

SEQ ID NO: 289329 - DNA, 20 bp, Artificial Sequence
  Description of Artificial Sequence: Synthetic oligonucleotide
  Target: ATXN1; (+) strand; PAM type: YTN; PAM sequence: CTT
cttgaacatatatatctttt

SEQ ID NO: 289330 - DNA, 20 bp, Artificial Sequence
  Description of Artificial Sequence: Synthetic oligonucleotide
  Target: ATXN1; (+) strand; PAM type: YTN; PAM sequence: TTC
ttgaacatatatatcttttt

SEQ ID NO: 289331 - DNA, 20 bp, Artificial Sequence
  Description of Artificial Sequence: Synthetic oligonucleotide
  Target: ATXN1; (+) strand; PAM type: YTN; PAM sequence: CTT
gaacatatatatcttttttc

SEQ ID NO: 289332 - DNA, 20 bp, Artificial Sequence
  Description of Artificial Sequence: Synthetic oligonucleotide
  Target: ATXN1; (+) strand; PAM type: YTN; PAM sequence: TTG
aacatatatatcttttttca

SEQ ID NO: 289333 - DNA, 20 bp, Artificial Sequence
  Description of Artificial Sequence: Synthetic oligonucleotide
  Target: ATXN1; (+) strand; PAM type: YTN; PAM sequence: CTT
ttttcaacatctctggttgt

SEQ ID NO: 289334 - DNA, 20 bp, Artificial Sequence
  Description of Artificial Sequence: Synthetic oligonucleotide
  Target: ATXN1; (+) strand; PAM type: YTN; PAM sequence: TTT
tttcaacatctctggttgtt

SEQ ID NO: 289335 - DNA, 20 bp, Artificial Sequence
  Description of Artificial Sequence: Synthetic oligonucleotide
  Target: ATXN1; (+) strand; PAM type: YTN; PAM sequence: TTT
ttcaacatctctggttgttt

SEQ ID NO: 289336 - DNA, 20 bp, Artificial Sequence
  Description of Artificial Sequence: Synthetic oligonucleotide
  Target: ATXN1; (+) strand; PAM type: YTN; PAM sequence: TTT
tcaacatctctggttgtttc

SEQ ID NO: 289337 - DNA, 20 bp, Artificial Sequence
  Description of Artificial Sequence: Synthetic oligonucleotide
  Target: ATXN1; (+) strand; PAM type: YTN; PAM sequence: TTT
caacatctctggttgtttcc

SEQ ID NO: 289338 - DNA, 20 bp, Artificial Sequence
  Description of Artificial Sequence: Synthetic oligonucleotide
  Target: ATXN1; (+) strand; PAM type: YTN; PAM sequence: TTC
aacatctctggttgtttcct

SEQ ID NO: 289339 - DNA, 20 bp, Artificial Sequence
  Description of Artificial Sequence: Synthetic oligonucleotide
  Target: ATXN1; (+) strand; PAM type: YTN; PAM sequence: CTC
tggttgtttccttaggacaa

SEQ ID NO: 289340 - DNA, 20 bp, Artificial Sequence
  Description of Artificial Sequence: Synthetic oligonucleotide
  Target: ATXN1; (+) strand; PAM type: YTN; PAM sequence: CTG
gttgtttccttaggacaaat

SEQ ID NO: 289341 - DNA, 20 bp, Artificial Sequence
  Description of Artificial Sequence: Synthetic oligonucleotide
  Target: ATXN1; (+) strand; PAM type: YTN; PAM sequence: TTG
tttccttaggacaaatttct

SEQ ID NO: 289342 - DNA, 20 bp, Artificial Sequence
  Description of Artificial Sequence: Synthetic oligonucleotide
  Target: ATXN1; (+) strand; PAM type: YTN; PAM sequence: TTT
ccttaggacaaatttctctg

SEQ ID NO: 289343 - DNA, 20 bp, Artificial Sequence
  Description of Artificial Sequence: Synthetic oligonucleotide
  Target: ATXN1; (+) strand; PAM type: YTN; PAM sequence: TTC
cttaggacaaatttctctgt

SEQ ID NO: 289344 - DNA, 20 bp, Artificial Sequence
  Description of Artificial Sequence: Synthetic oligonucleotide
  Target: ATXN1; (+) strand; PAM type: YTN; PAM sequence: CTT
aggacaaatttctctgtctc

SEQ ID NO: 289345 - DNA, 20 bp, Artificial Sequence
  Description of Artificial Sequence: Synthetic oligonucleotide
  Target: ATXN1; (+) strand; PAM type: YTN; PAM sequence: TTA
ggacaaatttctctgtctct

SEQ ID NO: 289346 - DNA, 20 bp, Artificial Sequence
  Description of Artificial Sequence: Synthetic oligonucleotide
  Target: ATXN1; (+) strand; PAM type: YTN; PAM sequence: TTT
ctctgtctctctctctctca

SEQ ID NO: 289347 - DNA, 20 bp, Artificial Sequence
  Description of Artificial Sequence: Synthetic oligonucleotide
  Target: ATXN1; (+) strand; PAM type: YTN; PAM sequence: TTC
tctgtctctctctctctcac

SEQ ID NO: 289348 - DNA, 20 bp, Artificial Sequence
  Description of Artificial Sequence: Synthetic oligonucleotide
  Target: ATXN1; (+) strand; PAM type: YTN; PAM sequence: CTC
tgtctctctctctctcacac

SEQ ID NO: 289349 - DNA, 20 bp, Artificial Sequence
  Description of Artificial Sequence: Synthetic oligonucleotide
  Target: ATXN1; (+) strand; PAM type: YTN; PAM sequence: CTG
tctctctctctctcacacac

SEQ ID NO: 289350 - DNA, 20 bp, Artificial Sequence
  Description of Artificial Sequence: Synthetic oligonucleotide
  Target: ATXN1; (+) strand; PAM type: YTN; PAM sequence: CTC
tctctctctcacacacacat

SEQ ID NO: 289351 - DNA, 20 bp, Artificial Sequence
  Description of Artificial Sequence: Synthetic oligonucleotide
  Target: ATXN1; (+) strand; PAM type: YTN; PAM sequence: CTC
tctctctcacacacacatac

SEQ ID NO: 289352 - DNA, 20 bp, Artificial Sequence
  Description of Artificial Sequence: Synthetic oligonucleotide
  Target: ATXN1; (+) strand; PAM type: YTN; PAM sequence: CTC
tctctcacacacacatacac

SEQ ID NO: 289353 - DNA, 20 bp, Artificial Sequence
  Description of Artificial Sequence: Synthetic oligonucleotide
  Target: ATXN1; (+) strand; PAM type: YTN; PAM sequence: CTC
tctcacacacacatacacac

SEQ ID NO: 289354 - DNA, 20 bp, Artificial Sequence
  Description of Artificial Sequence: Synthetic oligonucleotide
  Target: ATXN1; (+) strand; PAM type: YTN; PAM sequence: CTC
tcacacacacatacacacac

SEQ ID NO: 289355 - DNA, 20 bp, Artificial Sequence
  Description of Artificial Sequence: Synthetic oligonucleotide
  Target: ATXN1; (+) strand; PAM type: YTN; PAM sequence: CTC
acacacacatacacacacag

SEQ ID NO: 289356 - DNA, 20 bp, Artificial Sequence
  Description of Artificial Sequence: Synthetic oligonucleotide
  Target: ATXN1; (+) strand; PAM type: YTN; PAM sequence: TTC
tcatatcctaggatcctaag

SEQ ID NO: 289357 - DNA, 20 bp, Artificial Sequence
  Description of Artificial Sequence: Synthetic oligonucleotide
  Target: ATXN1; (+) strand; PAM type: YTN; PAM sequence: CTC
atatcctaggatcctaagaa

SEQ ID NO: 289358 - DNA, 20 bp, Artificial Sequence
  Description of Artificial Sequence: Synthetic oligonucleotide
  Target: ATXN1; (+) strand; PAM type: YTN; PAM sequence: CTA
ggatcctaagaaattggggc

SEQ ID NO: 289359 - DNA, 20 bp, Artificial Sequence
  Description of Artificial Sequence: Synthetic oligonucleotide
  Target: ATXN1; (+) strand; PAM type: YTN; PAM sequence: CTA
agaaattggggcaatcttta

SEQ ID NO: 289360 - DNA, 20 bp, Artificial Sequence
  Description of Artificial Sequence: Synthetic oligonucleotide
  Target: ATXN1; (+) strand; PAM type: YTN; PAM sequence: TTG
gggcaatctttaatatgcat

SEQ ID NO: 289361 - DNA, 20 bp, Artificial Sequence
  Description of Artificial Sequence: Synthetic oligonucleotide
  Target: ATXN1; (+) strand; PAM type: YTN; PAM sequence: CTT
taatatgcatctttaaggag

SEQ ID NO: 289362 - DNA, 20 bp, Artificial Sequence
  Description of Artificial Sequence: Synthetic oligonucleotide
  Target: ATXN1; (+) strand; PAM type: YTN; PAM sequence: TTT
aatatgcatctttaaggaga

SEQ ID NO: 289363 - DNA, 20 bp, Artificial Sequence
  Description of Artificial Sequence: Synthetic oligonucleotide
  Target: ATXN1; (+) strand; PAM type: YTN; PAM sequence: TTA
atatgcatctttaaggagat

SEQ ID NO: 289364 - DNA, 20 bp, Artificial Sequence
  Description of Artificial Sequence: Synthetic oligonucleotide
  Target: ATXN1; (+) strand; PAM type: YTN; PAM sequence: CTT
taaggagatcatctgagttt

SEQ ID NO: 289365 - DNA, 20 bp, Artificial Sequence
  Description of Artificial Sequence: Synthetic oligonucleotide
  Target: ATXN1; (+) strand; PAM type: YTN; PAM sequence: TTT
aaggagatcatctgagtttg

SEQ ID NO: 289366 - DNA, 20 bp, Artificial Sequence
  Description of Artificial Sequence: Synthetic oligonucleotide
  Target: ATXN1; (+) strand; PAM type: YTN; PAM sequence: TTA
aggagatcatctgagtttgg

SEQ ID NO: 289367 - DNA, 20 bp, Artificial Sequence
  Description of Artificial Sequence: Synthetic oligonucleotide
  Target: ATXN1; (+) strand; PAM type: YTN; PAM sequence: CTG
agtttggtcaacccaagtcg

SEQ ID NO: 289368 - DNA, 20 bp, Artificial Sequence
  Description of Artificial Sequence: Synthetic oligonucleotide
  Target: ATXN1; (+) strand; PAM type: YTN; PAM sequence: TTT
ggtcaacccaagtcgaagag

SEQ ID NO: 289369 - DNA, 20 bp, Artificial Sequence
  Description of Artificial Sequence: Synthetic oligonucleotide
  Target: ATXN1; (+) strand; PAM type: YTN; PAM sequence: TTG
gtcaacccaagtcgaagagg

SEQ ID NO: 289370 - DNA, 20 bp, Artificial Sequence
  Description of Artificial Sequence: Synthetic oligonucleotide
  Target: ATXN1; (+) strand; PAM type: YTN; PAM sequence: TTA
tataaagaagctagatgatc

SEQ ID NO: 289371 - DNA, 20 bp, Artificial Sequence
  Description of Artificial Sequence: Synthetic oligonucleotide
  Target: ATXN1; (+) strand; PAM type: YTN; PAM sequence: CTA
gatgatctaagaaaacagag

SEQ ID NO: 289372 - DNA, 20 bp, Artificial Sequence
  Description of Artificial Sequence: Synthetic oligonucleotide
  Target: ATXN1; (+) strand; PAM type: YTN; PAM sequence: CTA
agaaaacagaggttgttgat

SEQ ID NO: 289373 - DNA, 20 bp, Artificial Sequence
  Description of Artificial Sequence: Synthetic oligonucleotide
  Target: ATXN1; (+) strand; PAM type: YTN; PAM sequence: TTG
ttgatcatcagttggcccat

SEQ ID NO: 289374 - DNA, 20 bp, Artificial Sequence
  Description of Artificial Sequence: Synthetic oligonucleotide
  Target: ATXN1; (+) strand; PAM type: YTN; PAM sequence: TTG
atcatcagttggcccatata

SEQ ID NO: 289375 - DNA, 20 bp, Artificial Sequence
  Description of Artificial Sequence: Synthetic oligonucleotide
  Target: ATXN1; (+) strand; PAM type: YTN; PAM sequence: TTG
gcccatatatgcccccccaa

SEQ ID NO: 289376 - DNA, 20 bp, Artificial Sequence
  Description of Artificial Sequence: Synthetic oligonucleotide
  Target: ATXN1; (+) strand; PAM type: YTN; PAM sequence: CTT
tagccctccatggcacaggt

SEQ ID NO: 289377 - DNA, 20 bp, Artificial Sequence
  Description of Artificial Sequence: Synthetic oligonucleotide
  Target: ATXN1; (+) strand; PAM type: YTN; PAM sequence: TTT
agccctccatggcacaggtg

SEQ ID NO: 289378 - DNA, 20 bp, Artificial Sequence
  Description of Artificial Sequence: Synthetic oligonucleotide
  Target: ATXN1; (+) strand; PAM type: YTN; PAM sequence: TTA
gccctccatggcacaggtgt

SEQ ID NO: 289379 - DNA, 20 bp, Artificial Sequence
  Description of Artificial Sequence: Synthetic oligonucleotide
  Target: ATXN1; (+) strand; PAM type: YTN; PAM sequence: CTC
catggcacaggtgtatttac

SEQ ID NO: 289380 - DNA, 20 bp, Artificial Sequence
  Description of Artificial Sequence: Synthetic oligonucleotide
  Target: ATXN1; (+) strand; PAM type: YTN; PAM sequence: TTT
acagctgggtgtgcaaagtg

SEQ ID NO: 289381 - DNA, 20 bp, Artificial Sequence
  Description of Artificial Sequence: Synthetic oligonucleotide
  Target: ATXN1; (+) strand; PAM type: YTN; PAM sequence: TTA
cagctgggtgtgcaaagtgc

SEQ ID NO: 289382 - DNA, 20 bp, Artificial Sequence
  Description of Artificial Sequence: Synthetic oligonucleotide
  Target: ATXN1; (+) strand; PAM type: YTN; PAM sequence: CTG
ggtgtgcaaagtgccaagga

SEQ ID NO: 289383 - DNA, 20 bp, Artificial Sequence
  Description of Artificial Sequence: Synthetic oligonucleotide
  Target: ATXN1; (+) strand; PAM type: YTN; PAM sequence: CTG
ggtttcagaaggagccccag

SEQ ID NO: 289384 - DNA, 20 bp, Artificial Sequence
  Description of Artificial Sequence: Synthetic oligonucleotide
  Target: ATXN1; (+) strand; PAM type: YTN; PAM sequence: TTT
cagaaggagccccagaaagg

SEQ ID NO: 289385 - DNA, 20 bp, Artificial Sequence
  Description of Artificial Sequence: Synthetic oligonucleotide
  Target: ATXN1; (+) strand; PAM type: YTN; PAM sequence: TTC
agaaggagccccagaaaggg

SEQ ID NO: 289386 - DNA, 20 bp, Artificial Sequence
  Description of Artificial Sequence: Synthetic oligonucleotide
  Target: ATXN1; (+) strand; PAM type: YTN; PAM sequence: CTG
cataagttctaggaccccca

SEQ ID NO: 289387 - DNA, 20 bp, Artificial Sequence
  Description of Artificial Sequence: Synthetic oligonucleotide
  Target: ATXN1; (+) strand; PAM type: YTN; PAM sequence: TTC
taggacccccacctactccg

SEQ ID NO: 289388 - DNA, 20 bp, Artificial Sequence
  Description of Artificial Sequence: Synthetic oligonucleotide
  Target: ATXN1; (+) strand; PAM type: YTN; PAM sequence: CTA
ggacccccacctactccgct

SEQ ID NO: 289389 - DNA, 20 bp, Artificial Sequence
  Description of Artificial Sequence: Synthetic oligonucleotide
  Target: ATXN1; (+) strand; PAM type: YTN; PAM sequence: CTA
ctccgctggccagcaccaca

SEQ ID NO: 289390 - DNA, 20 bp, Artificial Sequence
  Description of Artificial Sequence: Synthetic oligonucleotide
  Target: ATXN1; (+) strand; PAM type: YTN; PAM sequence: CTC
cgctggccagcaccacatgt

SEQ ID NO: 289391 - DNA, 20 bp, Artificial Sequence
  Description of Artificial Sequence: Synthetic oligonucleotide
  Target: ATXN1; (+) strand; PAM type: YTN; PAM sequence: CTG
gccagcaccacatgtggtcc

SEQ ID NO: 289392 - DNA, 20 bp, Artificial Sequence
  Description of Artificial Sequence: Synthetic oligonucleotide
  Target: ATXN1; (+) strand; PAM type: YTN; PAM sequence: CTA
cactctcctctataagcaaa

SEQ ID NO: 289393 - DNA, 20 bp, Artificial Sequence
  Description of Artificial Sequence: Synthetic oligonucleotide
  Target: ATXN1; (+) strand; PAM type: YTN; PAM sequence: CTC
tcctctataagcaaaggaga

SEQ ID NO: 289394 - DNA, 20 bp, Artificial Sequence
  Description of Artificial Sequence: Synthetic oligonucleotide
  Target: ATXN1; (+) strand; PAM type: YTN; PAM sequence: CTC
ctctataagcaaaggagaac

SEQ ID NO: 289395 - DNA, 20 bp, Artificial Sequence
  Description of Artificial Sequence: Synthetic oligonucleotide
  Target: ATXN1; (+) strand; PAM type: YTN; PAM sequence: CTC
tataagcaaaggagaactct

SEQ ID NO: 289396 - DNA, 20 bp, Artificial Sequence
  Description of Artificial Sequence: Synthetic oligonucleotide
  Target: ATXN1; (+) strand; PAM type: YTN; PAM sequence: CTA
taagcaaaggagaactctct

SEQ ID NO: 289397 - DNA, 20 bp, Artificial Sequence
  Description of Artificial Sequence: Synthetic oligonucleotide
  Target: ATXN1; (+) strand; PAM type: YTN; PAM sequence: CTC
tctggggccctttctagatc

SEQ ID NO: 289398 - DNA, 20 bp, Artificial Sequence
  Description of Artificial Sequence: Synthetic oligonucleotide
  Target: ATXN1; (+) strand; PAM type: YTN; PAM sequence: CTC
tggggccctttctagatctg

SEQ ID NO: 289399 - DNA, 20 bp, Artificial Sequence
  Description of Artificial Sequence: Synthetic oligonucleotide
  Target: ATXN1; (+) strand; PAM type: YTN; PAM sequence: CTG
gggccctttctagatctgag

SEQ ID NO: 289400 - DNA, 20 bp, Artificial Sequence
  Description of Artificial Sequence: Synthetic oligonucleotide
  Target: ATXN1; (+) strand; PAM type: YTN; PAM sequence: CTT
tctagatctgaggtcctact

SEQ ID NO: 289401 - DNA, 20 bp, Artificial Sequence
  Description of Artificial Sequence: Synthetic oligonucleotide
  Target: ATXN1; (+) strand; PAM type: YTN; PAM sequence: TTT
ctagatctgaggtcctacta

SEQ ID NO: 289402 - DNA, 20 bp, Artificial Sequence
  Description of Artificial Sequence: Synthetic oligonucleotide
  Target: ATXN1; (+) strand; PAM type: YTN; PAM sequence: TTC
tagatctgaggtcctactaa

SEQ ID NO: 289403 - DNA, 20 bp, Artificial Sequence
  Description of Artificial Sequence: Synthetic oligonucleotide
  Target: ATXN1; (+) strand; PAM type: YTN; PAM sequence: CTA
gatctgaggtcctactaaaa

SEQ ID NO: 289404 - DNA, 20 bp, Artificial Sequence
  Description of Artificial Sequence: Synthetic oligonucleotide
  Target: ATXN1; (+) strand; PAM type: YTN; PAM sequence: CTG
aggtcctactaaaaagggtg

SEQ ID NO: 289405 - DNA, 20 bp, Artificial Sequence
  Description of Artificial Sequence: Synthetic oligonucleotide
  Target: ATXN1; (+) strand; PAM type: YTN; PAM sequence: CTA
ctaaaaagggtgacaacctc

SEQ ID NO: 289406 - DNA, 20 bp, Artificial Sequence
  Description of Artificial Sequence: Synthetic oligonucleotide
  Target: ATXN1; (+) strand; PAM type: YTN; PAM sequence: CTA
aaaagggtgacaacctcagc

SEQ ID NO: 289407 - DNA, 20 bp, Artificial Sequence
  Description of Artificial Sequence: Synthetic oligonucleotide
  Target: ATXN1; (+) strand; PAM type: YTN; PAM sequence: CTC
agctctgaacattagttgtt

SEQ ID NO: 289408 - DNA, 20 bp, Artificial Sequence
  Description of Artificial Sequence: Synthetic oligonucleotide
  Target: ATXN1; (+) strand; PAM type: YTN; PAM sequence: CTC
tgaacattagttgttttatt

SEQ ID NO: 289409 - DNA, 20 bp, Artificial Sequence
  Description of Artificial Sequence: Synthetic oligonucleotide
  Target: ATXN1; (+) strand; PAM type: YTN; PAM sequence: CTG
aacattagttgttttatttc

SEQ ID NO: 289410 - DNA, 20 bp, Artificial Sequence
  Description of Artificial Sequence: Synthetic oligonucleotide
  Target: ATXN1; (+) strand; PAM type: YTN; PAM sequence: TTA
gttgttttatttcaactcca

SEQ ID NO: 289411 - DNA, 20 bp, Artificial Sequence
  Description of Artificial Sequence: Synthetic oligonucleotide
  Target: ATXN1; (+) strand; PAM type: YTN; PAM sequence: TTG
ttttatttcaactccaaagt

SEQ ID NO: 289412 - DNA, 20 bp, Artificial Sequence
  Description of Artificial Sequence: Synthetic oligonucleotide
  Target: ATXN1; (+) strand; PAM type: YTN; PAM sequence: TTT
tatttcaactccaaagtggg

SEQ ID NO: 289413 - DNA, 20 bp, Artificial Sequence
  Description of Artificial Sequence: Synthetic oligonucleotide
  Target: ATXN1; (+) strand; PAM type: YTN; PAM sequence: TTT
atttcaactccaaagtgggc

SEQ ID NO: 289414 - DNA, 20 bp, Artificial Sequence
  Description of Artificial Sequence: Synthetic oligonucleotide
  Target: ATXN1; (+) strand; PAM type: YTN; PAM sequence: TTA
tttcaactccaaagtgggct

SEQ ID NO: 289415 - DNA, 20 bp, Artificial Sequence
  Description of Artificial Sequence: Synthetic oligonucleotide
  Target: ATXN1; (+) strand; PAM type: YTN; PAM sequence: TTT
caactccaaagtgggcttct

SEQ ID NO: 289416 - DNA, 20 bp, Artificial Sequence
  Description of Artificial Sequence: Synthetic oligonucleotide
  Target: ATXN1; (+) strand; PAM type: YTN; PAM sequence: TTC
aactccaaagtgggcttcta

SEQ ID NO: 289417 - DNA, 20 bp, Artificial Sequence
  Description of Artificial Sequence: Synthetic oligonucleotide
  Target: ATXN1; (+) strand; PAM type: YTN; PAM sequence: CTC
caaagtgggcttctacatcc

SEQ ID NO: 289418 - DNA, 20 bp, Artificial Sequence
  Description of Artificial Sequence: Synthetic oligonucleotide
  Target: ATXN1; (+) strand; PAM type: YTN; PAM sequence: CTT
ctacatcccgaaacaaatga

SEQ ID NO: 289419 - DNA, 20 bp, Artificial Sequence
  Description of Artificial Sequence: Synthetic oligonucleotide
  Target: ATXN1; (+) strand; PAM type: YTN; PAM sequence: TTC
tacatcccgaaacaaatgaa

SEQ ID NO: 289420 - DNA, 20 bp, Artificial Sequence
  Description of Artificial Sequence: Synthetic oligonucleotide
  Target: ATXN1; (+) strand; PAM type: YTN; PAM sequence: CTA
catcccgaaacaaatgaaag

SEQ ID NO: 289421 - DNA, 20 bp, Artificial Sequence
  Description of Artificial Sequence: Synthetic oligonucleotide
  Target: ATXN1; (+) strand; PAM type: YTN; PAM sequence: TTA
aaagataaataaagcattcc

SEQ ID NO: 289422 - DNA, 20 bp, Artificial Sequence
  Description of Artificial Sequence: Synthetic oligonucleotide
  Target: ATXN1; (+) strand; PAM type: YTN; PAM sequence: TTC
ctggcatccatgaaagcatt

SEQ ID NO: 289423 - DNA, 20 bp, Artificial Sequence
  Description of Artificial Sequence: Synthetic oligonucleotide
  Target: ATXN1; (+) strand; PAM type: YTN; PAM sequence: CTG
gcatccatgaaagcatttgc

SEQ ID NO: 289424 - DNA, 20 bp, Artificial Sequence
  Description of Artificial Sequence: Synthetic oligonucleotide
  Target: ATXN1; (+) strand; PAM type: YTN; PAM sequence: TTT
gctttccctgttcatgttat

SEQ ID NO: 289425 - DNA, 20 bp, Artificial Sequence
  Description of Artificial Sequence: Synthetic oligonucleotide
  Target: ATXN1; (+) strand; PAM type: YTN; PAM sequence: TTG
ctttccctgttcatgttatt

SEQ ID NO: 289426 - DNA, 20 bp, Artificial Sequence
  Description of Artificial Sequence: Synthetic oligonucleotide
  Target: ATXN1; (+) strand; PAM type: YTN; PAM sequence: CTT
tccctgttcatgttatttca

SEQ ID NO: 289427 - DNA, 20 bp, Artificial Sequence
  Description of Artificial Sequence: Synthetic oligonucleotide
  Target: ATXN1; (+) strand; PAM type: YTN; PAM sequence: TTT
ccctgttcatgttatttcag

SEQ ID NO: 289428 - DNA, 20 bp, Artificial Sequence
  Description of Artificial Sequence: Synthetic oligonucleotide
  Target: ATXN1; (+) strand; PAM type: YTN; PAM sequence: TTC
cctgttcatgttatttcagt

SEQ ID NO: 289429 - DNA, 20 bp, Artificial Sequence
  Description of Artificial Sequence: Synthetic oligonucleotide
  Target: ATXN1; (+) strand; PAM type: YTN; PAM sequence: CTG
ttcatgttatttcagtaaat

SEQ ID NO: 289430 - DNA, 20 bp, Artificial Sequence
  Description of Artificial Sequence: Synthetic oligonucleotide
  Target: ATXN1; (+) strand; PAM type: YTN; PAM sequence: TTC
atgttatttcagtaaatcta

SEQ ID NO: 289431 - DNA, 20 bp, Artificial Sequence
  Description of Artificial Sequence: Synthetic oligonucleotide
  Target: ATXN1; (+) strand; PAM type: YTN; PAM sequence: TTA
tttcagtaaatctagcagtg

SEQ ID NO: 289432 - DNA, 20 bp, Artificial Sequence
  Description of Artificial Sequence: Synthetic oligonucleotide
  Target: ATXN1; (+) strand; PAM type: YTN; PAM sequence: TTT
cagtaaatctagcagtgtag

SEQ ID NO: 289433 - DNA, 20 bp, Artificial Sequence
  Description of Artificial Sequence: Synthetic oligonucleotide
  Target: ATXN1; (+) strand; PAM type: YTN; PAM sequence: TTC
agtaaatctagcagtgtaga

SEQ ID NO: 289434 - DNA, 20 bp, Artificial Sequence
  Description of Artificial Sequence: Synthetic oligonucleotide
  Target: ATXN1; (+) strand; PAM type: YTN; PAM sequence: CTA
gcagtgtagaaagagacaaa

SEQ ID NO: 289435 - DNA, 20 bp, Artificial Sequence
  Description of Artificial Sequence: Synthetic oligonucleotide
  Target: ATXN1; (+) strand; PAM type: YTN; PAM sequence: TTA
caaggcagcacctgttcgga

SEQ ID NO: 289436 - DNA, 20 bp, Artificial Sequence
  Description of Artificial Sequence: Synthetic oligonucleotide
  Target: ATXN1; (+) strand; PAM type: YTN; PAM sequence: CTG
ttcggagcccaaggtcatta

SEQ ID NO: 289437 - DNA, 20 bp, Artificial Sequence
  Description of Artificial Sequence: Synthetic oligonucleotide
  Target: ATXN1; (+) strand; PAM type: YTN; PAM sequence: TTC
ggagcccaaggtcattagat

SEQ ID NO: 289438 - DNA, 20 bp, Artificial Sequence
  Description of Artificial Sequence: Synthetic oligonucleotide
  Target: ATXN1; (+) strand; PAM type: YTN; PAM sequence: TTA
gatgccattagcaatggcat

SEQ ID NO: 289439 - DNA, 20 bp, Artificial Sequence
  Description of Artificial Sequence: Synthetic oligonucleotide
  Target: ATXN1; (+) strand; PAM type: YTN; PAM sequence: TTA
gcaatggcataaagacacat

SEQ ID NO: 289440 - DNA, 20 bp, Artificial Sequence
  Description of Artificial Sequence: Synthetic oligonucleotide
  Target: ATXN1; (+) strand; PAM type: YTN; PAM sequence: TTT
aggagataacgcagctcagt

SEQ ID NO: 289441 - DNA, 20 bp, Artificial Sequence
  Description of Artificial Sequence: Synthetic oligonucleotide
  Target: ATXN1; (+) strand; PAM type: YTN; PAM sequence: TTA
ggagataacgcagctcagtg

SEQ ID NO: 289442 - DNA, 20 bp, Artificial Sequence
  Description of Artificial Sequence: Synthetic oligonucleotide
  Target: ATXN1; (+) strand; PAM type: YTN; PAM sequence: CTC
agtgggttattgcatccttc

SEQ ID NO: 289443 - DNA, 20 bp, Artificial Sequence
  Description of Artificial Sequence: Synthetic oligonucleotide
  Target: ATXN1; (+) strand; PAM type: YTN; PAM sequence: TTA
ttgcatccttccttcttgac

SEQ ID NO: 289444 - DNA, 20 bp, Artificial Sequence
  Description of Artificial Sequence: Synthetic oligonucleotide
  Target: ATXN1; (+) strand; PAM type: YTN; PAM sequence: TTG
catccttccttcttgacacc

SEQ ID NO: 289445 - DNA, 20 bp, Artificial Sequence
  Description of Artificial Sequence: Synthetic oligonucleotide
  Target: ATXN1; (+) strand; PAM type: YTN; PAM sequence: CTT
ccttcttgacaccttgtcgg

SEQ ID NO: 289446 - DNA, 20 bp, Artificial Sequence
  Description of Artificial Sequence: Synthetic oligonucleotide
  Target: ATXN1; (+) strand; PAM type: YTN; PAM sequence: TTC
cttcttgacaccttgtcggc

SEQ ID NO: 289447 - DNA, 20 bp, Artificial Sequence
  Description of Artificial Sequence: Synthetic oligonucleotide
  Target: ATXN1; (+) strand; PAM type: YTN; PAM sequence: CTT
cttgacaccttgtcggctgc

SEQ ID NO: 289448 - DNA, 20 bp, Artificial Sequence
  Description of Artificial Sequence: Synthetic oligonucleotide
  Target: ATXN1; (+) strand; PAM type: YTN; PAM sequence: TTC
ttgacaccttgtcggctgct

SEQ ID NO: 289449 - DNA, 20 bp, Artificial Sequence
  Description of Artificial Sequence: Synthetic oligonucleotide
  Target: ATXN1; (+) strand; PAM type: YTN; PAM sequence: CTT
gacaccttgtcggctgctct

SEQ ID NO: 289450 - DNA, 20 bp, Artificial Sequence
  Description of Artificial Sequence: Synthetic oligonucleotide
  Target: ATXN1; (+) strand; PAM type: YTN; PAM sequence: TTG
acaccttgtcggctgctctc

SEQ ID NO: 289451 - DNA, 20 bp, Artificial Sequence
  Description of Artificial Sequence: Synthetic oligonucleotide
  Target: ATXN1; (+) strand; PAM type: YTN; PAM sequence: CTT
gtcggctgctctcacagacc

SEQ ID NO: 289452 - DNA, 20 bp, Artificial Sequence
  Description of Artificial Sequence: Synthetic oligonucleotide
  Target: ATXN1; (+) strand; PAM type: YTN; PAM sequence: TTG
tcggctgctctcacagacct

SEQ ID NO: 289453 - DNA, 20 bp, Artificial Sequence
  Description of Artificial Sequence: Synthetic oligonucleotide
  Target: ATXN1; (+) strand; PAM type: YTN; PAM sequence: CTG
ctctcacagacctgcttcag

SEQ ID NO: 289454 - DNA, 20 bp, Artificial Sequence
  Description of Artificial Sequence: Synthetic oligonucleotide
  Target: ATXN1; (+) strand; PAM type: YTN; PAM sequence: CTC
tcacagacctgcttcagtct

SEQ ID NO: 289455 - DNA, 20 bp, Artificial Sequence
  Description of Artificial Sequence: Synthetic oligonucleotide
  Target: ATXN1; (+) strand; PAM type: YTN; PAM sequence: CTC
acagacctgcttcagtctca

SEQ ID NO: 289456 - DNA, 20 bp, Artificial Sequence
  Description of Artificial Sequence: Synthetic oligonucleotide
  Target: ATXN1; (+) strand; PAM type: YTN; PAM sequence: CTG
cttcagtctcagagcccaga

SEQ ID NO: 289457 - DNA, 20 bp, Artificial Sequence
  Description of Artificial Sequence: Synthetic oligonucleotide
  Target: ATXN1; (+) strand; PAM type: YTN; PAM sequence: CTT
cagtctcagagcccagacaa

SEQ ID NO: 289458 - DNA, 20 bp, Artificial Sequence
  Description of Artificial Sequence: Synthetic oligonucleotide
  Target: ATXN1; (+) strand; PAM type: YTN; PAM sequence: TTC
agtctcagagcccagacaat

SEQ ID NO: 289459 - DNA, 20 bp, Artificial Sequence
  Description of Artificial Sequence: Synthetic oligonucleotide
  Target: ATXN1; (+) strand; PAM type: YTN; PAM sequence: CTC
agagcccagacaatagcact

SEQ ID NO: 289460 - DNA, 20 bp, Artificial Sequence
  Description of Artificial Sequence: Synthetic oligonucleotide
  Target: ATXN1; (+) strand; PAM type: YTN; PAM sequence: CTA
aacacggcaagggcgttagc

SEQ ID NO: 289461 - DNA, 20 bp, Artificial Sequence
  Description of Artificial Sequence: Synthetic oligonucleotide
  Target: ATXN1; (+) strand; PAM type: YTN; PAM sequence: TTA
gctgcaagaggctgaaattg

SEQ ID NO: 289462 - DNA, 20 bp, Artificial Sequence
  Description of Artificial Sequence: Synthetic oligonucleotide
  Target: ATXN1; (+) strand; PAM type: YTN; PAM sequence: CTG
caagaggctgaaattggctg

SEQ ID NO: 289463 - DNA, 20 bp, Artificial Sequence
  Description of Artificial Sequence: Synthetic oligonucleotide
  Target: ATXN1; (+) strand; PAM type: YTN; PAM sequence: CTG
aaattggctgaacctgaaat

SEQ ID NO: 289464 - DNA, 20 bp, Artificial Sequence
  Description of Artificial Sequence: Synthetic oligonucleotide
  Target: ATXN1; (+) strand; PAM type: YTN; PAM sequence: TTG
gctgaacctgaaatatgagt

SEQ ID NO: 289465 - DNA, 20 bp, Artificial Sequence
  Description of Artificial Sequence: Synthetic oligonucleotide
  Target: ATXN1; (+) strand; PAM type: YTN; PAM sequence: CTG
aacctgaaatatgagtaaag

SEQ ID NO: 289466 - DNA, 20 bp, Artificial Sequence
  Description of Artificial Sequence: Synthetic oligonucleotide
  Target: ATXN1; (+) strand; PAM type: YTN; PAM sequence: CTG
aaatatgagtaaagtctttg

SEQ ID NO: 289467 - DNA, 20 bp, Artificial Sequence
  Description of Artificial Sequence: Synthetic oligonucleotide
  Target: ATXN1; (+) strand; PAM type: YTN; PAM sequence: CTT
tgtatatgcaaaacagaaat

SEQ ID NO: 289468 - DNA, 20 bp, Artificial Sequence
  Description of Artificial Sequence: Synthetic oligonucleotide
  Target: ATXN1; (+) strand; PAM type: YTN; PAM sequence: TTT
gtatatgcaaaacagaaata

SEQ ID NO: 289469 - DNA, 20 bp, Artificial Sequence
  Description of Artificial Sequence: Synthetic oligonucleotide
  Target: ATXN1; (+) strand; PAM type: YTN; PAM sequence: TTG
tatatgcaaaacagaaatag

SEQ ID NO: 289470 - DNA, 20 bp, Artificial Sequence
  Description of Artificial Sequence: Synthetic oligonucleotide
  Target: ATXN1; (+) strand; PAM type: YTN; PAM sequence: CTA
aaaggagacacaactattta

SEQ ID NO: 289471 - DNA, 20 bp, Artificial Sequence
  Description of Artificial Sequence: Synthetic oligonucleotide
  Target: ATXN1; (+) strand; PAM type: YTN; PAM sequence: CTA
tttatcaaaaaggtgcatac

SEQ ID NO: 289472 - DNA, 20 bp, Artificial Sequence
  Description of Artificial Sequence: Synthetic oligonucleotide
  Target: ATXN1; (+) strand; PAM type: YTN; PAM sequence: TTT
atcaaaaaggtgcatacaga

SEQ ID NO: 289473 - DNA, 20 bp, Artificial Sequence
  Description of Artificial Sequence: Synthetic oligonucleotide
  Target: ATXN1; (+) strand; PAM type: YTN; PAM sequence: TTA
tcaaaaaggtgcatacagag

SEQ ID NO: 289474 - DNA, 20 bp, Artificial Sequence
  Description of Artificial Sequence: Synthetic oligonucleotide
  Target: ATXN1; (+) strand; PAM type: YTN; PAM sequence: TTA
aacaaggccaggcccggcgg

SEQ ID NO: 289475 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatcccaacact

SEQ ID NO: 289476 - DNA, 20 bp, Artificial Sequence
  Description of Artificial Sequence: Synthetic oligonucleotide
  Target: ATXN1; (+) strand; PAM type: YTN; PAM sequence: CTG
taatcccaacactttgggag

SEQ ID NO: 289477 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggcaggtgg

SEQ ID NO: 289478 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggcaggtgga

SEQ ID NO: 289479 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggcaggtggat

SEQ ID NO: 289480 - DNA, 20 bp, Artificial Sequence
  Description of Artificial Sequence: Synthetic oligonucleotide
  Target: ATXN1; (+) strand; PAM type: YTN; PAM sequence: CTG
aggtcaggagttcaagacca

SEQ ID NO: 289481 - DNA, 20 bp, Artificial Sequence
  Description of Artificial Sequence: Synthetic oligonucleotide
  Target: ATXN1; (+) strand; PAM type: YTN; PAM sequence: TTC
aagaccaccctggccaacat

SEQ ID NO: 289482 - DNA, 20 bp, Artificial Sequence
  Description of Artificial Sequence: Synthetic oligonucleotide
  Target: ATXN1; (+) strand; PAM type: YTN; PAM sequence: CTG
gccaacatggagaatgccgt

SEQ ID NO: 289483 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 289484 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 289485 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagctgg

SEQ ID NO: 289486 - DNA, 20 bp, Artificial Sequence
  Description of Artificial Sequence: Synthetic oligonucleotide
  Target: ATXN1; (+) strand; PAM type: YTN; PAM sequence: TTA
gctgggtgtggtggtgcaca

SEQ ID NO: 289487 - DNA, 20 bp, Artificial Sequence
  Description of Artificial Sequence: Synthetic oligonucleotide
  Target: ATXN1; (+) strand; PAM type: YTN; PAM sequence: CTG
ggtgtggtggtgcacacctg

SEQ ID NO: 289488 - DNA, 20 bp, Artificial Sequence
  Description of Artificial Sequence: Synthetic oligonucleotide
  Target: ATXN1; (+) strand; PAM type: YTN; PAM sequence: CTG
taatcccagctactagggag

SEQ ID NO: 289489 - DNA, 20 bp, Artificial Sequence
  Description of Artificial Sequence: Synthetic oligonucleotide
  Target: ATXN1; (+) strand; PAM type: YTN; PAM sequence: CTA
ctagggaggctgaggcttga

SEQ ID NO: 289490 - DNA, 20 bp, Artificial Sequence
  Description of Artificial Sequence: Synthetic oligonucleotide
  Target: ATXN1; (+) strand; PAM type: YTN; PAM sequence: CTA
gggaggctgaggcttgaacc

SEQ ID NO: 289491 - DNA, 20 bp, Artificial Sequence
  Description of Artificial Sequence: Synthetic oligonucleotide
  Target: ATXN1; (+) strand; PAM type: YTN; PAM sequence: CTG
aggcttgaacccgggaggca

SEQ ID NO: 289492 - DNA, 20 bp, Artificial Sequence
  Description of Artificial Sequence: Synthetic oligonucleotide
  Target: ATXN1; (+) strand; PAM type: YTN; PAM sequence: CTT
gaacccgggaggcaatggag

SEQ ID NO: 289493 - DNA, 20 bp, Artificial Sequence
  Description of Artificial Sequence: Synthetic oligonucleotide
  Target: ATXN1; (+) strand; PAM type: YTN; PAM sequence: TTG
aacccgggaggcaatggagg

SEQ ID NO: 289494 - DNA, 20 bp, Artificial Sequence
  Description of Artificial Sequence: Synthetic oligonucleotide
  Target: ATXN1; (+) strand; PAM type: YTN; PAM sequence: TTG
cagtgagccaagatcgtgcc

SEQ ID NO: 289495 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggagacag

SEQ ID NO: 289496 - DNA, 20 bp, Artificial Sequence
  Description of Artificial Sequence: Synthetic oligonucleotide
  Target: ATXN1; (+) strand; PAM type: YTN; PAM sequence: CTC
cagcctgggagacagagcga

SEQ ID NO: 289497 - DNA, 20 bp, Artificial Sequence
  Description of Artificial Sequence: Synthetic oligonucleotide
  Target: ATXN1; (+) strand; PAM type: YTN; PAM sequence: CTG
ggagacagagcgagattcca

SEQ ID NO: 289498 - DNA, 20 bp, Artificial Sequence
  Description of Artificial Sequence: Synthetic oligonucleotide
  Target: ATXN1; (+) strand; PAM type: YTN; PAM sequence: TTC
catctcaaaaacaaaaaaca

SEQ ID NO: 289499 - DNA, 20 bp, Artificial Sequence
  Description of Artificial Sequence: Synthetic oligonucleotide
  Target: ATXN1; (+) strand; PAM type: YTN; PAM sequence: CTC
aaaaacaaaaaacaaagaat

SEQ ID NO: 289500 - DNA, 20 bp, Artificial Sequence
  Description of Artificial Sequence: Synthetic oligonucleotide
  Target: ATXN1; (+) strand; PAM type: YTN; PAM sequence: TTA
aacaaatgatgagttgatag

SEQ ID NO: 289501 - DNA, 20 bp, Artificial Sequence
  Description of Artificial Sequence: Synthetic oligonucleotide
  Target: ATXN1; (+) strand; PAM type: YTN; PAM sequence: TTG
atagcccgaaaagaagaaaa

SEQ ID NO: 289502 - DNA, 20 bp, Artificial Sequence
  Description of Artificial Sequence: Synthetic oligonucleotide
  Target: ATXN1; (+) strand; PAM type: YTN; PAM sequence: CTC
tatgcaaaaataaataaata

SEQ ID NO: 289503 - DNA, 20 bp, Artificial Sequence
  Description of Artificial Sequence: Synthetic oligonucleotide
  Target: ATXN1; (+) strand; PAM type: YTN; PAM sequence: CTA
tgcaaaaataaataaataaa

SEQ ID NO: 289504 - DNA, 20 bp, Artificial Sequence
  Description of Artificial Sequence: Synthetic oligonucleotide
  Target: ATXN1; (+) strand; PAM type: YTN; PAM sequence: CTG
agaactagcagcagatgata

SEQ ID NO: 289505 - DNA, 20 bp, Artificial Sequence
  Description of Artificial Sequence: Synthetic oligonucleotide
  Target: ATXN1; (+) strand; PAM type: YTN; PAM sequence: CTA
gcagcagatgataggcagaa

SEQ ID NO: 289506 - DNA, 20 bp, Artificial Sequence
  Description of Artificial Sequence: Synthetic oligonucleotide
  Target: ATXN1; (+) strand; PAM type: YTN; PAM sequence: TTA
agacaacaggctttggtgtc

SEQ ID NO: 289507 - DNA, 20 bp, Artificial Sequence
  Description of Artificial Sequence: Synthetic oligonucleotide
  Target: ATXN1; (+) strand; PAM type: YTN; PAM sequence: CTT
tggtgtcaggcacactggct

SEQ ID NO: 289508 - DNA, 20 bp, Artificial Sequence
  Description of Artificial Sequence: Synthetic oligonucleotide
  Target: ATXN1; (+) strand; PAM type: YTN; PAM sequence: TTT
ggtgtcaggcacactggctt

SEQ ID NO: 289509 - DNA, 20 bp, Artificial Sequence
  Description of Artificial Sequence: Synthetic oligonucleotide
  Target: ATXN1; (+) strand; PAM type: YTN; PAM sequence: TTG
gtgtcaggcacactggcttt

SEQ ID NO: 289510 - DNA, 20 bp, Artificial Sequence
  Description of Artificial Sequence: Synthetic oligonucleotide
  Target: ATXN1; (+) strand; PAM type: YTN; PAM sequence: CTG
gctttgaattctagcctcca

SEQ ID NO: 289511 - DNA, 20 bp, Artificial Sequence
  Description of Artificial Sequence: Synthetic oligonucleotide
  Target: ATXN1; (+) strand; PAM type: YTN; PAM sequence: CTT
tgaattctagcctccaccac

SEQ ID NO: 289512 - DNA, 20 bp, Artificial Sequence
  Description of Artificial Sequence: Synthetic oligonucleotide
  Target: ATXN1; (+) strand; PAM type: YTN; PAM sequence: TTT
gaattctagcctccaccacc

SEQ ID NO: 289513 - DNA, 20 bp, Artificial Sequence
  Description of Artificial Sequence: Synthetic oligonucleotide
  Target: ATXN1; (+) strand; PAM type: YTN; PAM sequence: TTG
aattctagcctccaccaccc

SEQ ID NO: 289514 - DNA, 20 bp, Artificial Sequence
  Description of Artificial Sequence: Synthetic oligonucleotide
  Target: ATXN1; (+) strand; PAM type: YTN; PAM sequence: TTC
tagcctccaccacccacaag

SEQ ID NO: 289515 - DNA, 20 bp, Artificial Sequence
  Description of Artificial Sequence: Synthetic oligonucleotide
  Target: ATXN1; (+) strand; PAM type: YTN; PAM sequence: CTA
gcctccaccacccacaagct

SEQ ID NO: 289516 - DNA, 20 bp, Artificial Sequence
  Description of Artificial Sequence: Synthetic oligonucleotide
  Target: ATXN1; (+) strand; PAM type: YTN; PAM sequence: CTC
caccacccacaagctgggta

SEQ ID NO: 289517 - DNA, 20 bp, Artificial Sequence
  Description of Artificial Sequence: Synthetic oligonucleotide
  Target: ATXN1; (+) strand; PAM type: YTN; PAM sequence: CTG
ggtaaatgtgggcgagtagt

SEQ ID NO: 289518 - DNA, 20 bp, Artificial Sequence
  Description of Artificial Sequence: Synthetic oligonucleotide
  Target: ATXN1; (+) strand; PAM type: YTN; PAM sequence: TTT
aatctatctgagtgccacca

SEQ ID NO: 289519 - DNA, 20 bp, Artificial Sequence
  Description of Artificial Sequence: Synthetic oligonucleotide
  Target: ATXN1; (+) strand; PAM type: YTN; PAM sequence: TTA
atctatctgagtgccaccat

SEQ ID NO: 289520 - DNA, 20 bp, Artificial Sequence
  Description of Artificial Sequence: Synthetic oligonucleotide
  Target: ATXN1; (+) strand; PAM type: YTN; PAM sequence: CTA
tctgagtgccaccattttta

SEQ ID NO: 289521 - DNA, 20 bp, Artificial Sequence
  Description of Artificial Sequence: Synthetic oligonucleotide
  Target: ATXN1; (+) strand; PAM type: YTN; PAM sequence: CTG
agtgccaccatttttaaaaa

SEQ ID NO: 289522 - DNA, 20 bp, Artificial Sequence
  Description of Artificial Sequence: Synthetic oligonucleotide
  Target: ATXN1; (+) strand; PAM type: YTN; PAM sequence: TTT
ttaaaaatctgtagaatagt

SEQ ID NO: 289523 - DNA, 20 bp, Artificial Sequence
  Description of Artificial Sequence: Synthetic oligonucleotide
  Target: ATXN1; (+) strand; PAM type: YTN; PAM sequence: TTT
taaaaatctgtagaatagta

SEQ ID NO: 289524 - DNA, 20 bp, Artificial Sequence
  Description of Artificial Sequence: Synthetic oligonucleotide
  Target: ATXN1; (+) strand; PAM type: YTN; PAM sequence: TTT
aaaaatctgtagaatagtaa

SEQ ID NO: 289525 - DNA, 20 bp, Artificial Sequence
  Description of Artificial Sequence: Synthetic oligonucleotide
  Target: ATXN1; (+) strand; PAM type: YTN; PAM sequence: TTA
aaaatctgtagaatagtaac

SEQ ID NO: 289526 - DNA, 20 bp, Artificial Sequence
  Description of Artificial Sequence: Synthetic oligonucleotide
  Target: ATXN1; (+) strand; PAM type: YTN; PAM sequence: CTG
tagaatagtaacagcaataa

SEQ ID NO: 289527 - DNA, 20 bp, Artificial Sequence
  Description of Artificial Sequence: Synthetic oligonucleotide
  Target: ATXN1; (+) strand; PAM type: YTN; PAM sequence: CTA
cctcaaagagttgttgggct

SEQ ID NO: 289528 - DNA, 20 bp, Artificial Sequence
  Description of Artificial Sequence: Synthetic oligonucleotide
  Target: ATXN1; (+) strand; PAM type: YTN; PAM sequence: CTC
aaagagttgttgggctaatt

SEQ ID NO: 289529 - DNA, 20 bp, Artificial Sequence
  Description of Artificial Sequence: Synthetic oligonucleotide
  Target: ATXN1; (+) strand; PAM type: YTN; PAM sequence: TTG
ttgggctaattcaggcattc

SEQ ID NO: 289530 - DNA, 20 bp, Artificial Sequence
  Description of Artificial Sequence: Synthetic oligonucleotide
  Target: ATXN1; (+) strand; PAM type: YTN; PAM sequence: TTG
ggctaattcaggcattcatt

SEQ ID NO: 289531 - DNA, 20 bp, Artificial Sequence
  Description of Artificial Sequence: Synthetic oligonucleotide
  Target: ATXN1; (+) strand; PAM type: YTN; PAM sequence: CTA
attcaggcattcattcactt

SEQ ID NO: 289532 - DNA, 20 bp, Artificial Sequence
  Description of Artificial Sequence: Synthetic oligonucleotide
  Target: ATXN1; (+) strand; PAM type: YTN; PAM sequence: TTC
aggcattcattcacttgatg

SEQ ID NO: 289533 - DNA, 20 bp, Artificial Sequence
  Description of Artificial Sequence: Synthetic oligonucleotide
  Target: ATXN1; (+) strand; PAM type: YTN; PAM sequence: TTC
attcacttgatgatcactga

SEQ ID NO: 289534 - DNA, 20 bp, Artificial Sequence
  Description of Artificial Sequence: Synthetic oligonucleotide
  Target: ATXN1; (+) strand; PAM type: YTN; PAM sequence: TTC
acttgatgatcactgattat

SEQ ID NO: 289535 - DNA, 20 bp, Artificial Sequence
  Description of Artificial Sequence: Synthetic oligonucleotide
  Target: ATXN1; (+) strand; PAM type: YTN; PAM sequence: CTT
gatgatcactgattatgatc

SEQ ID NO: 289536 - DNA, 20 bp, Artificial Sequence
  Description of Artificial Sequence: Synthetic oligonucleotide
  Target: ATXN1; (+) strand; PAM type: YTN; PAM sequence: TTG
atgatcactgattatgatca

SEQ ID NO: 289537 - DNA, 20 bp, Artificial Sequence
  Description of Artificial Sequence: Synthetic oligonucleotide
  Target: ATXN1; (+) strand; PAM type: YTN; PAM sequence: CTG
attatgatcagtgagcttct

SEQ ID NO: 289538 - DNA, 20 bp, Artificial Sequence
  Description of Artificial Sequence: Synthetic oligonucleotide
  Target: ATXN1; (+) strand; PAM type: YTN; PAM sequence: TTA
tgatcagtgagcttctaggt

SEQ ID NO: 289539 - DNA, 20 bp, Artificial Sequence
  Description of Artificial Sequence: Synthetic oligonucleotide
  Target: ATXN1; (+) strand; PAM type: YTN; PAM sequence: CTT
ctaggtgtgacaggcccagt

SEQ ID NO: 289540 - DNA, 20 bp, Artificial Sequence
  Description of Artificial Sequence: Synthetic oligonucleotide
  Target: ATXN1; (+) strand; PAM type: YTN; PAM sequence: TTC
taggtgtgacaggcccagtt

SEQ ID NO: 289541 - DNA, 20 bp, Artificial Sequence
  Description of Artificial Sequence: Synthetic oligonucleotide
  Target: ATXN1; (+) strand; PAM type: YTN; PAM sequence: CTA
ggtgtgacaggcccagtttt

SEQ ID NO: 289542 - DNA, 20 bp, Artificial Sequence
  Description of Artificial Sequence: Synthetic oligonucleotide
  Target: ATXN1; (+) strand; PAM type: YTN; PAM sequence: TTT
taaacactggaaatacacaa

SEQ ID NO: 289543 - DNA, 20 bp, Artificial Sequence
  Description of Artificial Sequence: Synthetic oligonucleotide
  Target: ATXN1; (+) strand; PAM type: YTN; PAM sequence: TTT
aaacactggaaatacacaag

SEQ ID NO: 289544 - DNA, 20 bp, Artificial Sequence
  Description of Artificial Sequence: Synthetic oligonucleotide
  Target: ATXN1; (+) strand; PAM type: YTN; PAM sequence: TTA
aacactggaaatacacaagt

SEQ ID NO: 289545 - DNA, 20 bp, Artificial Sequence
  Description of Artificial Sequence: Synthetic oligonucleotide
  Target: ATXN1; (+) strand; PAM type: YTN; PAM sequence: CTG
gaaatacacaagtgacagat

SEQ ID NO: 289546 - DNA, 20 bp, Artificial Sequence
  Description of Artificial Sequence: Synthetic oligonucleotide
  Target: ATXN1; (+) strand; PAM type: YTN; PAM sequence: CTC
tgcttccacagacttaacat

SEQ ID NO: 289547 - DNA, 20 bp, Artificial Sequence
  Description of Artificial Sequence: Synthetic oligonucleotide
  Target: ATXN1; (+) strand; PAM type: YTN; PAM sequence: CTG
cttccacagacttaacatca

SEQ ID NO: 289548 - DNA, 20 bp, Artificial Sequence
  Description of Artificial Sequence: Synthetic oligonucleotide
  Target: ATXN1; (+) strand; PAM type: YTN; PAM sequence: CTT
ccacagacttaacatcactc

SEQ ID NO: 289549 - DNA, 20 bp, Artificial Sequence
  Description of Artificial Sequence: Synthetic oligonucleotide
  Target: ATXN1; (+) strand; PAM type: YTN; PAM sequence: TTC
cacagacttaacatcactct

SEQ ID NO: 289550 - DNA, 20 bp, Artificial Sequence
  Description of Artificial Sequence: Synthetic oligonucleotide
  Target: ATXN1; (+) strand; PAM type: YTN; PAM sequence: CTT
aacatcactctcaaatttta

SEQ ID NO: 289551 - DNA, 20 bp, Artificial Sequence
  Description of Artificial Sequence: Synthetic oligonucleotide
  Target: ATXN1; (+) strand; PAM type: YTN; PAM sequence: TTA
acatcactctcaaattttag

SEQ ID NO: 289552 - DNA, 20 bp, Artificial Sequence
  Description of Artificial Sequence: Synthetic oligonucleotide
  Target: ATXN1; (+) strand; PAM type: YTN; PAM sequence: CTC
tcaaattttagtgaaatgag

SEQ ID NO: 289553 - DNA, 20 bp, Artificial Sequence
  Description of Artificial Sequence: Synthetic oligonucleotide
  Target: ATXN1; (+) strand; PAM type: YTN; PAM sequence: CTC
aaattttagtgaaatgagaa

SEQ ID NO: 289554 - DNA, 20 bp, Artificial Sequence
  Description of Artificial Sequence: Synthetic oligonucleotide
  Target: ATXN1; (+) strand; PAM type: YTN; PAM sequence: TTT
tagtgaaatgagaaagacaa

SEQ ID NO: 289555 - DNA, 20 bp, Artificial Sequence
  Description of Artificial Sequence: Synthetic oligonucleotide
  Target: ATXN1; (+) strand; PAM type: YTN; PAM sequence: TTT
agtgaaatgagaaagacaaa

SEQ ID NO: 289556 - DNA, 20 bp, Artificial Sequence
  Description of Artificial Sequence: Synthetic oligonucleotide
  Target: ATXN1; (+) strand; PAM type: YTN; PAM sequence: TTA
gtgaaatgagaaagacaaac

SEQ ID NO: 289557 - DNA, 20 bp, Artificial Sequence
  Description of Artificial Sequence: Synthetic oligonucleotide
  Target: ATXN1; (+) strand; PAM type: YTN; PAM sequence: TTA
aaccggtgaaggggataaaa

SEQ ID NO: 289558 - DNA, 20 bp, Artificial Sequence
  Description of Artificial Sequence: Synthetic oligonucleotide
  Target: ATXN1; (+) strand; PAM type: YTN; PAM sequence: CTG
atgagggtgttattttagag

SEQ ID NO: 289559 - DNA, 20 bp, Artificial Sequence
  Description of Artificial Sequence: Synthetic oligonucleotide
  Target: ATXN1; (+) strand; PAM type: YTN; PAM sequence: TTA
ttttagagtaatgcaaagac

SEQ ID NO: 289560 - DNA, 20 bp, Artificial Sequence
  Description of Artificial Sequence: Synthetic oligonucleotide
  Target: ATXN1; (+) strand; PAM type: YTN; PAM sequence: TTT
tagagtaatgcaaagaccct

SEQ ID NO: 289561 - DNA, 20 bp, Artificial Sequence
  Description of Artificial Sequence: Synthetic oligonucleotide
  Target: ATXN1; (+) strand; PAM type: YTN; PAM sequence: TTT
agagtaatgcaaagaccctg

SEQ ID NO: 289562 - DNA, 20 bp, Artificial Sequence
  Description of Artificial Sequence: Synthetic oligonucleotide
  Target: ATXN1; (+) strand; PAM type: YTN; PAM sequence: TTA
gagtaatgcaaagaccctga

SEQ ID NO: 289563 - DNA, 20 bp, Artificial Sequence
  Description of Artificial Sequence: Synthetic oligonucleotide
  Target: ATXN1; (+) strand; PAM type: YTN; PAM sequence: CTG
agggaggaacatgtttgcat

SEQ ID NO: 289564 - DNA, 20 bp, Artificial Sequence
  Description of Artificial Sequence: Synthetic oligonucleotide
  Target: ATXN1; (+) strand; PAM type: YTN; PAM sequence: TTT
gcattaaacggtaaggagct

SEQ ID NO: 289565 - DNA, 20 bp, Artificial Sequence
  Description of Artificial Sequence: Synthetic oligonucleotide
  Target: ATXN1; (+) strand; PAM type: YTN; PAM sequence: TTG
cattaaacggtaaggagctt

SEQ ID NO: 289566 - DNA, 20 bp, Artificial Sequence
  Description of Artificial Sequence: Synthetic oligonucleotide
  Target: ATXN1; (+) strand; PAM type: YTN; PAM sequence: TTA
aacggtaaggagcttagctc

SEQ ID NO: 289567 - DNA, 20 bp, Artificial Sequence
  Description of Artificial Sequence: Synthetic oligonucleotide
  Target: ATXN1; (+) strand; PAM type: YTN; PAM sequence: CTT
agctcagggctcataaaacc

SEQ ID NO: 289568 - DNA, 20 bp, Artificial Sequence
  Description of Artificial Sequence: Synthetic oligonucleotide
  Target: ATXN1; (+) strand; PAM type: YTN; PAM sequence: TTA
gctcagggctcataaaacca

SEQ ID NO: 289569 - DNA, 20 bp, Artificial Sequence
  Description of Artificial Sequence: Synthetic oligonucleotide
  Target: ATXN1; (+) strand; PAM type: YTN; PAM sequence: CTC
agggctcataaaaccatgtg

SEQ ID NO: 289570 - DNA, 20 bp, Artificial Sequence
  Description of Artificial Sequence: Synthetic oligonucleotide
  Target: ATXN1; (+) strand; PAM type: YTN; PAM sequence: CTC
ataaaaccatgtgctctagg

SEQ ID NO: 289571 - DNA, 20 bp, Artificial Sequence
  Description of Artificial Sequence: Synthetic oligonucleotide
  Target: ATXN1; (+) strand; PAM type: YTN; PAM sequence: CTC
taggagatggtgatgatgat

SEQ ID NO: 289572 - DNA, 20 bp, Artificial Sequence
  Description of Artificial Sequence: Synthetic oligonucleotide
  Target: ATXN1; (+) strand; PAM type: YTN; PAM sequence: CTA
ggagatggtgatgatgatga

SEQ ID NO: 289573 - DNA, 20 bp, Artificial Sequence
  Description of Artificial Sequence: Synthetic oligonucleotide
  Target: ATXN1; (+) strand; PAM type: YTN; PAM sequence: TTG
gtggtggtctcataacgata

SEQ ID NO: 289574 - DNA, 20 bp, Artificial Sequence
  Description of Artificial Sequence: Synthetic oligonucleotide
  Target: ATXN1; (+) strand; PAM type: YTN; PAM sequence: CTC
ataacgataaccaaacaagc

SEQ ID NO: 289575 - DNA, 20 bp, Artificial Sequence
  Description of Artificial Sequence: Synthetic oligonucleotide
  Target: ATXN1; (+) strand; PAM type: YTN; PAM sequence: TTA
agtaaagaaatgaactgaca

SEQ ID NO: 289576 - DNA, 20 bp, Artificial Sequence
  Description of Artificial Sequence: Synthetic oligonucleotide
  Target: ATXN1; (+) strand; PAM type: YTN; PAM sequence: CTG
acaaaattagtatcgaacac

SEQ ID NO: 289577 - DNA, 20 bp, Artificial Sequence
  Description of Artificial Sequence: Synthetic oligonucleotide
  Target: ATXN1; (+) strand; PAM type: YTN; PAM sequence: TTA
gtatcgaacacaggaagtac

SEQ ID NO: 289578 - DNA, 20 bp, Artificial Sequence
  Description of Artificial Sequence: Synthetic oligonucleotide
  Target: ATXN1; (+) strand; PAM type: YTN; PAM sequence: CTA
attagaatcttgactaattt

SEQ ID NO: 289579 - DNA, 20 bp, Artificial Sequence
  Description of Artificial Sequence: Synthetic oligonucleotide
  Target: ATXN1; (+) strand; PAM type: YTN; PAM sequence: TTA
gaatcttgactaattttcat

SEQ ID NO: 289580 - DNA, 20 bp, Artificial Sequence
  Description of Artificial Sequence: Synthetic oligonucleotide
  Target: ATXN1; (+) strand; PAM type: YTN; PAM sequence: CTT
gactaattttcatttattaa

SEQ ID NO: 289581 - DNA, 20 bp, Artificial Sequence
  Description of Artificial Sequence: Synthetic oligonucleotide
  Target: ATXN1; (+) strand; PAM type: YTN; PAM sequence: TTG
actaattttcatttattaaa

SEQ ID NO: 289582 - DNA, 20 bp, Artificial Sequence
  Description of Artificial Sequence: Synthetic oligonucleotide
  Target: ATXN1; (+) strand; PAM type: YTN; PAM sequence: CTA
attttcatttattaaagact

SEQ ID NO: 289583 - DNA, 20 bp, Artificial Sequence
  Description of Artificial Sequence: Synthetic oligonucleotide
  Target: ATXN1; (+) strand; PAM type: YTN; PAM sequence: TTT
tcatttattaaagactgcag

SEQ ID NO: 289584 - DNA, 20 bp, Artificial Sequence
  Description of Artificial Sequence: Synthetic oligonucleotide
  Target: ATXN1; (+) strand; PAM type: YTN; PAM sequence: TTT
catttattaaagactgcagt

SEQ ID NO: 289585 - DNA, 20 bp, Artificial Sequence
  Description of Artificial Sequence: Synthetic oligonucleotide
  Target: ATXN1; (+) strand; PAM type: YTN; PAM sequence: TTC
atttattaaagactgcagtt

SEQ ID NO: 289586 - DNA, 20 bp, Artificial Sequence
  Description of Artificial Sequence: Synthetic oligonucleotide
  Target: ATXN1; (+) strand; PAM type: YTN; PAM sequence: TTT
attaaagactgcagttctat

SEQ ID NO: 289587 - DNA, 20 bp, Artificial Sequence
  Description of Artificial Sequence: Synthetic oligonucleotide
  Target: ATXN1; (+) strand; PAM type: YTN; PAM sequence: TTA
ttaaagactgcagttctatt

SEQ ID NO: 289588 - DNA, 20 bp, Artificial Sequence
  Description of Artificial Sequence: Synthetic oligonucleotide
  Target: ATXN1; (+) strand; PAM type: YTN; PAM sequence: TTA
aagactgcagttctattttt

SEQ ID NO: 289589 - DNA, 20 bp, Artificial Sequence
  Description of Artificial Sequence: Synthetic oligonucleotide
  Target: ATXN1; (+) strand; PAM type: YTN; PAM sequence: CTG
cagttctatttttagttata

SEQ ID NO: 289590 - DNA, 20 bp, Artificial Sequence
  Description of Artificial Sequence: Synthetic oligonucleotide
  Target: ATXN1; (+) strand; PAM type: YTN; PAM sequence: TTC
tatttttagttatatccttc

SEQ ID NO: 289591 - DNA, 20 bp, Artificial Sequence
  Description of Artificial Sequence: Synthetic oligonucleotide
  Target: ATXN1; (+) strand; PAM type: YTN; PAM sequence: CTA
tttttagttatatccttcaa

SEQ ID NO: 289592 - DNA, 20 bp, Artificial Sequence
  Description of Artificial Sequence: Synthetic oligonucleotide
  Target: ATXN1; (+) strand; PAM type: YTN; PAM sequence: TTT
ttagttatatccttcaatct

SEQ ID NO: 289593 - DNA, 20 bp, Artificial Sequence
  Description of Artificial Sequence: Synthetic oligonucleotide
  Target: ATXN1; (+) strand; PAM type: YTN; PAM sequence: TTT
tagttatatccttcaatcta

SEQ ID NO: 289594 - DNA, 20 bp, Artificial Sequence
  Description of Artificial Sequence: Synthetic oligonucleotide
  Target: ATXN1; (+) strand; PAM type: YTN; PAM sequence: TTT
agttatatccttcaatctaa

SEQ ID NO: 289595 - DNA, 20 bp, Artificial Sequence
  Description of Artificial Sequence: Synthetic oligonucleotide
  Target: ATXN1; (+) strand; PAM type: YTN; PAM sequence: TTA
gttatatccttcaatctaac

SEQ ID NO: 289596 - DNA, 20 bp, Artificial Sequence
  Description of Artificial Sequence: Synthetic oligonucleotide
  Target: ATXN1; (+) strand; PAM type: YTN; PAM sequence: TTA
tatccttcaatctaacatca

SEQ ID NO: 289597 - DNA, 20 bp, Artificial Sequence
  Description of Artificial Sequence: Synthetic oligonucleotide
  Target: ATXN1; (+) strand; PAM type: YTN; PAM sequence: CTT
caatctaacatcattcaaga

SEQ ID NO: 289598 - DNA, 20 bp, Artificial Sequence
  Description of Artificial Sequence: Synthetic oligonucleotide
  Target: ATXN1; (+) strand; PAM type: YTN; PAM sequence: TTC
aatctaacatcattcaagaa

SEQ ID NO: 289599 - DNA, 20 bp, Artificial Sequence
  Description of Artificial Sequence: Synthetic oligonucleotide
  Target: ATXN1; (+) strand; PAM type: YTN; PAM sequence: CTA
acatcattcaagaaaagctt

SEQ ID NO: 289600 - DNA, 20 bp, Artificial Sequence
  Description of Artificial Sequence: Synthetic oligonucleotide
  Target: ATXN1; (+) strand; PAM type: YTN; PAM sequence: TTC
aagaaaagcttctctccaaa

SEQ ID NO: 289601 - DNA, 20 bp, Artificial Sequence
  Description of Artificial Sequence: Synthetic oligonucleotide
  Target: ATXN1; (+) strand; PAM type: YTN; PAM sequence: CTT
ctctccaaaaattctatttc

SEQ ID NO: 289602 - DNA, 20 bp, Artificial Sequence
  Description of Artificial Sequence: Synthetic oligonucleotide
  Target: ATXN1; (+) strand; PAM type: YTN; PAM sequence: TTC
tctccaaaaattctatttca

SEQ ID NO: 289603 - DNA, 20 bp, Artificial Sequence
  Description of Artificial Sequence: Synthetic oligonucleotide
  Target: ATXN1; (+) strand; PAM type: YTN; PAM sequence: CTC
tccaaaaattctatttcagg

SEQ ID NO: 289604 - DNA, 20 bp, Artificial Sequence
  Description of Artificial Sequence: Synthetic oligonucleotide
  Target: ATXN1; (+) strand; PAM type: YTN; PAM sequence: CTC
caaaaattctatttcaggaa

SEQ ID NO: 289605 - DNA, 20 bp, Artificial Sequence
  Description of Artificial Sequence: Synthetic oligonucleotide
  Target: ATXN1; (+) strand; PAM type: YTN; PAM sequence: TTC
tatttcaggaatgtaaattt

SEQ ID NO: 289606 - DNA, 20 bp, Artificial Sequence
  Description of Artificial Sequence: Synthetic oligonucleotide
  Target: ATXN1; (+) strand; PAM type: YTN; PAM sequence: CTA
tttcaggaatgtaaattttt

SEQ ID NO: 289607 - DNA, 20 bp, Artificial Sequence
  Description of Artificial Sequence: Synthetic oligonucleotide
  Target: ATXN1; (+) strand; PAM type: YTN; PAM sequence: TTT
caggaatgtaaatttttaaa

SEQ ID NO: 289608 - DNA, 20 bp, Artificial Sequence
  Description of Artificial Sequence: Synthetic oligonucleotide
  Target: ATXN1; (+) strand; PAM type: YTN; PAM sequence: TTC
aggaatgtaaatttttaaaa

SEQ ID NO: 289609 - DNA, 20 bp, Artificial Sequence
  Description of Artificial Sequence: Synthetic oligonucleotide
  Target: ATXN1; (+) strand; PAM type: YTN; PAM sequence: TTT
ttaaaagtaagagtgttctg

SEQ ID NO: 289610 - DNA, 20 bp, Artificial Sequence
  Description of Artificial Sequence: Synthetic oligonucleotide
  Target: ATXN1; (+) strand; PAM type: YTN; PAM sequence: TTT
taaaagtaagagtgttctgc

SEQ ID NO: 289611 - DNA, 20 bp, Artificial Sequence
  Description of Artificial Sequence: Synthetic oligonucleotide
  Target: ATXN1; (+) strand; PAM type: YTN; PAM sequence: TTT
aaaagtaagagtgttctgca

SEQ ID NO: 289612 - DNA, 20 bp, Artificial Sequence
  Description of Artificial Sequence: Synthetic oligonucleotide
  Target: ATXN1; (+) strand; PAM type: YTN; PAM sequence: TTA
aaagtaagagtgttctgcat

SEQ ID NO: 289613 - DNA, 20 bp, Artificial Sequence
  Description of Artificial Sequence: Synthetic oligonucleotide
  Target: ATXN1; (+) strand; PAM type: YTN; PAM sequence: TTC
tgcatgcatgatttcttttt

SEQ ID NO: 289614 - DNA, 20 bp, Artificial Sequence
  Description of Artificial Sequence: Synthetic oligonucleotide
  Target: ATXN1; (+) strand; PAM type: YTN; PAM sequence: CTG
catgcatgatttctttttac

SEQ ID NO: 289615 - DNA, 20 bp, Artificial Sequence
  Description of Artificial Sequence: Synthetic oligonucleotide
  Target: ATXN1; (+) strand; PAM type: YTN; PAM sequence: TTT
ctttttacccagccatcttt

SEQ ID NO: 289616 - DNA, 20 bp, Artificial Sequence
  Description of Artificial Sequence: Synthetic oligonucleotide
  Target: ATXN1; (+) strand; PAM type: YTN; PAM sequence: TTC
tttttacccagccatctttc

SEQ ID NO: 289617 - DNA, 20 bp, Artificial Sequence
  Description of Artificial Sequence: Synthetic oligonucleotide
  Target: ATXN1; (+) strand; PAM type: YTN; PAM sequence: CTT
tttacccagccatctttctg

SEQ ID NO: 289618 - DNA, 20 bp, Artificial Sequence
  Description of Artificial Sequence: Synthetic oligonucleotide
  Target: ATXN1; (+) strand; PAM type: YTN; PAM sequence: TTT
ttacccagccatctttctgt

SEQ ID NO: 289619 - DNA, 20 bp, Artificial Sequence
  Description of Artificial Sequence: Synthetic oligonucleotide
  Target: ATXN1; (+) strand; PAM type: YTN; PAM sequence: TTT
tacccagccatctttctgtt

SEQ ID NO: 289620 - DNA, 20 bp, Artificial Sequence
  Description of Artificial Sequence: Synthetic oligonucleotide
  Target: ATXN1; (+) strand; PAM type: YTN; PAM sequence: TTT
acccagccatctttctgttg

SEQ ID NO: 289621 - DNA, 20 bp, Artificial Sequence
  Description of Artificial Sequence: Synthetic oligonucleotide
  Target: ATXN1; (+) strand; PAM type: YTN; PAM sequence: TTA
cccagccatctttctgttgg

SEQ ID NO: 289622 - DNA, 20 bp, Artificial Sequence
  Description of Artificial Sequence: Synthetic oligonucleotide
  Target: ATXN1; (+) strand; PAM type: YTN; PAM sequence: CTT
tctgttggtttttagcctgc

SEQ ID NO: 289623 - DNA, 20 bp, Artificial Sequence
  Description of Artificial Sequence: Synthetic oligonucleotide
  Target: ATXN1; (+) strand; PAM type: YTN; PAM sequence: TTT
ctgttggtttttagcctgcc

SEQ ID NO: 289624 - DNA, 20 bp, Artificial Sequence
  Description of Artificial Sequence: Synthetic oligonucleotide
  Target: ATXN1; (+) strand; PAM type: YTN; PAM sequence: TTC
tgttggtttttagcctgcca

SEQ ID NO: 289625 - DNA, 20 bp, Artificial Sequence
  Description of Artificial Sequence: Synthetic oligonucleotide
  Target: ATXN1; (+) strand; PAM type: YTN; PAM sequence: CTG
ttggtttttagcctgccagt

SEQ ID NO: 289626 - DNA, 20 bp, Artificial Sequence
  Description of Artificial Sequence: Synthetic oligonucleotide
  Target: ATXN1; (+) strand; PAM type: YTN; PAM sequence: TTG
gtttttagcctgccagtagt

SEQ ID NO: 289627 - DNA, 20 bp, Artificial Sequence
  Description of Artificial Sequence: Synthetic oligonucleotide
  Target: ATXN1; (+) strand; PAM type: YTN; PAM sequence: TTT
ttagcctgccagtagtgtgt

SEQ ID NO: 289628 - DNA, 20 bp, Artificial Sequence
  Description of Artificial Sequence: Synthetic oligonucleotide
  Target: ATXN1; (+) strand; PAM type: YTN; PAM sequence: TTT
tagcctgccagtagtgtgta

SEQ ID NO: 289629 - DNA, 20 bp, Artificial Sequence
  Description of Artificial Sequence: Synthetic oligonucleotide
  Target: ATXN1; (+) strand; PAM type: YTN; PAM sequence: TTT
agcctgccagtagtgtgtat

SEQ ID NO: 289630 - DNA, 20 bp, Artificial Sequence
  Description of Artificial Sequence: Synthetic oligonucleotide
  Target: ATXN1; (+) strand; PAM type: YTN; PAM sequence: TTA
gcctgccagtagtgtgtatg

SEQ ID NO: 289631 - DNA, 20 bp, Artificial Sequence
  Description of Artificial Sequence: Synthetic oligonucleotide
  Target: ATXN1; (+) strand; PAM type: YTN; PAM sequence: CTG
ccagtagtgtgtatgtgata

SEQ ID NO: 289632 - DNA, 20 bp, Artificial Sequence
  Description of Artificial Sequence: Synthetic oligonucleotide
  Target: ATXN1; (+) strand; PAM type: YTN; PAM sequence: TTT
taaagacttactatgcaggg

SEQ ID NO: 289633 - DNA, 20 bp, Artificial Sequence
  Description of Artificial Sequence: Synthetic oligonucleotide
  Target: ATXN1; (+) strand; PAM type: YTN; PAM sequence: TTT
aaagacttactatgcagggt

SEQ ID NO: 289634 - DNA, 20 bp, Artificial Sequence
  Description of Artificial Sequence: Synthetic oligonucleotide
  Target: ATXN1; (+) strand; PAM type: YTN; PAM sequence: TTA
aagacttactatgcagggta

SEQ ID NO: 289635 - DNA, 20 bp, Artificial Sequence
  Description of Artificial Sequence: Synthetic oligonucleotide
  Target: ATXN1; (+) strand; PAM type: YTN; PAM sequence: CTT
actatgcagggtacttagaa

SEQ ID NO: 289636 - DNA, 20 bp, Artificial Sequence
  Description of Artificial Sequence: Synthetic oligonucleotide
  Target: ATXN1; (+) strand; PAM type: YTN; PAM sequence: TTA
ctatgcagggtacttagaaa

SEQ ID NO: 289637 - DNA, 20 bp, Artificial Sequence
  Description of Artificial Sequence: Synthetic oligonucleotide
  Target: ATXN1; (+) strand; PAM type: YTN; PAM sequence: CTA
tgcagggtacttagaaattt

SEQ ID NO: 289638 - DNA, 20 bp, Artificial Sequence
  Description of Artificial Sequence: Synthetic oligonucleotide
  Target: ATXN1; (+) strand; PAM type: YTN; PAM sequence: CTT
agaaatttcatatgagcatt

SEQ ID NO: 289639 - DNA, 20 bp, Artificial Sequence
  Description of Artificial Sequence: Synthetic oligonucleotide
  Target: ATXN1; (+) strand; PAM type: YTN; PAM sequence: TTA
gaaatttcatatgagcattt

SEQ ID NO: 289640 - DNA, 20 bp, Artificial Sequence
  Description of Artificial Sequence: Synthetic oligonucleotide
  Target: ATXN1; (+) strand; PAM type: YTN; PAM sequence: TTT
catatgagcatttaaaatgg

SEQ ID NO: 289641 - DNA, 20 bp, Artificial Sequence
  Description of Artificial Sequence: Synthetic oligonucleotide
  Target: ATXN1; (+) strand; PAM type: YTN; PAM sequence: TTC
atatgagcatttaaaatggc

SEQ ID NO: 289642 - DNA, 20 bp, Artificial Sequence
  Description of Artificial Sequence: Synthetic oligonucleotide
  Target: ATXN1; (+) strand; PAM type: YTN; PAM sequence: TTT
aaaatggcagaaatagctgg

SEQ ID NO: 289643 - DNA, 20 bp, Artificial Sequence
  Description of Artificial Sequence: Synthetic oligonucleotide
  Target: ATXN1; (+) strand; PAM type: YTN; PAM sequence: TTA
aaatggcagaaatagctggt

SEQ ID NO: 289644 - DNA, 20 bp, Artificial Sequence
  Description of Artificial Sequence: Synthetic oligonucleotide
  Target: ATXN1; (+) strand; PAM type: YTN; PAM sequence: CTG
gtagctttcatttccacatg

SEQ ID NO: 289645 - DNA, 20 bp, Artificial Sequence
  Description of Artificial Sequence: Synthetic oligonucleotide
  Target: ATXN1; (+) strand; PAM type: YTN; PAM sequence: CTT
tcatttccacatgtactctc

SEQ ID NO: 289646 - DNA, 20 bp, Artificial Sequence
  Description of Artificial Sequence: Synthetic oligonucleotide
  Target: ATXN1; (+) strand; PAM type: YTN; PAM sequence: TTT
catttccacatgtactctca

SEQ ID NO: 289647 - DNA, 20 bp, Artificial Sequence
  Description of Artificial Sequence: Synthetic oligonucleotide
  Target: ATXN1; (+) strand; PAM type: YTN; PAM sequence: TTC
atttccacatgtactctcag

SEQ ID NO: 289648 - DNA, 20 bp, Artificial Sequence
  Description of Artificial Sequence: Synthetic oligonucleotide
  Target: ATXN1; (+) strand; PAM type: YTN; PAM sequence: TTT
ccacatgtactctcagaaca

SEQ ID NO: 289649 - DNA, 20 bp, Artificial Sequence
  Description of Artificial Sequence: Synthetic oligonucleotide
  Target: ATXN1; (+) strand; PAM type: YTN; PAM sequence: TTC
cacatgtactctcagaacag

SEQ ID NO: 289650 - DNA, 20 bp, Artificial Sequence
  Description of Artificial Sequence: Synthetic oligonucleotide
  Target: ATXN1; (+) strand; PAM type: YTN; PAM sequence: CTC
tcagaacagagaaaaacgag

SEQ ID NO: 289651 - DNA, 20 bp, Artificial Sequence
  Description of Artificial Sequence: Synthetic oligonucleotide
  Target: ATXN1; (+) strand; PAM type: YTN; PAM sequence: CTC
agaacagagaaaaacgagtt

SEQ ID NO: 289652 - DNA, 20 bp, Artificial Sequence
  Description of Artificial Sequence: Synthetic oligonucleotide
  Target: ATXN1; (+) strand; PAM type: YTN; PAM sequence: TTC
taatccatgtctttctaagc

SEQ ID NO: 289653 - DNA, 20 bp, Artificial Sequence
  Description of Artificial Sequence: Synthetic oligonucleotide
  Target: ATXN1; (+) strand; PAM type: YTN; PAM sequence: CTA
atccatgtctttctaagctt

SEQ ID NO: 289654 - DNA, 20 bp, Artificial Sequence
  Description of Artificial Sequence: Synthetic oligonucleotide
  Target: ATXN1; (+) strand; PAM type: YTN; PAM sequence: CTT
tctaagcttctagccttttt

SEQ ID NO: 289655 - DNA, 20 bp, Artificial Sequence
  Description of Artificial Sequence: Synthetic oligonucleotide
  Target: ATXN1; (+) strand; PAM type: YTN; PAM sequence: TTT
ctaagcttctagcctttttt

SEQ ID NO: 289656 - DNA, 20 bp, Artificial Sequence
  Description of Artificial Sequence: Synthetic oligonucleotide
  Target: ATXN1; (+) strand; PAM type: YTN; PAM sequence: TTC
taagcttctagccttttttt

SEQ ID NO: 289657 - DNA, 20 bp, Artificial Sequence
  Description of Artificial Sequence: Synthetic oligonucleotide
  Target: ATXN1; (+) strand; PAM type: YTN; PAM sequence: CTA
agcttctagccttttttttt

SEQ ID NO: 289658 - DNA, 20 bp, Artificial Sequence
  Description of Artificial Sequence: Synthetic oligonucleotide
  Target: ATXN1; (+) strand; PAM type: YTN; PAM sequence: CTT
ctagccttttttttttaact

SEQ ID NO: 289659 - DNA, 20 bp, Artificial Sequence
  Description of Artificial Sequence: Synthetic oligonucleotide
  Target: ATXN1; (+) strand; PAM type: YTN; PAM sequence: TTC
tagccttttttttttaactg

SEQ ID NO: 289660 - DNA, 20 bp, Artificial Sequence
  Description of Artificial Sequence: Synthetic oligonucleotide
  Target: ATXN1; (+) strand; PAM type: YTN; PAM sequence: CTA
gccttttttttttaactgtc

SEQ ID NO: 289661 - DNA, 20 bp, Artificial Sequence
  Description of Artificial Sequence: Synthetic oligonucleotide
  Target: ATXN1; (+) strand; PAM type: YTN; PAM sequence: CTT
ttttttttaactgtctcagg

SEQ ID NO: 289662 - DNA, 20 bp, Artificial Sequence
  Description of Artificial Sequence: Synthetic oligonucleotide
  Target: ATXN1; (+) strand; PAM type: YTN; PAM sequence: TTT
tttttttaactgtctcaggg

SEQ ID NO: 289663 - DNA, 20 bp, Artificial Sequence
  Description of Artificial Sequence: Synthetic oligonucleotide
  Target: ATXN1; (+) strand; PAM type: YTN; PAM sequence: TTT
ttttttaactgtctcagggt

SEQ ID NO: 289664 - DNA, 20 bp, Artificial Sequence
  Description of Artificial Sequence: Synthetic oligonucleotide
  Target: ATXN1; (+) strand; PAM type: YTN; PAM sequence: TTT
tttttaactgtctcagggtg

SEQ ID NO: 289665 - DNA, 20 bp, Artificial Sequence
  Description of Artificial Sequence: Synthetic oligonucleotide
  Target: ATXN1; (+) strand; PAM type: YTN; PAM sequence: TTT
ttttaactgtctcagggtga

SEQ ID NO: 289666 - DNA, 20 bp, Artificial Sequence
  Description of Artificial Sequence: Synthetic oligonucleotide
  Target: ATXN1; (+) strand; PAM type: YTN; PAM sequence: TTT
tttaactgtctcagggtgaa

SEQ ID NO: 289667 - DNA, 20 bp, Artificial Sequence
  Description of Artificial Sequence: Synthetic oligonucleotide
  Target: ATXN1; (+) strand; PAM type: YTN; PAM sequence: TTT
ttaactgtctcagggtgaaa

SEQ ID NO: 289668 - DNA, 20 bp, Artificial Sequence
  Description of Artificial Sequence: Synthetic oligonucleotide
  Target: ATXN1; (+) strand; PAM type: YTN; PAM sequence: TTT
taactgtctcagggtgaaat

SEQ ID NO: 289669 - DNA, 20 bp, Artificial Sequence
  Description of Artificial Sequence: Synthetic oligonucleotide
  Target: ATXN1; (+) strand; PAM type: YTN; PAM sequence: TTT
aactgtctcagggtgaaatt

SEQ ID NO: 289670 - DNA, 20 bp, Artificial Sequence
  Description of Artificial Sequence: Synthetic oligonucleotide
  Target: ATXN1; (+) strand; PAM type: YTN; PAM sequence: TTA
actgtctcagggtgaaattc

SEQ ID NO: 289671 - DNA, 20 bp, Artificial Sequence
  Description of Artificial Sequence: Synthetic oligonucleotide
  Target: ATXN1; (+) strand; PAM type: YTN; PAM sequence: CTG
tctcagggtgaaattccact

SEQ ID NO: 289672 - DNA, 20 bp, Artificial Sequence
  Description of Artificial Sequence: Synthetic oligonucleotide
  Target: ATXN1; (+) strand; PAM type: YTN; PAM sequence: CTC
agggtgaaattccactttac

SEQ ID NO: 289673 - DNA, 20 bp, Artificial Sequence
  Description of Artificial Sequence: Synthetic oligonucleotide
  Target: ATXN1; (+) strand; PAM type: YTN; PAM sequence: TTC
cactttacttgtttaatgat

SEQ ID NO: 289674 - DNA, 20 bp, Artificial Sequence
  Description of Artificial Sequence: Synthetic oligonucleotide
  Target: ATXN1; (+) strand; PAM type: YTN; PAM sequence: CTT
tacttgtttaatgatgcata

SEQ ID NO: 289675 - DNA, 20 bp, Artificial Sequence
  Description of Artificial Sequence: Synthetic oligonucleotide
  Target: ATXN1; (+) strand; PAM type: YTN; PAM sequence: TTT
acttgtttaatgatgcatac

SEQ ID NO: 289676 - DNA, 20 bp, Artificial Sequence
  Description of Artificial Sequence: Synthetic oligonucleotide
  Target: ATXN1; (+) strand; PAM type: YTN; PAM sequence: TTA
cttgtttaatgatgcatact

SEQ ID NO: 289677 - DNA, 20 bp, Artificial Sequence
  Description of Artificial Sequence: Synthetic oligonucleotide
  Target: ATXN1; (+) strand; PAM type: YTN; PAM sequence: CTT
gtttaatgatgcatactttt

SEQ ID NO: 289678 - DNA, 20 bp, Artificial Sequence
  Description of Artificial Sequence: Synthetic oligonucleotide
  Target: ATXN1; (+) strand; PAM type: YTN; PAM sequence: TTG
tttaatgatgcatacttttg

SEQ ID NO: 289679 - DNA, 20 bp, Artificial Sequence
  Description of Artificial Sequence: Synthetic oligonucleotide
  Target: ATXN1; (+) strand; PAM type: YTN; PAM sequence: TTT
aatgatgcatacttttgaaa

SEQ ID NO: 289680 - DNA, 20 bp, Artificial Sequence
  Description of Artificial Sequence: Synthetic oligonucleotide
  Target: ATXN1; (+) strand; PAM type: YTN; PAM sequence: TTA
atgatgcatacttttgaaat

SEQ ID NO: 289681 - DNA, 20 bp, Artificial Sequence
  Description of Artificial Sequence: Synthetic oligonucleotide
  Target: ATXN1; (+) strand; PAM type: YTN; PAM sequence: CTT
ttgaaattttacaaaaataa

SEQ ID NO: 289682 - DNA, 20 bp, Artificial Sequence
  Description of Artificial Sequence: Synthetic oligonucleotide
  Target: ATXN1; (+) strand; PAM type: YTN; PAM sequence: TTT
tgaaattttacaaaaataat

SEQ ID NO: 289683 - DNA, 20 bp, Artificial Sequence
  Description of Artificial Sequence: Synthetic oligonucleotide
  Target: ATXN1; (+) strand; PAM type: YTN; PAM sequence: TTT
gaaattttacaaaaataatc

SEQ ID NO: 289684 - DNA, 20 bp, Artificial Sequence
  Description of Artificial Sequence: Synthetic oligonucleotide
  Target: ATXN1; (+) strand; PAM type: YTN; PAM sequence: TTG
aaattttacaaaaataatca

SEQ ID NO: 289685 - DNA, 20 bp, Artificial Sequence
  Description of Artificial Sequence: Synthetic oligonucleotide
  Target: ATXN1; (+) strand; PAM type: YTN; PAM sequence: TTT
tacaaaaataatcattcata

SEQ ID NO: 289686 - DNA, 20 bp, Artificial Sequence
  Description of Artificial Sequence: Synthetic oligonucleotide
  Target: ATXN1; (+) strand; PAM type: YTN; PAM sequence: TTT
acaaaaataatcattcatat

SEQ ID NO: 289687 - DNA, 20 bp, Artificial Sequence
  Description of Artificial Sequence: Synthetic oligonucleotide
  Target: ATXN1; (+) strand; PAM type: YTN; PAM sequence: TTA
caaaaataatcattcatatt

SEQ ID NO: 289688 - DNA, 20 bp, Artificial Sequence
  Description of Artificial Sequence: Synthetic oligonucleotide
  Target: ATXN1; (+) strand; PAM type: YTN; PAM sequence: TTC
atattttgaatttttctgca

SEQ ID NO: 289689 - DNA, 20 bp, Artificial Sequence
  Description of Artificial Sequence: Synthetic oligonucleotide
  Target: ATXN1; (+) strand; PAM type: YTN; PAM sequence: TTT
tgaatttttctgcaacgtaa

SEQ ID NO: 289690 - DNA, 20 bp, Artificial Sequence
  Description of Artificial Sequence: Synthetic oligonucleotide
  Target: ATXN1; (+) strand; PAM type: YTN; PAM sequence: TTT
gaatttttctgcaacgtaac

SEQ ID NO: 289691 - DNA, 20 bp, Artificial Sequence
  Description of Artificial Sequence: Synthetic oligonucleotide
  Target: ATXN1; (+) strand; PAM type: YTN; PAM sequence: TTG
aatttttctgcaacgtaact

SEQ ID NO: 289692 - DNA, 20 bp, Artificial Sequence
  Description of Artificial Sequence: Synthetic oligonucleotide
  Target: ATXN1; (+) strand; PAM type: YTN; PAM sequence: TTT
ttctgcaacgtaactttttt

SEQ ID NO: 289693 - DNA, 20 bp, Artificial Sequence
  Description of Artificial Sequence: Synthetic oligonucleotide
  Target: ATXN1; (+) strand; PAM type: YTN; PAM sequence: TTT
tctgcaacgtaacttttttg

SEQ ID NO: 289694 - DNA, 20 bp, Artificial Sequence
  Description of Artificial Sequence: Synthetic oligonucleotide
  Target: ATXN1; (+) strand; PAM type: YTN; PAM sequence: TTT
ctgcaacgtaacttttttgg

SEQ ID NO: 289695 - DNA, 20 bp, Artificial Sequence
  Description of Artificial Sequence: Synthetic oligonucleotide
  Target: ATXN1; (+) strand; PAM type: YTN; PAM sequence: TTC
tgcaacgtaacttttttggc

SEQ ID NO: 289696 - DNA, 20 bp, Artificial Sequence
  Description of Artificial Sequence: Synthetic oligonucleotide
  Target: ATXN1; (+) strand; PAM type: YTN; PAM sequence: CTG
caacgtaacttttttggctt

SEQ ID NO: 289697 - DNA, 20 bp, Artificial Sequence
  Description of Artificial Sequence: Synthetic oligonucleotide
  Target: ATXN1; (+) strand; PAM type: YTN; PAM sequence: CTT
ttttggcttcatatcaggtt

SEQ ID NO: 289698 - DNA, 20 bp, Artificial Sequence
  Description of Artificial Sequence: Synthetic oligonucleotide
  Target: ATXN1; (+) strand; PAM type: YTN; PAM sequence: TTT
tttggcttcatatcaggtta

SEQ ID NO: 289699 - DNA, 20 bp, Artificial Sequence
  Description of Artificial Sequence: Synthetic oligonucleotide
  Target: ATXN1; (+) strand; PAM type: YTN; PAM sequence: TTT
ttggcttcatatcaggttac

SEQ ID NO: 289700 - DNA, 20 bp, Artificial Sequence
  Description of Artificial Sequence: Synthetic oligonucleotide
  Target: ATXN1; (+) strand; PAM type: YTN; PAM sequence: TTT
tggcttcatatcaggttact

SEQ ID NO: 289701 - DNA, 20 bp, Artificial Sequence
  Description of Artificial Sequence: Synthetic oligonucleotide
  Target: ATXN1; (+) strand; PAM type: YTN; PAM sequence: TTT
ggcttcatatcaggttactg

SEQ ID NO: 289702 - DNA, 20 bp, Artificial Sequence
  Description of Artificial Sequence: Synthetic oligonucleotide
  Target: ATXN1; (+) strand; PAM type: YTN; PAM sequence: TTG
gcttcatatcaggttactga

SEQ ID NO: 289703 - DNA, 20 bp, Artificial Sequence
  Description of Artificial Sequence: Synthetic oligonucleotide
  Target: ATXN1; (+) strand; PAM type: YTN; PAM sequence: CTT
catatcaggttactgaaatg

SEQ ID NO: 289704 - DNA, 20 bp, Artificial Sequence
  Description of Artificial Sequence: Synthetic oligonucleotide
  Target: ATXN1; (+) strand; PAM type: YTN; PAM sequence: TTC
atatcaggttactgaaatgt

SEQ ID NO: 289705 - DNA, 20 bp, Artificial Sequence
  Description of Artificial Sequence: Synthetic oligonucleotide
  Target: ATXN1; (+) strand; PAM type: YTN; PAM sequence: TTA
ctgaaatgtatctatattgc

SEQ ID NO: 289706 - DNA, 20 bp, Artificial Sequence
  Description of Artificial Sequence: Synthetic oligonucleotide
  Target: ATXN1; (+) strand; PAM type: YTN; PAM sequence: CTG
aaatgtatctatattgctcc

SEQ ID NO: 289707 - DNA, 20 bp, Artificial Sequence
  Description of Artificial Sequence: Synthetic oligonucleotide
  Target: ATXN1; (+) strand; PAM type: YTN; PAM sequence: CTA
tattgctcctatatagtttt

SEQ ID NO: 289708 - DNA, 20 bp, Artificial Sequence
  Description of Artificial Sequence: Synthetic oligonucleotide
  Target: ATXN1; (+) strand; PAM type: YTN; PAM sequence: TTG
ctcctatatagttttagatc

SEQ ID NO: 289709 - DNA, 20 bp, Artificial Sequence
  Description of Artificial Sequence: Synthetic oligonucleotide
  Target: ATXN1; (+) strand; PAM type: YTN; PAM sequence: CTC
ctatatagttttagatcatt

SEQ ID NO: 289710 - DNA, 20 bp, Artificial Sequence
  Description of Artificial Sequence: Synthetic oligonucleotide
  Target: ATXN1; (+) strand; PAM type: YTN; PAM sequence: CTA
tatagttttagatcattcac

SEQ ID NO: 289711 - DNA, 20 bp, Artificial Sequence
  Description of Artificial Sequence: Synthetic oligonucleotide
  Target: ATXN1; (+) strand; PAM type: YTN; PAM sequence: TTT
tagatcattcactttcattg

SEQ ID NO: 289712 - DNA, 20 bp, Artificial Sequence
  Description of Artificial Sequence: Synthetic oligonucleotide
  Target: ATXN1; (+) strand; PAM type: YTN; PAM sequence: TTT
agatcattcactttcattgt

SEQ ID NO: 289713 - DNA, 20 bp, Artificial Sequence
  Description of Artificial Sequence: Synthetic oligonucleotide
  Target: ATXN1; (+) strand; PAM type: YTN; PAM sequence: TTA
gatcattcactttcattgtt

SEQ ID NO: 289714 - DNA, 20 bp, Artificial Sequence
  Description of Artificial Sequence: Synthetic oligonucleotide
  Target: ATXN1; (+) strand; PAM type: YTN; PAM sequence: TTC
actttcattgttgtattgtg

SEQ ID NO: 289715 - DNA, 20 bp, Artificial Sequence
  Description of Artificial Sequence: Synthetic oligonucleotide
  Target: ATXN1; (+) strand; PAM type: YTN; PAM sequence: CTT
tcattgttgtattgtgttct

SEQ ID NO: 289716 - DNA, 20 bp, Artificial Sequence
  Description of Artificial Sequence: Synthetic oligonucleotide
  Target: ATXN1; (+) strand; PAM type: YTN; PAM sequence: TTT
cattgttgtattgtgttctg

SEQ ID NO: 289717 - DNA, 20 bp, Artificial Sequence
  Description of Artificial Sequence: Synthetic oligonucleotide
  Target: ATXN1; (+) strand; PAM type: YTN; PAM sequence: TTC
attgttgtattgtgttctgt

SEQ ID NO: 289718 - DNA, 20 bp, Artificial Sequence
  Description of Artificial Sequence: Synthetic oligonucleotide
  Target: ATXN1; (+) strand; PAM type: YTN; PAM sequence: TTG
ttgtattgtgttctgtcatt

SEQ ID NO: 289719 - DNA, 20 bp, Artificial Sequence
  Description of Artificial Sequence: Synthetic oligonucleotide
  Target: ATXN1; (+) strand; PAM type: YTN; PAM sequence: TTG
tattgtgttctgtcatttga

SEQ ID NO: 289720 - DNA, 20 bp, Artificial Sequence
  Description of Artificial Sequence: Synthetic oligonucleotide
  Target: ATXN1; (+) strand; PAM type: YTN; PAM sequence: TTG
tgttctgtcatttgatcata

SEQ ID NO: 289721 - DNA, 20 bp, Artificial Sequence
  Description of Artificial Sequence: Synthetic oligonucleotide
  Target: ATXN1; (+) strand; PAM type: YTN; PAM sequence: TTC
tgtcatttgatcatatcata

SEQ ID NO: 289722 - DNA, 20 bp, Artificial Sequence
  Description of Artificial Sequence: Synthetic oligonucleotide
  Target: ATXN1; (+) strand; PAM type: YTN; PAM sequence: CTG
tcatttgatcatatcataat

SEQ ID NO: 289723 - DNA, 20 bp, Artificial Sequence
  Description of Artificial Sequence: Synthetic oligonucleotide
  Target: ATXN1; (+) strand; PAM type: YTN; PAM sequence: TTT
gatcatatcataatttgttt

SEQ ID NO: 289724 - DNA, 20 bp, Artificial Sequence
  Description of Artificial Sequence: Synthetic oligonucleotide
  Target: ATXN1; (+) strand; PAM type: YTN; PAM sequence: TTG
atcatatcataatttgttta

SEQ ID NO: 289725 - DNA, 20 bp, Artificial Sequence
  Description of Artificial Sequence: Synthetic oligonucleotide
  Target: ATXN1; (+) strand; PAM type: YTN; PAM sequence: TTT
gtttatttcactttaataaa

SEQ ID NO: 289726 - DNA, 20 bp, Artificial Sequence
  Description of Artificial Sequence: Synthetic oligonucleotide
  Target: ATXN1; (+) strand; PAM type: YTN; PAM sequence: TTG
tttatttcactttaataaac

SEQ ID NO: 289727 - DNA, 20 bp, Artificial Sequence
  Description of Artificial Sequence: Synthetic oligonucleotide
  Target: ATXN1; (+) strand; PAM type: YTN; PAM sequence: TTT
atttcactttaataaacatt

SEQ ID NO: 289728 - DNA, 20 bp, Artificial Sequence
  Description of Artificial Sequence: Synthetic oligonucleotide
  Target: ATXN1; (+) strand; PAM type: YTN; PAM sequence: TTA
tttcactttaataaacattc

SEQ ID NO: 289729 - DNA, 20 bp, Artificial Sequence
  Description of Artificial Sequence: Synthetic oligonucleotide
  Target: ATXN1; (+) strand; PAM type: YTN; PAM sequence: TTT
cactttaataaacattcaag

SEQ ID NO: 289730 - DNA, 20 bp, Artificial Sequence
  Description of Artificial Sequence: Synthetic oligonucleotide
  Target: ATXN1; (+) strand; PAM type: YTN; PAM sequence: TTC
actttaataaacattcaagt

SEQ ID NO: 289731 - DNA, 20 bp, Artificial Sequence
  Description of Artificial Sequence: Synthetic oligonucleotide
  Target: ATXN1; (+) strand; PAM type: YTN; PAM sequence: CTT
taataaacattcaagtagtt

SEQ ID NO: 289732 - DNA, 20 bp, Artificial Sequence
  Description of Artificial Sequence: Synthetic oligonucleotide
  Target: ATXN1; (+) strand; PAM type: YTN; PAM sequence: TTT
aataaacattcaagtagttt

SEQ ID NO: 289733 - DNA, 20 bp, Artificial Sequence
  Description of Artificial Sequence: Synthetic oligonucleotide
  Target: ATXN1; (+) strand; PAM type: YTN; PAM sequence: TTA
ataaacattcaagtagtttg

SEQ ID NO: 289734 - DNA, 20 bp, Artificial Sequence
  Description of Artificial Sequence: Synthetic oligonucleotide
  Target: ATXN1; (+) strand; PAM type: YTN; PAM sequence: TTC
aagtagtttgggtttatttt

SEQ ID NO: 289735 - DNA, 20 bp, Artificial Sequence
  Description of Artificial Sequence: Synthetic oligonucleotide
  Target: ATXN1; (+) strand; PAM type: YTN; PAM sequence: TTT
gggtttatttttttaaacca

SEQ ID NO: 289736 - DNA, 20 bp, Artificial Sequence
  Description of Artificial Sequence: Synthetic oligonucleotide
  Target: ATXN1; (+) strand; PAM type: YTN; PAM sequence: TTG
ggtttatttttttaaaccat

SEQ ID NO: 289737 - DNA, 20 bp, Artificial Sequence
  Description of Artificial Sequence: Synthetic oligonucleotide
  Target: ATXN1; (+) strand; PAM type: YTN; PAM sequence: TTT
atttttttaaaccattatta

SEQ ID NO: 289738 - DNA, 20 bp, Artificial Sequence
  Description of Artificial Sequence: Synthetic oligonucleotide
  Target: ATXN1; (+) strand; PAM type: YTN; PAM sequence: TTA
tttttttaaaccattattaa

SEQ ID NO: 289739 - DNA, 20 bp, Artificial Sequence
  Description of Artificial Sequence: Synthetic oligonucleotide
  Target: ATXN1; (+) strand; PAM type: YTN; PAM sequence: TTT
ttttaaaccattattaacac

SEQ ID NO: 289740 - DNA, 20 bp, Artificial Sequence
  Description of Artificial Sequence: Synthetic oligonucleotide
  Target: ATXN1; (+) strand; PAM type: YTN; PAM sequence: TTT
tttaaaccattattaacaca

SEQ ID NO: 289741 - DNA, 20 bp, Artificial Sequence
  Description of Artificial Sequence: Synthetic oligonucleotide
  Target: ATXN1; (+) strand; PAM type: YTN; PAM sequence: TTT
ttaaaccattattaacacaa

SEQ ID NO: 289742 - DNA, 20 bp, Artificial Sequence
  Description of Artificial Sequence: Synthetic oligonucleotide
  Target: ATXN1; (+) strand; PAM type: YTN; PAM sequence: TTT
taaaccattattaacacaaa

SEQ ID NO: 289743 - DNA, 20 bp, Artificial Sequence
  Description of Artificial Sequence: Synthetic oligonucleotide
  Target: ATXN1; (+) strand; PAM type: YTN; PAM sequence: TTT
aaaccattattaacacaaat

SEQ ID NO: 289744 - DNA, 20 bp, Artificial Sequence
  Description of Artificial Sequence: Synthetic oligonucleotide
  Target: ATXN1; (+) strand; PAM type: YTN; PAM sequence: TTA
aaccattattaacacaaata

SEQ ID NO: 289745 - DNA, 20 bp, Artificial Sequence
  Description of Artificial Sequence: Synthetic oligonucleotide
  Target: ATXN1; (+) strand; PAM type: YTN; PAM sequence: TTA
ttaacacaaataaagctgtg

SEQ ID NO: 289746 - DNA, 20 bp, Artificial Sequence
  Description of Artificial Sequence: Synthetic oligonucleotide
  Target: ATXN1; (+) strand; PAM type: YTN; PAM sequence: TTA
acacaaataaagctgtgctg

SEQ ID NO: 289747 - DNA, 20 bp, Artificial Sequence
  Description of Artificial Sequence: Synthetic oligonucleotide
  Target: ATXN1; (+) strand; PAM type: YTN; PAM sequence: CTG
tgctggagagcctccatgtc

SEQ ID NO: 289748 - DNA, 20 bp, Artificial Sequence
  Description of Artificial Sequence: Synthetic oligonucleotide
  Target: ATXN1; (+) strand; PAM type: YTN; PAM sequence: CTG
gagagcctccatgtctcgtg

SEQ ID NO: 289749 - DNA, 20 bp, Artificial Sequence
  Description of Artificial Sequence: Synthetic oligonucleotide
  Target: ATXN1; (+) strand; PAM type: YTN; PAM sequence: CTC
catgtctcgtggtatacagt

SEQ ID NO: 289750 - DNA, 20 bp, Artificial Sequence
  Description of Artificial Sequence: Synthetic oligonucleotide
  Target: ATXN1; (+) strand; PAM type: YTN; PAM sequence: CTC
gtggtatacagtacagaagt

SEQ ID NO: 289751 - DNA, 20 bp, Artificial Sequence
  Description of Artificial Sequence: Synthetic oligonucleotide
  Target: ATXN1; (+) strand; PAM type: YTN; PAM sequence: CTC
taggaaacacctagaaggaa

SEQ ID NO: 289752 - DNA, 20 bp, Artificial Sequence
  Description of Artificial Sequence: Synthetic oligonucleotide
  Target: ATXN1; (+) strand; PAM type: YTN; PAM sequence: CTA
ggaaacacctagaaggaaaa

SEQ ID NO: 289753 - DNA, 20 bp, Artificial Sequence
  Description of Artificial Sequence: Synthetic oligonucleotide
  Target: ATXN1; (+) strand; PAM type: YTN; PAM sequence: CTA
gaaggaaaattgctgagtca

SEQ ID NO: 289754 - DNA, 20 bp, Artificial Sequence
  Description of Artificial Sequence: Synthetic oligonucleotide
  Target: ATXN1; (+) strand; PAM type: YTN; PAM sequence: TTG
ctgagtcacagggtatacac

SEQ ID NO: 289755 - DNA, 20 bp, Artificial Sequence
  Description of Artificial Sequence: Synthetic oligonucleotide
  Target: ATXN1; (+) strand; PAM type: YTN; PAM sequence: CTG
agtcacagggtatacacatt

SEQ ID NO: 289756 - DNA, 20 bp, Artificial Sequence
  Description of Artificial Sequence: Synthetic oligonucleotide
  Target: ATXN1; (+) strand; PAM type: YTN; PAM sequence: TTT
gtttttgttaactggataat

SEQ ID NO: 289757 - DNA, 20 bp, Artificial Sequence
  Description of Artificial Sequence: Synthetic oligonucleotide
  Target: ATXN1; (+) strand; PAM type: YTN; PAM sequence: TTG
tttttgttaactggataata

SEQ ID NO: 289758 - DNA, 20 bp, Artificial Sequence
  Description of Artificial Sequence: Synthetic oligonucleotide
  Target: ATXN1; (+) strand; PAM type: YTN; PAM sequence: TTT
ttgttaactggataatacct

SEQ ID NO: 289759 - DNA, 20 bp, Artificial Sequence
  Description of Artificial Sequence: Synthetic oligonucleotide
  Target: ATXN1; (+) strand; PAM type: YTN; PAM sequence: TTT
tgttaactggataataccta

SEQ ID NO: 289760 - DNA, 20 bp, Artificial Sequence
  Description of Artificial Sequence: Synthetic oligonucleotide
  Target: ATXN1; (+) strand; PAM type: YTN; PAM sequence: TTT
gttaactggataatacctaa

SEQ ID NO: 289761 - DNA, 20 bp, Artificial Sequence
  Description of Artificial Sequence: Synthetic oligonucleotide
  Target: ATXN1; (+) strand; PAM type: YTN; PAM sequence: TTG
ttaactggataatacctaac

SEQ ID NO: 289762 - DNA, 20 bp, Artificial Sequence
  Description of Artificial Sequence: Synthetic oligonucleotide
  Target: ATXN1; (+) strand; PAM type: YTN; PAM sequence: TTA
actggataatacctaactgt

SEQ ID NO: 289763 - DNA, 20 bp, Artificial Sequence
  Description of Artificial Sequence: Synthetic oligonucleotide
  Target: ATXN1; (+) strand; PAM type: YTN; PAM sequence: CTG
gataatacctaactgtcttt

SEQ ID NO: 289764 - DNA, 20 bp, Artificial Sequence
  Description of Artificial Sequence: Synthetic oligonucleotide
  Target: ATXN1; (+) strand; PAM type: YTN; PAM sequence: CTA
actgtctttctaaatggttg

SEQ ID NO: 289765 - DNA, 20 bp, Artificial Sequence
  Description of Artificial Sequence: Synthetic oligonucleotide
  Target: ATXN1; (+) strand; PAM type: YTN; PAM sequence: CTG
tctttctaaatggttgtacc

SEQ ID NO: 289766 - DNA, 20 bp, Artificial Sequence
  Description of Artificial Sequence: Synthetic oligonucleotide
  Target: ATXN1; (+) strand; PAM type: YTN; PAM sequence: CTT
tctaaatggttgtaccaatg

SEQ ID NO: 289767 - DNA, 20 bp, Artificial Sequence
  Description of Artificial Sequence: Synthetic oligonucleotide
  Target: ATXN1; (+) strand; PAM type: YTN; PAM sequence: TTT
ctaaatggttgtaccaatga

SEQ ID NO: 289768 - DNA, 20 bp, Artificial Sequence
  Description of Artificial Sequence: Synthetic oligonucleotide
  Target: ATXN1; (+) strand; PAM type: YTN; PAM sequence: TTC
taaatggttgtaccaatgaa

SEQ ID NO: 289769 - DNA, 20 bp, Artificial Sequence
  Description of Artificial Sequence: Synthetic oligonucleotide
  Target: ATXN1; (+) strand; PAM type: YTN; PAM sequence: CTA
aatggttgtaccaatgaata

SEQ ID NO: 289770 - DNA, 20 bp, Artificial Sequence
  Description of Artificial Sequence: Synthetic oligonucleotide
  Target: ATXN1; (+) strand; PAM type: YTN; PAM sequence: TTG
taccaatgaatattcctatc

SEQ ID NO: 289771 - DNA, 20 bp, Artificial Sequence
  Description of Artificial Sequence: Synthetic oligonucleotide
  Target: ATXN1; (+) strand; PAM type: YTN; PAM sequence: TTC
ctatcagcagtacataaaca

SEQ ID NO: 289772 - DNA, 20 bp, Artificial Sequence
  Description of Artificial Sequence: Synthetic oligonucleotide
  Target: ATXN1; (+) strand; PAM type: YTN; PAM sequence: CTA
tcagcagtacataaacatga

SEQ ID NO: 289773 - DNA, 20 bp, Artificial Sequence
  Description of Artificial Sequence: Synthetic oligonucleotide
  Target: ATXN1; (+) strand; PAM type: YTN; PAM sequence: TTT
ttcaaacttggaccaaaata

SEQ ID NO: 289774 - DNA, 20 bp, Artificial Sequence
  Description of Artificial Sequence: Synthetic oligonucleotide
  Target: ATXN1; (+) strand; PAM type: YTN; PAM sequence: TTT
tcaaacttggaccaaaatat

SEQ ID NO: 289775 - DNA, 20 bp, Artificial Sequence
  Description of Artificial Sequence: Synthetic oligonucleotide
  Target: ATXN1; (+) strand; PAM type: YTN; PAM sequence: TTT
caaacttggaccaaaatatt

SEQ ID NO: 289776 - DNA, 20 bp, Artificial Sequence
  Description of Artificial Sequence: Synthetic oligonucleotide
  Target: ATXN1; (+) strand; PAM type: YTN; PAM sequence: TTC
aaacttggaccaaaatattc

SEQ ID NO: 289777 - DNA, 20 bp, Artificial Sequence
  Description of Artificial Sequence: Synthetic oligonucleotide
  Target: ATXN1; (+) strand; PAM type: YTN; PAM sequence: CTT
ggaccaaaatattcattact

SEQ ID NO: 289778 - DNA, 20 bp, Artificial Sequence
  Description of Artificial Sequence: Synthetic oligonucleotide
  Target: ATXN1; (+) strand; PAM type: YTN; PAM sequence: TTG
gaccaaaatattcattactg

SEQ ID NO: 289779 - DNA, 20 bp, Artificial Sequence
  Description of Artificial Sequence: Synthetic oligonucleotide
  Target: ATXN1; (+) strand; PAM type: YTN; PAM sequence: TTC
attactgggaactccagatc

SEQ ID NO: 289780 - DNA, 20 bp, Artificial Sequence
  Description of Artificial Sequence: Synthetic oligonucleotide
  Target: ATXN1; (+) strand; PAM type: YTN; PAM sequence: TTA
ctgggaactccagatctcaa

SEQ ID NO: 289781 - DNA, 20 bp, Artificial Sequence
  Description of Artificial Sequence: Synthetic oligonucleotide
  Target: ATXN1; (+) strand; PAM type: YTN; PAM sequence: CTG
ggaactccagatctcaaata

SEQ ID NO: 289782 - DNA, 20 bp, Artificial Sequence
  Description of Artificial Sequence: Synthetic oligonucleotide
  Target: ATXN1; (+) strand; PAM type: YTN; PAM sequence: CTC
cagatctcaaataagtcaag

SEQ ID NO: 289783 - DNA, 20 bp, Artificial Sequence
  Description of Artificial Sequence: Synthetic oligonucleotide
  Target: ATXN1; (+) strand; PAM type: YTN; PAM sequence: CTC
aaataagtcaagtgtcagtt

SEQ ID NO: 289784 - DNA, 20 bp, Artificial Sequence
  Description of Artificial Sequence: Synthetic oligonucleotide
  Target: ATXN1; (+) strand; PAM type: YTN; PAM sequence: TTC
catctatcgctttggtcaat

SEQ ID NO: 289785 - DNA, 20 bp, Artificial Sequence
  Description of Artificial Sequence: Synthetic oligonucleotide
  Target: ATXN1; (+) strand; PAM type: YTN; PAM sequence: CTA
tcgctttggtcaatttcaaa

SEQ ID NO: 289786 - DNA, 20 bp, Artificial Sequence
  Description of Artificial Sequence: Synthetic oligonucleotide
  Target: ATXN1; (+) strand; PAM type: YTN; PAM sequence: CTT
tggtcaatttcaaactgttc

SEQ ID NO: 289787 - DNA, 20 bp, Artificial Sequence
  Description of Artificial Sequence: Synthetic oligonucleotide
  Target: ATXN1; (+) strand; PAM type: YTN; PAM sequence: TTT
ggtcaatttcaaactgttct

SEQ ID NO: 289788 - DNA, 20 bp, Artificial Sequence
  Description of Artificial Sequence: Synthetic oligonucleotide
  Target: ATXN1; (+) strand; PAM type: YTN; PAM sequence: TTG
gtcaatttcaaactgttctt

SEQ ID NO: 289789 - DNA, 20 bp, Artificial Sequence
  Description of Artificial Sequence: Synthetic oligonucleotide
  Target: ATXN1; (+) strand; PAM type: YTN; PAM sequence: TTT
caaactgttctttgaacaaa

SEQ ID NO: 289790 - DNA, 20 bp, Artificial Sequence
  Description of Artificial Sequence: Synthetic oligonucleotide
  Target: ATXN1; (+) strand; PAM type: YTN; PAM sequence: TTC
aaactgttctttgaacaaat

SEQ ID NO: 289791 - DNA, 20 bp, Artificial Sequence
  Description of Artificial Sequence: Synthetic oligonucleotide
  Target: ATXN1; (+) strand; PAM type: YTN; PAM sequence: CTG
ttctttgaacaaatccagac

SEQ ID NO: 289792 - DNA, 20 bp, Artificial Sequence
  Description of Artificial Sequence: Synthetic oligonucleotide
  Target: ATXN1; (+) strand; PAM type: YTN; PAM sequence: TTC
tttgaacaaatccagacttg

SEQ ID NO: 289793 - DNA, 20 bp, Artificial Sequence
  Description of Artificial Sequence: Synthetic oligonucleotide
  Target: ATXN1; (+) strand; PAM type: YTN; PAM sequence: CTT
tgaacaaatccagacttgaa

SEQ ID NO: 289794 - DNA, 20 bp, Artificial Sequence
  Description of Artificial Sequence: Synthetic oligonucleotide
  Target: ATXN1; (+) strand; PAM type: YTN; PAM sequence: TTT
gaacaaatccagacttgaag

SEQ ID NO: 289795 - DNA, 20 bp, Artificial Sequence
  Description of Artificial Sequence: Synthetic oligonucleotide
  Target: ATXN1; (+) strand; PAM type: YTN; PAM sequence: TTG
aacaaatccagacttgaaga

SEQ ID NO: 289796 - DNA, 20 bp, Artificial Sequence
  Description of Artificial Sequence: Synthetic oligonucleotide
  Target: ATXN1; (+) strand; PAM type: YTN; PAM sequence: CTT
gaagaaatttccattctgtt

SEQ ID NO: 289797 - DNA, 20 bp, Artificial Sequence
  Description of Artificial Sequence: Synthetic oligonucleotide
  Target: ATXN1; (+) strand; PAM type: YTN; PAM sequence: TTG
aagaaatttccattctgtta

SEQ ID NO: 289798 - DNA, 20 bp, Artificial Sequence
  Description of Artificial Sequence: Synthetic oligonucleotide
  Target: ATXN1; (+) strand; PAM type: YTN; PAM sequence: TTT
ccattctgttaaatttctag

SEQ ID NO: 289799 - DNA, 20 bp, Artificial Sequence
  Description of Artificial Sequence: Synthetic oligonucleotide
  Target: ATXN1; (+) strand; PAM type: YTN; PAM sequence: TTC
cattctgttaaatttctagc

SEQ ID NO: 289800 - DNA, 20 bp, Artificial Sequence
  Description of Artificial Sequence: Synthetic oligonucleotide
  Target: ATXN1; (+) strand; PAM type: YTN; PAM sequence: TTC
tgttaaatttctagccaact

SEQ ID NO: 289801 - DNA, 20 bp, Artificial Sequence
  Description of Artificial Sequence: Synthetic oligonucleotide
  Target: ATXN1; (+) strand; PAM type: YTN; PAM sequence: CTG
ttaaatttctagccaactca

SEQ ID NO: 289802 - DNA, 20 bp, Artificial Sequence
  Description of Artificial Sequence: Synthetic oligonucleotide
  Target: ATXN1; (+) strand; PAM type: YTN; PAM sequence: TTA
aatttctagccaactcatca

SEQ ID NO: 289803 - DNA, 20 bp, Artificial Sequence
  Description of Artificial Sequence: Synthetic oligonucleotide
  Target: ATXN1; (+) strand; PAM type: YTN; PAM sequence: TTT
ctagccaactcatcacaatc

SEQ ID NO: 289804 - DNA, 20 bp, Artificial Sequence
  Description of Artificial Sequence: Synthetic oligonucleotide
  Target: ATXN1; (+) strand; PAM type: YTN; PAM sequence: TTC
tagccaactcatcacaatca

SEQ ID NO: 289805 - DNA, 20 bp, Artificial Sequence
  Description of Artificial Sequence: Synthetic oligonucleotide
  Target: ATXN1; (+) strand; PAM type: YTN; PAM sequence: CTA
gccaactcatcacaatcaac

SEQ ID NO: 289806 - DNA, 20 bp, Artificial Sequence
  Description of Artificial Sequence: Synthetic oligonucleotide
  Target: ATXN1; (+) strand; PAM type: YTN; PAM sequence: CTC
atcacaatcaactacgcaag

SEQ ID NO: 289807 - DNA, 20 bp, Artificial Sequence
  Description of Artificial Sequence: Synthetic oligonucleotide
  Target: ATXN1; (+) strand; PAM type: YTN; PAM sequence: CTA
cgcaagcaaacaatacccca

SEQ ID NO: 289808 - DNA, 20 bp, Artificial Sequence
  Description of Artificial Sequence: Synthetic oligonucleotide
  Target: ATXN1; (+) strand; PAM type: YTN; PAM sequence: TTG
ctggctccaggaagcaaaat

SEQ ID NO: 289809 - DNA, 20 bp, Artificial Sequence
  Description of Artificial Sequence: Synthetic oligonucleotide
  Target: ATXN1; (+) strand; PAM type: YTN; PAM sequence: CTG
gctccaggaagcaaaatgaa

SEQ ID NO: 289810 - DNA, 20 bp, Artificial Sequence
  Description of Artificial Sequence: Synthetic oligonucleotide
  Target: ATXN1; (+) strand; PAM type: YTN; PAM sequence: CTC
caggaagcaaaatgaagaca

SEQ ID NO: 289811 - DNA, 20 bp, Artificial Sequence
  Description of Artificial Sequence: Synthetic oligonucleotide
  Target: ATXN1; (+) strand; PAM type: YTN; PAM sequence: TTT
aaattaaagcaaacatgctt

SEQ ID NO: 289812 - DNA, 20 bp, Artificial Sequence
  Description of Artificial Sequence: Synthetic oligonucleotide
  Target: ATXN1; (+) strand; PAM type: YTN; PAM sequence: TTA
aattaaagcaaacatgctta

SEQ ID NO: 289813 - DNA, 20 bp, Artificial Sequence
  Description of Artificial Sequence: Synthetic oligonucleotide
  Target: ATXN1; (+) strand; PAM type: YTN; PAM sequence: TTA
aagcaaacatgcttacaaaa

SEQ ID NO: 289814 - DNA, 20 bp, Artificial Sequence
  Description of Artificial Sequence: Synthetic oligonucleotide
  Target: ATXN1; (+) strand; PAM type: YTN; PAM sequence: CTT
acaaaaatattctggctatc

SEQ ID NO: 289815 - DNA, 20 bp, Artificial Sequence
  Description of Artificial Sequence: Synthetic oligonucleotide
  Target: ATXN1; (+) strand; PAM type: YTN; PAM sequence: TTA
caaaaatattctggctatct

SEQ ID NO: 289816 - DNA, 20 bp, Artificial Sequence
  Description of Artificial Sequence: Synthetic oligonucleotide
  Target: ATXN1; (+) strand; PAM type: YTN; PAM sequence: TTC
tggctatctcaattaatctg

SEQ ID NO: 289817 - DNA, 20 bp, Artificial Sequence
  Description of Artificial Sequence: Synthetic oligonucleotide
  Target: ATXN1; (+) strand; PAM type: YTN; PAM sequence: CTG
gctatctcaattaatctgaa

SEQ ID NO: 289818 - DNA, 20 bp, Artificial Sequence
  Description of Artificial Sequence: Synthetic oligonucleotide
  Target: ATXN1; (+) strand; PAM type: YTN; PAM sequence: CTA
tctcaattaatctgaaccaa

SEQ ID NO: 289819 - DNA, 20 bp, Artificial Sequence
  Description of Artificial Sequence: Synthetic oligonucleotide
  Target: ATXN1; (+) strand; PAM type: YTN; PAM sequence: CTC
aattaatctgaaccaaacta

SEQ ID NO: 289820 - DNA, 20 bp, Artificial Sequence
  Description of Artificial Sequence: Synthetic oligonucleotide
  Target: ATXN1; (+) strand; PAM type: YTN; PAM sequence: TTA
atctgaaccaaactaagaat

SEQ ID NO: 289821 - DNA, 20 bp, Artificial Sequence
  Description of Artificial Sequence: Synthetic oligonucleotide
  Target: ATXN1; (+) strand; PAM type: YTN; PAM sequence: CTG
aaccaaactaagaataatct

SEQ ID NO: 289822 - DNA, 20 bp, Artificial Sequence
  Description of Artificial Sequence: Synthetic oligonucleotide
  Target: ATXN1; (+) strand; PAM type: YTN; PAM sequence: CTA
agaataatctagatatttcc

SEQ ID NO: 289823 - DNA, 20 bp, Artificial Sequence
  Description of Artificial Sequence: Synthetic oligonucleotide
  Target: ATXN1; (+) strand; PAM type: YTN; PAM sequence: CTA
gatatttcccccaatcttct

SEQ ID NO: 289824 - DNA, 20 bp, Artificial Sequence
  Description of Artificial Sequence: Synthetic oligonucleotide
  Target: ATXN1; (+) strand; PAM type: YTN; PAM sequence: TTT
cccccaatcttctgttccca

SEQ ID NO: 289825 - DNA, 20 bp, Artificial Sequence
  Description of Artificial Sequence: Synthetic oligonucleotide
  Target: ATXN1; (+) strand; PAM type: YTN; PAM sequence: TTC
ccccaatcttctgttcccat

SEQ ID NO: 289826 - DNA, 20 bp, Artificial Sequence
  Description of Artificial Sequence: Synthetic oligonucleotide
  Target: ATXN1; (+) strand; PAM type: YTN; PAM sequence: CTT
ctgttcccatttagttcatg

SEQ ID NO: 289827 - DNA, 20 bp, Artificial Sequence
  Description of Artificial Sequence: Synthetic oligonucleotide
  Target: ATXN1; (+) strand; PAM type: YTN; PAM sequence: TTC
tgttcccatttagttcatgg

SEQ ID NO: 289828 - DNA, 20 bp, Artificial Sequence
  Description of Artificial Sequence: Synthetic oligonucleotide
  Target: ATXN1; (+) strand; PAM type: YTN; PAM sequence: CTG
ttcccatttagttcatggca

SEQ ID NO: 289829 - DNA, 20 bp, Artificial Sequence
  Description of Artificial Sequence: Synthetic oligonucleotide
  Target: ATXN1; (+) strand; PAM type: YTN; PAM sequence: TTC
ccatttagttcatggcattt

SEQ ID NO: 289830 - DNA, 20 bp, Artificial Sequence
  Description of Artificial Sequence: Synthetic oligonucleotide
  Target: ATXN1; (+) strand; PAM type: YTN; PAM sequence: TTT
agttcatggcatttttataa

SEQ ID NO: 289831 - DNA, 20 bp, Artificial Sequence
  Description of Artificial Sequence: Synthetic oligonucleotide
  Target: ATXN1; (+) strand; PAM type: YTN; PAM sequence: TTA
gttcatggcatttttataac

SEQ ID NO: 289832 - DNA, 20 bp, Artificial Sequence
  Description of Artificial Sequence: Synthetic oligonucleotide
  Target: ATXN1; (+) strand; PAM type: YTN; PAM sequence: TTC
atggcatttttataacggga

SEQ ID NO: 289833 - DNA, 20 bp, Artificial Sequence
  Description of Artificial Sequence: Synthetic oligonucleotide
  Target: ATXN1; (+) strand; PAM type: YTN; PAM sequence: TTT
ttataacgggacttgccaga

SEQ ID NO: 289834 - DNA, 20 bp, Artificial Sequence
  Description of Artificial Sequence: Synthetic oligonucleotide
  Target: ATXN1; (+) strand; PAM type: YTN; PAM sequence: TTT
tataacgggacttgccagat

SEQ ID NO: 289835 - DNA, 20 bp, Artificial Sequence
  Description of Artificial Sequence: Synthetic oligonucleotide
  Target: ATXN1; (+) strand; PAM type: YTN; PAM sequence: TTT
ataacgggacttgccagata

SEQ ID NO: 289836 - DNA, 20 bp, Artificial Sequence
  Description of Artificial Sequence: Synthetic oligonucleotide
  Target: ATXN1; (+) strand; PAM type: YTN; PAM sequence: TTA
taacgggacttgccagataa

SEQ ID NO: 289837 - DNA, 20 bp, Artificial Sequence
  Description of Artificial Sequence: Synthetic oligonucleotide
  Target: ATXN1; (+) strand; PAM type: YTN; PAM sequence: CTT
gccagataagaagcatgtgt

SEQ ID NO: 289838 - DNA, 20 bp, Artificial Sequence
  Description of Artificial Sequence: Synthetic oligonucleotide
  Target: ATXN1; (+) strand; PAM type: YTN; PAM sequence: TTG
ccagataagaagcatgtgtg

SEQ ID NO: 289839 - DNA, 20 bp, Artificial Sequence
  Description of Artificial Sequence: Synthetic oligonucleotide
  Target: ATXN1; (+) strand; PAM type: YTN; PAM sequence: CTG
agaactaaggaaaaaaggat

SEQ ID NO: 289840 - DNA, 20 bp, Artificial Sequence
  Description of Artificial Sequence: Synthetic oligonucleotide
  Target: ATXN1; (+) strand; PAM type: YTN; PAM sequence: CTA
aggaaaaaaggattggtttt

SEQ ID NO: 289841 - DNA, 20 bp, Artificial Sequence
  Description of Artificial Sequence: Synthetic oligonucleotide
  Target: ATXN1; (+) strand; PAM type: YTN; PAM sequence: TTG
gttttactgtctcttcaaaa

SEQ ID NO: 289842 - DNA, 20 bp, Artificial Sequence
  Description of Artificial Sequence: Synthetic oligonucleotide
  Target: ATXN1; (+) strand; PAM type: YTN; PAM sequence: TTT
tactgtctcttcaaaaacat

SEQ ID NO: 289843 - DNA, 20 bp, Artificial Sequence
  Description of Artificial Sequence: Synthetic oligonucleotide
  Target: ATXN1; (+) strand; PAM type: YTN; PAM sequence: TTT
actgtctcttcaaaaacata

SEQ ID NO: 289844 - DNA, 20 bp, Artificial Sequence
  Description of Artificial Sequence: Synthetic oligonucleotide
  Target: ATXN1; (+) strand; PAM type: YTN; PAM sequence: TTA
ctgtctcttcaaaaacatat

SEQ ID NO: 289845 - DNA, 20 bp, Artificial Sequence
  Description of Artificial Sequence: Synthetic oligonucleotide
  Target: ATXN1; (+) strand; PAM type: YTN; PAM sequence: CTG
tctcttcaaaaacatatccg

SEQ ID NO: 289846 - DNA, 20 bp, Artificial Sequence
  Description of Artificial Sequence: Synthetic oligonucleotide
  Target: ATXN1; (+) strand; PAM type: YTN; PAM sequence: CTC
ttcaaaaacatatccgatgt

SEQ ID NO: 289847 - DNA, 20 bp, Artificial Sequence
  Description of Artificial Sequence: Synthetic oligonucleotide
  Target: ATXN1; (+) strand; PAM type: YTN; PAM sequence: CTT
caaaaacatatccgatgtga

SEQ ID NO: 289848 - DNA, 20 bp, Artificial Sequence
  Description of Artificial Sequence: Synthetic oligonucleotide
  Target: ATXN1; (+) strand; PAM type: YTN; PAM sequence: TTC
aaaaacatatccgatgtgaa

SEQ ID NO: 289849 - DNA, 20 bp, Artificial Sequence
  Description of Artificial Sequence: Synthetic oligonucleotide
  Target: ATXN1; (+) strand; PAM type: YTN; PAM sequence: CTA
aaaaccattcaattctgcag

SEQ ID NO: 289850 - DNA, 20 bp, Artificial Sequence
  Description of Artificial Sequence: Synthetic oligonucleotide
  Target: ATXN1; (+) strand; PAM type: YTN; PAM sequence: TTC
aattctgcagtttgtgaatt

SEQ ID NO: 289851 - DNA, 20 bp, Artificial Sequence
  Description of Artificial Sequence: Synthetic oligonucleotide
  Target: ATXN1; (+) strand; PAM type: YTN; PAM sequence: TTC
tgcagtttgtgaattatatc

SEQ ID NO: 289852 - DNA, 20 bp, Artificial Sequence
  Description of Artificial Sequence: Synthetic oligonucleotide
  Target: ATXN1; (+) strand; PAM type: YTN; PAM sequence: CTG
cagtttgtgaattatatccc

SEQ ID NO: 289853 - DNA, 20 bp, Artificial Sequence
  Description of Artificial Sequence: Synthetic oligonucleotide
  Target: ATXN1; (+) strand; PAM type: YTN; PAM sequence: TTT
gtgaattatatccccagaaa

SEQ ID NO: 289854 - DNA, 20 bp, Artificial Sequence
  Description of Artificial Sequence: Synthetic oligonucleotide
  Target: ATXN1; (+) strand; PAM type: YTN; PAM sequence: TTG
tgaattatatccccagaaag

SEQ ID NO: 289855 - DNA, 20 bp, Artificial Sequence
  Description of Artificial Sequence: Synthetic oligonucleotide
  Target: ATXN1; (+) strand; PAM type: YTN; PAM sequence: TTA
tatccccagaaagctggtat

SEQ ID NO: 289856 - DNA, 20 bp, Artificial Sequence
  Description of Artificial Sequence: Synthetic oligonucleotide
  Target: ATXN1; (+) strand; PAM type: YTN; PAM sequence: CTG
gtattaataatatagcagct

SEQ ID NO: 289857 - DNA, 20 bp, Artificial Sequence
  Description of Artificial Sequence: Synthetic oligonucleotide
  Target: ATXN1; (+) strand; PAM type: YTN; PAM sequence: TTA
ataatatagcagctaagtga

SEQ ID NO: 289858 - DNA, 20 bp, Artificial Sequence
  Description of Artificial Sequence: Synthetic oligonucleotide
  Target: ATXN1; (+) strand; PAM type: YTN; PAM sequence: CTA
agtgaaataagccagtcata

SEQ ID NO: 289859 - DNA, 20 bp, Artificial Sequence
  Description of Artificial Sequence: Synthetic oligonucleotide
  Target: ATXN1; (+) strand; PAM type: YTN; PAM sequence: CTG
tatgattcaccctctatgag

SEQ ID NO: 289860 - DNA, 20 bp, Artificial Sequence
  Description of Artificial Sequence: Synthetic oligonucleotide
  Target: ATXN1; (+) strand; PAM type: YTN; PAM sequence: TTC
accctctatgaggtatctag

SEQ ID NO: 289861 - DNA, 20 bp, Artificial Sequence
  Description of Artificial Sequence: Synthetic oligonucleotide
  Target: ATXN1; (+) strand; PAM type: YTN; PAM sequence: CTC
tatgaggtatctagagtaga

SEQ ID NO: 289862 - DNA, 20 bp, Artificial Sequence
  Description of Artificial Sequence: Synthetic oligonucleotide
  Target: ATXN1; (+) strand; PAM type: YTN; PAM sequence: CTA
tgaggtatctagagtagaca

SEQ ID NO: 289863 - DNA, 20 bp, Artificial Sequence
  Description of Artificial Sequence: Synthetic oligonucleotide
  Target: ATXN1; (+) strand; PAM type: YTN; PAM sequence: CTA
gagtagacattgtcatagaa

SEQ ID NO: 289864 - DNA, 20 bp, Artificial Sequence
  Description of Artificial Sequence: Synthetic oligonucleotide
  Target: ATXN1; (+) strand; PAM type: YTN; PAM sequence: TTG
tcatagaaatggaaaagcag

SEQ ID NO: 289865 - DNA, 20 bp, Artificial Sequence
  Description of Artificial Sequence: Synthetic oligonucleotide
  Target: ATXN1; (+) strand; PAM type: YTN; PAM sequence: TTG
ccaagggcttgggggagaag

SEQ ID NO: 289866 - DNA, 20 bp, Artificial Sequence
  Description of Artificial Sequence: Synthetic oligonucleotide
  Target: ATXN1; (+) strand; PAM type: YTN; PAM sequence: CTT
gggggagaagggaaaagaag

SEQ ID NO: 289867 - DNA, 20 bp, Artificial Sequence
  Description of Artificial Sequence: Synthetic oligonucleotide
  Target: ATXN1; (+) strand; PAM type: YTN; PAM sequence: TTG
ggggagaagggaaaagaaga

SEQ ID NO: 289868 - DNA, 20 bp, Artificial Sequence
  Description of Artificial Sequence: Synthetic oligonucleotide
  Target: ATXN1; (+) strand; PAM type: YTN; PAM sequence: TTG
ctatttaatgggtagaattt

SEQ ID NO: 289869 - DNA, 20 bp, Artificial Sequence
  Description of Artificial Sequence: Synthetic oligonucleotide
  Target: ATXN1; (+) strand; PAM type: YTN; PAM sequence: CTA
tttaatgggtagaatttcaa

SEQ ID NO: 289870 - DNA, 20 bp, Artificial Sequence
  Description of Artificial Sequence: Synthetic oligonucleotide
  Target: ATXN1; (+) strand; PAM type: YTN; PAM sequence: TTT
aatgggtagaatttcaattt

SEQ ID NO: 289871 - DNA, 20 bp, Artificial Sequence
  Description of Artificial Sequence: Synthetic oligonucleotide
  Target: ATXN1; (+) strand; PAM type: YTN; PAM sequence: TTA
atgggtagaatttcaatttt

SEQ ID NO: 289872 - DNA, 20 bp, Artificial Sequence
  Description of Artificial Sequence: Synthetic oligonucleotide
  Target: ATXN1; (+) strand; PAM type: YTN; PAM sequence: TTT
caattttgcaaaataaaaag

SEQ ID NO: 289873 - DNA, 20 bp, Artificial Sequence
  Description of Artificial Sequence: Synthetic oligonucleotide
  Target: ATXN1; (+) strand; PAM type: YTN; PAM sequence: TTC
aattttgcaaaataaaaaga

SEQ ID NO: 289874 - DNA, 20 bp, Artificial Sequence
  Description of Artificial Sequence: Synthetic oligonucleotide
  Target: ATXN1; (+) strand; PAM type: YTN; PAM sequence: TTT
tgcaaaataaaaagagttct

SEQ ID NO: 289875 - DNA, 20 bp, Artificial Sequence
  Description of Artificial Sequence: Synthetic oligonucleotide
  Target: ATXN1; (+) strand; PAM type: YTN; PAM sequence: TTT
gcaaaataaaaagagttctg

SEQ ID NO: 289876 - DNA, 20 bp, Artificial Sequence
  Description of Artificial Sequence: Synthetic oligonucleotide
  Target: ATXN1; (+) strand; PAM type: YTN; PAM sequence: TTG
caaaataaaaagagttctgg

SEQ ID NO: 289877 - DNA, 20 bp, Artificial Sequence
  Description of Artificial Sequence: Synthetic oligonucleotide
  Target: ATXN1; (+) strand; PAM type: YTN; PAM sequence: TTC
tgggttgggcgtggtggctc

SEQ ID NO: 289878 - DNA, 20 bp, Artificial Sequence
  Description of Artificial Sequence: Synthetic oligonucleotide
  Target: ATXN1; (+) strand; PAM type: YTN; PAM sequence: CTG
ggttgggcgtggtggctcgc

SEQ ID NO: 289879 - DNA, 20 bp, Artificial Sequence
  Description of Artificial Sequence: Synthetic oligonucleotide
  Target: ATXN1; (+) strand; PAM type: YTN; PAM sequence: TTG
ggcgtggtggctcgcacctg

SEQ ID NO: 289880 - DNA, 20 bp, Artificial Sequence
  Description of Artificial Sequence: Synthetic oligonucleotide
  Target: ATXN1; (+) strand; PAM type: YTN; PAM sequence: CTC
gcacctgtaatcccagcact

SEQ ID NO: 289881 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 289882 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggtgggcag

SEQ ID NO: 289883 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggtgggcaga

SEQ ID NO: 289884 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggtgggcagat

SEQ ID NO: 289885 - DNA, 20 bp, Artificial Sequence
  Description of Artificial Sequence: Synthetic oligonucleotide
  Target: ATXN1; (+) strand; PAM type: YTN; PAM sequence: CTG
aggtcaggagtttgagacca

SEQ ID NO: 289886 - DNA, 20 bp, Artificial Sequence
  Description of Artificial Sequence: Synthetic oligonucleotide
  Target: ATXN1; (+) strand; PAM type: YTN; PAM sequence: TTT
gagaccaacctggccaacat

SEQ ID NO: 289887 - DNA, 20 bp, Artificial Sequence
  Description of Artificial Sequence: Synthetic oligonucleotide
  Target: ATXN1; (+) strand; PAM type: YTN; PAM sequence: TTG
agaccaacctggccaacatg

SEQ ID NO: 289888 - DNA, 20 bp, Artificial Sequence
  Description of Artificial Sequence: Synthetic oligonucleotide
  Target: ATXN1; (+) strand; PAM type: YTN; PAM sequence: CTG
gccaacatggtgaaaccctg

SEQ ID NO: 289889 - DNA, 20 bp, Artificial Sequence
  Description of Artificial Sequence: Synthetic oligonucleotide
  Target: ATXN1; (+) strand; PAM type: YTN; PAM sequence: CTG
tctctactaaaaatacagaa

SEQ ID NO: 289890 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacagaaatta

SEQ ID NO: 289891 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacagaaattagc

SEQ ID NO: 289892 - DNA, 20 bp, Artificial Sequence
  Description of Artificial Sequence: Synthetic oligonucleotide
  Target: ATXN1; (+) strand; PAM type: YTN; PAM sequence: CTA
aaaatacagaaattagccag

SEQ ID NO: 289893 - DNA, 20 bp, Artificial Sequence
  Description of Artificial Sequence: Synthetic oligonucleotide
  Target: ATXN1; (+) strand; PAM type: YTN; PAM sequence: TTA
gccaggcgtcgtggcaggtt

SEQ ID NO: 289894 - DNA, 20 bp, Artificial Sequence
  Description of Artificial Sequence: Synthetic oligonucleotide
  Target: ATXN1; (+) strand; PAM type: YTN; PAM sequence: TTC
ctgtaatcccagctacttgg

SEQ ID NO: 289895 - DNA, 20 bp, Artificial Sequence
  Description of Artificial Sequence: Synthetic oligonucleotide
  Target: ATXN1; (+) strand; PAM type: YTN; PAM sequence: CTG
taatcccagctacttgggag

SEQ ID NO: 289896 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctggggcagga

SEQ ID NO: 289897 - DNA, 20 bp, Artificial Sequence
  Description of Artificial Sequence: Synthetic oligonucleotide
  Target: ATXN1; (+) strand; PAM type: YTN; PAM sequence: CTT
gggaggctggggcaggagga

SEQ ID NO: 289898 - DNA, 20 bp, Artificial Sequence
  Description of Artificial Sequence: Synthetic oligonucleotide
  Target: ATXN1; (+) strand; PAM type: YTN; PAM sequence: TTG
ggaggctggggcaggaggat

SEQ ID NO: 289899 - DNA, 20 bp, Artificial Sequence
  Description of Artificial Sequence: Synthetic oligonucleotide
  Target: ATXN1; (+) strand; PAM type: YTN; PAM sequence: CTG
gggcaggaggatcacttgaa

SEQ ID NO: 289900 - DNA, 20 bp, Artificial Sequence
  Description of Artificial Sequence: Synthetic oligonucleotide
  Target: ATXN1; (+) strand; PAM type: YTN; PAM sequence: CTT
gaacccaggaagcagaggtt

SEQ ID NO: 289901 - DNA, 20 bp, Artificial Sequence
  Description of Artificial Sequence: Synthetic oligonucleotide
  Target: ATXN1; (+) strand; PAM type: YTN; PAM sequence: TTG
aacccaggaagcagaggttg

SEQ ID NO: 289902 - DNA, 20 bp, Artificial Sequence
  Description of Artificial Sequence: Synthetic oligonucleotide
  Target: ATXN1; (+) strand; PAM type: YTN; PAM sequence: TTG
cagtgaactgagatcacacc

SEQ ID NO: 289903 - DNA, 20 bp, Artificial Sequence
  Description of Artificial Sequence: Synthetic oligonucleotide
  Target: ATXN1; (+) strand; PAM type: YTN; PAM sequence: CTG
agatcacaccatcacactcc

SEQ ID NO: 289904 - DNA, 20 bp, Artificial Sequence
  Description of Artificial Sequence: Synthetic oligonucleotide
  Target: ATXN1; (+) strand; PAM type: YTN; PAM sequence: CTC
cagcctgggggatgagagcg

SEQ ID NO: 289905 - DNA, 20 bp, Artificial Sequence
  Description of Artificial Sequence: Synthetic oligonucleotide
  Target: ATXN1; (+) strand; PAM type: YTN; PAM sequence: CTG
ggggatgagagcgagacttt

SEQ ID NO: 289906 - DNA, 20 bp, Artificial Sequence
  Description of Artificial Sequence: Synthetic oligonucleotide
  Target: ATXN1; (+) strand; PAM type: YTN; PAM sequence: CTT
tgtctcaagaaaaaaaaaaa

SEQ ID NO: 289907 - DNA, 20 bp, Artificial Sequence
  Description of Artificial Sequence: Synthetic oligonucleotide
  Target: ATXN1; (+) strand; PAM type: YTN; PAM sequence: TTT
gtctcaagaaaaaaaaaaaa

SEQ ID NO: 289908 - DNA, 20 bp, Artificial Sequence
  Description of Artificial Sequence: Synthetic oligonucleotide
  Target: ATXN1; (+) strand; PAM type: YTN; PAM sequence: TTG
tctcaagaaaaaaaaaaaaa

SEQ ID NO: 289909 - DNA, 20 bp, Artificial Sequence
  Description of Artificial Sequence: Synthetic oligonucleotide
  Target: ATXN1; (+) strand; PAM type: YTN; PAM sequence: CTC
aagaaaaaaaaaaaaaaaaa

SEQ ID NO: 289910 - DNA, 20 bp, Artificial Sequence
  Description of Artificial Sequence: Synthetic oligonucleotide
  Target: ATXN1; (+) strand; PAM type: YTN; PAM sequence: TTC
tggagatggatggtggtgac

SEQ ID NO: 289911 - DNA, 20 bp, Artificial Sequence
  Description of Artificial Sequence: Synthetic oligonucleotide
  Target: ATXN1; (+) strand; PAM type: YTN; PAM sequence: CTG
gagatggatggtggtgacag

SEQ ID NO: 289912 - DNA, 20 bp, Artificial Sequence
  Description of Artificial Sequence: Synthetic oligonucleotide
  Target: ATXN1; (+) strand; PAM type: YTN; PAM sequence: TTG
tacaacaatgtgaattcagt

SEQ ID NO: 289913 - DNA, 20 bp, Artificial Sequence
  Description of Artificial Sequence: Synthetic oligonucleotide
  Target: ATXN1; (+) strand; PAM type: YTN; PAM sequence: TTC
agttaataccactgaatgta

SEQ ID NO: 289914 - DNA, 20 bp, Artificial Sequence
  Description of Artificial Sequence: Synthetic oligonucleotide
  Target: ATXN1; (+) strand; PAM type: YTN; PAM sequence: TTA
ataccactgaatgtacactt

SEQ ID NO: 289915 - DNA, 20 bp, Artificial Sequence
  Description of Artificial Sequence: Synthetic oligonucleotide
  Target: ATXN1; (+) strand; PAM type: YTN; PAM sequence: CTG
aatgtacacttgatggtgaa

SEQ ID NO: 289916 - DNA, 20 bp, Artificial Sequence
  Description of Artificial Sequence: Synthetic oligonucleotide
  Target: ATXN1; (+) strand; PAM type: YTN; PAM sequence: CTT
gatggtgaagacggtcaatt

SEQ ID NO: 289917 - DNA, 20 bp, Artificial Sequence
  Description of Artificial Sequence: Synthetic oligonucleotide
  Target: ATXN1; (+) strand; PAM type: YTN; PAM sequence: TTG
atggtgaagacggtcaattt

SEQ ID NO: 289918 - DNA, 20 bp, Artificial Sequence
  Description of Artificial Sequence: Synthetic oligonucleotide
  Target: ATXN1; (+) strand; PAM type: YTN; PAM sequence: TTT
tatagtgtatgccttttgcc

SEQ ID NO: 289919 - DNA, 20 bp, Artificial Sequence
  Description of Artificial Sequence: Synthetic oligonucleotide
  Target: ATXN1; (+) strand; PAM type: YTN; PAM sequence: TTT
atagtgtatgccttttgcca

SEQ ID NO: 289920 - DNA, 20 bp, Artificial Sequence
  Description of Artificial Sequence: Synthetic oligonucleotide
  Target: ATXN1; (+) strand; PAM type: YTN; PAM sequence: TTA
tagtgtatgccttttgccac

SEQ ID NO: 289921 - DNA, 20 bp, Artificial Sequence
  Description of Artificial Sequence: Synthetic oligonucleotide
  Target: ATXN1; (+) strand; PAM type: YTN; PAM sequence: CTT
ttgccacaatgtatggttta

SEQ ID NO: 289922 - DNA, 20 bp, Artificial Sequence
  Description of Artificial Sequence: Synthetic oligonucleotide
  Target: ATXN1; (+) strand; PAM type: YTN; PAM sequence: TTT
tgccacaatgtatggtttat

SEQ ID NO: 289923 - DNA, 20 bp, Artificial Sequence
  Description of Artificial Sequence: Synthetic oligonucleotide
  Target: ATXN1; (+) strand; PAM type: YTN; PAM sequence: TTT
gccacaatgtatggtttatt

SEQ ID NO: 289924 - DNA, 20 bp, Artificial Sequence
  Description of Artificial Sequence: Synthetic oligonucleotide
  Target: ATXN1; (+) strand; PAM type: YTN; PAM sequence: TTG
ccacaatgtatggtttattt

SEQ ID NO: 289925 - DNA, 20 bp, Artificial Sequence
  Description of Artificial Sequence: Synthetic oligonucleotide
  Target: ATXN1; (+) strand; PAM type: YTN; PAM sequence: TTT
atttatttacttaaaagcaa

SEQ ID NO: 289926 - DNA, 20 bp, Artificial Sequence
  Description of Artificial Sequence: Synthetic oligonucleotide
  Target: ATXN1; (+) strand; PAM type: YTN; PAM sequence: TTA
tttatttacttaaaagcaaa

SEQ ID NO: 289927 - DNA, 20 bp, Artificial Sequence
  Description of Artificial Sequence: Synthetic oligonucleotide
  Target: ATXN1; (+) strand; PAM type: YTN; PAM sequence: TTT
atttacttaaaagcaaaagt

SEQ ID NO: 289928 - DNA, 20 bp, Artificial Sequence
  Description of Artificial Sequence: Synthetic oligonucleotide
  Target: ATXN1; (+) strand; PAM type: YTN; PAM sequence: TTA
tttacttaaaagcaaaagtg

SEQ ID NO: 289929 - DNA, 20 bp, Artificial Sequence
  Description of Artificial Sequence: Synthetic oligonucleotide
  Target: ATXN1; (+) strand; PAM type: YTN; PAM sequence: TTT
acttaaaagcaaaagtggcg

SEQ ID NO: 289930 - DNA, 20 bp, Artificial Sequence
  Description of Artificial Sequence: Synthetic oligonucleotide
  Target: ATXN1; (+) strand; PAM type: YTN; PAM sequence: TTA
cttaaaagcaaaagtggcgg

SEQ ID NO: 289931 - DNA, 20 bp, Artificial Sequence
  Description of Artificial Sequence: Synthetic oligonucleotide
  Target: ATXN1; (+) strand; PAM type: YTN; PAM sequence: CTT
aaaagcaaaagtggcggtgt

SEQ ID NO: 289932 - DNA, 20 bp, Artificial Sequence
  Description of Artificial Sequence: Synthetic oligonucleotide
  Target: ATXN1; (+) strand; PAM type: YTN; PAM sequence: TTA
aaagcaaaagtggcggtgtt

SEQ ID NO: 289933 - DNA, 20 bp, Artificial Sequence
  Description of Artificial Sequence: Synthetic oligonucleotide
  Target: ATXN1; (+) strand; PAM type: YTN; PAM sequence: TTT
tgtttcagtattaggtcggg

SEQ ID NO: 289934 - DNA, 20 bp, Artificial Sequence
  Description of Artificial Sequence: Synthetic oligonucleotide
  Target: ATXN1; (+) strand; PAM type: YTN; PAM sequence: TTT
gtttcagtattaggtcgggt

SEQ ID NO: 289935 - DNA, 20 bp, Artificial Sequence
  Description of Artificial Sequence: Synthetic oligonucleotide
  Target: ATXN1; (+) strand; PAM type: YTN; PAM sequence: TTG
tttcagtattaggtcgggtt

SEQ ID NO: 289936 - DNA, 20 bp, Artificial Sequence
  Description of Artificial Sequence: Synthetic oligonucleotide
  Target: ATXN1; (+) strand; PAM type: YTN; PAM sequence: TTT
cagtattaggtcgggttcaa

SEQ ID NO: 289937 - DNA, 20 bp, Artificial Sequence
  Description of Artificial Sequence: Synthetic oligonucleotide
  Target: ATXN1; (+) strand; PAM type: YTN; PAM sequence: TTC
agtattaggtcgggttcaag

SEQ ID NO: 289938 - DNA, 20 bp, Artificial Sequence
  Description of Artificial Sequence: Synthetic oligonucleotide
  Target: ATXN1; (+) strand; PAM type: YTN; PAM sequence: TTA
ggtcgggttcaagcaaacag

SEQ ID NO: 289939 - DNA, 20 bp, Artificial Sequence
  Description of Artificial Sequence: Synthetic oligonucleotide
  Target: ATXN1; (+) strand; PAM type: YTN; PAM sequence: TTC
aagcaaacagaagggttatt

SEQ ID NO: 289940 - DNA, 20 bp, Artificial Sequence
  Description of Artificial Sequence: Synthetic oligonucleotide
  Target: ATXN1; (+) strand; PAM type: YTN; PAM sequence: TTA
ttccttcataatcatataca

SEQ ID NO: 289941 - DNA, 20 bp, Artificial Sequence
  Description of Artificial Sequence: Synthetic oligonucleotide
  Target: ATXN1; (+) strand; PAM type: YTN; PAM sequence: TTC
cttcataatcatatacattc

SEQ ID NO: 289942 - DNA, 20 bp, Artificial Sequence
  Description of Artificial Sequence: Synthetic oligonucleotide
  Target: ATXN1; (+) strand; PAM type: YTN; PAM sequence: CTT
cataatcatatacattctgc

SEQ ID NO: 289943 - DNA, 20 bp, Artificial Sequence
  Description of Artificial Sequence: Synthetic oligonucleotide
  Target: ATXN1; (+) strand; PAM type: YTN; PAM sequence: TTC
ataatcatatacattctgca

SEQ ID NO: 289944 - DNA, 20 bp, Artificial Sequence
  Description of Artificial Sequence: Synthetic oligonucleotide
  Target: ATXN1; (+) strand; PAM type: YTN; PAM sequence: TTC
tgcaccatagattgagcatt

SEQ ID NO: 289945 - DNA, 20 bp, Artificial Sequence
  Description of Artificial Sequence: Synthetic oligonucleotide
  Target: ATXN1; (+) strand; PAM type: YTN; PAM sequence: CTG
caccatagattgagcattgc

SEQ ID NO: 289946 - DNA, 20 bp, Artificial Sequence
  Description of Artificial Sequence: Synthetic oligonucleotide
  Target: ATXN1; (+) strand; PAM type: YTN; PAM sequence: TTG
agcattgcaccattttttta

SEQ ID NO: 289947 - DNA, 20 bp, Artificial Sequence
  Description of Artificial Sequence: Synthetic oligonucleotide
  Target: ATXN1; (+) strand; PAM type: YTN; PAM sequence: TTG
caccatttttttatttttat

SEQ ID NO: 289948 - DNA, 20 bp, Artificial Sequence
  Description of Artificial Sequence: Synthetic oligonucleotide
  Target: ATXN1; (+) strand; PAM type: YTN; PAM sequence: TTT
ttttatttttataagctata

SEQ ID NO: 289949 - DNA, 20 bp, Artificial Sequence
  Description of Artificial Sequence: Synthetic oligonucleotide
  Target: ATXN1; (+) strand; PAM type: YTN; PAM sequence: TTT
tttatttttataagctatac

SEQ ID NO: 289950 - DNA, 20 bp, Artificial Sequence
  Description of Artificial Sequence: Synthetic oligonucleotide
  Target: ATXN1; (+) strand; PAM type: YTN; PAM sequence: TTT
ttatttttataagctatacc

SEQ ID NO: 289951 - DNA, 20 bp, Artificial Sequence
  Description of Artificial Sequence: Synthetic oligonucleotide
  Target: ATXN1; (+) strand; PAM type: YTN; PAM sequence: TTT
tatttttataagctatacca

SEQ ID NO: 289952 - DNA, 20 bp, Artificial Sequence
  Description of Artificial Sequence: Synthetic oligonucleotide
  Target: ATXN1; (+) strand; PAM type: YTN; PAM sequence: TTT
atttttataagctataccaa

SEQ ID NO: 289953 - DNA, 20 bp, Artificial Sequence
  Description of Artificial Sequence: Synthetic oligonucleotide
  Target: ATXN1; (+) strand; PAM type: YTN; PAM sequence: TTA
tttttataagctataccaaa

SEQ ID NO: 289954 - DNA, 20 bp, Artificial Sequence
  Description of Artificial Sequence: Synthetic oligonucleotide
  Target: ATXN1; (+) strand; PAM type: YTN; PAM sequence: TTT
ttataagctataccaaattt

SEQ ID NO: 289955 - DNA, 20 bp, Artificial Sequence
  Description of Artificial Sequence: Synthetic oligonucleotide
  Target: ATXN1; (+) strand; PAM type: YTN; PAM sequence: TTT
tataagctataccaaatttc

SEQ ID NO: 289956 - DNA, 20 bp, Artificial Sequence
  Description of Artificial Sequence: Synthetic oligonucleotide
  Target: ATXN1; (+) strand; PAM type: YTN; PAM sequence: TTT
ataagctataccaaatttca

SEQ ID NO: 289957 - DNA, 20 bp, Artificial Sequence
  Description of Artificial Sequence: Synthetic oligonucleotide
  Target: ATXN1; (+) strand; PAM type: YTN; PAM sequence: TTA
taagctataccaaatttcag

SEQ ID NO: 289958 - DNA, 20 bp, Artificial Sequence
  Description of Artificial Sequence: Synthetic oligonucleotide
  Target: ATXN1; (+) strand; PAM type: YTN; PAM sequence: CTA
taccaaatttcagtgcacaa

SEQ ID NO: 289959 - DNA, 20 bp, Artificial Sequence
  Description of Artificial Sequence: Synthetic oligonucleotide
  Target: ATXN1; (+) strand; PAM type: YTN; PAM sequence: TTT
cagtgcacaaatgctataac

SEQ ID NO: 289960 - DNA, 20 bp, Artificial Sequence
  Description of Artificial Sequence: Synthetic oligonucleotide
  Target: ATXN1; (+) strand; PAM type: YTN; PAM sequence: TTC
agtgcacaaatgctataaca

SEQ ID NO: 289961 - DNA, 20 bp, Artificial Sequence
  Description of Artificial Sequence: Synthetic oligonucleotide
  Target: ATXN1; (+) strand; PAM type: YTN; PAM sequence: CTA
taacagcacatactgtgggt

SEQ ID NO: 289962 - DNA, 20 bp, Artificial Sequence
  Description of Artificial Sequence: Synthetic oligonucleotide
  Target: ATXN1; (+) strand; PAM type: YTN; PAM sequence: CTG
tgggtgagaatataaaaaat

SEQ ID NO: 289963 - DNA, 20 bp, Artificial Sequence
  Description of Artificial Sequence: Synthetic oligonucleotide
  Target: ATXN1; (+) strand; PAM type: YTN; PAM sequence: TTG
tgaaagtctaaagttactgc

SEQ ID NO: 289964 - DNA, 20 bp, Artificial Sequence
  Description of Artificial Sequence: Synthetic oligonucleotide
  Target: ATXN1; (+) strand; PAM type: YTN; PAM sequence: CTA
aagttactgctcacattgca

SEQ ID NO: 289965 - DNA, 20 bp, Artificial Sequence
  Description of Artificial Sequence: Synthetic oligonucleotide
  Target: ATXN1; (+) strand; PAM type: YTN; PAM sequence: TTA
ctgctcacattgcaaccttg

SEQ ID NO: 289966 - DNA, 20 bp, Artificial Sequence
  Description of Artificial Sequence: Synthetic oligonucleotide
  Target: ATXN1; (+) strand; PAM type: YTN; PAM sequence: CTG
ctcacattgcaaccttgaca

SEQ ID NO: 289967 - DNA, 20 bp, Artificial Sequence
  Description of Artificial Sequence: Synthetic oligonucleotide
  Target: ATXN1; (+) strand; PAM type: YTN; PAM sequence: CTC
acattgcaaccttgacacaa

SEQ ID NO: 289968 - DNA, 20 bp, Artificial Sequence
  Description of Artificial Sequence: Synthetic oligonucleotide
  Target: ATXN1; (+) strand; PAM type: YTN; PAM sequence: TTG
caaccttgacacaacgactc

SEQ ID NO: 289969 - DNA, 20 bp, Artificial Sequence
  Description of Artificial Sequence: Synthetic oligonucleotide
  Target: ATXN1; (+) strand; PAM type: YTN; PAM sequence: CTT
gacacaacgactctgcaaaa

SEQ ID NO: 289970 - DNA, 20 bp, Artificial Sequence
  Description of Artificial Sequence: Synthetic oligonucleotide
  Target: ATXN1; (+) strand; PAM type: YTN; PAM sequence: TTG
acacaacgactctgcaaaaa

SEQ ID NO: 289971 - DNA, 20 bp, Artificial Sequence
  Description of Artificial Sequence: Synthetic oligonucleotide
  Target: ATXN1; (+) strand; PAM type: YTN; PAM sequence: CTC
tgcaaaaacaagggcttaaa

SEQ ID NO: 289972 - DNA, 20 bp, Artificial Sequence
  Description of Artificial Sequence: Synthetic oligonucleotide
  Target: ATXN1; (+) strand; PAM type: YTN; PAM sequence: CTG
caaaaacaagggcttaaatt

SEQ ID NO: 289973 - DNA, 20 bp, Artificial Sequence
  Description of Artificial Sequence: Synthetic oligonucleotide
  Target: ATXN1; (+) strand; PAM type: YTN; PAM sequence: CTT
aaatttaactgaatatgcca

SEQ ID NO: 289974 - DNA, 20 bp, Artificial Sequence
  Description of Artificial Sequence: Synthetic oligonucleotide
  Target: ATXN1; (+) strand; PAM type: YTN; PAM sequence: TTA
aatttaactgaatatgccac

SEQ ID NO: 289975 - DNA, 20 bp, Artificial Sequence
  Description of Artificial Sequence: Synthetic oligonucleotide
  Target: ATXN1; (+) strand; PAM type: YTN; PAM sequence: TTT
aactgaatatgccacaattc

SEQ ID NO: 289976 - DNA, 20 bp, Artificial Sequence
  Description of Artificial Sequence: Synthetic oligonucleotide
  Target: ATXN1; (+) strand; PAM type: YTN; PAM sequence: TTA
actgaatatgccacaattca

SEQ ID NO: 289977 - DNA, 20 bp, Artificial Sequence
  Description of Artificial Sequence: Synthetic oligonucleotide
  Target: ATXN1; (+) strand; PAM type: YTN; PAM sequence: CTG
aatatgccacaattcagaaa

SEQ ID NO: 289978 - DNA, 20 bp, Artificial Sequence
  Description of Artificial Sequence: Synthetic oligonucleotide
  Target: ATXN1; (+) strand; PAM type: YTN; PAM sequence: TTC
agaaaatgctactaccatat

SEQ ID NO: 289979 - DNA, 20 bp, Artificial Sequence
  Description of Artificial Sequence: Synthetic oligonucleotide
  Target: ATXN1; (+) strand; PAM type: YTN; PAM sequence: CTA
ctaccatatgcccgagggga

SEQ ID NO: 289980 - DNA, 20 bp, Artificial Sequence
  Description of Artificial Sequence: Synthetic oligonucleotide
  Target: ATXN1; (+) strand; PAM type: YTN; PAM sequence: CTA
ccatatgcccgaggggactg

SEQ ID NO: 289981 - DNA, 20 bp, Artificial Sequence
  Description of Artificial Sequence: Synthetic oligonucleotide
  Target: ATXN1; (+) strand; PAM type: YTN; PAM sequence: CTG
agtcacacttgcagtttaac

SEQ ID NO: 289982 - DNA, 20 bp, Artificial Sequence
  Description of Artificial Sequence: Synthetic oligonucleotide
  Target: ATXN1; (+) strand; PAM type: YTN; PAM sequence: CTT
gcagtttaacttcaactcct

SEQ ID NO: 289983 - DNA, 20 bp, Artificial Sequence
  Description of Artificial Sequence: Synthetic oligonucleotide
  Target: ATXN1; (+) strand; PAM type: YTN; PAM sequence: TTG
cagtttaacttcaactcctg

SEQ ID NO: 289984 - DNA, 20 bp, Artificial Sequence
  Description of Artificial Sequence: Synthetic oligonucleotide
  Target: ATXN1; (+) strand; PAM type: YTN; PAM sequence: TTT
aacttcaactcctgaatttt

SEQ ID NO: 289985 - DNA, 20 bp, Artificial Sequence
  Description of Artificial Sequence: Synthetic oligonucleotide
  Target: ATXN1; (+) strand; PAM type: YTN; PAM sequence: TTA
acttcaactcctgaattttt

SEQ ID NO: 289986 - DNA, 20 bp, Artificial Sequence
  Description of Artificial Sequence: Synthetic oligonucleotide
  Target: ATXN1; (+) strand; PAM type: YTN; PAM sequence: CTT
caactcctgaattttttgac

SEQ ID NO: 289987 - DNA, 20 bp, Artificial Sequence
  Description of Artificial Sequence: Synthetic oligonucleotide
  Target: ATXN1; (+) strand; PAM type: YTN; PAM sequence: TTC
aactcctgaattttttgact

SEQ ID NO: 289988 - DNA, 20 bp, Artificial Sequence
  Description of Artificial Sequence: Synthetic oligonucleotide
  Target: ATXN1; (+) strand; PAM type: YTN; PAM sequence: CTC
ctgaattttttgacttctgt

SEQ ID NO: 289989 - DNA, 20 bp, Artificial Sequence
  Description of Artificial Sequence: Synthetic oligonucleotide
  Target: ATXN1; (+) strand; PAM type: YTN; PAM sequence: CTG
aattttttgacttctgtatg

SEQ ID NO: 289990 - DNA, 20 bp, Artificial Sequence
  Description of Artificial Sequence: Synthetic oligonucleotide
  Target: ATXN1; (+) strand; PAM type: YTN; PAM sequence: TTT
tttgacttctgtatgtttaa

SEQ ID NO: 289991 - DNA, 20 bp, Artificial Sequence
  Description of Artificial Sequence: Synthetic oligonucleotide
  Target: ATXN1; (+) strand; PAM type: YTN; PAM sequence: TTT
ttgacttctgtatgtttaaa

SEQ ID NO: 289992 - DNA, 20 bp, Artificial Sequence
  Description of Artificial Sequence: Synthetic oligonucleotide
  Target: ATXN1; (+) strand; PAM type: YTN; PAM sequence: TTT
tgacttctgtatgtttaaat

SEQ ID NO: 289993 - DNA, 20 bp, Artificial Sequence
  Description of Artificial Sequence: Synthetic oligonucleotide
  Target: ATXN1; (+) strand; PAM type: YTN; PAM sequence: TTT
gacttctgtatgtttaaatt

SEQ ID NO: 289994 - DNA, 20 bp, Artificial Sequence
  Description of Artificial Sequence: Synthetic oligonucleotide
  Target: ATXN1; (+) strand; PAM type: YTN; PAM sequence: TTG
acttctgtatgtttaaattc

SEQ ID NO: 289995 - DNA, 20 bp, Artificial Sequence
  Description of Artificial Sequence: Synthetic oligonucleotide
  Target: ATXN1; (+) strand; PAM type: YTN; PAM sequence: CTT
ctgtatgtttaaattctcat

SEQ ID NO: 289996 - DNA, 20 bp, Artificial Sequence
  Description of Artificial Sequence: Synthetic oligonucleotide
  Target: ATXN1; (+) strand; PAM type: YTN; PAM sequence: TTC
tgtatgtttaaattctcatc

SEQ ID NO: 289997 - DNA, 20 bp, Artificial Sequence
  Description of Artificial Sequence: Synthetic oligonucleotide
  Target: ATXN1; (+) strand; PAM type: YTN; PAM sequence: CTG
tatgtttaaattctcatcaa

SEQ ID NO: 289998 - DNA, 20 bp, Artificial Sequence
  Description of Artificial Sequence: Synthetic oligonucleotide
  Target: ATXN1; (+) strand; PAM type: YTN; PAM sequence: TTT
aaattctcatcaaactgcag

SEQ ID NO: 289999 - DNA, 20 bp, Artificial Sequence
  Description of Artificial Sequence: Synthetic oligonucleotide
  Target: ATXN1; (+) strand; PAM type: YTN; PAM sequence: TTA
aattctcatcaaactgcagc

SEQ ID NO: 290000 - DNA, 20 bp, Artificial Sequence
  Description of Artificial Sequence: Synthetic oligonucleotide
  Target: ATXN1; (+) strand; PAM type: YTN; PAM sequence: TTC
tcatcaaactgcagcttcaa

SEQ ID NO: 290001 - DNA, 20 bp, Artificial Sequence
  Description of Artificial Sequence: Synthetic oligonucleotide
  Target: ATXN1; (+) strand; PAM type: YTN; PAM sequence: CTC
atcaaactgcagcttcaacc

SEQ ID NO: 290002 - DNA, 20 bp, Artificial Sequence
  Description of Artificial Sequence: Synthetic oligonucleotide
  Target: ATXN1; (+) strand; PAM type: YTN; PAM sequence: CTG
cagcttcaacctttgtttct

SEQ ID NO: 290003 - DNA, 20 bp, Artificial Sequence
  Description of Artificial Sequence: Synthetic oligonucleotide
  Target: ATXN1; (+) strand; PAM type: YTN; PAM sequence: CTT
caacctttgtttctgccact

SEQ ID NO: 290004 - DNA, 20 bp, Artificial Sequence
  Description of Artificial Sequence: Synthetic oligonucleotide
  Target: ATXN1; (+) strand; PAM type: YTN; PAM sequence: TTC
aacctttgtttctgccactg

SEQ ID NO: 290005 - DNA, 20 bp, Artificial Sequence
  Description of Artificial Sequence: Synthetic oligonucleotide
  Target: ATXN1; (+) strand; PAM type: YTN; PAM sequence: CTT
tgtttctgccactgatcgca

SEQ ID NO: 290006 - DNA, 20 bp, Artificial Sequence
  Description of Artificial Sequence: Synthetic oligonucleotide
  Target: ATXN1; (+) strand; PAM type: YTN; PAM sequence: TTT
gtttctgccactgatcgcag

SEQ ID NO: 290007 - DNA, 20 bp, Artificial Sequence
  Description of Artificial Sequence: Synthetic oligonucleotide
  Target: ATXN1; (+) strand; PAM type: YTN; PAM sequence: TTG
tttctgccactgatcgcaga

SEQ ID NO: 290008 - DNA, 20 bp, Artificial Sequence
  Description of Artificial Sequence: Synthetic oligonucleotide
  Target: ATXN1; (+) strand; PAM type: YTN; PAM sequence: TTT
ctgccactgatcgcagaatg

SEQ ID NO: 290009 - DNA, 20 bp, Artificial Sequence
  Description of Artificial Sequence: Synthetic oligonucleotide
  Target: ATXN1; (+) strand; PAM type: YTN; PAM sequence: TTC
tgccactgatcgcagaatgc

SEQ ID NO: 290010 - DNA, 20 bp, Artificial Sequence
  Description of Artificial Sequence: Synthetic oligonucleotide
  Target: ATXN1; (+) strand; PAM type: YTN; PAM sequence: CTG
ccactgatcgcagaatgcat

SEQ ID NO: 290011 - DNA, 20 bp, Artificial Sequence
  Description of Artificial Sequence: Synthetic oligonucleotide
  Target: ATXN1; (+) strand; PAM type: YTN; PAM sequence: CTG
atcgcagaatgcatcgctta

SEQ ID NO: 290012 - DNA, 20 bp, Artificial Sequence
  Description of Artificial Sequence: Synthetic oligonucleotide
  Target: ATXN1; (+) strand; PAM type: YTN; PAM sequence: CTT
atcatttgacgtaatctcta

SEQ ID NO: 290013 - DNA, 20 bp, Artificial Sequence
  Description of Artificial Sequence: Synthetic oligonucleotide
  Target: ATXN1; (+) strand; PAM type: YTN; PAM sequence: TTA
tcatttgacgtaatctctac

SEQ ID NO: 290014 - DNA, 20 bp, Artificial Sequence
  Description of Artificial Sequence: Synthetic oligonucleotide
  Target: ATXN1; (+) strand; PAM type: YTN; PAM sequence: TTT
gacgtaatctctaccatgaa

SEQ ID NO: 290015 - DNA, 20 bp, Artificial Sequence
  Description of Artificial Sequence: Synthetic oligonucleotide
  Target: ATXN1; (+) strand; PAM type: YTN; PAM sequence: TTG
acgtaatctctaccatgaaa

SEQ ID NO: 290016 - DNA, 20 bp, Artificial Sequence
  Description of Artificial Sequence: Synthetic oligonucleotide
  Target: ATXN1; (+) strand; PAM type: YTN; PAM sequence: CTC
taccatgaaatacttgtttt

SEQ ID NO: 290017 - DNA, 20 bp, Artificial Sequence
  Description of Artificial Sequence: Synthetic oligonucleotide
  Target: ATXN1; (+) strand; PAM type: YTN; PAM sequence: CTA
ccatgaaatacttgtttttg

SEQ ID NO: 290018 - DNA, 20 bp, Artificial Sequence
  Description of Artificial Sequence: Synthetic oligonucleotide
  Target: ATXN1; (+) strand; PAM type: YTN; PAM sequence: CTT
gtttttgaacagcctaaggt

SEQ ID NO: 290019 - DNA, 20 bp, Artificial Sequence
  Description of Artificial Sequence: Synthetic oligonucleotide
  Target: ATXN1; (+) strand; PAM type: YTN; PAM sequence: TTG
tttttgaacagcctaaggtt

SEQ ID NO: 290020 - DNA, 20 bp, Artificial Sequence
  Description of Artificial Sequence: Synthetic oligonucleotide
  Target: ATXN1; (+) strand; PAM type: YTN; PAM sequence: TTT
ttgaacagcctaaggttcgg

SEQ ID NO: 290021 - DNA, 20 bp, Artificial Sequence
  Description of Artificial Sequence: Synthetic oligonucleotide
  Target: ATXN1; (+) strand; PAM type: YTN; PAM sequence: TTT
tgaacagcctaaggttcgga

SEQ ID NO: 290022 - DNA, 20 bp, Artificial Sequence
  Description of Artificial Sequence: Synthetic oligonucleotide
  Target: ATXN1; (+) strand; PAM type: YTN; PAM sequence: TTT
gaacagcctaaggttcggag

SEQ ID NO: 290023 - DNA, 20 bp, Artificial Sequence
  Description of Artificial Sequence: Synthetic oligonucleotide
  Target: ATXN1; (+) strand; PAM type: YTN; PAM sequence: TTG
aacagcctaaggttcggagg

SEQ ID NO: 290024 - DNA, 20 bp, Artificial Sequence
  Description of Artificial Sequence: Synthetic oligonucleotide
  Target: ATXN1; (+) strand; PAM type: YTN; PAM sequence: CTA
aggttcggaggacacttttt

SEQ ID NO: 290025 - DNA, 20 bp, Artificial Sequence
  Description of Artificial Sequence: Synthetic oligonucleotide
  Target: ATXN1; (+) strand; PAM type: YTN; PAM sequence: TTC
ggaggacacttttttaaatg

SEQ ID NO: 290026 - DNA, 20 bp, Artificial Sequence
  Description of Artificial Sequence: Synthetic oligonucleotide
  Target: ATXN1; (+) strand; PAM type: YTN; PAM sequence: CTT
ttttaaatgttaaataaaaa

SEQ ID NO: 290027 - DNA, 20 bp, Artificial Sequence
  Description of Artificial Sequence: Synthetic oligonucleotide
  Target: ATXN1; (+) strand; PAM type: YTN; PAM sequence: TTT
tttaaatgttaaataaaaaa

SEQ ID NO: 290028 - DNA, 20 bp, Artificial Sequence
  Description of Artificial Sequence: Synthetic oligonucleotide
  Target: ATXN1; (+) strand; PAM type: YTN; PAM sequence: TTT
ttaaatgttaaataaaaaac

SEQ ID NO: 290029 - DNA, 20 bp, Artificial Sequence
  Description of Artificial Sequence: Synthetic oligonucleotide
  Target: ATXN1; (+) strand; PAM type: YTN; PAM sequence: TTT
taaatgttaaataaaaaact

SEQ ID NO: 290030 - DNA, 20 bp, Artificial Sequence
  Description of Artificial Sequence: Synthetic oligonucleotide
  Target: ATXN1; (+) strand; PAM type: YTN; PAM sequence: TTT
aaatgttaaataaaaaactg

SEQ ID NO: 290031 - DNA, 20 bp, Artificial Sequence
  Description of Artificial Sequence: Synthetic oligonucleotide
  Target: ATXN1; (+) strand; PAM type: YTN; PAM sequence: TTA
aatgttaaataaaaaactgt

SEQ ID NO: 290032 - DNA, 20 bp, Artificial Sequence
  Description of Artificial Sequence: Synthetic oligonucleotide
  Target: ATXN1; (+) strand; PAM type: YTN; PAM sequence: TTA
aataaaaaactgtcaacgat

SEQ ID NO: 290033 - DNA, 20 bp, Artificial Sequence
  Description of Artificial Sequence: Synthetic oligonucleotide
  Target: ATXN1; (+) strand; PAM type: YTN; PAM sequence: CTG
tcaacgattactgggaatgg

SEQ ID NO: 290034 - DNA, 20 bp, Artificial Sequence
  Description of Artificial Sequence: Synthetic oligonucleotide
  Target: ATXN1; (+) strand; PAM type: YTN; PAM sequence: TTA
ctgggaatggaaaaacagcc

SEQ ID NO: 290035 - DNA, 20 bp, Artificial Sequence
  Description of Artificial Sequence: Synthetic oligonucleotide
  Target: ATXN1; (+) strand; PAM type: YTN; PAM sequence: CTG
ggaatggaaaaacagccaag

SEQ ID NO: 290036 - DNA, 20 bp, Artificial Sequence
  Description of Artificial Sequence: Synthetic oligonucleotide
  Target: ATXN1; (+) strand; PAM type: YTN; PAM sequence: CTC
tttgatgccatccttatgcc

SEQ ID NO: 290037 - DNA, 20 bp, Artificial Sequence
  Description of Artificial Sequence: Synthetic oligonucleotide
  Target: ATXN1; (+) strand; PAM type: YTN; PAM sequence: CTT
tgatgccatccttatgccta

SEQ ID NO: 290038 - DNA, 20 bp, Artificial Sequence
  Description of Artificial Sequence: Synthetic oligonucleotide
  Target: ATXN1; (+) strand; PAM type: YTN; PAM sequence: TTT
gatgccatccttatgcctag

SEQ ID NO: 290039 - DNA, 20 bp, Artificial Sequence
  Description of Artificial Sequence: Synthetic oligonucleotide
  Target: ATXN1; (+) strand; PAM type: YTN; PAM sequence: TTG
atgccatccttatgcctaga

SEQ ID NO: 290040 - DNA, 20 bp, Artificial Sequence
  Description of Artificial Sequence: Synthetic oligonucleotide
  Target: ATXN1; (+) strand; PAM type: YTN; PAM sequence: CTT
atgcctagaaaaatcttccc

SEQ ID NO: 290041 - DNA, 20 bp, Artificial Sequence
  Description of Artificial Sequence: Synthetic oligonucleotide
  Target: ATXN1; (+) strand; PAM type: YTN; PAM sequence: TTA
tgcctagaaaaatcttccca

SEQ ID NO: 290042 - DNA, 20 bp, Artificial Sequence
  Description of Artificial Sequence: Synthetic oligonucleotide
  Target: ATXN1; (+) strand; PAM type: YTN; PAM sequence: CTA
gaaaaatcttcccactccca

SEQ ID NO: 290043 - DNA, 20 bp, Artificial Sequence
  Description of Artificial Sequence: Synthetic oligonucleotide
  Target: ATXN1; (+) strand; PAM type: YTN; PAM sequence: CTT
cccactcccactcccacatc

SEQ ID NO: 290044 - DNA, 20 bp, Artificial Sequence
  Description of Artificial Sequence: Synthetic oligonucleotide
  Target: ATXN1; (+) strand; PAM type: YTN; PAM sequence: TTC
ccactcccactcccacatcg

SEQ ID NO: 290045 - DNA, 20 bp, Artificial Sequence
  Description of Artificial Sequence: Synthetic oligonucleotide
  Target: ATXN1; (+) strand; PAM type: YTN; PAM sequence: CTC
ccactcccacatcgatcaag

SEQ ID NO: 290046 - DNA, 20 bp, Artificial Sequence
  Description of Artificial Sequence: Synthetic oligonucleotide
  Target: ATXN1; (+) strand; PAM type: YTN; PAM sequence: CTC
ccacatcgatcaagtgagct

SEQ ID NO: 290047 - DNA, 20 bp, Artificial Sequence
  Description of Artificial Sequence: Synthetic oligonucleotide
  Target: ATXN1; (+) strand; PAM type: YTN; PAM sequence: CTG
catctcttccttctttcaaa

SEQ ID NO: 290048 - DNA, 20 bp, Artificial Sequence
  Description of Artificial Sequence: Synthetic oligonucleotide
  Target: ATXN1; (+) strand; PAM type: YTN; PAM sequence: CTC
ttccttctttcaaagttcac

SEQ ID NO: 290049 - DNA, 20 bp, Artificial Sequence
  Description of Artificial Sequence: Synthetic oligonucleotide
  Target: ATXN1; (+) strand; PAM type: YTN; PAM sequence: CTT
ccttctttcaaagttcacct

SEQ ID NO: 290050 - DNA, 20 bp, Artificial Sequence
  Description of Artificial Sequence: Synthetic oligonucleotide
  Target: ATXN1; (+) strand; PAM type: YTN; PAM sequence: TTC
cttctttcaaagttcacctt

SEQ ID NO: 290051 - DNA, 20 bp, Artificial Sequence
  Description of Artificial Sequence: Synthetic oligonucleotide
  Target: ATXN1; (+) strand; PAM type: YTN; PAM sequence: CTT
ctttcaaagttcaccttaat

SEQ ID NO: 290052 - DNA, 20 bp, Artificial Sequence
  Description of Artificial Sequence: Synthetic oligonucleotide
  Target: ATXN1; (+) strand; PAM type: YTN; PAM sequence: TTC
tttcaaagttcaccttaatt

SEQ ID NO: 290053 - DNA, 20 bp, Artificial Sequence
  Description of Artificial Sequence: Synthetic oligonucleotide
  Target: ATXN1; (+) strand; PAM type: YTN; PAM sequence: CTT
tcaaagttcaccttaattca

SEQ ID NO: 290054 - DNA, 20 bp, Artificial Sequence
  Description of Artificial Sequence: Synthetic oligonucleotide
  Target: ATXN1; (+) strand; PAM type: YTN; PAM sequence: TTT
caaagttcaccttaattcac

SEQ ID NO: 290055 - DNA, 20 bp, Artificial Sequence
  Description of Artificial Sequence: Synthetic oligonucleotide
  Target: ATXN1; (+) strand; PAM type: YTN; PAM sequence: TTC
aaagttcaccttaattcact

SEQ ID NO: 290056 - DNA, 20 bp, Artificial Sequence
  Description of Artificial Sequence: Synthetic oligonucleotide
  Target: ATXN1; (+) strand; PAM type: YTN; PAM sequence: TTC
accttaattcacttctctat

SEQ ID NO: 290057 - DNA, 20 bp, Artificial Sequence
  Description of Artificial Sequence: Synthetic oligonucleotide
  Target: ATXN1; (+) strand; PAM type: YTN; PAM sequence: CTT
aattcacttctctatgattc

SEQ ID NO: 290058 - DNA, 20 bp, Artificial Sequence
  Description of Artificial Sequence: Synthetic oligonucleotide
  Target: ATXN1; (+) strand; PAM type: YTN; PAM sequence: TTA
attcacttctctatgattct

SEQ ID NO: 290059 - DNA, 20 bp, Artificial Sequence
  Description of Artificial Sequence: Synthetic oligonucleotide
  Target: ATXN1; (+) strand; PAM type: YTN; PAM sequence: TTC
acttctctatgattctataa

SEQ ID NO: 290060 - DNA, 20 bp, Artificial Sequence
  Description of Artificial Sequence: Synthetic oligonucleotide
  Target: ATXN1; (+) strand; PAM type: YTN; PAM sequence: CTT
ctctatgattctataatgaa

SEQ ID NO: 290061 - DNA, 20 bp, Artificial Sequence
  Description of Artificial Sequence: Synthetic oligonucleotide
  Target: ATXN1; (+) strand; PAM type: YTN; PAM sequence: TTC
tctatgattctataatgaag

SEQ ID NO: 290062 - DNA, 20 bp, Artificial Sequence
  Description of Artificial Sequence: Synthetic oligonucleotide
  Target: ATXN1; (+) strand; PAM type: YTN; PAM sequence: CTC
tatgattctataatgaaggc

SEQ ID NO: 290063 - DNA, 20 bp, Artificial Sequence
  Description of Artificial Sequence: Synthetic oligonucleotide
  Target: ATXN1; (+) strand; PAM type: YTN; PAM sequence: CTA
tgattctataatgaaggcag

SEQ ID NO: 290064 - DNA, 20 bp, Artificial Sequence
  Description of Artificial Sequence: Synthetic oligonucleotide
  Target: ATXN1; (+) strand; PAM type: YTN; PAM sequence: TTC
tataatgaaggcagctgtga

SEQ ID NO: 290065 - DNA, 20 bp, Artificial Sequence
  Description of Artificial Sequence: Synthetic oligonucleotide
  Target: ATXN1; (+) strand; PAM type: YTN; PAM sequence: CTA
taatgaaggcagctgtgatt

SEQ ID NO: 290066 - DNA, 20 bp, Artificial Sequence
  Description of Artificial Sequence: Synthetic oligonucleotide
  Target: ATXN1; (+) strand; PAM type: YTN; PAM sequence: CTG
tgattacagcagaagtgaag

SEQ ID NO: 290067 - DNA, 20 bp, Artificial Sequence
  Description of Artificial Sequence: Synthetic oligonucleotide
  Target: ATXN1; (+) strand; PAM type: YTN; PAM sequence: TTA
cagcagaagtgaagaagaga

SEQ ID NO: 290068 - DNA, 20 bp, Artificial Sequence
  Description of Artificial Sequence: Synthetic oligonucleotide
  Target: ATXN1; (+) strand; PAM type: YTN; PAM sequence: CTA
cctaccctgggagcaagtta

SEQ ID NO: 290069 - DNA, 20 bp, Artificial Sequence
  Description of Artificial Sequence: Synthetic oligonucleotide
  Target: ATXN1; (+) strand; PAM type: YTN; PAM sequence: CTA
ccctgggagcaagttaattt

SEQ ID NO: 290070 - DNA, 20 bp, Artificial Sequence
  Description of Artificial Sequence: Synthetic oligonucleotide
  Target: ATXN1; (+) strand; PAM type: YTN; PAM sequence: CTG
ggagcaagttaatttatggc

SEQ ID NO: 290071 - DNA, 20 bp, Artificial Sequence
  Description of Artificial Sequence: Synthetic oligonucleotide
  Target: ATXN1; (+) strand; PAM type: YTN; PAM sequence: TTA
atttatggccataggcccac

SEQ ID NO: 290072 - DNA, 20 bp, Artificial Sequence
  Description of Artificial Sequence: Synthetic oligonucleotide
  Target: ATXN1; (+) strand; PAM type: YTN; PAM sequence: TTT
atggccataggcccactagg

SEQ ID NO: 290073 - DNA, 20 bp, Artificial Sequence
  Description of Artificial Sequence: Synthetic oligonucleotide
  Target: ATXN1; (+) strand; PAM type: YTN; PAM sequence: TTA
tggccataggcccactaggg

SEQ ID NO: 290074 - DNA, 20 bp, Artificial Sequence
  Description of Artificial Sequence: Synthetic oligonucleotide
  Target: ATXN1; (+) strand; PAM type: YTN; PAM sequence: CTA
gggatacactgaacgaacta

SEQ ID NO: 290075 - DNA, 20 bp, Artificial Sequence
  Description of Artificial Sequence: Synthetic oligonucleotide
  Target: ATXN1; (+) strand; PAM type: YTN; PAM sequence: CTG
aacgaactacattttttaat

SEQ ID NO: 290076 - DNA, 20 bp, Artificial Sequence
  Description of Artificial Sequence: Synthetic oligonucleotide
  Target: ATXN1; (+) strand; PAM type: YTN; PAM sequence: CTA
cattttttaatgtatgtcta

SEQ ID NO: 290077 - DNA, 20 bp, Artificial Sequence
  Description of Artificial Sequence: Synthetic oligonucleotide
  Target: ATXN1; (+) strand; PAM type: YTN; PAM sequence: TTT
tttaatgtatgtctatgcaa

SEQ ID NO: 290078 - DNA, 20 bp, Artificial Sequence
  Description of Artificial Sequence: Synthetic oligonucleotide
  Target: ATXN1; (+) strand; PAM type: YTN; PAM sequence: TTT
ttaatgtatgtctatgcaat

SEQ ID NO: 290079 - DNA, 20 bp, Artificial Sequence
  Description of Artificial Sequence: Synthetic oligonucleotide
  Target: ATXN1; (+) strand; PAM type: YTN; PAM sequence: TTT
taatgtatgtctatgcaata

SEQ ID NO: 290080 - DNA, 20 bp, Artificial Sequence
  Description of Artificial Sequence: Synthetic oligonucleotide
  Target: ATXN1; (+) strand; PAM type: YTN; PAM sequence: TTT
aatgtatgtctatgcaataa

SEQ ID NO: 290081 - DNA, 20 bp, Artificial Sequence
  Description of Artificial Sequence: Synthetic oligonucleotide
  Target: ATXN1; (+) strand; PAM type: YTN; PAM sequence: TTA
atgtatgtctatgcaataac

SEQ ID NO: 290082 - DNA, 20 bp, Artificial Sequence
  Description of Artificial Sequence: Synthetic oligonucleotide
  Target: ATXN1; (+) strand; PAM type: YTN; PAM sequence: CTA
tgcaataacctgtatatgat

SEQ ID NO: 290083 - DNA, 20 bp, Artificial Sequence
  Description of Artificial Sequence: Synthetic oligonucleotide
  Target: ATXN1; (+) strand; PAM type: YTN; PAM sequence: CTG
tatatgatttttccatcatt

SEQ ID NO: 290084 - DNA, 20 bp, Artificial Sequence
  Description of Artificial Sequence: Synthetic oligonucleotide
  Target: ATXN1; (+) strand; PAM type: YTN; PAM sequence: TTT
ttccatcattaagaatcttc

SEQ ID NO: 290085 - DNA, 20 bp, Artificial Sequence
  Description of Artificial Sequence: Synthetic oligonucleotide
  Target: ATXN1; (+) strand; PAM type: YTN; PAM sequence: TTT
tccatcattaagaatcttca

SEQ ID NO: 290086 - DNA, 20 bp, Artificial Sequence
  Description of Artificial Sequence: Synthetic oligonucleotide
  Target: ATXN1; (+) strand; PAM type: YTN; PAM sequence: TTT
ccatcattaagaatcttcaa

SEQ ID NO: 290087 - DNA, 20 bp, Artificial Sequence
  Description of Artificial Sequence: Synthetic oligonucleotide
  Target: ATXN1; (+) strand; PAM type: YTN; PAM sequence: TTC
catcattaagaatcttcaac

SEQ ID NO: 290088 - DNA, 20 bp, Artificial Sequence
  Description of Artificial Sequence: Synthetic oligonucleotide
  Target: ATXN1; (+) strand; PAM type: YTN; PAM sequence: TTA
agaatcttcaacagtcccag

SEQ ID NO: 290089 - DNA, 20 bp, Artificial Sequence
  Description of Artificial Sequence: Synthetic oligonucleotide
  Target: ATXN1; (+) strand; PAM type: YTN; PAM sequence: CTT
caacagtcccagatgcaagg

SEQ ID NO: 290090 - DNA, 20 bp, Artificial Sequence
  Description of Artificial Sequence: Synthetic oligonucleotide
  Target: ATXN1; (+) strand; PAM type: YTN; PAM sequence: TTC
aacagtcccagatgcaagga

SEQ ID NO: 290091 - DNA, 20 bp, Artificial Sequence
  Description of Artificial Sequence: Synthetic oligonucleotide
  Target: ATXN1; (+) strand; PAM type: YTN; PAM sequence: CTG
gagggggctagggatttagg

SEQ ID NO: 290092 - DNA, 20 bp, Artificial Sequence
  Description of Artificial Sequence: Synthetic oligonucleotide
  Target: ATXN1; (+) strand; PAM type: YTN; PAM sequence: CTA
gggatttagggatggcattc

SEQ ID NO: 290093 - DNA, 20 bp, Artificial Sequence
  Description of Artificial Sequence: Synthetic oligonucleotide
  Target: ATXN1; (+) strand; PAM type: YTN; PAM sequence: TTT
agggatggcattcctattat

SEQ ID NO: 290094 - DNA, 20 bp, Artificial Sequence
  Description of Artificial Sequence: Synthetic oligonucleotide
  Target: ATXN1; (+) strand; PAM type: YTN; PAM sequence: TTA
gggatggcattcctattatt

SEQ ID NO: 290095 - DNA, 20 bp, Artificial Sequence
  Description of Artificial Sequence: Synthetic oligonucleotide
  Target: ATXN1; (+) strand; PAM type: YTN; PAM sequence: TTC
ctattatttacaaggcgctg

SEQ ID NO: 290096 - DNA, 20 bp, Artificial Sequence
  Description of Artificial Sequence: Synthetic oligonucleotide
  Target: ATXN1; (+) strand; PAM type: YTN; PAM sequence: CTA
ttatttacaaggcgctgagt

SEQ ID NO: 290097 - DNA, 20 bp, Artificial Sequence
  Description of Artificial Sequence: Synthetic oligonucleotide
  Target: ATXN1; (+) strand; PAM type: YTN; PAM sequence: TTA
tttacaaggcgctgagttag

SEQ ID NO: 290098 - DNA, 20 bp, Artificial Sequence
  Description of Artificial Sequence: Synthetic oligonucleotide
  Target: ATXN1; (+) strand; PAM type: YTN; PAM sequence: TTT
acaaggcgctgagttagaca

SEQ ID NO: 290099 - DNA, 20 bp, Artificial Sequence
  Description of Artificial Sequence: Synthetic oligonucleotide
  Target: ATXN1; (+) strand; PAM type: YTN; PAM sequence: TTA
caaggcgctgagttagacag

SEQ ID NO: 290100 - DNA, 20 bp, Artificial Sequence
  Description of Artificial Sequence: Synthetic oligonucleotide
  Target: ATXN1; (+) strand; PAM type: YTN; PAM sequence: CTG
agttagacagaccatgtgtg

SEQ ID NO: 290101 - DNA, 20 bp, Artificial Sequence
  Description of Artificial Sequence: Synthetic oligonucleotide
  Target: ATXN1; (+) strand; PAM type: YTN; PAM sequence: TTA
gacagaccatgtgtgaccat

SEQ ID NO: 290102 - DNA, 20 bp, Artificial Sequence
  Description of Artificial Sequence: Synthetic oligonucleotide
  Target: ATXN1; (+) strand; PAM type: YTN; PAM sequence: TTC
ctgctcagaagcttacaatc

SEQ ID NO: 290103 - DNA, 20 bp, Artificial Sequence
  Description of Artificial Sequence: Synthetic oligonucleotide
  Target: ATXN1; (+) strand; PAM type: YTN; PAM sequence: CTG
ctcagaagcttacaatcgct

SEQ ID NO: 290104 - DNA, 20 bp, Artificial Sequence
  Description of Artificial Sequence: Synthetic oligonucleotide
  Target: ATXN1; (+) strand; PAM type: YTN; PAM sequence: CTC
agaagcttacaatcgctttg

SEQ ID NO: 290105 - DNA, 20 bp, Artificial Sequence
  Description of Artificial Sequence: Synthetic oligonucleotide
  Target: ATXN1; (+) strand; PAM type: YTN; PAM sequence: CTT
acaatcgctttggagaggca

SEQ ID NO: 290106 - DNA, 20 bp, Artificial Sequence
  Description of Artificial Sequence: Synthetic oligonucleotide
  Target: ATXN1; (+) strand; PAM type: YTN; PAM sequence: TTA
caatcgctttggagaggcaa

SEQ ID NO: 290107 - DNA, 20 bp, Artificial Sequence
  Description of Artificial Sequence: Synthetic oligonucleotide
  Target: ATXN1; (+) strand; PAM type: YTN; PAM sequence: CTT
tggagaggcaaggcatttat

SEQ ID NO: 290108 - DNA, 20 bp, Artificial Sequence
  Description of Artificial Sequence: Synthetic oligonucleotide
  Target: ATXN1; (+) strand; PAM type: YTN; PAM sequence: TTT
ggagaggcaaggcatttatc

SEQ ID NO: 290109 - DNA, 20 bp, Artificial Sequence
  Description of Artificial Sequence: Synthetic oligonucleotide
  Target: ATXN1; (+) strand; PAM type: YTN; PAM sequence: TTG
gagaggcaaggcatttatca

SEQ ID NO: 290110 - DNA, 20 bp, Artificial Sequence
  Description of Artificial Sequence: Synthetic oligonucleotide
  Target: ATXN1; (+) strand; PAM type: YTN; PAM sequence: TTT
atcatgcacagagagctgat

SEQ ID NO: 290111 - DNA, 20 bp, Artificial Sequence
  Description of Artificial Sequence: Synthetic oligonucleotide
  Target: ATXN1; (+) strand; PAM type: YTN; PAM sequence: TTA
tcatgcacagagagctgata

SEQ ID NO: 290112 - DNA, 20 bp, Artificial Sequence
  Description of Artificial Sequence: Synthetic oligonucleotide
  Target: ATXN1; (+) strand; PAM type: YTN; PAM sequence: CTG
ataatagcaggcaatttttc

SEQ ID NO: 290113 - DNA, 20 bp, Artificial Sequence
  Description of Artificial Sequence: Synthetic oligonucleotide
  Target: ATXN1; (+) strand; PAM type: YTN; PAM sequence: TTT
ttcaatcagcatacatttat

SEQ ID NO: 290114 - DNA, 20 bp, Artificial Sequence
  Description of Artificial Sequence: Synthetic oligonucleotide
  Target: ATXN1; (+) strand; PAM type: YTN; PAM sequence: TTT
tcaatcagcatacatttatt

SEQ ID NO: 290115 - DNA, 20 bp, Artificial Sequence
  Description of Artificial Sequence: Synthetic oligonucleotide
  Target: ATXN1; (+) strand; PAM type: YTN; PAM sequence: TTT
caatcagcatacatttattc

SEQ ID NO: 290116 - DNA, 20 bp, Artificial Sequence
  Description of Artificial Sequence: Synthetic oligonucleotide
  Target: ATXN1; (+) strand; PAM type: YTN; PAM sequence: TTC
aatcagcatacatttattca

SEQ ID NO: 290117 - DNA, 20 bp, Artificial Sequence
  Description of Artificial Sequence: Synthetic oligonucleotide
  Target: ATXN1; (+) strand; PAM type: YTN; PAM sequence: TTT
attcagcaaatatttactga

SEQ ID NO: 290118 - DNA, 20 bp, Artificial Sequence
  Description of Artificial Sequence: Synthetic oligonucleotide
  Target: ATXN1; (+) strand; PAM type: YTN; PAM sequence: TTA
ttcagcaaatatttactgaa

SEQ ID NO: 290119 - DNA, 20 bp, Artificial Sequence
  Description of Artificial Sequence: Synthetic oligonucleotide
  Target: ATXN1; (+) strand; PAM type: YTN; PAM sequence: TTC
agcaaatatttactgaagac

SEQ ID NO: 290120 - DNA, 20 bp, Artificial Sequence
  Description of Artificial Sequence: Synthetic oligonucleotide
  Target: ATXN1; (+) strand; PAM type: YTN; PAM sequence: TTT
actgaagacctactaaatgc

SEQ ID NO: 290121 - DNA, 20 bp, Artificial Sequence
  Description of Artificial Sequence: Synthetic oligonucleotide
  Target: ATXN1; (+) strand; PAM type: YTN; PAM sequence: TTA
ctgaagacctactaaatgcc

SEQ ID NO: 290122 - DNA, 20 bp, Artificial Sequence
  Description of Artificial Sequence: Synthetic oligonucleotide
  Target: ATXN1; (+) strand; PAM type: YTN; PAM sequence: CTG
aagacctactaaatgccagg

SEQ ID NO: 290123 - DNA, 20 bp, Artificial Sequence
  Description of Artificial Sequence: Synthetic oligonucleotide
  Target: ATXN1; (+) strand; PAM type: YTN; PAM sequence: CTA
ctaaatgccaggcacgatgc

SEQ ID NO: 290124 - DNA, 20 bp, Artificial Sequence
  Description of Artificial Sequence: Synthetic oligonucleotide
  Target: ATXN1; (+) strand; PAM type: YTN; PAM sequence: CTA
aatgccaggcacgatgccag

SEQ ID NO: 290125 - DNA, 20 bp, Artificial Sequence
  Description of Artificial Sequence: Synthetic oligonucleotide
  Target: ATXN1; (+) strand; PAM type: YTN; PAM sequence: TTA
gggacaaaaatatgactaag

SEQ ID NO: 290126 - DNA, 20 bp, Artificial Sequence
  Description of Artificial Sequence: Synthetic oligonucleotide
  Target: ATXN1; (+) strand; PAM type: YTN; PAM sequence: CTA
agatgtggtcccagcagaga

SEQ ID NO: 290127 - DNA, 20 bp, Artificial Sequence
  Description of Artificial Sequence: Synthetic oligonucleotide
  Target: ATXN1; (+) strand; PAM type: YTN; PAM sequence: TTC
cgtatagtaaccatgttatc

SEQ ID NO: 290128 - DNA, 20 bp, Artificial Sequence
  Description of Artificial Sequence: Synthetic oligonucleotide
  Target: ATXN1; (+) strand; PAM type: YTN; PAM sequence: TTA
tcaaggagtcatcagaatgc

SEQ ID NO: 290129 - DNA, 20 bp, Artificial Sequence
  Description of Artificial Sequence: Synthetic oligonucleotide
  Target: ATXN1; (+) strand; PAM type: YTN; PAM sequence: CTA
ctagatgataaaaatagcag

SEQ ID NO: 290130 - DNA, 20 bp, Artificial Sequence
  Description of Artificial Sequence: Synthetic oligonucleotide
  Target: ATXN1; (+) strand; PAM type: YTN; PAM sequence: CTA
gatgataaaaatagcagctt

SEQ ID NO: 290131 - DNA, 20 bp, Artificial Sequence
  Description of Artificial Sequence: Synthetic oligonucleotide
  Target: ATXN1; (+) strand; PAM type: YTN; PAM sequence: CTT
tcccctcttcgaaaaatgca

SEQ ID NO: 290132 - DNA, 20 bp, Artificial Sequence
  Description of Artificial Sequence: Synthetic oligonucleotide
  Target: ATXN1; (+) strand; PAM type: YTN; PAM sequence: TTT
cccctcttcgaaaaatgcag

SEQ ID NO: 290133 - DNA, 20 bp, Artificial Sequence
  Description of Artificial Sequence: Synthetic oligonucleotide
  Target: ATXN1; (+) strand; PAM type: YTN; PAM sequence: TTC
ccctcttcgaaaaatgcaga

SEQ ID NO: 290134 - DNA, 20 bp, Artificial Sequence
  Description of Artificial Sequence: Synthetic oligonucleotide
  Target: ATXN1; (+) strand; PAM type: YTN; PAM sequence: CTC
ttcgaaaaatgcagagtaca

SEQ ID NO: 290135 - DNA, 20 bp, Artificial Sequence
  Description of Artificial Sequence: Synthetic oligonucleotide
  Target: ATXN1; (+) strand; PAM type: YTN; PAM sequence: CTT
cgaaaaatgcagagtacaca

SEQ ID NO: 290136 - DNA, 20 bp, Artificial Sequence
  Description of Artificial Sequence: Synthetic oligonucleotide
  Target: ATXN1; (+) strand; PAM type: YTN; PAM sequence: TTC
gaaaaatgcagagtacacat

SEQ ID NO: 290137 - DNA, 20 bp, Artificial Sequence
  Description of Artificial Sequence: Synthetic oligonucleotide
  Target: ATXN1; (+) strand; PAM type: YTN; PAM sequence: CTA
atccagtcactgagtgagca

SEQ ID NO: 290138 - DNA, 20 bp, Artificial Sequence
  Description of Artificial Sequence: Synthetic oligonucleotide
  Target: ATXN1; (+) strand; PAM type: YTN; PAM sequence: CTG
agtgagcattctggcaatga

SEQ ID NO: 290139 - DNA, 20 bp, Artificial Sequence
  Description of Artificial Sequence: Synthetic oligonucleotide
  Target: ATXN1; (+) strand; PAM type: YTN; PAM sequence: TTC
tggcaatgaaaaaacatatt

SEQ ID NO: 290140 - DNA, 20 bp, Artificial Sequence
  Description of Artificial Sequence: Synthetic oligonucleotide
  Target: ATXN1; (+) strand; PAM type: YTN; PAM sequence: CTG
gcaatgaaaaaacatatttg

SEQ ID NO: 290141 - DNA, 20 bp, Artificial Sequence
  Description of Artificial Sequence: Synthetic oligonucleotide
  Target: ATXN1; (+) strand; PAM type: YTN; PAM sequence: TTT
ggaatgagaatagtgatctt

SEQ ID NO: 290142 - DNA, 20 bp, Artificial Sequence
  Description of Artificial Sequence: Synthetic oligonucleotide
  Target: ATXN1; (+) strand; PAM type: YTN; PAM sequence: TTG
gaatgagaatagtgatcttc

SEQ ID NO: 290143 - DNA, 20 bp, Artificial Sequence
  Description of Artificial Sequence: Synthetic oligonucleotide
  Target: ATXN1; (+) strand; PAM type: YTN; PAM sequence: CTT
cagaactctaggtaccaagc

SEQ ID NO: 290144 - DNA, 20 bp, Artificial Sequence
  Description of Artificial Sequence: Synthetic oligonucleotide
  Target: ATXN1; (+) strand; PAM type: YTN; PAM sequence: TTC
agaactctaggtaccaagca

SEQ ID NO: 290145 - DNA, 20 bp, Artificial Sequence
  Description of Artificial Sequence: Synthetic oligonucleotide
  Target: ATXN1; (+) strand; PAM type: YTN; PAM sequence: CTC
taggtaccaagcattccaga

SEQ ID NO: 290146 - DNA, 20 bp, Artificial Sequence
  Description of Artificial Sequence: Synthetic oligonucleotide
  Target: ATXN1; (+) strand; PAM type: YTN; PAM sequence: CTA
ggtaccaagcattccagata

SEQ ID NO: 290147 - DNA, 20 bp, Artificial Sequence
  Description of Artificial Sequence: Synthetic oligonucleotide
  Target: ATXN1; (+) strand; PAM type: YTN; PAM sequence: TTC
cagatacataaatgttctga

SEQ ID NO: 290148 - DNA, 20 bp, Artificial Sequence
  Description of Artificial Sequence: Synthetic oligonucleotide
  Target: ATXN1; (+) strand; PAM type: YTN; PAM sequence: TTC
tgatccccttgagtggcaat

SEQ ID NO: 290149 - DNA, 20 bp, Artificial Sequence
  Description of Artificial Sequence: Synthetic oligonucleotide
  Target: ATXN1; (+) strand; PAM type: YTN; PAM sequence: CTG
atccccttgagtggcaattg

SEQ ID NO: 290150 - DNA, 20 bp, Artificial Sequence
  Description of Artificial Sequence: Synthetic oligonucleotide
  Target: ATXN1; (+) strand; PAM type: YTN; PAM sequence: CTT
gagtggcaattgaccggctg

SEQ ID NO: 290151 - DNA, 20 bp, Artificial Sequence
  Description of Artificial Sequence: Synthetic oligonucleotide
  Target: ATXN1; (+) strand; PAM type: YTN; PAM sequence: TTG
agtggcaattgaccggctga

SEQ ID NO: 290152 - DNA, 20 bp, Artificial Sequence
  Description of Artificial Sequence: Synthetic oligonucleotide
  Target: ATXN1; (+) strand; PAM type: YTN; PAM sequence: TTG
accggctgacactgaggcaa

SEQ ID NO: 290153 - DNA, 20 bp, Artificial Sequence
  Description of Artificial Sequence: Synthetic oligonucleotide
  Target: ATXN1; (+) strand; PAM type: YTN; PAM sequence: CTG
acactgaggcaaacttgcca

SEQ ID NO: 290154 - DNA, 20 bp, Artificial Sequence
  Description of Artificial Sequence: Synthetic oligonucleotide
  Target: ATXN1; (+) strand; PAM type: YTN; PAM sequence: CTG
aggcaaacttgccaccatgg

SEQ ID NO: 290155 - DNA, 20 bp, Artificial Sequence
  Description of Artificial Sequence: Synthetic oligonucleotide
  Target: ATXN1; (+) strand; PAM type: YTN; PAM sequence: CTT
gccaccatggaagatgtgaa

SEQ ID NO: 290156 - DNA, 20 bp, Artificial Sequence
  Description of Artificial Sequence: Synthetic oligonucleotide
  Target: ATXN1; (+) strand; PAM type: YTN; PAM sequence: TTG
ccaccatggaagatgtgaat

SEQ ID NO: 290157 - DNA, 20 bp, Artificial Sequence
  Description of Artificial Sequence: Synthetic oligonucleotide
  Target: ATXN1; (+) strand; PAM type: YTN; PAM sequence: TTA
aaacgagtgattgtactaag

SEQ ID NO: 290158 - DNA, 20 bp, Artificial Sequence
  Description of Artificial Sequence: Synthetic oligonucleotide
  Target: ATXN1; (+) strand; PAM type: YTN; PAM sequence: TTG
tactaaggtatagaaatggc

SEQ ID NO: 290159 - DNA, 20 bp, Artificial Sequence
  Description of Artificial Sequence: Synthetic oligonucleotide
  Target: ATXN1; (+) strand; PAM type: YTN; PAM sequence: CTA
aggtatagaaatggcactcg

SEQ ID NO: 290160 - DNA, 20 bp, Artificial Sequence
  Description of Artificial Sequence: Synthetic oligonucleotide
  Target: ATXN1; (+) strand; PAM type: YTN; PAM sequence: CTC
gtacttcctgtttcataaca

SEQ ID NO: 290161 - DNA, 20 bp, Artificial Sequence
  Description of Artificial Sequence: Synthetic oligonucleotide
  Target: ATXN1; (+) strand; PAM type: YTN; PAM sequence: CTT
cctgtttcataacagtcctc

SEQ ID NO: 290162 - DNA, 20 bp, Artificial Sequence
  Description of Artificial Sequence: Synthetic oligonucleotide
  Target: ATXN1; (+) strand; PAM type: YTN; PAM sequence: TTC
ctgtttcataacagtcctca

SEQ ID NO: 290163 - DNA, 20 bp, Artificial Sequence
  Description of Artificial Sequence: Synthetic oligonucleotide
  Target: ATXN1; (+) strand; PAM type: YTN; PAM sequence: CTG
tttcataacagtcctcacaa

SEQ ID NO: 290164 - DNA, 20 bp, Artificial Sequence
  Description of Artificial Sequence: Synthetic oligonucleotide
  Target: ATXN1; (+) strand; PAM type: YTN; PAM sequence: TTT
cataacagtcctcacaagac

SEQ ID NO: 290165 - DNA, 20 bp, Artificial Sequence
  Description of Artificial Sequence: Synthetic oligonucleotide
  Target: ATXN1; (+) strand; PAM type: YTN; PAM sequence: TTC
ataacagtcctcacaagacc

SEQ ID NO: 290166 - DNA, 20 bp, Artificial Sequence
  Description of Artificial Sequence: Synthetic oligonucleotide
  Target: ATXN1; (+) strand; PAM type: YTN; PAM sequence: CTC
acaagaccctttttaaatgt

SEQ ID NO: 290167 - DNA, 20 bp, Artificial Sequence
  Description of Artificial Sequence: Synthetic oligonucleotide
  Target: ATXN1; (+) strand; PAM type: YTN; PAM sequence: CTT
tttaaatgtctgcctttcct

SEQ ID NO: 290168 - DNA, 20 bp, Artificial Sequence
  Description of Artificial Sequence: Synthetic oligonucleotide
  Target: ATXN1; (+) strand; PAM type: YTN; PAM sequence: TTT
ttaaatgtctgcctttcctg

SEQ ID NO: 290169 - DNA, 20 bp, Artificial Sequence
  Description of Artificial Sequence: Synthetic oligonucleotide
  Target: ATXN1; (+) strand; PAM type: YTN; PAM sequence: TTT
taaatgtctgcctttcctga

SEQ ID NO: 290170 - DNA, 20 bp, Artificial Sequence
  Description of Artificial Sequence: Synthetic oligonucleotide
  Target: ATXN1; (+) strand; PAM type: YTN; PAM sequence: TTT
aaatgtctgcctttcctgat

SEQ ID NO: 290171 - DNA, 20 bp, Artificial Sequence
  Description of Artificial Sequence: Synthetic oligonucleotide
  Target: ATXN1; (+) strand; PAM type: YTN; PAM sequence: TTA
aatgtctgcctttcctgata

SEQ ID NO: 290172 - DNA, 20 bp, Artificial Sequence
  Description of Artificial Sequence: Synthetic oligonucleotide
  Target: ATXN1; (+) strand; PAM type: YTN; PAM sequence: CTG
cctttcctgatagactgcaa

SEQ ID NO: 290173 - DNA, 20 bp, Artificial Sequence
  Description of Artificial Sequence: Synthetic oligonucleotide
  Target: ATXN1; (+) strand; PAM type: YTN; PAM sequence: CTT
tcctgatagactgcaacctg

SEQ ID NO: 290174 - DNA, 20 bp, Artificial Sequence
  Description of Artificial Sequence: Synthetic oligonucleotide
  Target: ATXN1; (+) strand; PAM type: YTN; PAM sequence: TTT
cctgatagactgcaacctga

SEQ ID NO: 290175 - DNA, 20 bp, Artificial Sequence
  Description of Artificial Sequence: Synthetic oligonucleotide
  Target: ATXN1; (+) strand; PAM type: YTN; PAM sequence: TTC
ctgatagactgcaacctgaa

SEQ ID NO: 290176 - DNA, 20 bp, Artificial Sequence
  Description of Artificial Sequence: Synthetic oligonucleotide
  Target: ATXN1; (+) strand; PAM type: YTN; PAM sequence: CTG
atagactgcaacctgaaaaa

SEQ ID NO: 290177 - DNA, 20 bp, Artificial Sequence
  Description of Artificial Sequence: Synthetic oligonucleotide
  Target: ATXN1; (+) strand; PAM type: YTN; PAM sequence: CTG
caacctgaaaaaaaggaagg

SEQ ID NO: 290178 - DNA, 20 bp, Artificial Sequence
  Description of Artificial Sequence: Synthetic oligonucleotide
  Target: ATXN1; (+) strand; PAM type: YTN; PAM sequence: CTG
aaaaaaaggaaggaactggg

SEQ ID NO: 290179 - DNA, 20 bp, Artificial Sequence
  Description of Artificial Sequence: Synthetic oligonucleotide
  Target: ATXN1; (+) strand; PAM type: YTN; PAM sequence: CTG
ggtctcttttatttacagtt

SEQ ID NO: 290180 - DNA, 20 bp, Artificial Sequence
  Description of Artificial Sequence: Synthetic oligonucleotide
  Target: ATXN1; (+) strand; PAM type: YTN; PAM sequence: CTC
ttttatttacagttttcccc

SEQ ID NO: 290181 - DNA, 20 bp, Artificial Sequence
  Description of Artificial Sequence: Synthetic oligonucleotide
  Target: ATXN1; (+) strand; PAM type: YTN; PAM sequence: CTT
ttatttacagttttccccag

SEQ ID NO: 290182 - DNA, 20 bp, Artificial Sequence
  Description of Artificial Sequence: Synthetic oligonucleotide
  Target: ATXN1; (+) strand; PAM type: YTN; PAM sequence: TTT
tatttacagttttccccagt

SEQ ID NO: 290183 - DNA, 20 bp, Artificial Sequence
  Description of Artificial Sequence: Synthetic oligonucleotide
  Target: ATXN1; (+) strand; PAM type: YTN; PAM sequence: TTT
atttacagttttccccagtg

SEQ ID NO: 290184 - DNA, 20 bp, Artificial Sequence
  Description of Artificial Sequence: Synthetic oligonucleotide
  Target: ATXN1; (+) strand; PAM type: YTN; PAM sequence: TTA
tttacagttttccccagtgc

SEQ ID NO: 290185 - DNA, 20 bp, Artificial Sequence
  Description of Artificial Sequence: Synthetic oligonucleotide
  Target: ATXN1; (+) strand; PAM type: YTN; PAM sequence: TTT
acagttttccccagtgccta

SEQ ID NO: 290186 - DNA, 20 bp, Artificial Sequence
  Description of Artificial Sequence: Synthetic oligonucleotide
  Target: ATXN1; (+) strand; PAM type: YTN; PAM sequence: TTA
cagttttccccagtgcctag

SEQ ID NO: 290187 - DNA, 20 bp, Artificial Sequence
  Description of Artificial Sequence: Synthetic oligonucleotide
  Target: ATXN1; (+) strand; PAM type: YTN; PAM sequence: TTT
tccccagtgcctagtacaac

SEQ ID NO: 290188 - DNA, 20 bp, Artificial Sequence
  Description of Artificial Sequence: Synthetic oligonucleotide
  Target: ATXN1; (+) strand; PAM type: YTN; PAM sequence: TTT
ccccagtgcctagtacaacg

SEQ ID NO: 290189 - DNA, 20 bp, Artificial Sequence
  Description of Artificial Sequence: Synthetic oligonucleotide
  Target: ATXN1; (+) strand; PAM type: YTN; PAM sequence: TTC
cccagtgcctagtacaacgc

SEQ ID NO: 290190 - DNA, 20 bp, Artificial Sequence
  Description of Artificial Sequence: Synthetic oligonucleotide
  Target: ATXN1; (+) strand; PAM type: YTN; PAM sequence: CTA
gtacaacgcctgacacatag

SEQ ID NO: 290191 - DNA, 20 bp, Artificial Sequence
  Description of Artificial Sequence: Synthetic oligonucleotide
  Target: ATXN1; (+) strand; PAM type: YTN; PAM sequence: CTG
acacatagtaagcaattaaa

SEQ ID NO: 290192 - DNA, 20 bp, Artificial Sequence
  Description of Artificial Sequence: Synthetic oligonucleotide
  Target: ATXN1; (+) strand; PAM type: YTN; PAM sequence: TTA
aaaacatttatggcactaga

SEQ ID NO: 290193 - DNA, 20 bp, Artificial Sequence
  Description of Artificial Sequence: Synthetic oligonucleotide
  Target: ATXN1; (+) strand; PAM type: YTN; PAM sequence: TTT
atggcactagaattttcaat

SEQ ID NO: 290194 - DNA, 20 bp, Artificial Sequence
  Description of Artificial Sequence: Synthetic oligonucleotide
  Target: ATXN1; (+) strand; PAM type: YTN; PAM sequence: TTA
tggcactagaattttcaatt

SEQ ID NO: 290195 - DNA, 20 bp, Artificial Sequence
  Description of Artificial Sequence: Synthetic oligonucleotide
  Target: ATXN1; (+) strand; PAM type: YTN; PAM sequence: CTA
gaattttcaattagctggct

SEQ ID NO: 290196 - DNA, 20 bp, Artificial Sequence
  Description of Artificial Sequence: Synthetic oligonucleotide
  Target: ATXN1; (+) strand; PAM type: YTN; PAM sequence: TTT
tcaattagctggctgcatat

SEQ ID NO: 290197 - DNA, 20 bp, Artificial Sequence
  Description of Artificial Sequence: Synthetic oligonucleotide
  Target: ATXN1; (+) strand; PAM type: YTN; PAM sequence: TTT
caattagctggctgcatatt

SEQ ID NO: 290198 - DNA, 20 bp, Artificial Sequence
  Description of Artificial Sequence: Synthetic oligonucleotide
  Target: ATXN1; (+) strand; PAM type: YTN; PAM sequence: TTC
aattagctggctgcatatta

SEQ ID NO: 290199 - DNA, 20 bp, Artificial Sequence
  Description of Artificial Sequence: Synthetic oligonucleotide
  Target: ATXN1; (+) strand; PAM type: YTN; PAM sequence: TTA
gctggctgcatattattgca

SEQ ID NO: 290200 - DNA, 20 bp, Artificial Sequence
  Description of Artificial Sequence: Synthetic oligonucleotide
  Target: ATXN1; (+) strand; PAM type: YTN; PAM sequence: CTG
gctgcatattattgcaaagt

SEQ ID NO: 290201 - DNA, 20 bp, Artificial Sequence
  Description of Artificial Sequence: Synthetic oligonucleotide
  Target: ATXN1; (+) strand; PAM type: YTN; PAM sequence: CTG
catattattgcaaagttaac

SEQ ID NO: 290202 - DNA, 20 bp, Artificial Sequence
  Description of Artificial Sequence: Synthetic oligonucleotide
  Target: ATXN1; (+) strand; PAM type: YTN; PAM sequence: TTA
ttgcaaagttaacatctgaa

SEQ ID NO: 290203 - DNA, 20 bp, Artificial Sequence
  Description of Artificial Sequence: Synthetic oligonucleotide
  Target: ATXN1; (+) strand; PAM type: YTN; PAM sequence: TTG
caaagttaacatctgaaaag

SEQ ID NO: 290204 - DNA, 20 bp, Artificial Sequence
  Description of Artificial Sequence: Synthetic oligonucleotide
  Target: ATXN1; (+) strand; PAM type: YTN; PAM sequence: TTA
acatctgaaaaggctattaa

SEQ ID NO: 290205 - DNA, 20 bp, Artificial Sequence
  Description of Artificial Sequence: Synthetic oligonucleotide
  Target: ATXN1; (+) strand; PAM type: YTN; PAM sequence: CTG
aaaaggctattaaaatggtc

SEQ ID NO: 290206 - DNA, 20 bp, Artificial Sequence
  Description of Artificial Sequence: Synthetic oligonucleotide
  Target: ATXN1; (+) strand; PAM type: YTN; PAM sequence: CTA
ttaaaatggtcatgtaaaga

SEQ ID NO: 290207 - DNA, 20 bp, Artificial Sequence
  Description of Artificial Sequence: Synthetic oligonucleotide
  Target: ATXN1; (+) strand; PAM type: YTN; PAM sequence: TTA
aaatggtcatgtaaagactt

SEQ ID NO: 290208 - DNA, 20 bp, Artificial Sequence
  Description of Artificial Sequence: Synthetic oligonucleotide
  Target: ATXN1; (+) strand; PAM type: YTN; PAM sequence: CTT
ggtaaccaatataatctagt

SEQ ID NO: 290209 - DNA, 20 bp, Artificial Sequence
  Description of Artificial Sequence: Synthetic oligonucleotide
  Target: ATXN1; (+) strand; PAM type: YTN; PAM sequence: TTG
gtaaccaatataatctagtt

SEQ ID NO: 290210 - DNA, 20 bp, Artificial Sequence
  Description of Artificial Sequence: Synthetic oligonucleotide
  Target: ATXN1; (+) strand; PAM type: YTN; PAM sequence: CTA
gtttaataatatttatttat

SEQ ID NO: 290211 - DNA, 20 bp, Artificial Sequence
  Description of Artificial Sequence: Synthetic oligonucleotide
  Target: ATXN1; (+) strand; PAM type: YTN; PAM sequence: TTT
aataatatttatttatttac

SEQ ID NO: 290212 - DNA, 20 bp, Artificial Sequence
  Description of Artificial Sequence: Synthetic oligonucleotide
  Target: ATXN1; (+) strand; PAM type: YTN; PAM sequence: TTA
ataatatttatttatttact

SEQ ID NO: 290213 - DNA, 20 bp, Artificial Sequence
  Description of Artificial Sequence: Synthetic oligonucleotide
  Target: ATXN1; (+) strand; PAM type: YTN; PAM sequence: TTT
atttatttactttatttctt

SEQ ID NO: 290214 - DNA, 20 bp, Artificial Sequence
  Description of Artificial Sequence: Synthetic oligonucleotide
  Target: ATXN1; (+) strand; PAM type: YTN; PAM sequence: TTA
tttatttactttatttcttg

SEQ ID NO: 290215 - DNA, 20 bp, Artificial Sequence
  Description of Artificial Sequence: Synthetic oligonucleotide
  Target: ATXN1; (+) strand; PAM type: YTN; PAM sequence: TTT
atttactttatttcttgttt

SEQ ID NO: 290216 - DNA, 20 bp, Artificial Sequence
  Description of Artificial Sequence: Synthetic oligonucleotide
  Target: ATXN1; (+) strand; PAM type: YTN; PAM sequence: TTA
tttactttatttcttgtttt

SEQ ID NO: 290217 - DNA, 20 bp, Artificial Sequence
  Description of Artificial Sequence: Synthetic oligonucleotide
  Target: ATXN1; (+) strand; PAM type: YTN; PAM sequence: TTT
actttatttcttgtttttga

SEQ ID NO: 290218 - DNA, 20 bp, Artificial Sequence
  Description of Artificial Sequence: Synthetic oligonucleotide
  Target: ATXN1; (+) strand; PAM type: YTN; PAM sequence: TTA
ctttatttcttgtttttgag

SEQ ID NO: 290219 - DNA, 20 bp, Artificial Sequence
  Description of Artificial Sequence: Synthetic oligonucleotide
  Target: ATXN1; (+) strand; PAM type: YTN; PAM sequence: CTT
tatttcttgtttttgagtca

SEQ ID NO: 290220 - DNA, 20 bp, Artificial Sequence
  Description of Artificial Sequence: Synthetic oligonucleotide
  Target: ATXN1; (+) strand; PAM type: YTN; PAM sequence: TTT
atttcttgtttttgagtcag

SEQ ID NO: 290221 - DNA, 20 bp, Artificial Sequence
  Description of Artificial Sequence: Synthetic oligonucleotide
  Target: ATXN1; (+) strand; PAM type: YTN; PAM sequence: TTA
tttcttgtttttgagtcagg

SEQ ID NO: 290222 - DNA, 20 bp, Artificial Sequence
  Description of Artificial Sequence: Synthetic oligonucleotide
  Target: ATXN1; (+) strand; PAM type: YTN; PAM sequence: TTT
cttgtttttgagtcagggtc

SEQ ID NO: 290223 - DNA, 20 bp, Artificial Sequence
  Description of Artificial Sequence: Synthetic oligonucleotide
  Target: ATXN1; (+) strand; PAM type: YTN; PAM sequence: TTC
ttgtttttgagtcagggtct

SEQ ID NO: 290224 - DNA, 20 bp, Artificial Sequence
  Description of Artificial Sequence: Synthetic oligonucleotide
  Target: ATXN1; (+) strand; PAM type: YTN; PAM sequence: CTT
gtttttgagtcagggtcttc

SEQ ID NO: 290225 - DNA, 20 bp, Artificial Sequence
  Description of Artificial Sequence: Synthetic oligonucleotide
  Target: ATXN1; (+) strand; PAM type: YTN; PAM sequence: TTG
tttttgagtcagggtcttcc

SEQ ID NO: 290226 - DNA, 20 bp, Artificial Sequence
  Description of Artificial Sequence: Synthetic oligonucleotide
  Target: ATXN1; (+) strand; PAM type: YTN; PAM sequence: TTT
ttgagtcagggtcttcctct

SEQ ID NO: 290227 - DNA, 20 bp, Artificial Sequence
  Description of Artificial Sequence: Synthetic oligonucleotide
  Target: ATXN1; (+) strand; PAM type: YTN; PAM sequence: TTT
tgagtcagggtcttcctctg

SEQ ID NO: 290228 - DNA, 20 bp, Artificial Sequence
  Description of Artificial Sequence: Synthetic oligonucleotide
  Target: ATXN1; (+) strand; PAM type: YTN; PAM sequence: TTT
gagtcagggtcttcctctgt

SEQ ID NO: 290229 - DNA, 20 bp, Artificial Sequence
  Description of Artificial Sequence: Synthetic oligonucleotide
  Target: ATXN1; (+) strand; PAM type: YTN; PAM sequence: TTG
agtcagggtcttcctctgtt

SEQ ID NO: 290230 - DNA, 20 bp, Artificial Sequence
  Description of Artificial Sequence: Synthetic oligonucleotide
  Target: ATXN1; (+) strand; PAM type: YTN; PAM sequence: CTT
cctctgttgcccaggctgga

SEQ ID NO: 290231 - DNA, 20 bp, Artificial Sequence
  Description of Artificial Sequence: Synthetic oligonucleotide
  Target: ATXN1; (+) strand; PAM type: YTN; PAM sequence: TTC
ctctgttgcccaggctggag

SEQ ID NO: 290232 - DNA, 20 bp, Artificial Sequence
  Description of Artificial Sequence: Synthetic oligonucleotide
  Target: ATXN1; (+) strand; PAM type: YTN; PAM sequence: CTC
tgttgcccaggctggagtgc

SEQ ID NO: 290233 - DNA, 20 bp, Artificial Sequence
  Description of Artificial Sequence: Synthetic oligonucleotide
  Target: ATXN1; (+) strand; PAM type: YTN; PAM sequence: CTG
ttgcccaggctggagtgcag

SEQ ID NO: 290234 - DNA, 20 bp, Artificial Sequence
  Description of Artificial Sequence: Synthetic oligonucleotide
  Target: ATXN1; (+) strand; PAM type: YTN; PAM sequence: TTG
cccaggctggagtgcagtgg

SEQ ID NO: 290235 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggtgcatgtga

SEQ ID NO: 290236 - DNA, 20 bp, Artificial Sequence
  Description of Artificial Sequence: Synthetic oligonucleotide
  Target: ATXN1; (+) strand; PAM type: YTN; PAM sequence: CTT
agctcactgcaacctctctg

SEQ ID NO: 290237 - DNA, 20 bp, Artificial Sequence
  Description of Artificial Sequence: Synthetic oligonucleotide
  Target: ATXN1; (+) strand; PAM type: YTN; PAM sequence: TTA
gctcactgcaacctctctgc

SEQ ID NO: 290238 - DNA, 20 bp, Artificial Sequence
  Description of Artificial Sequence: Synthetic oligonucleotide
  Target: ATXN1; (+) strand; PAM type: YTN; PAM sequence: CTC
actgcaacctctctgcctcc

SEQ ID NO: 290239 - DNA, 20 bp, Artificial Sequence
  Description of Artificial Sequence: Synthetic oligonucleotide
  Target: ATXN1; (+) strand; PAM type: YTN; PAM sequence: CTG
caacctctctgcctcccagg

SEQ ID NO: 290240 - DNA, 20 bp, Artificial Sequence
  Description of Artificial Sequence: Synthetic oligonucleotide
  Target: ATXN1; (+) strand; PAM type: YTN; PAM sequence: CTC
tctgcctcccaggttcaagt

SEQ ID NO: 290241 - DNA, 20 bp, Artificial Sequence
  Description of Artificial Sequence: Synthetic oligonucleotide
  Target: ATXN1; (+) strand; PAM type: YTN; PAM sequence: CTC
tgcctcccaggttcaagtga

SEQ ID NO: 290242 - DNA, 20 bp, Artificial Sequence
  Description of Artificial Sequence: Synthetic oligonucleotide
  Target: ATXN1; (+) strand; PAM type: YTN; PAM sequence: CTG
cctcccaggttcaagtgatt

SEQ ID NO: 290243 - DNA, 20 bp, Artificial Sequence
  Description of Artificial Sequence: Synthetic oligonucleotide
  Target: ATXN1; (+) strand; PAM type: YTN; PAM sequence: CTC
ccaggttcaagtgattctcc

SEQ ID NO: 290244 - DNA, 20 bp, Artificial Sequence
  Description of Artificial Sequence: Synthetic oligonucleotide
  Target: ATXN1; (+) strand; PAM type: YTN; PAM sequence: TTC
aagtgattctcctgcctcag

SEQ ID NO: 290245 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcccaag

SEQ ID NO: 290246 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccaagca

SEQ ID NO: 290247 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaagcagct

SEQ ID NO: 290248 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagcagctggga

SEQ ID NO: 290249 - DNA, 20 bp, Artificial Sequence
  Description of Artificial Sequence: Synthetic oligonucleotide
  Target: ATXN1; (+) strand; PAM type: YTN; PAM sequence: CTC
ccaagcagctgggattacag

SEQ ID NO: 290250 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcacgcaccac

SEQ ID NO: 290251 - DNA, 20 bp, Artificial Sequence
  Description of Artificial Sequence: Synthetic oligonucleotide
  Target: ATXN1; (+) strand; PAM type: YTN; PAM sequence: TTA
caggcacgcaccaccatgcc

SEQ ID NO: 290252 - DNA, 20 bp, Artificial Sequence
  Description of Artificial Sequence: Synthetic oligonucleotide
  Target: ATXN1; (+) strand; PAM type: YTN; PAM sequence: CTA
atttttgtttttttagtaga

SEQ ID NO: 290253 - DNA, 20 bp, Artificial Sequence
  Description of Artificial Sequence: Synthetic oligonucleotide
  Target: ATXN1; (+) strand; PAM type: YTN; PAM sequence: TTT
ttgtttttttagtagagacg

SEQ ID NO: 290254 - DNA, 20 bp, Artificial Sequence
  Description of Artificial Sequence: Synthetic oligonucleotide
  Target: ATXN1; (+) strand; PAM type: YTN; PAM sequence: TTT
tgtttttttagtagagacgg

SEQ ID NO: 290255 - DNA, 20 bp, Artificial Sequence
  Description of Artificial Sequence: Synthetic oligonucleotide
  Target: ATXN1; (+) strand; PAM type: YTN; PAM sequence: TTT
gtttttttagtagagacggg

SEQ ID NO: 290256 - DNA, 20 bp, Artificial Sequence
  Description of Artificial Sequence: Synthetic oligonucleotide
  Target: ATXN1; (+) strand; PAM type: YTN; PAM sequence: TTG
tttttttagtagagacgggg

SEQ ID NO: 290257 - DNA, 20 bp, Artificial Sequence
  Description of Artificial Sequence: Synthetic oligonucleotide
  Target: ATXN1; (+) strand; PAM type: YTN; PAM sequence: TTT
ttttagtagagacggggttt

SEQ ID NO: 290258 - DNA, 20 bp, Artificial Sequence
  Description of Artificial Sequence: Synthetic oligonucleotide
  Target: ATXN1; (+) strand; PAM type: YTN; PAM sequence: TTT
tttagtagagacggggtttc

SEQ ID NO: 290259 - DNA, 20 bp, Artificial Sequence
  Description of Artificial Sequence: Synthetic oligonucleotide
  Target: ATXN1; (+) strand; PAM type: YTN; PAM sequence: TTT
ttagtagagacggggtttca

SEQ ID NO: 290260 - DNA, 20 bp, Artificial Sequence
  Description of Artificial Sequence: Synthetic oligonucleotide
  Target: ATXN1; (+) strand; PAM type: YTN; PAM sequence: TTT
tagtagagacggggtttcac

SEQ ID NO: 290261 - DNA, 20 bp, Artificial Sequence
  Description of Artificial Sequence: Synthetic oligonucleotide
  Target: ATXN1; (+) strand; PAM type: YTN; PAM sequence: TTT
agtagagacggggtttcacc

SEQ ID NO: 290262 - DNA, 20 bp, Artificial Sequence
  Description of Artificial Sequence: Synthetic oligonucleotide
  Target: ATXN1; (+) strand; PAM type: YTN; PAM sequence: TTA
gtagagacggggtttcacca

SEQ ID NO: 290263 - DNA, 20 bp, Artificial Sequence
  Description of Artificial Sequence: Synthetic oligonucleotide
  Target: ATXN1; (+) strand; PAM type: YTN; PAM sequence: TTT
caccatgttggccaggctgt

SEQ ID NO: 290264 - DNA, 20 bp, Artificial Sequence
  Description of Artificial Sequence: Synthetic oligonucleotide
  Target: ATXN1; (+) strand; PAM type: YTN; PAM sequence: TTC
accatgttggccaggctgtt

SEQ ID NO: 290265 - DNA, 20 bp, Artificial Sequence
  Description of Artificial Sequence: Synthetic oligonucleotide
  Target: ATXN1; (+) strand; PAM type: YTN; PAM sequence: TTG
gccaggctgttcacgaactc

SEQ ID NO: 290266 - DNA, 20 bp, Artificial Sequence
  Description of Artificial Sequence: Synthetic oligonucleotide
  Target: ATXN1; (+) strand; PAM type: YTN; PAM sequence: CTG
ttcacgaactcctgacctca

SEQ ID NO: 290267 - DNA, 20 bp, Artificial Sequence
  Description of Artificial Sequence: Synthetic oligonucleotide
  Target: ATXN1; (+) strand; PAM type: YTN; PAM sequence: TTC
acgaactcctgacctcagat

SEQ ID NO: 290268 - DNA, 20 bp, Artificial Sequence
  Description of Artificial Sequence: Synthetic oligonucleotide
  Target: ATXN1; (+) strand; PAM type: YTN; PAM sequence: CTC
ctgacctcagatgatgtgcc

SEQ ID NO: 290269 - DNA, 20 bp, Artificial Sequence
  Description of Artificial Sequence: Synthetic oligonucleotide
  Target: ATXN1; (+) strand; PAM type: YTN; PAM sequence: CTG
acctcagatgatgtgcccac

SEQ ID NO: 290270 - DNA, 20 bp, Artificial Sequence
  Description of Artificial Sequence: Synthetic oligonucleotide
  Target: ATXN1; (+) strand; PAM type: YTN; PAM sequence: CTC
agatgatgtgcccacccacc

SEQ ID NO: 290271 - DNA, 20 bp, Artificial Sequence
  Description of Artificial Sequence: Synthetic oligonucleotide
  Target: ATXN1; (+) strand; PAM type: YTN; PAM sequence: CTC
ggcctcccaaagtactgaga

SEQ ID NO: 290272 - DNA, 20 bp, Artificial Sequence
  Description of Artificial Sequence: Synthetic oligonucleotide
  Target: ATXN1; (+) strand; PAM type: YTN; PAM sequence: CTC
ccaaagtactgagattacag

SEQ ID NO: 290273 - DNA, 20 bp, Artificial Sequence
  Description of Artificial Sequence: Synthetic oligonucleotide
  Target: ATXN1; (+) strand; PAM type: YTN; PAM sequence: CTG
agattacaggcatgagccac

SEQ ID NO: 290274 - DNA, 20 bp, Artificial Sequence
  Description of Artificial Sequence: Synthetic oligonucleotide
  Target: ATXN1; (+) strand; PAM type: YTN; PAM sequence: TTA
caggcatgagccactgcgcc

SEQ ID NO: 290275 - DNA, 20 bp, Artificial Sequence
  Description of Artificial Sequence: Synthetic oligonucleotide
  Target: ATXN1; (+) strand; PAM type: YTN; PAM sequence: CTG
cgcccagctggtttaatcat

SEQ ID NO: 290276 - DNA, 20 bp, Artificial Sequence
  Description of Artificial Sequence: Synthetic oligonucleotide
  Target: ATXN1; (+) strand; PAM type: YTN; PAM sequence: CTG
gtttaatcatacttaatcaa

SEQ ID NO: 290277 - DNA, 20 bp, Artificial Sequence
  Description of Artificial Sequence: Synthetic oligonucleotide
  Target: ATXN1; (+) strand; PAM type: YTN; PAM sequence: TTT
aatcatacttaatcaactaa

SEQ ID NO: 290278 - DNA, 20 bp, Artificial Sequence
  Description of Artificial Sequence: Synthetic oligonucleotide
  Target: ATXN1; (+) strand; PAM type: YTN; PAM sequence: TTA
atcatacttaatcaactaat

SEQ ID NO: 290279 - DNA, 20 bp, Artificial Sequence
  Description of Artificial Sequence: Synthetic oligonucleotide
  Target: ATXN1; (+) strand; PAM type: YTN; PAM sequence: CTT
aatcaactaatgaatcaagt

SEQ ID NO: 290280 - DNA, 20 bp, Artificial Sequence
  Description of Artificial Sequence: Synthetic oligonucleotide
  Target: ATXN1; (+) strand; PAM type: YTN; PAM sequence: TTA
atcaactaatgaatcaagtt

SEQ ID NO: 290281 - DNA, 20 bp, Artificial Sequence
  Description of Artificial Sequence: Synthetic oligonucleotide
  Target: ATXN1; (+) strand; PAM type: YTN; PAM sequence: CTA
atgaatcaagttaacttatg

SEQ ID NO: 290282 - DNA, 20 bp, Artificial Sequence
  Description of Artificial Sequence: Synthetic oligonucleotide
  Target: ATXN1; (+) strand; PAM type: YTN; PAM sequence: TTA
acttatggatactgttactg

SEQ ID NO: 290283 - DNA, 20 bp, Artificial Sequence
  Description of Artificial Sequence: Synthetic oligonucleotide
  Target: ATXN1; (+) strand; PAM type: YTN; PAM sequence: CTT
atggatactgttactggctg

SEQ ID NO: 290284 - DNA, 20 bp, Artificial Sequence
  Description of Artificial Sequence: Synthetic oligonucleotide
  Target: ATXN1; (+) strand; PAM type: YTN; PAM sequence: TTA
tggatactgttactggctga

SEQ ID NO: 290285 - DNA, 20 bp, Artificial Sequence
  Description of Artificial Sequence: Synthetic oligonucleotide
  Target: ATXN1; (+) strand; PAM type: YTN; PAM sequence: CTG
ttactggctgaattttttcc

SEQ ID NO: 290286 - DNA, 20 bp, Artificial Sequence
  Description of Artificial Sequence: Synthetic oligonucleotide
  Target: ATXN1; (+) strand; PAM type: YTN; PAM sequence: TTA
ctggctgaattttttccccc

SEQ ID NO: 290287 - DNA, 20 bp, Artificial Sequence
  Description of Artificial Sequence: Synthetic oligonucleotide
  Target: ATXN1; (+) strand; PAM type: YTN; PAM sequence: CTG
gctgaattttttccccccac

SEQ ID NO: 290288 - DNA, 20 bp, Artificial Sequence
  Description of Artificial Sequence: Synthetic oligonucleotide
  Target: ATXN1; (+) strand; PAM type: YTN; PAM sequence: CTG
aattttttccccccacaacc

SEQ ID NO: 290289 - DNA, 20 bp, Artificial Sequence
  Description of Artificial Sequence: Synthetic oligonucleotide
  Target: ATXN1; (+) strand; PAM type: YTN; PAM sequence: TTT
tttccccccacaaccactca

SEQ ID NO: 290290 - DNA, 20 bp, Artificial Sequence
  Description of Artificial Sequence: Synthetic oligonucleotide
  Target: ATXN1; (+) strand; PAM type: YTN; PAM sequence: TTT
ttccccccacaaccactcaa

SEQ ID NO: 290291 - DNA, 20 bp, Artificial Sequence
  Description of Artificial Sequence: Synthetic oligonucleotide
  Target: ATXN1; (+) strand; PAM type: YTN; PAM sequence: TTT
tccccccacaaccactcaaa

SEQ ID NO: 290292 - DNA, 20 bp, Artificial Sequence
  Description of Artificial Sequence: Synthetic oligonucleotide
  Target: ATXN1; (+) strand; PAM type: YTN; PAM sequence: TTT
ccccccacaaccactcaaaa

SEQ ID NO: 290293 - DNA, 20 bp, Artificial Sequence
  Description of Artificial Sequence: Synthetic oligonucleotide
  Target: ATXN1; (+) strand; PAM type: YTN; PAM sequence: TTC
cccccacaaccactcaaaat

SEQ ID NO: 290294 - DNA, 20 bp, Artificial Sequence
  Description of Artificial Sequence: Synthetic oligonucleotide
  Target: ATXN1; (+) strand; PAM type: YTN; PAM sequence: CTC
aaaattcatgtgttgaagcc

SEQ ID NO: 290295 - DNA, 20 bp, Artificial Sequence
  Description of Artificial Sequence: Synthetic oligonucleotide
  Target: ATXN1; (+) strand; PAM type: YTN; PAM sequence: TTC
atgtgttgaagccctaactt

SEQ ID NO: 290296 - DNA, 20 bp, Artificial Sequence
  Description of Artificial Sequence: Synthetic oligonucleotide
  Target: ATXN1; (+) strand; PAM type: YTN; PAM sequence: TTG
aagccctaacttccagtttc

SEQ ID NO: 290297 - DNA, 20 bp, Artificial Sequence
  Description of Artificial Sequence: Synthetic oligonucleotide
  Target: ATXN1; (+) strand; PAM type: YTN; PAM sequence: CTA
acttccagtttctcagaata

SEQ ID NO: 290298 - DNA, 20 bp, Artificial Sequence
  Description of Artificial Sequence: Synthetic oligonucleotide
  Target: ATXN1; (+) strand; PAM type: YTN; PAM sequence: CTT
ccagtttctcagaatataac

SEQ ID NO: 290299 - DNA, 20 bp, Artificial Sequence
  Description of Artificial Sequence: Synthetic oligonucleotide
  Target: ATXN1; (+) strand; PAM type: YTN; PAM sequence: TTC
cagtttctcagaatataact

SEQ ID NO: 290300 - DNA, 20 bp, Artificial Sequence
  Description of Artificial Sequence: Synthetic oligonucleotide
  Target: ATXN1; (+) strand; PAM type: YTN; PAM sequence: TTT
ctcagaatataactgtattt

SEQ ID NO: 290301 - DNA, 20 bp, Artificial Sequence
  Description of Artificial Sequence: Synthetic oligonucleotide
  Target: ATXN1; (+) strand; PAM type: YTN; PAM sequence: TTC
tcagaatataactgtatttg

SEQ ID NO: 290302 - DNA, 20 bp, Artificial Sequence
  Description of Artificial Sequence: Synthetic oligonucleotide
  Target: ATXN1; (+) strand; PAM type: YTN; PAM sequence: CTC
agaatataactgtatttgga

SEQ ID NO: 290303 - DNA, 20 bp, Artificial Sequence
  Description of Artificial Sequence: Synthetic oligonucleotide
  Target: ATXN1; (+) strand; PAM type: YTN; PAM sequence: CTG
tatttggaaattggaccttt

SEQ ID NO: 290304 - DNA, 20 bp, Artificial Sequence
  Description of Artificial Sequence: Synthetic oligonucleotide
  Target: ATXN1; (+) strand; PAM type: YTN; PAM sequence: TTT
ggaaattggaccttttgaga

SEQ ID NO: 290305 - DNA, 20 bp, Artificial Sequence
  Description of Artificial Sequence: Synthetic oligonucleotide
  Target: ATXN1; (+) strand; PAM type: YTN; PAM sequence: TTG
gaaattggaccttttgagag

SEQ ID NO: 290306 - DNA, 20 bp, Artificial Sequence
  Description of Artificial Sequence: Synthetic oligonucleotide
  Target: ATXN1; (+) strand; PAM type: YTN; PAM sequence: TTG
gaccttttgagaggtaatta

SEQ ID NO: 290307 - DNA, 20 bp, Artificial Sequence
  Description of Artificial Sequence: Synthetic oligonucleotide
  Target: ATXN1; (+) strand; PAM type: YTN; PAM sequence: CTT
ttgagaggtaattaaaacaa

SEQ ID NO: 290308 - DNA, 20 bp, Artificial Sequence
  Description of Artificial Sequence: Synthetic oligonucleotide
  Target: ATXN1; (+) strand; PAM type: YTN; PAM sequence: TTT
tgagaggtaattaaaacaaa

SEQ ID NO: 290309 - DNA, 20 bp, Artificial Sequence
  Description of Artificial Sequence: Synthetic oligonucleotide
  Target: ATXN1; (+) strand; PAM type: YTN; PAM sequence: TTT
gagaggtaattaaaacaaaa

SEQ ID NO: 290310 - DNA, 20 bp, Artificial Sequence
  Description of Artificial Sequence: Synthetic oligonucleotide
  Target: ATXN1; (+) strand; PAM type: YTN; PAM sequence: TTG
agaggtaattaaaacaaaat

SEQ ID NO: 290311 - DNA, 20 bp, Artificial Sequence
  Description of Artificial Sequence: Synthetic oligonucleotide
  Target: ATXN1; (+) strand; PAM type: YTN; PAM sequence: TTA
aaacaaaataaggtcatatg

SEQ ID NO: 290312 - DNA, 20 bp, Artificial Sequence
  Description of Artificial Sequence: Synthetic oligonucleotide
  Target: ATXN1; (+) strand; PAM type: YTN; PAM sequence: CTA
ttccactatgactggtgtcc

SEQ ID NO: 290313 - DNA, 20 bp, Artificial Sequence
  Description of Artificial Sequence: Synthetic oligonucleotide
  Target: ATXN1; (+) strand; PAM type: YTN; PAM sequence: TTC
cactatgactggtgtccttg

SEQ ID NO: 290314 - DNA, 20 bp, Artificial Sequence
  Description of Artificial Sequence: Synthetic oligonucleotide
  Target: ATXN1; (+) strand; PAM type: YTN; PAM sequence: CTA
tgactggtgtccttgtaaca

SEQ ID NO: 290315 - DNA, 20 bp, Artificial Sequence
  Description of Artificial Sequence: Synthetic oligonucleotide
  Target: ATXN1; (+) strand; PAM type: YTN; PAM sequence: CTG
gtgtccttgtaacaggagac

SEQ ID NO: 290316 - DNA, 20 bp, Artificial Sequence
  Description of Artificial Sequence: Synthetic oligonucleotide
  Target: ATXN1; (+) strand; PAM type: YTN; PAM sequence: CTT
gtaacaggagactgggacac

SEQ ID NO: 290317 - DNA, 20 bp, Artificial Sequence
  Description of Artificial Sequence: Synthetic oligonucleotide
  Target: ATXN1; (+) strand; PAM type: YTN; PAM sequence: TTG
taacaggagactgggacaca

SEQ ID NO: 290318 - DNA, 20 bp, Artificial Sequence
  Description of Artificial Sequence: Synthetic oligonucleotide
  Target: ATXN1; (+) strand; PAM type: YTN; PAM sequence: CTG
ggacacagacttggagggaa

SEQ ID NO: 290319 - DNA, 20 bp, Artificial Sequence
  Description of Artificial Sequence: Synthetic oligonucleotide
  Target: ATXN1; (+) strand; PAM type: YTN; PAM sequence: CTT
ggagggaagcccacgagagg

SEQ ID NO: 290320 - DNA, 20 bp, Artificial Sequence
  Description of Artificial Sequence: Synthetic oligonucleotide
  Target: ATXN1; (+) strand; PAM type: YTN; PAM sequence: TTG
gagggaagcccacgagagga

SEQ ID NO: 290321 - DNA, 20 bp, Artificial Sequence
  Description of Artificial Sequence: Synthetic oligonucleotide
  Target: ATXN1; (+) strand; PAM type: YTN; PAM sequence: CTG
caagccaaggagaaggactt

SEQ ID NO: 290322 - DNA, 20 bp, Artificial Sequence
  Description of Artificial Sequence: Synthetic oligonucleotide
  Target: ATXN1; (+) strand; PAM type: YTN; PAM sequence: CTT
cagaaggaaccaactttcct

SEQ ID NO: 290323 - DNA, 20 bp, Artificial Sequence
  Description of Artificial Sequence: Synthetic oligonucleotide
  Target: ATXN1; (+) strand; PAM type: YTN; PAM sequence: TTC
agaaggaaccaactttcctg

SEQ ID NO: 290324 - DNA, 20 bp, Artificial Sequence
  Description of Artificial Sequence: Synthetic oligonucleotide
  Target: ATXN1; (+) strand; PAM type: YTN; PAM sequence: CTT
tcctgacactttcatttcaa

SEQ ID NO: 290325 - DNA, 20 bp, Artificial Sequence
  Description of Artificial Sequence: Synthetic oligonucleotide
  Target: ATXN1; (+) strand; PAM type: YTN; PAM sequence: TTT
cctgacactttcatttcaaa

SEQ ID NO: 290326 - DNA, 20 bp, Artificial Sequence
  Description of Artificial Sequence: Synthetic oligonucleotide
  Target: ATXN1; (+) strand; PAM type: YTN; PAM sequence: TTC
ctgacactttcatttcaaac

SEQ ID NO: 290327 - DNA, 20 bp, Artificial Sequence
  Description of Artificial Sequence: Synthetic oligonucleotide
  Target: ATXN1; (+) strand; PAM type: YTN; PAM sequence: CTG
acactttcatttcaaactta

SEQ ID NO: 290328 - DNA, 20 bp, Artificial Sequence
  Description of Artificial Sequence: Synthetic oligonucleotide
  Target: ATXN1; (+) strand; PAM type: YTN; PAM sequence: CTT
tcatttcaaacttactgtct

SEQ ID NO: 290329 - DNA, 20 bp, Artificial Sequence
  Description of Artificial Sequence: Synthetic oligonucleotide
  Target: ATXN1; (+) strand; PAM type: YTN; PAM sequence: TTT
catttcaaacttactgtctc

SEQ ID NO: 290330 - DNA, 20 bp, Artificial Sequence
  Description of Artificial Sequence: Synthetic oligonucleotide
  Target: ATXN1; (+) strand; PAM type: YTN; PAM sequence: TTC
atttcaaacttactgtctct

SEQ ID NO: 290331 - DNA, 20 bp, Artificial Sequence
  Description of Artificial Sequence: Synthetic oligonucleotide
  Target: ATXN1; (+) strand; PAM type: YTN; PAM sequence: TTT
caaacttactgtctctagaa

SEQ ID NO: 290332 - DNA, 20 bp, Artificial Sequence
  Description of Artificial Sequence: Synthetic oligonucleotide
  Target: ATXN1; (+) strand; PAM type: YTN; PAM sequence: TTC
aaacttactgtctctagaat

SEQ ID NO: 290333 - DNA, 20 bp, Artificial Sequence
  Description of Artificial Sequence: Synthetic oligonucleotide
  Target: ATXN1; (+) strand; PAM type: YTN; PAM sequence: CTT
actgtctctagaatcataag

SEQ ID NO: 290334 - DNA, 20 bp, Artificial Sequence
  Description of Artificial Sequence: Synthetic oligonucleotide
  Target: ATXN1; (+) strand; PAM type: YTN; PAM sequence: TTA
ctgtctctagaatcataaga

SEQ ID NO: 290335 - DNA, 20 bp, Artificial Sequence
  Description of Artificial Sequence: Synthetic oligonucleotide
  Target: ATXN1; (+) strand; PAM type: YTN; PAM sequence: CTG
tctctagaatcataagaaaa

SEQ ID NO: 290336 - DNA, 20 bp, Artificial Sequence
  Description of Artificial Sequence: Synthetic oligonucleotide
  Target: ATXN1; (+) strand; PAM type: YTN; PAM sequence: CTC
tagaatcataagaaaataag

SEQ ID NO: 290337 - DNA, 20 bp, Artificial Sequence
  Description of Artificial Sequence: Synthetic oligonucleotide
  Target: ATXN1; (+) strand; PAM type: YTN; PAM sequence: CTA
gaatcataagaaaataagtt

SEQ ID NO: 290338 - DNA, 20 bp, Artificial Sequence
  Description of Artificial Sequence: Synthetic oligonucleotide
  Target: ATXN1; (+) strand; PAM type: YTN; PAM sequence: TTT
gtgctgtttaagccactcag

SEQ ID NO: 290339 - DNA, 20 bp, Artificial Sequence
  Description of Artificial Sequence: Synthetic oligonucleotide
  Target: ATXN1; (+) strand; PAM type: YTN; PAM sequence: TTG
tgctgtttaagccactcagt

SEQ ID NO: 290340 - DNA, 20 bp, Artificial Sequence
  Description of Artificial Sequence: Synthetic oligonucleotide
  Target: ATXN1; (+) strand; PAM type: YTN; PAM sequence: CTG
tttaagccactcagtctggg

SEQ ID NO: 290341 - DNA, 20 bp, Artificial Sequence
  Description of Artificial Sequence: Synthetic oligonucleotide
  Target: ATXN1; (+) strand; PAM type: YTN; PAM sequence: TTT
aagccactcagtctgggtta

SEQ ID NO: 290342 - DNA, 20 bp, Artificial Sequence
  Description of Artificial Sequence: Synthetic oligonucleotide
  Target: ATXN1; (+) strand; PAM type: YTN; PAM sequence: TTA
agccactcagtctgggttac

SEQ ID NO: 290343 - DNA, 20 bp, Artificial Sequence
  Description of Artificial Sequence: Synthetic oligonucleotide
  Target: ATXN1; (+) strand; PAM type: YTN; PAM sequence: CTC
agtctgggttactttgttat

SEQ ID NO: 290344 - DNA, 20 bp, Artificial Sequence
  Description of Artificial Sequence: Synthetic oligonucleotide
  Target: ATXN1; (+) strand; PAM type: YTN; PAM sequence: CTG
ggttactttgttatggtaga

SEQ ID NO: 290345 - DNA, 20 bp, Artificial Sequence
  Description of Artificial Sequence: Synthetic oligonucleotide
  Target: ATXN1; (+) strand; PAM type: YTN; PAM sequence: TTA
ctttgttatggtagacctcg

SEQ ID NO: 290346 - DNA, 20 bp, Artificial Sequence
  Description of Artificial Sequence: Synthetic oligonucleotide
  Target: ATXN1; (+) strand; PAM type: YTN; PAM sequence: CTT
tgttatggtagacctcgcaa

SEQ ID NO: 290347 - DNA, 20 bp, Artificial Sequence
  Description of Artificial Sequence: Synthetic oligonucleotide
  Target: ATXN1; (+) strand; PAM type: YTN; PAM sequence: TTT
gttatggtagacctcgcaaa

SEQ ID NO: 290348 - DNA, 20 bp, Artificial Sequence
  Description of Artificial Sequence: Synthetic oligonucleotide
  Target: ATXN1; (+) strand; PAM type: YTN; PAM sequence: TTG
ttatggtagacctcgcaaac

SEQ ID NO: 290349 - DNA, 20 bp, Artificial Sequence
  Description of Artificial Sequence: Synthetic oligonucleotide
  Target: ATXN1; (+) strand; PAM type: YTN; PAM sequence: TTA
tggtagacctcgcaaactga

SEQ ID NO: 290350 - DNA, 20 bp, Artificial Sequence
  Description of Artificial Sequence: Synthetic oligonucleotide
  Target: ATXN1; (+) strand; PAM type: YTN; PAM sequence: CTC
gcaaactgacagatactaag

SEQ ID NO: 290351 - DNA, 20 bp, Artificial Sequence
  Description of Artificial Sequence: Synthetic oligonucleotide
  Target: ATXN1; (+) strand; PAM type: YTN; PAM sequence: CTG
acagatactaagcccttgtt

SEQ ID NO: 290352 - DNA, 20 bp, Artificial Sequence
  Description of Artificial Sequence: Synthetic oligonucleotide
  Target: ATXN1; (+) strand; PAM type: YTN; PAM sequence: CTA
agcccttgtttgagatggag

SEQ ID NO: 290353 - DNA, 20 bp, Artificial Sequence
  Description of Artificial Sequence: Synthetic oligonucleotide
  Target: ATXN1; (+) strand; PAM type: YTN; PAM sequence: CTT
gtttgagatggagctgtggc

SEQ ID NO: 290354 - DNA, 20 bp, Artificial Sequence
  Description of Artificial Sequence: Synthetic oligonucleotide
  Target: ATXN1; (+) strand; PAM type: YTN; PAM sequence: TTG
tttgagatggagctgtggcc

SEQ ID NO: 290355 - DNA, 20 bp, Artificial Sequence
  Description of Artificial Sequence: Synthetic oligonucleotide
  Target: ATXN1; (+) strand; PAM type: YTN; PAM sequence: TTT
gagatggagctgtggcccta

SEQ ID NO: 290356 - DNA, 20 bp, Artificial Sequence
  Description of Artificial Sequence: Synthetic oligonucleotide
  Target: ATXN1; (+) strand; PAM type: YTN; PAM sequence: TTG
agatggagctgtggccctat

SEQ ID NO: 290357 - DNA, 20 bp, Artificial Sequence
  Description of Artificial Sequence: Synthetic oligonucleotide
  Target: ATXN1; (+) strand; PAM type: YTN; PAM sequence: CTG
tggccctataaatggctatt

SEQ ID NO: 290358 - DNA, 20 bp, Artificial Sequence
  Description of Artificial Sequence: Synthetic oligonucleotide
  Target: ATXN1; (+) strand; PAM type: YTN; PAM sequence: CTA
taaatggctattttagaaag

SEQ ID NO: 290359 - DNA, 20 bp, Artificial Sequence
  Description of Artificial Sequence: Synthetic oligonucleotide
  Target: ATXN1; (+) strand; PAM type: YTN; PAM sequence: CTA
ttttagaaagacaatgtgaa

SEQ ID NO: 290360 - DNA, 20 bp, Artificial Sequence
  Description of Artificial Sequence: Synthetic oligonucleotide
  Target: ATXN1; (+) strand; PAM type: YTN; PAM sequence: TTT
tagaaagacaatgtgaactg

SEQ ID NO: 290361 - DNA, 20 bp, Artificial Sequence
  Description of Artificial Sequence: Synthetic oligonucleotide
  Target: ATXN1; (+) strand; PAM type: YTN; PAM sequence: TTT
agaaagacaatgtgaactgg

SEQ ID NO: 290362 - DNA, 20 bp, Artificial Sequence
  Description of Artificial Sequence: Synthetic oligonucleotide
  Target: ATXN1; (+) strand; PAM type: YTN; PAM sequence: TTA
gaaagacaatgtgaactggc

SEQ ID NO: 290363 - DNA, 20 bp, Artificial Sequence
  Description of Artificial Sequence: Synthetic oligonucleotide
  Target: ATXN1; (+) strand; PAM type: YTN; PAM sequence: CTG
gcagcaacggtactggaaca

SEQ ID NO: 290364 - DNA, 20 bp, Artificial Sequence
  Description of Artificial Sequence: Synthetic oligonucleotide
  Target: ATXN1; (+) strand; PAM type: YTN; PAM sequence: CTG
gaacaggaatgaggagtcca

SEQ ID NO: 290365 - DNA, 20 bp, Artificial Sequence
  Description of Artificial Sequence: Synthetic oligonucleotide
  Target: ATXN1; (+) strand; PAM type: YTN; PAM sequence: CTT
ctggttccagtctgacttct

SEQ ID NO: 290366 - DNA, 20 bp, Artificial Sequence
  Description of Artificial Sequence: Synthetic oligonucleotide
  Target: ATXN1; (+) strand; PAM type: YTN; PAM sequence: TTC
tggttccagtctgacttctt

SEQ ID NO: 290367 - DNA, 20 bp, Artificial Sequence
  Description of Artificial Sequence: Synthetic oligonucleotide
  Target: ATXN1; (+) strand; PAM type: YTN; PAM sequence: CTG
gttccagtctgacttcttgg

SEQ ID NO: 290368 - DNA, 20 bp, Artificial Sequence
  Description of Artificial Sequence: Synthetic oligonucleotide
  Target: ATXN1; (+) strand; PAM type: YTN; PAM sequence: TTC
cagtctgacttcttggtcaa

SEQ ID NO: 290369 - DNA, 20 bp, Artificial Sequence
  Description of Artificial Sequence: Synthetic oligonucleotide
  Target: ATXN1; (+) strand; PAM type: YTN; PAM sequence: CTG
acttcttggtcaagccattt

SEQ ID NO: 290370 - DNA, 20 bp, Artificial Sequence
  Description of Artificial Sequence: Synthetic oligonucleotide
  Target: ATXN1; (+) strand; PAM type: YTN; PAM sequence: CTT
cttggtcaagccatttttac

SEQ ID NO: 290371 - DNA, 20 bp, Artificial Sequence
  Description of Artificial Sequence: Synthetic oligonucleotide
  Target: ATXN1; (+) strand; PAM type: YTN; PAM sequence: TTC
ttggtcaagccatttttact

SEQ ID NO: 290372 - DNA, 20 bp, Artificial Sequence
  Description of Artificial Sequence: Synthetic oligonucleotide
  Target: ATXN1; (+) strand; PAM type: YTN; PAM sequence: CTT
ggtcaagccatttttacttc

SEQ ID NO: 290373 - DNA, 20 bp, Artificial Sequence
  Description of Artificial Sequence: Synthetic oligonucleotide
  Target: ATXN1; (+) strand; PAM type: YTN; PAM sequence: TTG
gtcaagccatttttacttct

SEQ ID NO: 290374 - DNA, 20 bp, Artificial Sequence
  Description of Artificial Sequence: Synthetic oligonucleotide
  Target: ATXN1; (+) strand; PAM type: YTN; PAM sequence: TTT
ttacttctctgagtctcttt

SEQ ID NO: 290375 - DNA, 20 bp, Artificial Sequence
  Description of Artificial Sequence: Synthetic oligonucleotide
  Target: ATXN1; (+) strand; PAM type: YTN; PAM sequence: TTT
tacttctctgagtctctttc

SEQ ID NO: 290376 - DNA, 20 bp, Artificial Sequence
  Description of Artificial Sequence: Synthetic oligonucleotide
  Target: ATXN1; (+) strand; PAM type: YTN; PAM sequence: TTT
acttctctgagtctctttcc

SEQ ID NO: 290377 - DNA, 20 bp, Artificial Sequence
  Description of Artificial Sequence: Synthetic oligonucleotide
  Target: ATXN1; (+) strand; PAM type: YTN; PAM sequence: TTA
cttctctgagtctctttcct

SEQ ID NO: 290378 - DNA, 20 bp, Artificial Sequence
  Description of Artificial Sequence: Synthetic oligonucleotide
  Target: ATXN1; (+) strand; PAM type: YTN; PAM sequence: CTT
ctctgagtctctttcctcct

SEQ ID NO: 290379 - DNA, 20 bp, Artificial Sequence
  Description of Artificial Sequence: Synthetic oligonucleotide
  Target: ATXN1; (+) strand; PAM type: YTN; PAM sequence: TTC
tctgagtctctttcctcctt

SEQ ID NO: 290380 - DNA, 20 bp, Artificial Sequence
  Description of Artificial Sequence: Synthetic oligonucleotide
  Target: ATXN1; (+) strand; PAM type: YTN; PAM sequence: CTC
tgagtctctttcctccttta

SEQ ID NO: 290381 - DNA, 20 bp, Artificial Sequence
  Description of Artificial Sequence: Synthetic oligonucleotide
  Target: ATXN1; (+) strand; PAM type: YTN; PAM sequence: CTG
agtctctttcctcctttaaa

SEQ ID NO: 290382 - DNA, 20 bp, Artificial Sequence
  Description of Artificial Sequence: Synthetic oligonucleotide
  Target: ATXN1; (+) strand; PAM type: YTN; PAM sequence: CTC
tttcctcctttaaatataga

SEQ ID NO: 290383 - DNA, 20 bp, Artificial Sequence
  Description of Artificial Sequence: Synthetic oligonucleotide
  Target: ATXN1; (+) strand; PAM type: YTN; PAM sequence: CTT
tcctcctttaaatatagaag

SEQ ID NO: 290384 - DNA, 20 bp, Artificial Sequence
  Description of Artificial Sequence: Synthetic oligonucleotide
  Target: ATXN1; (+) strand; PAM type: YTN; PAM sequence: TTT
cctcctttaaatatagaagt

SEQ ID NO: 290385 - DNA, 20 bp, Artificial Sequence
  Description of Artificial Sequence: Synthetic oligonucleotide
  Target: ATXN1; (+) strand; PAM type: YTN; PAM sequence: TTC
ctcctttaaatatagaagtt

SEQ ID NO: 290386 - DNA, 20 bp, Artificial Sequence
  Description of Artificial Sequence: Synthetic oligonucleotide
  Target: ATXN1; (+) strand; PAM type: YTN; PAM sequence: CTC
ctttaaatatagaagtttag

SEQ ID NO: 290387 - DNA, 20 bp, Artificial Sequence
  Description of Artificial Sequence: Synthetic oligonucleotide
  Target: ATXN1; (+) strand; PAM type: YTN; PAM sequence: CTT
taaatatagaagtttagatc

SEQ ID NO: 290388 - DNA, 20 bp, Artificial Sequence
  Description of Artificial Sequence: Synthetic oligonucleotide
  Target: ATXN1; (+) strand; PAM type: YTN; PAM sequence: TTT
aaatatagaagtttagatca

SEQ ID NO: 290389 - DNA, 20 bp, Artificial Sequence
  Description of Artificial Sequence: Synthetic oligonucleotide
  Target: ATXN1; (+) strand; PAM type: YTN; PAM sequence: TTA
aatatagaagtttagatcac

SEQ ID NO: 290390 - DNA, 20 bp, Artificial Sequence
  Description of Artificial Sequence: Synthetic oligonucleotide
  Target: ATXN1; (+) strand; PAM type: YTN; PAM sequence: TTT
agatcacatgagctctgagt

SEQ ID NO: 290391 - DNA, 20 bp, Artificial Sequence
  Description of Artificial Sequence: Synthetic oligonucleotide
  Target: ATXN1; (+) strand; PAM type: YTN; PAM sequence: TTA
gatcacatgagctctgagtt

SEQ ID NO: 290392 - DNA, 20 bp, Artificial Sequence
  Description of Artificial Sequence: Synthetic oligonucleotide
  Target: ATXN1; (+) strand; PAM type: YTN; PAM sequence: CTC
tgagtttcaggtgacctaga

SEQ ID NO: 290393 - DNA, 20 bp, Artificial Sequence
  Description of Artificial Sequence: Synthetic oligonucleotide
  Target: ATXN1; (+) strand; PAM type: YTN; PAM sequence: CTG
agtttcaggtgacctagaac

SEQ ID NO: 290394 - DNA, 20 bp, Artificial Sequence
  Description of Artificial Sequence: Synthetic oligonucleotide
  Target: ATXN1; (+) strand; PAM type: YTN; PAM sequence: TTT
caggtgacctagaactgtat

SEQ ID NO: 290395 - DNA, 20 bp, Artificial Sequence
  Description of Artificial Sequence: Synthetic oligonucleotide
  Target: ATXN1; (+) strand; PAM type: YTN; PAM sequence: TTC
aggtgacctagaactgtatg

SEQ ID NO: 290396 - DNA, 20 bp, Artificial Sequence
  Description of Artificial Sequence: Synthetic oligonucleotide
  Target: ATXN1; (+) strand; PAM type: YTN; PAM sequence: CTA
gaactgtatggttctatgca

SEQ ID NO: 290397 - DNA, 20 bp, Artificial Sequence
  Description of Artificial Sequence: Synthetic oligonucleotide
  Target: ATXN1; (+) strand; PAM type: YTN; PAM sequence: CTG
tatggttctatgcagcaaac

SEQ ID NO: 290398 - DNA, 20 bp, Artificial Sequence
  Description of Artificial Sequence: Synthetic oligonucleotide
  Target: ATXN1; (+) strand; PAM type: YTN; PAM sequence: TTC
tatgcagcaaactcaatgtt

SEQ ID NO: 290399 - DNA, 20 bp, Artificial Sequence
  Description of Artificial Sequence: Synthetic oligonucleotide
  Target: ATXN1; (+) strand; PAM type: YTN; PAM sequence: CTA
tgcagcaaactcaatgttac

SEQ ID NO: 290400 - DNA, 20 bp, Artificial Sequence
  Description of Artificial Sequence: Synthetic oligonucleotide
  Target: ATXN1; (+) strand; PAM type: YTN; PAM sequence: CTC
aatgttaccttctaagatgt

SEQ ID NO: 290401 - DNA, 20 bp, Artificial Sequence
  Description of Artificial Sequence: Synthetic oligonucleotide
  Target: ATXN1; (+) strand; PAM type: YTN; PAM sequence: TTA
ccttctaagatgtgagagat

SEQ ID NO: 290402 - DNA, 20 bp, Artificial Sequence
  Description of Artificial Sequence: Synthetic oligonucleotide
  Target: ATXN1; (+) strand; PAM type: YTN; PAM sequence: CTT
ctaagatgtgagagatggca

SEQ ID NO: 290403 - DNA, 20 bp, Artificial Sequence
  Description of Artificial Sequence: Synthetic oligonucleotide
  Target: ATXN1; (+) strand; PAM type: YTN; PAM sequence: TTC
taagatgtgagagatggcac

SEQ ID NO: 290404 - DNA, 20 bp, Artificial Sequence
  Description of Artificial Sequence: Synthetic oligonucleotide
  Target: ATXN1; (+) strand; PAM type: YTN; PAM sequence: CTA
agatgtgagagatggcacag

SEQ ID NO: 290405 - DNA, 20 bp, Artificial Sequence
  Description of Artificial Sequence: Synthetic oligonucleotide
  Target: ATXN1; (+) strand; PAM type: YTN; PAM sequence: CTG
tttttccctggctacactga

SEQ ID NO: 290406 - DNA, 20 bp, Artificial Sequence
  Description of Artificial Sequence: Synthetic oligonucleotide
  Target: ATXN1; (+) strand; PAM type: YTN; PAM sequence: TTT
ttccctggctacactgagcc

SEQ ID NO: 290407 - DNA, 20 bp, Artificial Sequence
  Description of Artificial Sequence: Synthetic oligonucleotide
  Target: ATXN1; (+) strand; PAM type: YTN; PAM sequence: TTT
tccctggctacactgagcca

SEQ ID NO: 290408 - DNA, 20 bp, Artificial Sequence
  Description of Artificial Sequence: Synthetic oligonucleotide
  Target: ATXN1; (+) strand; PAM type: YTN; PAM sequence: TTT
ccctggctacactgagccac

SEQ ID NO: 290409 - DNA, 20 bp, Artificial Sequence
  Description of Artificial Sequence: Synthetic oligonucleotide
  Target: ATXN1; (+) strand; PAM type: YTN; PAM sequence: TTC
cctggctacactgagccact

SEQ ID NO: 290410 - DNA, 20 bp, Artificial Sequence
  Description of Artificial Sequence: Synthetic oligonucleotide
  Target: ATXN1; (+) strand; PAM type: YTN; PAM sequence: CTG
gctacactgagccactggca

SEQ ID NO: 290411 - DNA, 20 bp, Artificial Sequence
  Description of Artificial Sequence: Synthetic oligonucleotide
  Target: ATXN1; (+) strand; PAM type: YTN; PAM sequence: CTA
cactgagccactggcagtag

SEQ ID NO: 290412 - DNA, 20 bp, Artificial Sequence
  Description of Artificial Sequence: Synthetic oligonucleotide
  Target: ATXN1; (+) strand; PAM type: YTN; PAM sequence: CTG
agccactggcagtaggcctc

SEQ ID NO: 290413 - DNA, 20 bp, Artificial Sequence
  Description of Artificial Sequence: Synthetic oligonucleotide
  Target: ATXN1; (+) strand; PAM type: YTN; PAM sequence: CTG
gcagtaggcctcccaaacac

SEQ ID NO: 290414 - DNA, 20 bp, Artificial Sequence
  Description of Artificial Sequence: Synthetic oligonucleotide
  Target: ATXN1; (+) strand; PAM type: YTN; PAM sequence: CTC
ccaaacacttcccatctgct

SEQ ID NO: 290415 - DNA, 20 bp, Artificial Sequence
  Description of Artificial Sequence: Synthetic oligonucleotide
  Target: ATXN1; (+) strand; PAM type: YTN; PAM sequence: CTT
cccatctgcttcttgaacca

SEQ ID NO: 290416 - DNA, 20 bp, Artificial Sequence
  Description of Artificial Sequence: Synthetic oligonucleotide
  Target: ATXN1; (+) strand; PAM type: YTN; PAM sequence: TTC
ccatctgcttcttgaaccat

SEQ ID NO: 290417 - DNA, 20 bp, Artificial Sequence
  Description of Artificial Sequence: Synthetic oligonucleotide
  Target: ATXN1; (+) strand; PAM type: YTN; PAM sequence: CTG
cttcttgaaccatttcatac

SEQ ID NO: 290418 - DNA, 20 bp, Artificial Sequence
  Description of Artificial Sequence: Synthetic oligonucleotide
  Target: ATXN1; (+) strand; PAM type: YTN; PAM sequence: CTT
cttgaaccatttcatacata

SEQ ID NO: 290419 - DNA, 20 bp, Artificial Sequence
  Description of Artificial Sequence: Synthetic oligonucleotide
  Target: ATXN1; (+) strand; PAM type: YTN; PAM sequence: TTC
ttgaaccatttcatacatat

SEQ ID NO: 290420 - DNA, 20 bp, Artificial Sequence
  Description of Artificial Sequence: Synthetic oligonucleotide
  Target: ATXN1; (+) strand; PAM type: YTN; PAM sequence: CTT
gaaccatttcatacatatca

SEQ ID NO: 290421 - DNA, 20 bp, Artificial Sequence
  Description of Artificial Sequence: Synthetic oligonucleotide
  Target: ATXN1; (+) strand; PAM type: YTN; PAM sequence: TTG
aaccatttcatacatatcac

SEQ ID NO: 290422 - DNA, 20 bp, Artificial Sequence
  Description of Artificial Sequence: Synthetic oligonucleotide
  Target: ATXN1; (+) strand; PAM type: YTN; PAM sequence: TTT
catacatatcacccaacatc

SEQ ID NO: 290423 - DNA, 20 bp, Artificial Sequence
  Description of Artificial Sequence: Synthetic oligonucleotide
  Target: ATXN1; (+) strand; PAM type: YTN; PAM sequence: TTC
atacatatcacccaacatcc

SEQ ID NO: 290424 - DNA, 20 bp, Artificial Sequence
  Description of Artificial Sequence: Synthetic oligonucleotide
  Target: ATXN1; (+) strand; PAM type: YTN; PAM sequence: TTA
aagacagggtcctcggccag

SEQ ID NO: 290425 - DNA, 20 bp, Artificial Sequence
  Description of Artificial Sequence: Synthetic oligonucleotide
  Target: ATXN1; (+) strand; PAM type: YTN; PAM sequence: CTC
ggccaggcgcggtggctcac

SEQ ID NO: 290426 - DNA, 20 bp, Artificial Sequence
  Description of Artificial Sequence: Synthetic oligonucleotide
  Target: ATXN1; (+) strand; PAM type: YTN; PAM sequence: CTC
acacttgtaatcccagcact

SEQ ID NO: 290427 - DNA, 20 bp, Artificial Sequence
  Description of Artificial Sequence: Synthetic oligonucleotide
  Target: ATXN1; (+) strand; PAM type: YTN; PAM sequence: CTT
gtaatcccagcactttggga

SEQ ID NO: 290428 - DNA, 20 bp, Artificial Sequence
  Description of Artificial Sequence: Synthetic oligonucleotide
  Target: ATXN1; (+) strand; PAM type: YTN; PAM sequence: TTG
taatcccagcactttgggag

SEQ ID NO: 290429 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggtgggcgg

SEQ ID NO: 290430 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggtgggcggg

SEQ ID NO: 290431 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggtgggcgggt

SEQ ID NO: 290432 - DNA, 20 bp, Artificial Sequence
  Description of Artificial Sequence: Synthetic oligonucleotide
  Target: ATXN1; (+) strand; PAM type: YTN; PAM sequence: TTT
gagacctgcctggccaacat

SEQ ID NO: 290433 - DNA, 20 bp, Artificial Sequence
  Description of Artificial Sequence: Synthetic oligonucleotide
  Target: ATXN1; (+) strand; PAM type: YTN; PAM sequence: TTG
agacctgcctggccaacatg

SEQ ID NO: 290434 - DNA, 20 bp, Artificial Sequence
  Description of Artificial Sequence: Synthetic oligonucleotide
  Target: ATXN1; (+) strand; PAM type: YTN; PAM sequence: CTG
cctggccaacatggtgaaat

SEQ ID NO: 290435 - DNA, 20 bp, Artificial Sequence
  Description of Artificial Sequence: Synthetic oligonucleotide
  Target: ATXN1; (+) strand; PAM type: YTN; PAM sequence: CTG
gccaacatggtgaaatccca

SEQ ID NO: 290436 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaacatta

SEQ ID NO: 290437 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaacattagc

SEQ ID NO: 290438 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaacattagccgg

SEQ ID NO: 290439 - DNA, 20 bp, Artificial Sequence
  Description of Artificial Sequence: Synthetic oligonucleotide
  Target: ATXN1; (+) strand; PAM type: YTN; PAM sequence: TTA
gccgggtgtggtggctcacg

SEQ ID NO: 290440 - DNA, 20 bp, Artificial Sequence
  Description of Artificial Sequence: Synthetic oligonucleotide
  Target: ATXN1; (+) strand; PAM type: YTN; PAM sequence: CTC
acgcctgtcatactagctac

SEQ ID NO: 290441 - DNA, 20 bp, Artificial Sequence
  Description of Artificial Sequence: Synthetic oligonucleotide
  Target: ATXN1; (+) strand; PAM type: YTN; PAM sequence: CTG
tcatactagctactcgggag

SEQ ID NO: 290442 - DNA, 20 bp, Artificial Sequence
  Description of Artificial Sequence: Synthetic oligonucleotide
  Target: ATXN1; (+) strand; PAM type: YTN; PAM sequence: CTA
gctactcgggaggctgaggc

SEQ ID NO: 290443 - DNA, 20 bp, Artificial Sequence
  Description of Artificial Sequence: Synthetic oligonucleotide
  Target: ATXN1; (+) strand; PAM type: YTN; PAM sequence: CTA
ctcgggaggctgaggcagga

SEQ ID NO: 290444 - DNA, 20 bp, Artificial Sequence
  Description of Artificial Sequence: Synthetic oligonucleotide
  Target: ATXN1; (+) strand; PAM type: YTN; PAM sequence: CTC
gggaggctgaggcaggagaa

SEQ ID NO: 290445 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcgcttgaa

SEQ ID NO: 290446 - DNA, 20 bp, Artificial Sequence
  Description of Artificial Sequence: Synthetic oligonucleotide
  Target: ATXN1; (+) strand; PAM type: YTN; PAM sequence: CTT
gaacctgggaggcagaggct

SEQ ID NO: 290447 - DNA, 20 bp, Artificial Sequence
  Description of Artificial Sequence: Synthetic oligonucleotide
  Target: ATXN1; (+) strand; PAM type: YTN; PAM sequence: TTG
aacctgggaggcagaggctg

SEQ ID NO: 290448 - DNA, 20 bp, Artificial Sequence
  Description of Artificial Sequence: Synthetic oligonucleotide
  Target: ATXN1; (+) strand; PAM type: YTN; PAM sequence: CTG
ggaggcagaggctgcagtga

SEQ ID NO: 290449 - DNA, 20 bp, Artificial Sequence
  Description of Artificial Sequence: Synthetic oligonucleotide
  Target: ATXN1; (+) strand; PAM type: YTN; PAM sequence: CTG
cagtgagctgagatcatgcc

SEQ ID NO: 290450 - DNA, 20 bp, Artificial Sequence
  Description of Artificial Sequence: Synthetic oligonucleotide
  Target: ATXN1; (+) strand; PAM type: YTN; PAM sequence: CTG
agatcatgccactgcactcc

SEQ ID NO: 290451 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggtggcag

SEQ ID NO: 290452 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtggcagagcaa

SEQ ID NO: 290453 - DNA, 20 bp, Artificial Sequence
  Description of Artificial Sequence: Synthetic oligonucleotide
  Target: ATXN1; (+) strand; PAM type: YTN; PAM sequence: CTG
ggtggcagagcaagactcca

SEQ ID NO: 290454 - DNA, 20 bp, Artificial Sequence
  Description of Artificial Sequence: Synthetic oligonucleotide
  Target: ATXN1; (+) strand; PAM type: YTN; PAM sequence: CTC
catctcaaagcaaacaaaca

SEQ ID NO: 290455 - DNA, 20 bp, Artificial Sequence
  Description of Artificial Sequence: Synthetic oligonucleotide
  Target: ATXN1; (+) strand; PAM type: YTN; PAM sequence: CTC
aaagcaaacaaacaaacaaa

SEQ ID NO: 290456 - DNA, 20 bp, Artificial Sequence
  Description of Artificial Sequence: Synthetic oligonucleotide
  Target: ATXN1; (+) strand; PAM type: YTN; PAM sequence: CTC
tctcagcaagtctcctatca

SEQ ID NO: 290457 - DNA, 20 bp, Artificial Sequence
  Description of Artificial Sequence: Synthetic oligonucleotide
  Target: ATXN1; (+) strand; PAM type: YTN; PAM sequence: CTC
tcagcaagtctcctatcaca

SEQ ID NO: 290458 - DNA, 20 bp, Artificial Sequence
  Description of Artificial Sequence: Synthetic oligonucleotide
  Target: ATXN1; (+) strand; PAM type: YTN; PAM sequence: CTC
agcaagtctcctatcacaaa

SEQ ID NO: 290459 - DNA, 20 bp, Artificial Sequence
  Description of Artificial Sequence: Synthetic oligonucleotide
  Target: ATXN1; (+) strand; PAM type: YTN; PAM sequence: CTC
ctatcacaaaaggaatacac

SEQ ID NO: 290460 - DNA, 20 bp, Artificial Sequence
  Description of Artificial Sequence: Synthetic oligonucleotide
  Target: ATXN1; (+) strand; PAM type: YTN; PAM sequence: CTA
tcacaaaaggaatacacatc

SEQ ID NO: 290461 - DNA, 20 bp, Artificial Sequence
  Description of Artificial Sequence: Synthetic oligonucleotide
  Target: ATXN1; (+) strand; PAM type: YTN; PAM sequence: CTG
ctggaccaccccagctctaa

SEQ ID NO: 290462 - DNA, 20 bp, Artificial Sequence
  Description of Artificial Sequence: Synthetic oligonucleotide
  Target: ATXN1; (+) strand; PAM type: YTN; PAM sequence: CTG
gaccaccccagctctaaggg

SEQ ID NO: 290463 - DNA, 20 bp, Artificial Sequence
  Description of Artificial Sequence: Synthetic oligonucleotide
  Target: ATXN1; (+) strand; PAM type: YTN; PAM sequence: CTC
taagggggaggtcaacttgt

SEQ ID NO: 290464 - DNA, 20 bp, Artificial Sequence
  Description of Artificial Sequence: Synthetic oligonucleotide
  Target: ATXN1; (+) strand; PAM type: YTN; PAM sequence: CTA
agggggaggtcaacttgtga

SEQ ID NO: 290465 - DNA, 20 bp, Artificial Sequence
  Description of Artificial Sequence: Synthetic oligonucleotide
  Target: ATXN1; (+) strand; PAM type: YTN; PAM sequence: CTT
gtgagcaataagtcgaagca

SEQ ID NO: 290466 - DNA, 20 bp, Artificial Sequence
  Description of Artificial Sequence: Synthetic oligonucleotide
  Target: ATXN1; (+) strand; PAM type: YTN; PAM sequence: TTG
tgagcaataagtcgaagcaa

SEQ ID NO: 290467 - DNA, 20 bp, Artificial Sequence
  Description of Artificial Sequence: Synthetic oligonucleotide
  Target: ATXN1; (+) strand; PAM type: YTN; PAM sequence: CTC
catacattgtataattttca

SEQ ID NO: 290468 - DNA, 20 bp, Artificial Sequence
  Description of Artificial Sequence: Synthetic oligonucleotide
  Target: ATXN1; (+) strand; PAM type: YTN; PAM sequence: TTG
tataattttcatctattcca

SEQ ID NO: 290469 - DNA, 20 bp, Artificial Sequence
  Description of Artificial Sequence: Synthetic oligonucleotide
  Target: ATXN1; (+) strand; PAM type: YTN; PAM sequence: TTT
tcatctattccaaccagaaa

SEQ ID NO: 290470 - DNA, 20 bp, Artificial Sequence
  Description of Artificial Sequence: Synthetic oligonucleotide
  Target: ATXN1; (+) strand; PAM type: YTN; PAM sequence: TTT
catctattccaaccagaaaa

SEQ ID NO: 290471 - DNA, 20 bp, Artificial Sequence
  Description of Artificial Sequence: Synthetic oligonucleotide
  Target: ATXN1; (+) strand; PAM type: YTN; PAM sequence: TTC
atctattccaaccagaaaag

SEQ ID NO: 290472 - DNA, 20 bp, Artificial Sequence
  Description of Artificial Sequence: Synthetic oligonucleotide
  Target: ATXN1; (+) strand; PAM type: YTN; PAM sequence: CTA
ttccaaccagaaaagagctg

SEQ ID NO: 290473 - DNA, 20 bp, Artificial Sequence
  Description of Artificial Sequence: Synthetic oligonucleotide
  Target: ATXN1; (+) strand; PAM type: YTN; PAM sequence: TTC
caaccagaaaagagctgctc

SEQ ID NO: 290474 - DNA, 20 bp, Artificial Sequence
  Description of Artificial Sequence: Synthetic oligonucleotide
  Target: ATXN1; (+) strand; PAM type: YTN; PAM sequence: CTG
ctcattctgatcaaagatgt

SEQ ID NO: 290475 - DNA, 20 bp, Artificial Sequence
  Description of Artificial Sequence: Synthetic oligonucleotide
  Target: ATXN1; (+) strand; PAM type: YTN; PAM sequence: CTC
attctgatcaaagatgttaa

SEQ ID NO: 290476 - DNA, 20 bp, Artificial Sequence
  Description of Artificial Sequence: Synthetic oligonucleotide
  Target: ATXN1; (+) strand; PAM type: YTN; PAM sequence: TTC
tgatcaaagatgttaatgag

SEQ ID NO: 290477 - DNA, 20 bp, Artificial Sequence
  Description of Artificial Sequence: Synthetic oligonucleotide
  Target: ATXN1; (+) strand; PAM type: YTN; PAM sequence: CTG
atcaaagatgttaatgagcc

SEQ ID NO: 290478 - DNA, 20 bp, Artificial Sequence
  Description of Artificial Sequence: Synthetic oligonucleotide
  Target: ATXN1; (+) strand; PAM type: YTN; PAM sequence: TTA
atgagccctgcaaacagaaa

SEQ ID NO: 290479 - DNA, 20 bp, Artificial Sequence
  Description of Artificial Sequence: Synthetic oligonucleotide
  Target: ATXN1; (+) strand; PAM type: YTN; PAM sequence: CTG
caaacagaaattactacaat

SEQ ID NO: 290480 - DNA, 20 bp, Artificial Sequence
  Description of Artificial Sequence: Synthetic oligonucleotide
  Target: ATXN1; (+) strand; PAM type: YTN; PAM sequence: TTA
ctacaatagaacagtagaca

SEQ ID NO: 290481 - DNA, 20 bp, Artificial Sequence
  Description of Artificial Sequence: Synthetic oligonucleotide
  Target: ATXN1; (+) strand; PAM type: YTN; PAM sequence: CTA
caatagaacagtagacacct

SEQ ID NO: 290482 - DNA, 20 bp, Artificial Sequence
  Description of Artificial Sequence: Synthetic oligonucleotide
  Target: ATXN1; (+) strand; PAM type: YTN; PAM sequence: CTT
cattaattattttctcctgc

SEQ ID NO: 290483 - DNA, 20 bp, Artificial Sequence
  Description of Artificial Sequence: Synthetic oligonucleotide
  Target: ATXN1; (+) strand; PAM type: YTN; PAM sequence: TTC
attaattattttctcctgca

SEQ ID NO: 290484 - DNA, 20 bp, Artificial Sequence
  Description of Artificial Sequence: Synthetic oligonucleotide
  Target: ATXN1; (+) strand; PAM type: YTN; PAM sequence: TTA
attattttctcctgcaatat

SEQ ID NO: 290485 - DNA, 20 bp, Artificial Sequence
  Description of Artificial Sequence: Synthetic oligonucleotide
  Target: ATXN1; (+) strand; PAM type: YTN; PAM sequence: TTA
ttttctcctgcaatattagc

SEQ ID NO: 290486 - DNA, 20 bp, Artificial Sequence
  Description of Artificial Sequence: Synthetic oligonucleotide
  Target: ATXN1; (+) strand; PAM type: YTN; PAM sequence: TTT
tctcctgcaatattagcact

SEQ ID NO: 290487 - DNA, 20 bp, Artificial Sequence
  Description of Artificial Sequence: Synthetic oligonucleotide
  Target: ATXN1; (+) strand; PAM type: YTN; PAM sequence: TTT
ctcctgcaatattagcacta

SEQ ID NO: 290488 - DNA, 20 bp, Artificial Sequence
  Description of Artificial Sequence: Synthetic oligonucleotide
  Target: ATXN1; (+) strand; PAM type: YTN; PAM sequence: TTC
tcctgcaatattagcactaa

SEQ ID NO: 290489 - DNA, 20 bp, Artificial Sequence
  Description of Artificial Sequence: Synthetic oligonucleotide
  Target: ATXN1; (+) strand; PAM type: YTN; PAM sequence: CTC
ctgcaatattagcactaatg

SEQ ID NO: 290490 - DNA, 20 bp, Artificial Sequence
  Description of Artificial Sequence: Synthetic oligonucleotide
  Target: ATXN1; (+) strand; PAM type: YTN; PAM sequence: CTG
caatattagcactaatgatt

SEQ ID NO: 290491 - DNA, 20 bp, Artificial Sequence
  Description of Artificial Sequence: Synthetic oligonucleotide
  Target: ATXN1; (+) strand; PAM type: YTN; PAM sequence: TTA
gcactaatgattagaaaatc

SEQ ID NO: 290492 - DNA, 20 bp, Artificial Sequence
  Description of Artificial Sequence: Synthetic oligonucleotide
  Target: ATXN1; (+) strand; PAM type: YTN; PAM sequence: CTA
atgattagaaaatcttcaat

SEQ ID NO: 290493 - DNA, 20 bp, Artificial Sequence
  Description of Artificial Sequence: Synthetic oligonucleotide
  Target: ATXN1; (+) strand; PAM type: YTN; PAM sequence: TTA
gaaaatcttcaatagcagca

SEQ ID NO: 290494 - DNA, 20 bp, Artificial Sequence
  Description of Artificial Sequence: Synthetic oligonucleotide
  Target: ATXN1; (+) strand; PAM type: YTN; PAM sequence: CTT
caatagcagcacaaataaaa

SEQ ID NO: 290495 - DNA, 20 bp, Artificial Sequence
  Description of Artificial Sequence: Synthetic oligonucleotide
  Target: ATXN1; (+) strand; PAM type: YTN; PAM sequence: TTC
aatagcagcacaaataaaaa

SEQ ID NO: 290496 - DNA, 20 bp, Artificial Sequence
  Description of Artificial Sequence: Synthetic oligonucleotide
  Target: ATXN1; (+) strand; PAM type: YTN; PAM sequence: CTT
ggtacagcctccgtacagat

SEQ ID NO: 290497 - DNA, 20 bp, Artificial Sequence
  Description of Artificial Sequence: Synthetic oligonucleotide
  Target: ATXN1; (+) strand; PAM type: YTN; PAM sequence: TTG
gtacagcctccgtacagatc

SEQ ID NO: 290498 - DNA, 20 bp, Artificial Sequence
  Description of Artificial Sequence: Synthetic oligonucleotide
  Target: ATXN1; (+) strand; PAM type: YTN; PAM sequence: CTC
cgtacagatccatactggac

SEQ ID NO: 290499 - DNA, 20 bp, Artificial Sequence
  Description of Artificial Sequence: Synthetic oligonucleotide
  Target: ATXN1; (+) strand; PAM type: YTN; PAM sequence: CTG
gactgttcattcagcaccca

SEQ ID NO: 290500 - DNA, 20 bp, Artificial Sequence
  Description of Artificial Sequence: Synthetic oligonucleotide
  Target: ATXN1; (+) strand; PAM type: YTN; PAM sequence: CTG
ttcattcagcacccagtatt

SEQ ID NO: 290501 - DNA, 20 bp, Artificial Sequence
  Description of Artificial Sequence: Synthetic oligonucleotide
  Target: ATXN1; (+) strand; PAM type: YTN; PAM sequence: TTC
attcagcacccagtattctg

SEQ ID NO: 290502 - DNA, 20 bp, Artificial Sequence
  Description of Artificial Sequence: Synthetic oligonucleotide
  Target: ATXN1; (+) strand; PAM type: YTN; PAM sequence: TTC
agcacccagtattctggaat

SEQ ID NO: 290503 - DNA, 20 bp, Artificial Sequence
  Description of Artificial Sequence: Synthetic oligonucleotide
  Target: ATXN1; (+) strand; PAM type: YTN; PAM sequence: TTC
tggaatttgcctattaatgc

SEQ ID NO: 290504 - DNA, 20 bp, Artificial Sequence
  Description of Artificial Sequence: Synthetic oligonucleotide
  Target: ATXN1; (+) strand; PAM type: YTN; PAM sequence: CTG
gaatttgcctattaatgcag

SEQ ID NO: 290505 - DNA, 20 bp, Artificial Sequence
  Description of Artificial Sequence: Synthetic oligonucleotide
  Target: ATXN1; (+) strand; PAM type: YTN; PAM sequence: TTT
gcctattaatgcaggtggaa

SEQ ID NO: 290506 - DNA, 20 bp, Artificial Sequence
  Description of Artificial Sequence: Synthetic oligonucleotide
  Target: ATXN1; (+) strand; PAM type: YTN; PAM sequence: TTG
cctattaatgcaggtggaag

SEQ ID NO: 290507 - DNA, 20 bp, Artificial Sequence
  Description of Artificial Sequence: Synthetic oligonucleotide
  Target: ATXN1; (+) strand; PAM type: YTN; PAM sequence: CTA
ttaatgcaggtggaagcagt

SEQ ID NO: 290508 - DNA, 20 bp, Artificial Sequence
  Description of Artificial Sequence: Synthetic oligonucleotide
  Target: ATXN1; (+) strand; PAM type: YTN; PAM sequence: TTA
atgcaggtggaagcagtcct

SEQ ID NO: 290509 - DNA, 20 bp, Artificial Sequence
  Description of Artificial Sequence: Synthetic oligonucleotide
  Target: ATXN1; (+) strand; PAM type: YTN; PAM sequence: CTG
ttcatacaatatgacccaaa

SEQ ID NO: 290510 - DNA, 20 bp, Artificial Sequence
  Description of Artificial Sequence: Synthetic oligonucleotide
  Target: ATXN1; (+) strand; PAM type: YTN; PAM sequence: TTC
atacaatatgacccaaactc

SEQ ID NO: 290511 - DNA, 20 bp, Artificial Sequence
  Description of Artificial Sequence: Synthetic oligonucleotide
  Target: ATXN1; (+) strand; PAM type: YTN; PAM sequence: CTC
caaattcaatgtgaattttt

SEQ ID NO: 290512 - DNA, 20 bp, Artificial Sequence
  Description of Artificial Sequence: Synthetic oligonucleotide
  Target: ATXN1; (+) strand; PAM type: YTN; PAM sequence: TTC
aatgtgaatttttggttttg

SEQ ID NO: 290513 - DNA, 20 bp, Artificial Sequence
  Description of Artificial Sequence: Synthetic oligonucleotide
  Target: ATXN1; (+) strand; PAM type: YTN; PAM sequence: TTT
ttggttttgatttttggttt

SEQ ID NO: 290514 - DNA, 20 bp, Artificial Sequence
  Description of Artificial Sequence: Synthetic oligonucleotide
  Target: ATXN1; (+) strand; PAM type: YTN; PAM sequence: TTT
tggttttgatttttggttta

SEQ ID NO: 290515 - DNA, 20 bp, Artificial Sequence
  Description of Artificial Sequence: Synthetic oligonucleotide
  Target: ATXN1; (+) strand; PAM type: YTN; PAM sequence: TTT
ggttttgatttttggtttat

SEQ ID NO: 290516 - DNA, 20 bp, Artificial Sequence
  Description of Artificial Sequence: Synthetic oligonucleotide
  Target: ATXN1; (+) strand; PAM type: YTN; PAM sequence: TTG
gttttgatttttggtttatt

SEQ ID NO: 290517 - DNA, 20 bp, Artificial Sequence
  Description of Artificial Sequence: Synthetic oligonucleotide
  Target: ATXN1; (+) strand; PAM type: YTN; PAM sequence: TTT
tgatttttggtttatttgtt

SEQ ID NO: 290518 - DNA, 20 bp, Artificial Sequence
  Description of Artificial Sequence: Synthetic oligonucleotide
  Target: ATXN1; (+) strand; PAM type: YTN; PAM sequence: TTT
gatttttggtttatttgttt

SEQ ID NO: 290519 - DNA, 20 bp, Artificial Sequence
  Description of Artificial Sequence: Synthetic oligonucleotide
  Target: ATXN1; (+) strand; PAM type: YTN; PAM sequence: TTG
atttttggtttatttgtttg

SEQ ID NO: 290520 - DNA, 20 bp, Artificial Sequence
  Description of Artificial Sequence: Synthetic oligonucleotide
  Target: ATXN1; (+) strand; PAM type: YTN; PAM sequence: TTT
ttggtttatttgtttgtttt

SEQ ID NO: 290521 - DNA, 20 bp, Artificial Sequence
  Description of Artificial Sequence: Synthetic oligonucleotide
  Target: ATXN1; (+) strand; PAM type: YTN; PAM sequence: TTT
tggtttatttgtttgttttg

SEQ ID NO: 290522 - DNA, 20 bp, Artificial Sequence
  Description of Artificial Sequence: Synthetic oligonucleotide
  Target: ATXN1; (+) strand; PAM type: YTN; PAM sequence: TTT
ggtttatttgtttgttttgt

SEQ ID NO: 290523 - DNA, 20 bp, Artificial Sequence
  Description of Artificial Sequence: Synthetic oligonucleotide
  Target: ATXN1; (+) strand; PAM type: YTN; PAM sequence: TTG
gtttatttgtttgttttgtt

SEQ ID NO: 290524 - DNA, 20 bp, Artificial Sequence
  Description of Artificial Sequence: Synthetic oligonucleotide
  Target: ATXN1; (+) strand; PAM type: YTN; PAM sequence: TTT
atttgtttgttttgttttgt

SEQ ID NO: 290525 - DNA, 20 bp, Artificial Sequence
  Description of Artificial Sequence: Synthetic oligonucleotide
  Target: ATXN1; (+) strand; PAM type: YTN; PAM sequence: TTA
tttgtttgttttgttttgtt

SEQ ID NO: 290526 - DNA, 20 bp, Artificial Sequence
  Description of Artificial Sequence: Synthetic oligonucleotide
  Target: ATXN1; (+) strand; PAM type: YTN; PAM sequence: TTT
gtttgttttgttttgtttcc

SEQ ID NO: 290527 - DNA, 20 bp, Artificial Sequence
  Description of Artificial Sequence: Synthetic oligonucleotide
  Target: ATXN1; (+) strand; PAM type: YTN; PAM sequence: TTG
tttgttttgttttgtttccc

SEQ ID NO: 290528 - DNA, 20 bp, Artificial Sequence
  Description of Artificial Sequence: Synthetic oligonucleotide
  Target: ATXN1; (+) strand; PAM type: YTN; PAM sequence: TTT
gttttgttttgtttccccaa

SEQ ID NO: 290529 - DNA, 20 bp, Artificial Sequence
  Description of Artificial Sequence: Synthetic oligonucleotide
  Target: ATXN1; (+) strand; PAM type: YTN; PAM sequence: TTG
ttttgttttgtttccccaag

SEQ ID NO: 290530 - DNA, 20 bp, Artificial Sequence
  Description of Artificial Sequence: Synthetic oligonucleotide
  Target: ATXN1; (+) strand; PAM type: YTN; PAM sequence: TTT
tgttttgtttccccaaggcc

SEQ ID NO: 290531 - DNA, 20 bp, Artificial Sequence
  Description of Artificial Sequence: Synthetic oligonucleotide
  Target: ATXN1; (+) strand; PAM type: YTN; PAM sequence: TTT
gttttgtttccccaaggccc

SEQ ID NO: 290532 - DNA, 20 bp, Artificial Sequence
  Description of Artificial Sequence: Synthetic oligonucleotide
  Target: ATXN1; (+) strand; PAM type: YTN; PAM sequence: TTG
ttttgtttccccaaggccca

SEQ ID NO: 290533 - DNA, 20 bp, Artificial Sequence
  Description of Artificial Sequence: Synthetic oligonucleotide
  Target: ATXN1; (+) strand; PAM type: YTN; PAM sequence: TTT
tgtttccccaaggcccagcc

SEQ ID NO: 290534 - DNA, 20 bp, Artificial Sequence
  Description of Artificial Sequence: Synthetic oligonucleotide
  Target: ATXN1; (+) strand; PAM type: YTN; PAM sequence: TTT
gtttccccaaggcccagccg

SEQ ID NO: 290535 - DNA, 20 bp, Artificial Sequence
  Description of Artificial Sequence: Synthetic oligonucleotide
  Target: ATXN1; (+) strand; PAM type: YTN; PAM sequence: TTG
tttccccaaggcccagccgt

SEQ ID NO: 290536 - DNA, 20 bp, Artificial Sequence
  Description of Artificial Sequence: Synthetic oligonucleotide
  Target: ATXN1; (+) strand; PAM type: YTN; PAM sequence: TTT
ccccaaggcccagccgtgcc

SEQ ID NO: 290537 - DNA, 20 bp, Artificial Sequence
  Description of Artificial Sequence: Synthetic oligonucleotide
  Target: ATXN1; (+) strand; PAM type: YTN; PAM sequence: TTC
cccaaggcccagccgtgccc

SEQ ID NO: 290538 - DNA, 20 bp, Artificial Sequence
  Description of Artificial Sequence: Synthetic oligonucleotide
  Target: ATXN1; (+) strand; PAM type: YTN; PAM sequence: CTA
aaatccatgggatatccacg

SEQ ID NO: 290539 - DNA, 20 bp, Artificial Sequence
  Description of Artificial Sequence: Synthetic oligonucleotide
  Target: ATXN1; (+) strand; PAM type: YTN; PAM sequence: CTC
atcaaaatccccgtttctta

SEQ ID NO: 290540 - DNA, 20 bp, Artificial Sequence
  Description of Artificial Sequence: Synthetic oligonucleotide
  Target: ATXN1; (+) strand; PAM type: YTN; PAM sequence: TTT
cttagaagctccctctagtg

SEQ ID NO: 290541 - DNA, 20 bp, Artificial Sequence
  Description of Artificial Sequence: Synthetic oligonucleotide
  Target: ATXN1; (+) strand; PAM type: YTN; PAM sequence: TTC
ttagaagctccctctagtga

SEQ ID NO: 290542 - DNA, 20 bp, Artificial Sequence
  Description of Artificial Sequence: Synthetic oligonucleotide
  Target: ATXN1; (+) strand; PAM type: YTN; PAM sequence: CTT
agaagctccctctagtgagt

SEQ ID NO: 290543 - DNA, 20 bp, Artificial Sequence
  Description of Artificial Sequence: Synthetic oligonucleotide
  Target: ATXN1; (+) strand; PAM type: YTN; PAM sequence: TTA
gaagctccctctagtgagtt

SEQ ID NO: 290544 - DNA, 20 bp, Artificial Sequence
  Description of Artificial Sequence: Synthetic oligonucleotide
  Target: ATXN1; (+) strand; PAM type: YTN; PAM sequence: CTC
cctctagtgagttactttta

SEQ ID NO: 290545 - DNA, 20 bp, Artificial Sequence
  Description of Artificial Sequence: Synthetic oligonucleotide
  Target: ATXN1; (+) strand; PAM type: YTN; PAM sequence: CTC
tagtgagttacttttactgg

SEQ ID NO: 290546 - DNA, 20 bp, Artificial Sequence
  Description of Artificial Sequence: Synthetic oligonucleotide
  Target: ATXN1; (+) strand; PAM type: YTN; PAM sequence: CTA
gtgagttacttttactggca

SEQ ID NO: 290547 - DNA, 20 bp, Artificial Sequence
  Description of Artificial Sequence: Synthetic oligonucleotide
  Target: ATXN1; (+) strand; PAM type: YTN; PAM sequence: TTA
cttttactggcaataaagaa

SEQ ID NO: 290548 - DNA, 20 bp, Artificial Sequence
  Description of Artificial Sequence: Synthetic oligonucleotide
  Target: ATXN1; (+) strand; PAM type: YTN; PAM sequence: CTT
ttactggcaataaagaatac

SEQ ID NO: 290549 - DNA, 20 bp, Artificial Sequence
  Description of Artificial Sequence: Synthetic oligonucleotide
  Target: ATXN1; (+) strand; PAM type: YTN; PAM sequence: TTT
tactggcaataaagaatact

SEQ ID NO: 290550 - DNA, 20 bp, Artificial Sequence
  Description of Artificial Sequence: Synthetic oligonucleotide
  Target: ATXN1; (+) strand; PAM type: YTN; PAM sequence: TTT
actggcaataaagaatacta

SEQ ID NO: 290551 - DNA, 20 bp, Artificial Sequence
  Description of Artificial Sequence: Synthetic oligonucleotide
  Target: ATXN1; (+) strand; PAM type: YTN; PAM sequence: TTA
ctggcaataaagaatactaa

SEQ ID NO: 290552 - DNA, 20 bp, Artificial Sequence
  Description of Artificial Sequence: Synthetic oligonucleotide
  Target: ATXN1; (+) strand; PAM type: YTN; PAM sequence: CTG
gcaataaagaatactaatta

SEQ ID NO: 290553 - DNA, 20 bp, Artificial Sequence
  Description of Artificial Sequence: Synthetic oligonucleotide
  Target: ATXN1; (+) strand; PAM type: YTN; PAM sequence: CTA
attagcaaaaccatatttca

SEQ ID NO: 290554 - DNA, 20 bp, Artificial Sequence
  Description of Artificial Sequence: Synthetic oligonucleotide
  Target: ATXN1; (+) strand; PAM type: YTN; PAM sequence: TTA
gcaaaaccatatttcacaca

SEQ ID NO: 290555 - DNA, 20 bp, Artificial Sequence
  Description of Artificial Sequence: Synthetic oligonucleotide
  Target: ATXN1; (+) strand; PAM type: YTN; PAM sequence: TTT
cacacacaaacaaatgcatt

SEQ ID NO: 290556 - DNA, 20 bp, Artificial Sequence
  Description of Artificial Sequence: Synthetic oligonucleotide
  Target: ATXN1; (+) strand; PAM type: YTN; PAM sequence: TTC
acacacaaacaaatgcatta

SEQ ID NO: 290557 - DNA, 20 bp, Artificial Sequence
  Description of Artificial Sequence: Synthetic oligonucleotide
  Target: ATXN1; (+) strand; PAM type: YTN; PAM sequence: TTA
ggatagtctttaaaataacc

SEQ ID NO: 290558 - DNA, 20 bp, Artificial Sequence
  Description of Artificial Sequence: Synthetic oligonucleotide
  Target: ATXN1; (+) strand; PAM type: YTN; PAM sequence: CTT
taaaataacctatttcttaa

SEQ ID NO: 290559 - DNA, 20 bp, Artificial Sequence
  Description of Artificial Sequence: Synthetic oligonucleotide
  Target: ATXN1; (+) strand; PAM type: YTN; PAM sequence: TTT
aaaataacctatttcttaag

SEQ ID NO: 290560 - DNA, 20 bp, Artificial Sequence
  Description of Artificial Sequence: Synthetic oligonucleotide
  Target: ATXN1; (+) strand; PAM type: YTN; PAM sequence: TTA
aaataacctatttcttaagc

SEQ ID NO: 290561 - DNA, 20 bp, Artificial Sequence
  Description of Artificial Sequence: Synthetic oligonucleotide
  Target: ATXN1; (+) strand; PAM type: YTN; PAM sequence: CTA
tttcttaagcttttatttta

SEQ ID NO: 290562 - DNA, 20 bp, Artificial Sequence
  Description of Artificial Sequence: Synthetic oligonucleotide
  Target: ATXN1; (+) strand; PAM type: YTN; PAM sequence: TTT
cttaagcttttattttaggt

SEQ ID NO: 290563 - DNA, 20 bp, Artificial Sequence
  Description of Artificial Sequence: Synthetic oligonucleotide
  Target: ATXN1; (+) strand; PAM type: YTN; PAM sequence: TTC
ttaagcttttattttaggtt

SEQ ID NO: 290564 - DNA, 20 bp, Artificial Sequence
  Description of Artificial Sequence: Synthetic oligonucleotide
  Target: ATXN1; (+) strand; PAM type: YTN; PAM sequence: CTT
aagcttttattttaggttca

SEQ ID NO: 290565 - DNA, 20 bp, Artificial Sequence
  Description of Artificial Sequence: Synthetic oligonucleotide
  Target: ATXN1; (+) strand; PAM type: YTN; PAM sequence: TTA
agcttttattttaggttcag

SEQ ID NO: 290566 - DNA, 20 bp, Artificial Sequence
  Description of Artificial Sequence: Synthetic oligonucleotide
  Target: ATXN1; (+) strand; PAM type: YTN; PAM sequence: CTT
ttattttaggttcaggggta

SEQ ID NO: 290567 - DNA, 20 bp, Artificial Sequence
  Description of Artificial Sequence: Synthetic oligonucleotide
  Target: ATXN1; (+) strand; PAM type: YTN; PAM sequence: TTT
tattttaggttcaggggtac

SEQ ID NO: 290568 - DNA, 20 bp, Artificial Sequence
  Description of Artificial Sequence: Synthetic oligonucleotide
  Target: ATXN1; (+) strand; PAM type: YTN; PAM sequence: TTT
attttaggttcaggggtaca

SEQ ID NO: 290569 - DNA, 20 bp, Artificial Sequence
  Description of Artificial Sequence: Synthetic oligonucleotide
  Target: ATXN1; (+) strand; PAM type: YTN; PAM sequence: TTA
ttttaggttcaggggtacat

SEQ ID NO: 290570 - DNA, 20 bp, Artificial Sequence
  Description of Artificial Sequence: Synthetic oligonucleotide
  Target: ATXN1; (+) strand; PAM type: YTN; PAM sequence: TTT
taggttcaggggtacatgtg

SEQ ID NO: 290571 - DNA, 20 bp, Artificial Sequence
  Description of Artificial Sequence: Synthetic oligonucleotide
  Target: ATXN1; (+) strand; PAM type: YTN; PAM sequence: TTT
aggttcaggggtacatgtgc

SEQ ID NO: 290572 - DNA, 20 bp, Artificial Sequence
  Description of Artificial Sequence: Synthetic oligonucleotide
  Target: ATXN1; (+) strand; PAM type: YTN; PAM sequence: TTA
ggttcaggggtacatgtgca

SEQ ID NO: 290573 - DNA, 20 bp, Artificial Sequence
  Description of Artificial Sequence: Synthetic oligonucleotide
  Target: ATXN1; (+) strand; PAM type: YTN; PAM sequence: TTC
aggggtacatgtgcaggttt

SEQ ID NO: 290574 - DNA, 20 bp, Artificial Sequence
  Description of Artificial Sequence: Synthetic oligonucleotide
  Target: ATXN1; (+) strand; PAM type: YTN; PAM sequence: TTT
attaaatagataaactcatg

SEQ ID NO: 290575 - DNA, 20 bp, Artificial Sequence
  Description of Artificial Sequence: Synthetic oligonucleotide
  Target: ATXN1; (+) strand; PAM type: YTN; PAM sequence: TTA
ttaaatagataaactcatgc

SEQ ID NO: 290576 - DNA, 20 bp, Artificial Sequence
  Description of Artificial Sequence: Synthetic oligonucleotide
  Target: ATXN1; (+) strand; PAM type: YTN; PAM sequence: TTA
aatagataaactcatgccat

SEQ ID NO: 290577 - DNA, 20 bp, Artificial Sequence
  Description of Artificial Sequence: Synthetic oligonucleotide
  Target: ATXN1; (+) strand; PAM type: YTN; PAM sequence: CTC
atgccatgggggtttgttgt

SEQ ID NO: 290578 - DNA, 20 bp, Artificial Sequence
  Description of Artificial Sequence: Synthetic oligonucleotide
  Target: ATXN1; (+) strand; PAM type: YTN; PAM sequence: TTT
gttgtacagatggtttcgtc

SEQ ID NO: 290579 - DNA, 20 bp, Artificial Sequence
  Description of Artificial Sequence: Synthetic oligonucleotide
  Target: ATXN1; (+) strand; PAM type: YTN; PAM sequence: TTG
ttgtacagatggtttcgtca

SEQ ID NO: 290580 - DNA, 20 bp, Artificial Sequence
  Description of Artificial Sequence: Synthetic oligonucleotide
  Target: ATXN1; (+) strand; PAM type: YTN; PAM sequence: TTG
tacagatggtttcgtcaccc

SEQ ID NO: 290581 - DNA, 20 bp, Artificial Sequence
  Description of Artificial Sequence: Synthetic oligonucleotide
  Target: ATXN1; (+) strand; PAM type: YTN; PAM sequence: TTT
cgtcacccagatactaagcc

SEQ ID NO: 290582 - DNA, 20 bp, Artificial Sequence
  Description of Artificial Sequence: Synthetic oligonucleotide
  Target: ATXN1; (+) strand; PAM type: YTN; PAM sequence: TTC
gtcacccagatactaagcct

SEQ ID NO: 290583 - DNA, 20 bp, Artificial Sequence
  Description of Artificial Sequence: Synthetic oligonucleotide
  Target: ATXN1; (+) strand; PAM type: YTN; PAM sequence: CTA
agcctagtacccaataattg

SEQ ID NO: 290584 - DNA, 20 bp, Artificial Sequence
  Description of Artificial Sequence: Synthetic oligonucleotide
  Target: ATXN1; (+) strand; PAM type: YTN; PAM sequence: CTA
gtacccaataattgtttttt

SEQ ID NO: 290585 - DNA, 20 bp, Artificial Sequence
  Description of Artificial Sequence: Synthetic oligonucleotide
  Target: ATXN1; (+) strand; PAM type: YTN; PAM sequence: TTG
ttttttctgctcctcttcct

SEQ ID NO: 290586 - DNA, 20 bp, Artificial Sequence
  Description of Artificial Sequence: Synthetic oligonucleotide
  Target: ATXN1; (+) strand; PAM type: YTN; PAM sequence: TTT
tttctgctcctcttcctcct

SEQ ID NO: 290587 - DNA, 20 bp, Artificial Sequence
  Description of Artificial Sequence: Synthetic oligonucleotide
  Target: ATXN1; (+) strand; PAM type: YTN; PAM sequence: TTT
ttctgctcctcttcctcctc

SEQ ID NO: 290588 - DNA, 20 bp, Artificial Sequence
  Description of Artificial Sequence: Synthetic oligonucleotide
  Target: ATXN1; (+) strand; PAM type: YTN; PAM sequence: TTT
tctgctcctcttcctcctcc

SEQ ID NO: 290589 - DNA, 20 bp, Artificial Sequence
  Description of Artificial Sequence: Synthetic oligonucleotide
  Target: ATXN1; (+) strand; PAM type: YTN; PAM sequence: TTT
ctgctcctcttcctcctcca

SEQ ID NO: 290590 - DNA, 20 bp, Artificial Sequence
  Description of Artificial Sequence: Synthetic oligonucleotide
  Target: ATXN1; (+) strand; PAM type: YTN; PAM sequence: TTC
tgctcctcttcctcctccac

SEQ ID NO: 290591 - DNA, 20 bp, Artificial Sequence
  Description of Artificial Sequence: Synthetic oligonucleotide
  Target: ATXN1; (+) strand; PAM type: YTN; PAM sequence: CTG
ctcctcttcctcctccaccc

SEQ ID NO: 290592 - DNA, 20 bp, Artificial Sequence
  Description of Artificial Sequence: Synthetic oligonucleotide
  Target: ATXN1; (+) strand; PAM type: YTN; PAM sequence: CTC
ctcttcctcctccaccctct

SEQ ID NO: 290593 - DNA, 20 bp, Artificial Sequence
  Description of Artificial Sequence: Synthetic oligonucleotide
  Target: ATXN1; (+) strand; PAM type: YTN; PAM sequence: CTC
ttcctcctccaccctctacc

SEQ ID NO: 290594 - DNA, 20 bp, Artificial Sequence
  Description of Artificial Sequence: Synthetic oligonucleotide
  Target: ATXN1; (+) strand; PAM type: YTN; PAM sequence: CTT
cctcctccaccctctaccct

SEQ ID NO: 290595 - DNA, 20 bp, Artificial Sequence
  Description of Artificial Sequence: Synthetic oligonucleotide
  Target: ATXN1; (+) strand; PAM type: YTN; PAM sequence: TTC
ctcctccaccctctaccctc

SEQ ID NO: 290596 - DNA, 20 bp, Artificial Sequence
  Description of Artificial Sequence: Synthetic oligonucleotide
  Target: ATXN1; (+) strand; PAM type: YTN; PAM sequence: CTC
ctccaccctctaccctcaag

SEQ ID NO: 290597 - DNA, 20 bp, Artificial Sequence
  Description of Artificial Sequence: Synthetic oligonucleotide
  Target: ATXN1; (+) strand; PAM type: YTN; PAM sequence: CTC
caccctctaccctcaagtag

SEQ ID NO: 290598 - DNA, 20 bp, Artificial Sequence
  Description of Artificial Sequence: Synthetic oligonucleotide
  Target: ATXN1; (+) strand; PAM type: YTN; PAM sequence: CTC
taccctcaagtaggacccag

SEQ ID NO: 290599 - DNA, 20 bp, Artificial Sequence
  Description of Artificial Sequence: Synthetic oligonucleotide
  Target: ATXN1; (+) strand; PAM type: YTN; PAM sequence: CTA
ccctcaagtaggacccagtg

SEQ ID NO: 290600 - DNA, 20 bp, Artificial Sequence
  Description of Artificial Sequence: Synthetic oligonucleotide
  Target: ATXN1; (+) strand; PAM type: YTN; PAM sequence: CTC
aagtaggacccagtgtctgc

SEQ ID NO: 290601 - DNA, 20 bp, Artificial Sequence
  Description of Artificial Sequence: Synthetic oligonucleotide
  Target: ATXN1; (+) strand; PAM type: YTN; PAM sequence: CTG
ctgttcccttctttgtgtcc

SEQ ID NO: 290602 - DNA, 20 bp, Artificial Sequence
  Description of Artificial Sequence: Synthetic oligonucleotide
  Target: ATXN1; (+) strand; PAM type: YTN; PAM sequence: CTG
ttcccttctttgtgtccatg

SEQ ID NO: 290603 - DNA, 20 bp, Artificial Sequence
  Description of Artificial Sequence: Synthetic oligonucleotide
  Target: ATXN1; (+) strand; PAM type: YTN; PAM sequence: TTC
ccttctttgtgtccatgagt

SEQ ID NO: 290604 - DNA, 20 bp, Artificial Sequence
  Description of Artificial Sequence: Synthetic oligonucleotide
  Target: ATXN1; (+) strand; PAM type: YTN; PAM sequence: CTT
ctttgtgtccatgagttctc

SEQ ID NO: 290605 - DNA, 20 bp, Artificial Sequence
  Description of Artificial Sequence: Synthetic oligonucleotide
  Target: ATXN1; (+) strand; PAM type: YTN; PAM sequence: TTC
tttgtgtccatgagttctca

SEQ ID NO: 290606 - DNA, 20 bp, Artificial Sequence
  Description of Artificial Sequence: Synthetic oligonucleotide
  Target: ATXN1; (+) strand; PAM type: YTN; PAM sequence: CTT
tgtgtccatgagttctcatc

SEQ ID NO: 290607 - DNA, 20 bp, Artificial Sequence
  Description of Artificial Sequence: Synthetic oligonucleotide
  Target: ATXN1; (+) strand; PAM type: YTN; PAM sequence: TTT
gtgtccatgagttctcatca

SEQ ID NO: 290608 - DNA, 20 bp, Artificial Sequence
  Description of Artificial Sequence: Synthetic oligonucleotide
  Target: ATXN1; (+) strand; PAM type: YTN; PAM sequence: TTG
tgtccatgagttctcatcat

SEQ ID NO: 290609 - DNA, 20 bp, Artificial Sequence
  Description of Artificial Sequence: Synthetic oligonucleotide
  Target: ATXN1; (+) strand; PAM type: YTN; PAM sequence: TTC
tcatcatttagctcccactt

SEQ ID NO: 290610 - DNA, 20 bp, Artificial Sequence
  Description of Artificial Sequence: Synthetic oligonucleotide
  Target: ATXN1; (+) strand; PAM type: YTN; PAM sequence: CTC
atcatttagctcccacttgt

SEQ ID NO: 290611 - DNA, 20 bp, Artificial Sequence
  Description of Artificial Sequence: Synthetic oligonucleotide
  Target: ATXN1; (+) strand; PAM type: YTN; PAM sequence: TTT
agctcccacttgtaagtgag

SEQ ID NO: 290612 - DNA, 20 bp, Artificial Sequence
  Description of Artificial Sequence: Synthetic oligonucleotide
  Target: ATXN1; (+) strand; PAM type: YTN; PAM sequence: TTA
gctcccacttgtaagtgaga

SEQ ID NO: 290613 - DNA, 20 bp, Artificial Sequence
  Description of Artificial Sequence: Synthetic oligonucleotide
  Target: ATXN1; (+) strand; PAM type: YTN; PAM sequence: CTC
ccacttgtaagtgagaacat

SEQ ID NO: 290614 - DNA, 20 bp, Artificial Sequence
  Description of Artificial Sequence: Synthetic oligonucleotide
  Target: ATXN1; (+) strand; PAM type: YTN; PAM sequence: CTT
gtaagtgagaacatgcagta

SEQ ID NO: 290615 - DNA, 20 bp, Artificial Sequence
  Description of Artificial Sequence: Synthetic oligonucleotide
  Target: ATXN1; (+) strand; PAM type: YTN; PAM sequence: TTG
taagtgagaacatgcagtat

SEQ ID NO: 290616 - DNA, 20 bp, Artificial Sequence
  Description of Artificial Sequence: Synthetic oligonucleotide
  Target: ATXN1; (+) strand; PAM type: YTN; PAM sequence: TTT
agttttttgttcctgtgata

SEQ ID NO: 290617 - DNA, 20 bp, Artificial Sequence
  Description of Artificial Sequence: Synthetic oligonucleotide
  Target: ATXN1; (+) strand; PAM type: YTN; PAM sequence: TTA
gttttttgttcctgtgatag

SEQ ID NO: 290618 - DNA, 20 bp, Artificial Sequence
  Description of Artificial Sequence: Synthetic oligonucleotide
  Target: ATXN1; (+) strand; PAM type: YTN; PAM sequence: TTT
tttgttcctgtgatagtttg

SEQ ID NO: 290619 - DNA, 20 bp, Artificial Sequence
  Description of Artificial Sequence: Synthetic oligonucleotide
  Target: ATXN1; (+) strand; PAM type: YTN; PAM sequence: TTT
ttgttcctgtgatagtttgc

SEQ ID NO: 290620 - DNA, 20 bp, Artificial Sequence
  Description of Artificial Sequence: Synthetic oligonucleotide
  Target: ATXN1; (+) strand; PAM type: YTN; PAM sequence: TTT
tgttcctgtgatagtttgct

SEQ ID NO: 290621 - DNA, 20 bp, Artificial Sequence
  Description of Artificial Sequence: Synthetic oligonucleotide
  Target: ATXN1; (+) strand; PAM type: YTN; PAM sequence: TTT
gttcctgtgatagtttgcta

SEQ ID NO: 290622 - DNA, 20 bp, Artificial Sequence
  Description of Artificial Sequence: Synthetic oligonucleotide
  Target: ATXN1; (+) strand; PAM type: YTN; PAM sequence: TTG
ttcctgtgatagtttgctaa

SEQ ID NO: 290623 - DNA, 20 bp, Artificial Sequence
  Description of Artificial Sequence: Synthetic oligonucleotide
  Target: ATXN1; (+) strand; PAM type: YTN; PAM sequence: TTC
ctgtgatagtttgctaagga

SEQ ID NO: 290624 - DNA, 20 bp, Artificial Sequence
  Description of Artificial Sequence: Synthetic oligonucleotide
  Target: ATXN1; (+) strand; PAM type: YTN; PAM sequence: CTG
tgatagtttgctaaggataa

SEQ ID NO: 290625 - DNA, 20 bp, Artificial Sequence
  Description of Artificial Sequence: Synthetic oligonucleotide
  Target: ATXN1; (+) strand; PAM type: YTN; PAM sequence: TTT
gctaaggataatggcctcca

SEQ ID NO: 290626 - DNA, 20 bp, Artificial Sequence
  Description of Artificial Sequence: Synthetic oligonucleotide
  Target: ATXN1; (+) strand; PAM type: YTN; PAM sequence: TTG
ctaaggataatggcctccag

SEQ ID NO: 290627 - DNA, 20 bp, Artificial Sequence
  Description of Artificial Sequence: Synthetic oligonucleotide
  Target: ATXN1; (+) strand; PAM type: YTN; PAM sequence: CTA
aggataatggcctccagctc

SEQ ID NO: 290628 - DNA, 20 bp, Artificial Sequence
  Description of Artificial Sequence: Synthetic oligonucleotide
  Target: ATXN1; (+) strand; PAM type: YTN; PAM sequence: CTC
cagctccttccatactcctg

SEQ ID NO: 290629 - DNA, 20 bp, Artificial Sequence
  Description of Artificial Sequence: Synthetic oligonucleotide
  Target: ATXN1; (+) strand; PAM type: YTN; PAM sequence: CTC
cttccatactcctgcaaaag

SEQ ID NO: 290630 - DNA, 20 bp, Artificial Sequence
  Description of Artificial Sequence: Synthetic oligonucleotide
  Target: ATXN1; (+) strand; PAM type: YTN; PAM sequence: CTT
ccatactcctgcaaaagaca

SEQ ID NO: 290631 - DNA, 20 bp, Artificial Sequence
  Description of Artificial Sequence: Synthetic oligonucleotide
  Target: ATXN1; (+) strand; PAM type: YTN; PAM sequence: TTC
catactcctgcaaaagacat

SEQ ID NO: 290632 - DNA, 20 bp, Artificial Sequence
  Description of Artificial Sequence: Synthetic oligonucleotide
  Target: ATXN1; (+) strand; PAM type: YTN; PAM sequence: CTC
ctgcaaaagacatgatctca

SEQ ID NO: 290633 - DNA, 20 bp, Artificial Sequence
  Description of Artificial Sequence: Synthetic oligonucleotide
  Target: ATXN1; (+) strand; PAM type: YTN; PAM sequence: CTG
caaaagacatgatctcattc

SEQ ID NO: 290634 - DNA, 20 bp, Artificial Sequence
  Description of Artificial Sequence: Synthetic oligonucleotide
  Target: ATXN1; (+) strand; PAM type: YTN; PAM sequence: CTC
attccttttttatggctgca

SEQ ID NO: 290635 - DNA, 20 bp, Artificial Sequence
  Description of Artificial Sequence: Synthetic oligonucleotide
  Target: ATXN1; (+) strand; PAM type: YTN; PAM sequence: TTC
cttttttatggctgcatagt

SEQ ID NO: 290636 - DNA, 20 bp, Artificial Sequence
  Description of Artificial Sequence: Synthetic oligonucleotide
  Target: ATXN1; (+) strand; PAM type: YTN; PAM sequence: CTT
ttttatggctgcatagtatt

SEQ ID NO: 290637 - DNA, 20 bp, Artificial Sequence
  Description of Artificial Sequence: Synthetic oligonucleotide
  Target: ATXN1; (+) strand; PAM type: YTN; PAM sequence: TTT
tttatggctgcatagtattc

SEQ ID NO: 290638 - DNA, 20 bp, Artificial Sequence
  Description of Artificial Sequence: Synthetic oligonucleotide
  Target: ATXN1; (+) strand; PAM type: YTN; PAM sequence: TTT
ttatggctgcatagtattcc

SEQ ID NO: 290639 - DNA, 20 bp, Artificial Sequence
  Description of Artificial Sequence: Synthetic oligonucleotide
  Target: ATXN1; (+) strand; PAM type: YTN; PAM sequence: TTT
tatggctgcatagtattcca

SEQ ID NO: 290640 - DNA, 20 bp, Artificial Sequence
  Description of Artificial Sequence: Synthetic oligonucleotide
  Target: ATXN1; (+) strand; PAM type: YTN; PAM sequence: TTT
atggctgcatagtattccat

SEQ ID NO: 290641 - DNA, 20 bp, Artificial Sequence
  Description of Artificial Sequence: Synthetic oligonucleotide
  Target: ATXN1; (+) strand; PAM type: YTN; PAM sequence: TTA
tggctgcatagtattccatg

SEQ ID NO: 290642 - DNA, 20 bp, Artificial Sequence
  Description of Artificial Sequence: Synthetic oligonucleotide
  Target: ATXN1; (+) strand; PAM type: YTN; PAM sequence: CTG
catagtattccatggtaata

SEQ ID NO: 290643 - DNA, 20 bp, Artificial Sequence
  Description of Artificial Sequence: Synthetic oligonucleotide
  Target: ATXN1; (+) strand; PAM type: YTN; PAM sequence: TTC
catggtaatatgtaccacat

SEQ ID NO: 290644 - DNA, 20 bp, Artificial Sequence
  Description of Artificial Sequence: Synthetic oligonucleotide
  Target: ATXN1; (+) strand; PAM type: YTN; PAM sequence: TTT
tttttgtccaatctgtcatt

SEQ ID NO: 290645 - DNA, 20 bp, Artificial Sequence
  Description of Artificial Sequence: Synthetic oligonucleotide
  Target: ATXN1; (+) strand; PAM type: YTN; PAM sequence: TTT
ttttgtccaatctgtcattg

SEQ ID NO: 290646 - DNA, 20 bp, Artificial Sequence
  Description of Artificial Sequence: Synthetic oligonucleotide
  Target: ATXN1; (+) strand; PAM type: YTN; PAM sequence: TTT
tttgtccaatctgtcattga

SEQ ID NO: 290647 - DNA, 20 bp, Artificial Sequence
  Description of Artificial Sequence: Synthetic oligonucleotide
  Target: ATXN1; (+) strand; PAM type: YTN; PAM sequence: TTT
ttgtccaatctgtcattgat

SEQ ID NO: 290648 - DNA, 20 bp, Artificial Sequence
  Description of Artificial Sequence: Synthetic oligonucleotide
  Target: ATXN1; (+) strand; PAM type: YTN; PAM sequence: TTT
tgtccaatctgtcattgatg

SEQ ID NO: 290649 - DNA, 20 bp, Artificial Sequence
  Description of Artificial Sequence: Synthetic oligonucleotide
  Target: ATXN1; (+) strand; PAM type: YTN; PAM sequence: TTT
gtccaatctgtcattgatgg

SEQ ID NO: 290650 - DNA, 20 bp, Artificial Sequence
  Description of Artificial Sequence: Synthetic oligonucleotide
  Target: ATXN1; (+) strand; PAM type: YTN; PAM sequence: TTG
tccaatctgtcattgatggg

SEQ ID NO: 290651 - DNA, 20 bp, Artificial Sequence
  Description of Artificial Sequence: Synthetic oligonucleotide
  Target: ATXN1; (+) strand; PAM type: YTN; PAM sequence: CTG
tcattgatgggcatttaggt

SEQ ID NO: 290652 - DNA, 20 bp, Artificial Sequence
  Description of Artificial Sequence: Synthetic oligonucleotide
  Target: ATXN1; (+) strand; PAM type: YTN; PAM sequence: TTG
atgggcatttaggttgattc

SEQ ID NO: 290653 - DNA, 20 bp, Artificial Sequence
  Description of Artificial Sequence: Synthetic oligonucleotide
  Target: ATXN1; (+) strand; PAM type: YTN; PAM sequence: TTT
aggttgattctgtgtctttg

SEQ ID NO: 290654 - DNA, 20 bp, Artificial Sequence
  Description of Artificial Sequence: Synthetic oligonucleotide
  Target: ATXN1; (+) strand; PAM type: YTN; PAM sequence: TTA
ggttgattctgtgtctttgc

SEQ ID NO: 290655 - DNA, 20 bp, Artificial Sequence
  Description of Artificial Sequence: Synthetic oligonucleotide
  Target: ATXN1; (+) strand; PAM type: YTN; PAM sequence: TTG
attctgtgtctttgctactg

SEQ ID NO: 290656 - DNA, 20 bp, Artificial Sequence
  Description of Artificial Sequence: Synthetic oligonucleotide
  Target: ATXN1; (+) strand; PAM type: YTN; PAM sequence: TTC
tgtgtctttgctactgtgaa

SEQ ID NO: 290657 - DNA, 20 bp, Artificial Sequence
  Description of Artificial Sequence: Synthetic oligonucleotide
  Target: ATXN1; (+) strand; PAM type: YTN; PAM sequence: CTG
tgtctttgctactgtgaata

SEQ ID NO: 290658 - DNA, 20 bp, Artificial Sequence
  Description of Artificial Sequence: Synthetic oligonucleotide
  Target: ATXN1; (+) strand; PAM type: YTN; PAM sequence: CTT
tgctactgtgaatagtgctg

SEQ ID NO: 290659 - DNA, 20 bp, Artificial Sequence
  Description of Artificial Sequence: Synthetic oligonucleotide
  Target: ATXN1; (+) strand; PAM type: YTN; PAM sequence: TTT
gctactgtgaatagtgctgc

SEQ ID NO: 290660 - DNA, 20 bp, Artificial Sequence
  Description of Artificial Sequence: Synthetic oligonucleotide
  Target: ATXN1; (+) strand; PAM type: YTN; PAM sequence: TTG
ctactgtgaatagtgctgca

SEQ ID NO: 290661 - DNA, 20 bp, Artificial Sequence
  Description of Artificial Sequence: Synthetic oligonucleotide
  Target: ATXN1; (+) strand; PAM type: YTN; PAM sequence: CTA
ctgtgaatagtgctgcaatg

SEQ ID NO: 290662 - DNA, 20 bp, Artificial Sequence
  Description of Artificial Sequence: Synthetic oligonucleotide
  Target: ATXN1; (+) strand; PAM type: YTN; PAM sequence: CTG
tgaatagtgctgcaatgaac

SEQ ID NO: 290663 - DNA, 20 bp, Artificial Sequence
  Description of Artificial Sequence: Synthetic oligonucleotide
  Target: ATXN1; (+) strand; PAM type: YTN; PAM sequence: CTG
caatgaacatttgcgtgcat

SEQ ID NO: 290664 - DNA, 20 bp, Artificial Sequence
  Description of Artificial Sequence: Synthetic oligonucleotide
  Target: ATXN1; (+) strand; PAM type: YTN; PAM sequence: TTT
gcgtgcatgtgtctaaattt

SEQ ID NO: 290665 - DNA, 20 bp, Artificial Sequence
  Description of Artificial Sequence: Synthetic oligonucleotide
  Target: ATXN1; (+) strand; PAM type: YTN; PAM sequence: TTG
cgtgcatgtgtctaaattta

SEQ ID NO: 290666 - DNA, 20 bp, Artificial Sequence
  Description of Artificial Sequence: Synthetic oligonucleotide
  Target: ATXN1; (+) strand; PAM type: YTN; PAM sequence: CTA
aatttatggtagaatgattt

SEQ ID NO: 290667 - DNA, 20 bp, Artificial Sequence
  Description of Artificial Sequence: Synthetic oligonucleotide
  Target: ATXN1; (+) strand; PAM type: YTN; PAM sequence: TTT
atggtagaatgatttatatt

SEQ ID NO: 290668 - DNA, 20 bp, Artificial Sequence
  Description of Artificial Sequence: Synthetic oligonucleotide
  Target: ATXN1; (+) strand; PAM type: YTN; PAM sequence: TTA
tggtagaatgatttatattc

SEQ ID NO: 290669 - DNA, 20 bp, Artificial Sequence
  Description of Artificial Sequence: Synthetic oligonucleotide
  Target: ATXN1; (+) strand; PAM type: YTN; PAM sequence: TTT
atattcctctgggtagatac

SEQ ID NO: 290670 - DNA, 20 bp, Artificial Sequence
  Description of Artificial Sequence: Synthetic oligonucleotide
  Target: ATXN1; (+) strand; PAM type: YTN; PAM sequence: TTA
tattcctctgggtagatacc

SEQ ID NO: 290671 - DNA, 20 bp, Artificial Sequence
  Description of Artificial Sequence: Synthetic oligonucleotide
  Target: ATXN1; (+) strand; PAM type: YTN; PAM sequence: TTC
ctctgggtagatacccagta

SEQ ID NO: 290672 - DNA, 20 bp, Artificial Sequence
  Description of Artificial Sequence: Synthetic oligonucleotide
  Target: ATXN1; (+) strand; PAM type: YTN; PAM sequence: CTC
tgggtagatacccagtaatg

SEQ ID NO: 290673 - DNA, 20 bp, Artificial Sequence
  Description of Artificial Sequence: Synthetic oligonucleotide
  Target: ATXN1; (+) strand; PAM type: YTN; PAM sequence: CTG
ggtagatacccagtaatggg

SEQ ID NO: 290674 - DNA, 20 bp, Artificial Sequence
  Description of Artificial Sequence: Synthetic oligonucleotide
  Target: ATXN1; (+) strand; PAM type: YTN; PAM sequence: TTG
ctgggtcgaatggtagttct

SEQ ID NO: 290675 - DNA, 20 bp, Artificial Sequence
  Description of Artificial Sequence: Synthetic oligonucleotide
  Target: ATXN1; (+) strand; PAM type: YTN; PAM sequence: CTG
ggtcgaatggtagttctgct

SEQ ID NO: 290676 - DNA, 20 bp, Artificial Sequence
  Description of Artificial Sequence: Synthetic oligonucleotide
  Target: ATXN1; (+) strand; PAM type: YTN; PAM sequence: TTC
tgcttttagctctttgcaga

SEQ ID NO: 290677 - DNA, 20 bp, Artificial Sequence
  Description of Artificial Sequence: Synthetic oligonucleotide
  Target: ATXN1; (+) strand; PAM type: YTN; PAM sequence: CTG
cttttagctctttgcagaat

SEQ ID NO: 290678 - DNA, 20 bp, Artificial Sequence
  Description of Artificial Sequence: Synthetic oligonucleotide
  Target: ATXN1; (+) strand; PAM type: YTN; PAM sequence: CTT
ttagctctttgcagaattgc

SEQ ID NO: 290679 - DNA, 20 bp, Artificial Sequence
  Description of Artificial Sequence: Synthetic oligonucleotide
  Target: ATXN1; (+) strand; PAM type: YTN; PAM sequence: TTT
tagctctttgcagaattgcc

SEQ ID NO: 290680 - DNA, 20 bp, Artificial Sequence
  Description of Artificial Sequence: Synthetic oligonucleotide
  Target: ATXN1; (+) strand; PAM type: YTN; PAM sequence: TTT
agctctttgcagaattgcca

SEQ ID NO: 290681 - DNA, 20 bp, Artificial Sequence
  Description of Artificial Sequence: Synthetic oligonucleotide
  Target: ATXN1; (+) strand; PAM type: YTN; PAM sequence: TTA
gctctttgcagaattgccac

SEQ ID NO: 290682 - DNA, 20 bp, Artificial Sequence
  Description of Artificial Sequence: Synthetic oligonucleotide
  Target: ATXN1; (+) strand; PAM type: YTN; PAM sequence: CTC
tttgcagaattgccacactg

SEQ ID NO: 290683 - DNA, 20 bp, Artificial Sequence
  Description of Artificial Sequence: Synthetic oligonucleotide
  Target: ATXN1; (+) strand; PAM type: YTN; PAM sequence: CTT
tgcagaattgccacactgcc

SEQ ID NO: 290684 - DNA, 20 bp, Artificial Sequence
  Description of Artificial Sequence: Synthetic oligonucleotide
  Target: ATXN1; (+) strand; PAM type: YTN; PAM sequence: TTT
gcagaattgccacactgcct

SEQ ID NO: 290685 - DNA, 20 bp, Artificial Sequence
  Description of Artificial Sequence: Synthetic oligonucleotide
  Target: ATXN1; (+) strand; PAM type: YTN; PAM sequence: TTG
cagaattgccacactgcctt

SEQ ID NO: 290686 - DNA, 20 bp, Artificial Sequence
  Description of Artificial Sequence: Synthetic oligonucleotide
  Target: ATXN1; (+) strand; PAM type: YTN; PAM sequence: TTG
ccacactgccttccacaatg

SEQ ID NO: 290687 - DNA, 20 bp, Artificial Sequence
  Description of Artificial Sequence: Synthetic oligonucleotide
  Target: ATXN1; (+) strand; PAM type: YTN; PAM sequence: CTG
ccttccacaatggctgaact

SEQ ID NO: 290688 - DNA, 20 bp, Artificial Sequence
  Description of Artificial Sequence: Synthetic oligonucleotide
  Target: ATXN1; (+) strand; PAM type: YTN; PAM sequence: CTT
ccacaatggctgaactaatt

SEQ ID NO: 290689 - DNA, 20 bp, Artificial Sequence
  Description of Artificial Sequence: Synthetic oligonucleotide
  Target: ATXN1; (+) strand; PAM type: YTN; PAM sequence: TTC
cacaatggctgaactaattt

SEQ ID NO: 290690 - DNA, 20 bp, Artificial Sequence
  Description of Artificial Sequence: Synthetic oligonucleotide
  Target: ATXN1; (+) strand; PAM type: YTN; PAM sequence: CTG
aactaatttgtacactcacc

SEQ ID NO: 290691 - DNA, 20 bp, Artificial Sequence
  Description of Artificial Sequence: Synthetic oligonucleotide
  Target: ATXN1; (+) strand; PAM type: YTN; PAM sequence: CTA
atttgtacactcaccaacag

SEQ ID NO: 290692 - DNA, 20 bp, Artificial Sequence
  Description of Artificial Sequence: Synthetic oligonucleotide
  Target: ATXN1; (+) strand; PAM type: YTN; PAM sequence: TTT
gtacactcaccaacagtgta

SEQ ID NO: 290693 - DNA, 20 bp, Artificial Sequence
  Description of Artificial Sequence: Synthetic oligonucleotide
  Target: ATXN1; (+) strand; PAM type: YTN; PAM sequence: TTG
tacactcaccaacagtgtat

SEQ ID NO: 290694 - DNA, 20 bp, Artificial Sequence
  Description of Artificial Sequence: Synthetic oligonucleotide
  Target: ATXN1; (+) strand; PAM type: YTN; PAM sequence: CTC
accaacagtgtataagtgtt

SEQ ID NO: 290695 - DNA, 20 bp, Artificial Sequence
  Description of Artificial Sequence: Synthetic oligonucleotide
  Target: ATXN1; (+) strand; PAM type: YTN; PAM sequence: TTC
cctttctccgcaacctcatc

SEQ ID NO: 290696 - DNA, 20 bp, Artificial Sequence
  Description of Artificial Sequence: Synthetic oligonucleotide
  Target: ATXN1; (+) strand; PAM type: YTN; PAM sequence: CTT
tctccgcaacctcatcagca

SEQ ID NO: 290697 - DNA, 20 bp, Artificial Sequence
  Description of Artificial Sequence: Synthetic oligonucleotide
  Target: ATXN1; (+) strand; PAM type: YTN; PAM sequence: TTT
ctccgcaacctcatcagcat

SEQ ID NO: 290698 - DNA, 20 bp, Artificial Sequence
  Description of Artificial Sequence: Synthetic oligonucleotide
  Target: ATXN1; (+) strand; PAM type: YTN; PAM sequence: TTC
tccgcaacctcatcagcatc

SEQ ID NO: 290699 - DNA, 20 bp, Artificial Sequence
  Description of Artificial Sequence: Synthetic oligonucleotide
  Target: ATXN1; (+) strand; PAM type: YTN; PAM sequence: CTC
cgcaacctcatcagcatcca

SEQ ID NO: 290700 - DNA, 20 bp, Artificial Sequence
  Description of Artificial Sequence: Synthetic oligonucleotide
  Target: ATXN1; (+) strand; PAM type: YTN; PAM sequence: CTC
atcagcatccaactggttat

SEQ ID NO: 290701 - DNA, 20 bp, Artificial Sequence
  Description of Artificial Sequence: Synthetic oligonucleotide
  Target: ATXN1; (+) strand; PAM type: YTN; PAM sequence: CTG
gttattttttgactttttaa

SEQ ID NO: 290702 - DNA, 20 bp, Artificial Sequence
  Description of Artificial Sequence: Synthetic oligonucleotide
  Target: ATXN1; (+) strand; PAM type: YTN; PAM sequence: TTA
ttttttgactttttaacaac

SEQ ID NO: 290703 - DNA, 20 bp, Artificial Sequence
  Description of Artificial Sequence: Synthetic oligonucleotide
  Target: ATXN1; (+) strand; PAM type: YTN; PAM sequence: TTT
tttgactttttaacaacagc

SEQ ID NO: 290704 - DNA, 20 bp, Artificial Sequence
  Description of Artificial Sequence: Synthetic oligonucleotide
  Target: ATXN1; (+) strand; PAM type: YTN; PAM sequence: TTT
ttgactttttaacaacagcc

SEQ ID NO: 290705 - DNA, 20 bp, Artificial Sequence
  Description of Artificial Sequence: Synthetic oligonucleotide
  Target: ATXN1; (+) strand; PAM type: YTN; PAM sequence: TTT
tgactttttaacaacagcca

SEQ ID NO: 290706 - DNA, 20 bp, Artificial Sequence
  Description of Artificial Sequence: Synthetic oligonucleotide
  Target: ATXN1; (+) strand; PAM type: YTN; PAM sequence: TTT
gactttttaacaacagccat

SEQ ID NO: 290707 - DNA, 20 bp, Artificial Sequence
  Description of Artificial Sequence: Synthetic oligonucleotide
  Target: ATXN1; (+) strand; PAM type: YTN; PAM sequence: TTG
actttttaacaacagccatt

SEQ ID NO: 290708 - DNA, 20 bp, Artificial Sequence
  Description of Artificial Sequence: Synthetic oligonucleotide
  Target: ATXN1; (+) strand; PAM type: YTN; PAM sequence: CTT
tttaacaacagccattctga

SEQ ID NO: 290709 - DNA, 20 bp, Artificial Sequence
  Description of Artificial Sequence: Synthetic oligonucleotide
  Target: ATXN1; (+) strand; PAM type: YTN; PAM sequence: TTT
ttaacaacagccattctgac

SEQ ID NO: 290710 - DNA, 20 bp, Artificial Sequence
  Description of Artificial Sequence: Synthetic oligonucleotide
  Target: ATXN1; (+) strand; PAM type: YTN; PAM sequence: TTT
taacaacagccattctgact

SEQ ID NO: 290711 - DNA, 20 bp, Artificial Sequence
  Description of Artificial Sequence: Synthetic oligonucleotide
  Target: ATXN1; (+) strand; PAM type: YTN; PAM sequence: TTT
aacaacagccattctgactg

SEQ ID NO: 290712 - DNA, 20 bp, Artificial Sequence
  Description of Artificial Sequence: Synthetic oligonucleotide
  Target: ATXN1; (+) strand; PAM type: YTN; PAM sequence: TTA
acaacagccattctgactgg

SEQ ID NO: 290713 - DNA, 20 bp, Artificial Sequence
  Description of Artificial Sequence: Synthetic oligonucleotide
  Target: ATXN1; (+) strand; PAM type: YTN; PAM sequence: TTC
tgactggtatgagatagtat

SEQ ID NO: 290714 - DNA, 20 bp, Artificial Sequence
  Description of Artificial Sequence: Synthetic oligonucleotide
  Target: ATXN1; (+) strand; PAM type: YTN; PAM sequence: CTG
actggtatgagatagtatct

SEQ ID NO: 290715 - DNA, 20 bp, Artificial Sequence
  Description of Artificial Sequence: Synthetic oligonucleotide
  Target: ATXN1; (+) strand; PAM type: YTN; PAM sequence: CTG
gtatgagatagtatctcatt

SEQ ID NO: 290716 - DNA, 20 bp, Artificial Sequence
  Description of Artificial Sequence: Synthetic oligonucleotide
  Target: ATXN1; (+) strand; PAM type: YTN; PAM sequence: CTC
attgtgcttttgatttgcgt

SEQ ID NO: 290717 - DNA, 20 bp, Artificial Sequence
  Description of Artificial Sequence: Synthetic oligonucleotide
  Target: ATXN1; (+) strand; PAM type: YTN; PAM sequence: TTG
tgcttttgatttgcgttgct

SEQ ID NO: 290718 - DNA, 20 bp, Artificial Sequence
  Description of Artificial Sequence: Synthetic oligonucleotide
  Target: ATXN1; (+) strand; PAM type: YTN; PAM sequence: CTT
ttgatttgcgttgctctaat

SEQ ID NO: 290719 - DNA, 20 bp, Artificial Sequence
  Description of Artificial Sequence: Synthetic oligonucleotide
  Target: ATXN1; (+) strand; PAM type: YTN; PAM sequence: TTT
tgatttgcgttgctctaatg

SEQ ID NO: 290720 - DNA, 20 bp, Artificial Sequence
  Description of Artificial Sequence: Synthetic oligonucleotide
  Target: ATXN1; (+) strand; PAM type: YTN; PAM sequence: TTT
gatttgcgttgctctaatga

SEQ ID NO: 290721 - DNA, 20 bp, Artificial Sequence
  Description of Artificial Sequence: Synthetic oligonucleotide
  Target: ATXN1; (+) strand; PAM type: YTN; PAM sequence: TTG
atttgcgttgctctaatgac

SEQ ID NO: 290722 - DNA, 20 bp, Artificial Sequence
  Description of Artificial Sequence: Synthetic oligonucleotide
  Target: ATXN1; (+) strand; PAM type: YTN; PAM sequence: TTT
gcgttgctctaatgaccagc

SEQ ID NO: 290723 - DNA, 20 bp, Artificial Sequence
  Description of Artificial Sequence: Synthetic oligonucleotide
  Target: ATXN1; (+) strand; PAM type: YTN; PAM sequence: TTG
cgttgctctaatgaccagcg

SEQ ID NO: 290724 - DNA, 20 bp, Artificial Sequence
  Description of Artificial Sequence: Synthetic oligonucleotide
  Target: ATXN1; (+) strand; PAM type: YTN; PAM sequence: TTG
ctctaatgaccagcgatatt

SEQ ID NO: 290725 - DNA, 20 bp, Artificial Sequence
  Description of Artificial Sequence: Synthetic oligonucleotide
  Target: ATXN1; (+) strand; PAM type: YTN; PAM sequence: CTC
taatgaccagcgatattgag

SEQ ID NO: 290726 - DNA, 20 bp, Artificial Sequence
  Description of Artificial Sequence: Synthetic oligonucleotide
  Target: ATXN1; (+) strand; PAM type: YTN; PAM sequence: CTA
atgaccagcgatattgagct

SEQ ID NO: 290727 - DNA, 20 bp, Artificial Sequence
  Description of Artificial Sequence: Synthetic oligonucleotide
  Target: ATXN1; (+) strand; PAM type: YTN; PAM sequence: TTG
agctgcttttcatattctta

SEQ ID NO: 290728 - DNA, 20 bp, Artificial Sequence
  Description of Artificial Sequence: Synthetic oligonucleotide
  Target: ATXN1; (+) strand; PAM type: YTN; PAM sequence: CTG
cttttcatattcttattggc

SEQ ID NO: 290729 - DNA, 20 bp, Artificial Sequence
  Description of Artificial Sequence: Synthetic oligonucleotide
  Target: ATXN1; (+) strand; PAM type: YTN; PAM sequence: CTT
ttcatattcttattggccat

SEQ ID NO: 290730 - DNA, 20 bp, Artificial Sequence
  Description of Artificial Sequence: Synthetic oligonucleotide
  Target: ATXN1; (+) strand; PAM type: YTN; PAM sequence: TTT
tcatattcttattggccata

SEQ ID NO: 290731 - DNA, 20 bp, Artificial Sequence
  Description of Artificial Sequence: Synthetic oligonucleotide
  Target: ATXN1; (+) strand; PAM type: YTN; PAM sequence: TTT
catattcttattggccatat

SEQ ID NO: 290732 - DNA, 20 bp, Artificial Sequence
  Description of Artificial Sequence: Synthetic oligonucleotide
  Target: ATXN1; (+) strand; PAM type: YTN; PAM sequence: TTC
atattcttattggccatatg

SEQ ID NO: 290733 - DNA, 20 bp, Artificial Sequence
  Description of Artificial Sequence: Synthetic oligonucleotide
  Target: ATXN1; (+) strand; PAM type: YTN; PAM sequence: TTC
ttattggccatatgtcttct

SEQ ID NO: 290734 - DNA, 20 bp, Artificial Sequence
  Description of Artificial Sequence: Synthetic oligonucleotide
  Target: ATXN1; (+) strand; PAM type: YTN; PAM sequence: CTT
attggccatatgtcttcttt

SEQ ID NO: 290735 - DNA, 20 bp, Artificial Sequence
  Description of Artificial Sequence: Synthetic oligonucleotide
  Target: ATXN1; (+) strand; PAM type: YTN; PAM sequence: TTA
ttggccatatgtcttctttt

SEQ ID NO: 290736 - DNA, 20 bp, Artificial Sequence
  Description of Artificial Sequence: Synthetic oligonucleotide
  Target: ATXN1; (+) strand; PAM type: YTN; PAM sequence: TTG
gccatatgtcttcttttgaa

SEQ ID NO: 290737 - DNA, 20 bp, Artificial Sequence
  Description of Artificial Sequence: Synthetic oligonucleotide
  Target: ATXN1; (+) strand; PAM type: YTN; PAM sequence: CTT
cttttgaaaagtgtctgttc

SEQ ID NO: 290738 - DNA, 20 bp, Artificial Sequence
  Description of Artificial Sequence: Synthetic oligonucleotide
  Target: ATXN1; (+) strand; PAM type: YTN; PAM sequence: TTC
ttttgaaaagtgtctgttca

SEQ ID NO: 290739 - DNA, 20 bp, Artificial Sequence
  Description of Artificial Sequence: Synthetic oligonucleotide
  Target: ATXN1; (+) strand; PAM type: YTN; PAM sequence: CTT
ttgaaaagtgtctgttcatg

SEQ ID NO: 290740 - DNA, 20 bp, Artificial Sequence
  Description of Artificial Sequence: Synthetic oligonucleotide
  Target: ATXN1; (+) strand; PAM type: YTN; PAM sequence: TTT
tgaaaagtgtctgttcatgt

SEQ ID NO: 290741 - DNA, 20 bp, Artificial Sequence
  Description of Artificial Sequence: Synthetic oligonucleotide
  Target: ATXN1; (+) strand; PAM type: YTN; PAM sequence: TTT
gaaaagtgtctgttcatgtc

SEQ ID NO: 290742 - DNA, 20 bp, Artificial Sequence
  Description of Artificial Sequence: Synthetic oligonucleotide
  Target: ATXN1; (+) strand; PAM type: YTN; PAM sequence: TTG
aaaagtgtctgttcatgtcc

SEQ ID NO: 290743 - DNA, 20 bp, Artificial Sequence
  Description of Artificial Sequence: Synthetic oligonucleotide
  Target: ATXN1; (+) strand; PAM type: YTN; PAM sequence: CTG
ttcatgtcctttgctcactt

SEQ ID NO: 290744 - DNA, 20 bp, Artificial Sequence
  Description of Artificial Sequence: Synthetic oligonucleotide
  Target: ATXN1; (+) strand; PAM type: YTN; PAM sequence: TTC
atgtcctttgctcacttttt

SEQ ID NO: 290745 - DNA, 20 bp, Artificial Sequence
  Description of Artificial Sequence: Synthetic oligonucleotide
  Target: ATXN1; (+) strand; PAM type: YTN; PAM sequence: CTT
tgctcactttttcatggggt

SEQ ID NO: 290746 - DNA, 20 bp, Artificial Sequence
  Description of Artificial Sequence: Synthetic oligonucleotide
  Target: ATXN1; (+) strand; PAM type: YTN; PAM sequence: TTT
gctcactttttcatggggtt

SEQ ID NO: 290747 - DNA, 20 bp, Artificial Sequence
  Description of Artificial Sequence: Synthetic oligonucleotide
  Target: ATXN1; (+) strand; PAM type: YTN; PAM sequence: TTG
ctcactttttcatggggttg

SEQ ID NO: 290748 - DNA, 20 bp, Artificial Sequence
  Description of Artificial Sequence: Synthetic oligonucleotide
  Target: ATXN1; (+) strand; PAM type: YTN; PAM sequence: CTC
actttttcatggggttgaaa

SEQ ID NO: 290749 - DNA, 20 bp, Artificial Sequence
  Description of Artificial Sequence: Synthetic oligonucleotide
  Target: ATXN1; (+) strand; PAM type: YTN; PAM sequence: CTT
tttcatggggttgaaagtaa

SEQ ID NO: 290750 - DNA, 20 bp, Artificial Sequence
  Description of Artificial Sequence: Synthetic oligonucleotide
  Target: ATXN1; (+) strand; PAM type: YTN; PAM sequence: TTT
ttcatggggttgaaagtaac

SEQ ID NO: 290751 - DNA, 20 bp, Artificial Sequence
  Description of Artificial Sequence: Synthetic oligonucleotide
  Target: ATXN1; (+) strand; PAM type: YTN; PAM sequence: TTT
tcatggggttgaaagtaacc

SEQ ID NO: 290752 - DNA, 20 bp, Artificial Sequence
  Description of Artificial Sequence: Synthetic oligonucleotide
  Target: ATXN1; (+) strand; PAM type: YTN; PAM sequence: TTT
catggggttgaaagtaacct

SEQ ID NO: 290753 - DNA, 20 bp, Artificial Sequence
  Description of Artificial Sequence: Synthetic oligonucleotide
  Target: ATXN1; (+) strand; PAM type: YTN; PAM sequence: TTC
atggggttgaaagtaacctt

SEQ ID NO: 290754 - DNA, 20 bp, Artificial Sequence
  Description of Artificial Sequence: Synthetic oligonucleotide
  Target: ATXN1; (+) strand; PAM type: YTN; PAM sequence: TTG
aaagtaaccttctccccgcc

SEQ ID NO: 290755 - DNA, 20 bp, Artificial Sequence
  Description of Artificial Sequence: Synthetic oligonucleotide
  Target: ATXN1; (+) strand; PAM type: YTN; PAM sequence: CTT
ctccccgcctccccctgagg

SEQ ID NO: 290756 - DNA, 20 bp, Artificial Sequence
  Description of Artificial Sequence: Synthetic oligonucleotide
  Target: ATXN1; (+) strand; PAM type: YTN; PAM sequence: TTC
tccccgcctccccctgaggc

SEQ ID NO: 290757 - DNA, 20 bp, Artificial Sequence
  Description of Artificial Sequence: Synthetic oligonucleotide
  Target: ATXN1; (+) strand; PAM type: YTN; PAM sequence: CTC
cccgcctccccctgaggcag

SEQ ID NO: 290758 - DNA, 20 bp, Artificial Sequence
  Description of Artificial Sequence: Synthetic oligonucleotide
  Target: ATXN1; (+) strand; PAM type: YTN; PAM sequence: CTC
cccctgaggcagagtcatgc

SEQ ID NO: 290759 - DNA, 20 bp, Artificial Sequence
  Description of Artificial Sequence: Synthetic oligonucleotide
  Target: ATXN1; (+) strand; PAM type: YTN; PAM sequence: CTG
aggcagagtcatgctctgtc

SEQ ID NO: 290760 - DNA, 20 bp, Artificial Sequence
  Description of Artificial Sequence: Synthetic oligonucleotide
  Target: ATXN1; (+) strand; PAM type: YTN; PAM sequence: CTC
tgtcacccaggctggagcat

SEQ ID NO: 290761 - DNA, 20 bp, Artificial Sequence
  Description of Artificial Sequence: Synthetic oligonucleotide
  Target: ATXN1; (+) strand; PAM type: YTN; PAM sequence: CTG
tcacccaggctggagcatag

SEQ ID NO: 290762 - DNA, 20 bp, Artificial Sequence
  Description of Artificial Sequence: Synthetic oligonucleotide
  Target: ATXN1; (+) strand; PAM type: YTN; PAM sequence: CTG
gagcatagtggtgcaatctc

SEQ ID NO: 290763 - DNA, 20 bp, Artificial Sequence
  Description of Artificial Sequence: Synthetic oligonucleotide
  Target: ATXN1; (+) strand; PAM type: YTN; PAM sequence: CTC
ggctcactgcaaccttcgcc

SEQ ID NO: 290764 - DNA, 20 bp, Artificial Sequence
  Description of Artificial Sequence: Synthetic oligonucleotide
  Target: ATXN1; (+) strand; PAM type: YTN; PAM sequence: CTC
actgcaaccttcgcctccca

SEQ ID NO: 290765 - DNA, 20 bp, Artificial Sequence
  Description of Artificial Sequence: Synthetic oligonucleotide
  Target: ATXN1; (+) strand; PAM type: YTN; PAM sequence: CTG
caaccttcgcctcccaggtt

SEQ ID NO: 290766 - DNA, 20 bp, Artificial Sequence
  Description of Artificial Sequence: Synthetic oligonucleotide
  Target: ATXN1; (+) strand; PAM type: YTN; PAM sequence: CTT
cgcctcccaggttcaagcaa

SEQ ID NO: 290767 - DNA, 20 bp, Artificial Sequence
  Description of Artificial Sequence: Synthetic oligonucleotide
  Target: ATXN1; (+) strand; PAM type: YTN; PAM sequence: TTC
gcctcccaggttcaagcaat

SEQ ID NO: 290768 - DNA, 20 bp, Artificial Sequence
  Description of Artificial Sequence: Synthetic oligonucleotide
  Target: ATXN1; (+) strand; PAM type: YTN; PAM sequence: CTC
ccaggttcaagcaattctcc

SEQ ID NO: 290769 - DNA, 20 bp, Artificial Sequence
  Description of Artificial Sequence: Synthetic oligonucleotide
  Target: ATXN1; (+) strand; PAM type: YTN; PAM sequence: TTC
aagcaattctcctgcctcag

SEQ ID NO: 290770 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcccgcg

SEQ ID NO: 290771 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccgcgta

SEQ ID NO: 290772 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccgcgtagct

SEQ ID NO: 290773 - DNA, 20 bp, Artificial Sequence
  Description of Artificial Sequence: Synthetic oligonucleotide
  Target: ATXN1; (+) strand; PAM type: YTN; PAM sequence: CTC
agcctcccgcgtagctggga

SEQ ID NO: 290774 - DNA, 20 bp, Artificial Sequence
  Description of Artificial Sequence: Synthetic oligonucleotide
  Target: ATXN1; (+) strand; PAM type: YTN; PAM sequence: CTC
ccgcgtagctgggattacag

SEQ ID NO: 290775 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcactcgccac

SEQ ID NO: 290776 - DNA, 20 bp, Artificial Sequence
  Description of Artificial Sequence: Synthetic oligonucleotide
  Target: ATXN1; (+) strand; PAM type: YTN; PAM sequence: TTA
caggcactcgccaccagccc

SEQ ID NO: 290777 - DNA, 20 bp, Artificial Sequence
  Description of Artificial Sequence: Synthetic oligonucleotide
  Target: ATXN1; (+) strand; PAM type: YTN; PAM sequence: CTC
gccaccagcccagctaattg

SEQ ID NO: 290778 - DNA, 20 bp, Artificial Sequence
  Description of Artificial Sequence: Synthetic oligonucleotide
  Target: ATXN1; (+) strand; PAM type: YTN; PAM sequence: CTA
attgtttttgtattttttag

SEQ ID NO: 290779 - DNA, 20 bp, Artificial Sequence
  Description of Artificial Sequence: Synthetic oligonucleotide
  Target: ATXN1; (+) strand; PAM type: YTN; PAM sequence: TTG
tttttgtattttttagtaga

SEQ ID NO: 290780 - DNA, 20 bp, Artificial Sequence
  Description of Artificial Sequence: Synthetic oligonucleotide
  Target: ATXN1; (+) strand; PAM type: YTN; PAM sequence: TTT
ttgtattttttagtagagat

SEQ ID NO: 290781 - DNA, 20 bp, Artificial Sequence
  Description of Artificial Sequence: Synthetic oligonucleotide
  Target: ATXN1; (+) strand; PAM type: YTN; PAM sequence: TTT
tgtattttttagtagagatg

SEQ ID NO: 290782 - DNA, 20 bp, Artificial Sequence
  Description of Artificial Sequence: Synthetic oligonucleotide
  Target: ATXN1; (+) strand; PAM type: YTN; PAM sequence: TTT
gtattttttagtagagatgg

SEQ ID NO: 290783 - DNA, 20 bp, Artificial Sequence
  Description of Artificial Sequence: Synthetic oligonucleotide
  Target: ATXN1; (+) strand; PAM type: YTN; PAM sequence: TTG
tattttttagtagagatggg

SEQ ID NO: 290784 - DNA, 20 bp, Artificial Sequence
  Description of Artificial Sequence: Synthetic oligonucleotide
  Target: ATXN1; (+) strand; PAM type: YTN; PAM sequence: TTT
tttagtagagatggggtttc

SEQ ID NO: 290785 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatggggtttca

SEQ ID NO: 290786 - DNA, 20 bp, Artificial Sequence
  Description of Artificial Sequence: Synthetic oligonucleotide
  Target: ATXN1; (+) strand; PAM type: YTN; PAM sequence: TTT
tagtagagatggggtttcac

SEQ ID NO: 290787 - DNA, 20 bp, Artificial Sequence
  Description of Artificial Sequence: Synthetic oligonucleotide
  Target: ATXN1; (+) strand; PAM type: YTN; PAM sequence: TTT
agtagagatggggtttcacc

SEQ ID NO: 290788 - DNA, 20 bp, Artificial Sequence
  Description of Artificial Sequence: Synthetic oligonucleotide
  Target: ATXN1; (+) strand; PAM type: YTN; PAM sequence: TTA
gtagagatggggtttcacca

SEQ ID NO: 290789 - DNA, 20 bp, Artificial Sequence
  Description of Artificial Sequence: Synthetic oligonucleotide
  Target: ATXN1; (+) strand; PAM type: YTN; PAM sequence: TTT
caccatgtttgcaaggctgg

SEQ ID NO: 290790 - DNA, 20 bp, Artificial Sequence
  Description of Artificial Sequence: Synthetic oligonucleotide
  Target: ATXN1; (+) strand; PAM type: YTN; PAM sequence: TTC
accatgtttgcaaggctggt

SEQ ID NO: 290791 - DNA, 20 bp, Artificial Sequence
  Description of Artificial Sequence: Synthetic oligonucleotide
  Target: ATXN1; (+) strand; PAM type: YTN; PAM sequence: TTT
gcaaggctggtctctaactc

SEQ ID NO: 290792 - DNA, 20 bp, Artificial Sequence
  Description of Artificial Sequence: Synthetic oligonucleotide
  Target: ATXN1; (+) strand; PAM type: YTN; PAM sequence: TTG
caaggctggtctctaactcc

SEQ ID NO: 290793 - DNA, 20 bp, Artificial Sequence
  Description of Artificial Sequence: Synthetic oligonucleotide
  Target: ATXN1; (+) strand; PAM type: YTN; PAM sequence: CTG
gtctctaactcctgactttg

SEQ ID NO: 290794 - DNA, 20 bp, Artificial Sequence
  Description of Artificial Sequence: Synthetic oligonucleotide
  Target: ATXN1; (+) strand; PAM type: YTN; PAM sequence: CTC
taactcctgactttgtgatc

SEQ ID NO: 290795 - DNA, 20 bp, Artificial Sequence
  Description of Artificial Sequence: Synthetic oligonucleotide
  Target: ATXN1; (+) strand; PAM type: YTN; PAM sequence: CTA
actcctgactttgtgatctg

SEQ ID NO: 290796 - DNA, 20 bp, Artificial Sequence
  Description of Artificial Sequence: Synthetic oligonucleotide
  Target: ATXN1; (+) strand; PAM type: YTN; PAM sequence: CTC
ctgactttgtgatctgccca

SEQ ID NO: 290797 - DNA, 20 bp, Artificial Sequence
  Description of Artificial Sequence: Synthetic oligonucleotide
  Target: ATXN1; (+) strand; PAM type: YTN; PAM sequence: CTG
actttgtgatctgcccacct

SEQ ID NO: 290798 - DNA, 20 bp, Artificial Sequence
  Description of Artificial Sequence: Synthetic oligonucleotide
  Target: ATXN1; (+) strand; PAM type: YTN; PAM sequence: CTT
tgtgatctgcccaccttggc

SEQ ID NO: 290799 - DNA, 20 bp, Artificial Sequence
  Description of Artificial Sequence: Synthetic oligonucleotide
  Target: ATXN1; (+) strand; PAM type: YTN; PAM sequence: TTT
gtgatctgcccaccttggcc

SEQ ID NO: 290800 - DNA, 20 bp, Artificial Sequence
  Description of Artificial Sequence: Synthetic oligonucleotide
  Target: ATXN1; (+) strand; PAM type: YTN; PAM sequence: TTG
tgatctgcccaccttggcct

SEQ ID NO: 290801 - DNA, 20 bp, Artificial Sequence
  Description of Artificial Sequence: Synthetic oligonucleotide
  Target: ATXN1; (+) strand; PAM type: YTN; PAM sequence: CTG
cccaccttggcctttcaaag

SEQ ID NO: 290802 - DNA, 20 bp, Artificial Sequence
  Description of Artificial Sequence: Synthetic oligonucleotide
  Target: ATXN1; (+) strand; PAM type: YTN; PAM sequence: CTT
ggcctttcaaagtgctggga

SEQ ID NO: 290803 - DNA, 20 bp, Artificial Sequence
  Description of Artificial Sequence: Synthetic oligonucleotide
  Target: ATXN1; (+) strand; PAM type: YTN; PAM sequence: TTG
gcctttcaaagtgctgggat

SEQ ID NO: 290804 - DNA, 20 bp, Artificial Sequence
  Description of Artificial Sequence: Synthetic oligonucleotide
  Target: ATXN1; (+) strand; PAM type: YTN; PAM sequence: CTT
tcaaagtgctgggatgaaaa

SEQ ID NO: 290805 - DNA, 20 bp, Artificial Sequence
  Description of Artificial Sequence: Synthetic oligonucleotide
  Target: ATXN1; (+) strand; PAM type: YTN; PAM sequence: TTT
caaagtgctgggatgaaaat

SEQ ID NO: 290806 - DNA, 20 bp, Artificial Sequence
  Description of Artificial Sequence: Synthetic oligonucleotide
  Target: ATXN1; (+) strand; PAM type: YTN; PAM sequence: TTC
aaagtgctgggatgaaaata

SEQ ID NO: 290807 - DNA, 20 bp, Artificial Sequence
  Description of Artificial Sequence: Synthetic oligonucleotide
  Target: ATXN1; (+) strand; PAM type: YTN; PAM sequence: CTG
ggatgaaaataaccttttta

SEQ ID NO: 290808 - DNA, 20 bp, Artificial Sequence
  Description of Artificial Sequence: Synthetic oligonucleotide
  Target: ATXN1; (+) strand; PAM type: YTN; PAM sequence: CTT
tttaaaaatatatatatttc

SEQ ID NO: 290809 - DNA, 20 bp, Artificial Sequence
  Description of Artificial Sequence: Synthetic oligonucleotide
  Target: ATXN1; (+) strand; PAM type: YTN; PAM sequence: TTT
ttaaaaatatatatatttcg

SEQ ID NO: 290810 - DNA, 20 bp, Artificial Sequence
  Description of Artificial Sequence: Synthetic oligonucleotide
  Target: ATXN1; (+) strand; PAM type: YTN; PAM sequence: TTT
taaaaatatatatatttcgg

SEQ ID NO: 290811 - DNA, 20 bp, Artificial Sequence
  Description of Artificial Sequence: Synthetic oligonucleotide
  Target: ATXN1; (+) strand; PAM type: YTN; PAM sequence: TTT
aaaaatatatatatttcggc

SEQ ID NO: 290812 - DNA, 20 bp, Artificial Sequence
  Description of Artificial Sequence: Synthetic oligonucleotide
  Target: ATXN1; (+) strand; PAM type: YTN; PAM sequence: TTA
aaaatatatatatttcggcc

SEQ ID NO: 290813 - DNA, 20 bp, Artificial Sequence
  Description of Artificial Sequence: Synthetic oligonucleotide
  Target: ATXN1; (+) strand; PAM type: YTN; PAM sequence: TTT
cggccaggcaaggtggctca

SEQ ID NO: 290814 - DNA, 20 bp, Artificial Sequence
  Description of Artificial Sequence: Synthetic oligonucleotide
  Target: ATXN1; (+) strand; PAM type: YTN; PAM sequence: TTC
ggccaggcaaggtggctcat

SEQ ID NO: 290815 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatccctgcact

SEQ ID NO: 290816 - DNA, 20 bp, Artificial Sequence
  Description of Artificial Sequence: Synthetic oligonucleotide
  Target: ATXN1; (+) strand; PAM type: YTN; PAM sequence: CTG
taatccctgcactttgggag

SEQ ID NO: 290817 - DNA, 20 bp, Artificial Sequence
  Description of Artificial Sequence: Synthetic oligonucleotide
  Target: ATXN1; (+) strand; PAM type: YTN; PAM sequence: CTG
cactttgggaggctgaagtg

SEQ ID NO: 290818 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgaagtgggtgg

SEQ ID NO: 290819 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaagtgggtgga

SEQ ID NO: 290820 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaagtgggtggat

SEQ ID NO: 290821 - DNA, 20 bp, Artificial Sequence
  Description of Artificial Sequence: Synthetic oligonucleotide
  Target: ATXN1; (+) strand; PAM type: YTN; PAM sequence: CTG
aagtgggtggatcccctgag

SEQ ID NO: 290822 - DNA, 20 bp, Artificial Sequence
  Description of Artificial Sequence: Synthetic oligonucleotide
  Target: ATXN1; (+) strand; PAM type: YTN; PAM sequence: CTG
aggtcaggagttcgagacca

SEQ ID NO: 290823 - DNA, 20 bp, Artificial Sequence
  Description of Artificial Sequence: Synthetic oligonucleotide
  Target: ATXN1; (+) strand; PAM type: YTN; PAM sequence: TTC
gagaccatcctggccaacat

SEQ ID NO: 290824 - DNA, 20 bp, Artificial Sequence
  Description of Artificial Sequence: Synthetic oligonucleotide
  Target: ATXN1; (+) strand; PAM type: YTN; PAM sequence: CTG
gccaacatgatgaaaccctg

SEQ ID NO: 290825 - DNA, 20 bp, Artificial Sequence
  Description of Artificial Sequence: Synthetic oligonucleotide
  Target: ATXN1; (+) strand; PAM type: YTN; PAM sequence: CTG
tctctactaaaaatacaaaa

SEQ ID NO: 290826 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaaact

SEQ ID NO: 290827 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaaactag

SEQ ID NO: 290828 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaaactagctg

SEQ ID NO: 290829 - DNA, 20 bp, Artificial Sequence
  Description of Artificial Sequence: Synthetic oligonucleotide
  Target: ATXN1; (+) strand; PAM type: YTN; PAM sequence: CTA
gctggacgtggtggtgtgcg

SEQ ID NO: 290830 - DNA, 20 bp, Artificial Sequence
  Description of Artificial Sequence: Synthetic oligonucleotide
  Target: ATXN1; (+) strand; PAM type: YTN; PAM sequence: CTG
gacgtggtggtgtgcgcctg

SEQ ID NO: 290831 - DNA, 20 bp, Artificial Sequence
  Description of Artificial Sequence: Synthetic oligonucleotide
  Target: ATXN1; (+) strand; PAM type: YTN; PAM sequence: CTG
taatcccagctacttgggag

SEQ ID NO: 290832 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgaggcagga

SEQ ID NO: 290833 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggcaggagaa

SEQ ID NO: 290834 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggagaat

SEQ ID NO: 290835 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcgcttgaa

SEQ ID NO: 290836 - DNA, 20 bp, Artificial Sequence
  Description of Artificial Sequence: Synthetic oligonucleotide
  Target: ATXN1; (+) strand; PAM type: YTN; PAM sequence: CTT
gaacccaggaggcagaggtt

SEQ ID NO: 290837 - DNA, 20 bp, Artificial Sequence
  Description of Artificial Sequence: Synthetic oligonucleotide
  Target: ATXN1; (+) strand; PAM type: YTN; PAM sequence: TTG
aacccaggaggcagaggttg

SEQ ID NO: 290838 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagatcacacc

SEQ ID NO: 290839 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggcaacaa

SEQ ID NO: 290840 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcaacaaaagca

SEQ ID NO: 290841 - DNA, 20 bp, Artificial Sequence
  Description of Artificial Sequence: Synthetic oligonucleotide
  Target: ATXN1; (+) strand; PAM type: YTN; PAM sequence: CTG
ggcaacaaaagcaaaactcc

SEQ ID NO: 290842 - DNA, 20 bp, Artificial Sequence
  Description of Artificial Sequence: Synthetic oligonucleotide
  Target: ATXN1; (+) strand; PAM type: YTN; PAM sequence: CTC
catctcaaaaaaaaaaaaat

SEQ ID NO: 290843 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaattcaaaa

SEQ ID NO: 290844 - DNA, 20 bp, Artificial Sequence
  Description of Artificial Sequence: Synthetic oligonucleotide
  Target: ATXN1; (+) strand; PAM type: YTN; PAM sequence: TTC
aaaaatttcttaatgttgcc

SEQ ID NO: 290845 - DNA, 20 bp, Artificial Sequence
  Description of Artificial Sequence: Synthetic oligonucleotide
  Target: ATXN1; (+) strand; PAM type: YTN; PAM sequence: TTT
cttaatgttgccttcttaga

SEQ ID NO: 290846 - DNA, 20 bp, Artificial Sequence
  Description of Artificial Sequence: Synthetic oligonucleotide
  Target: ATXN1; (+) strand; PAM type: YTN; PAM sequence: TTC
ttaatgttgccttcttagag

SEQ ID NO: 290847 - DNA, 20 bp, Artificial Sequence
  Description of Artificial Sequence: Synthetic oligonucleotide
  Target: ATXN1; (+) strand; PAM type: YTN; PAM sequence: CTT
aatgttgccttcttagagtc

SEQ ID NO: 290848 - DNA, 20 bp, Artificial Sequence
  Description of Artificial Sequence: Synthetic oligonucleotide
  Target: ATXN1; (+) strand; PAM type: YTN; PAM sequence: TTA
atgttgccttcttagagtct

SEQ ID NO: 290849 - DNA, 20 bp, Artificial Sequence
  Description of Artificial Sequence: Synthetic oligonucleotide
  Target: ATXN1; (+) strand; PAM type: YTN; PAM sequence: TTG
ccttcttagagtctgtataa

SEQ ID NO: 290850 - DNA, 20 bp, Artificial Sequence
  Description of Artificial Sequence: Synthetic oligonucleotide
  Target: ATXN1; (+) strand; PAM type: YTN; PAM sequence: CTT
cttagagtctgtataacctt

SEQ ID NO: 290851 - DNA, 20 bp, Artificial Sequence
  Description of Artificial Sequence: Synthetic oligonucleotide
  Target: ATXN1; (+) strand; PAM type: YTN; PAM sequence: TTC
ttagagtctgtataaccttc

SEQ ID NO: 290852 - DNA, 20 bp, Artificial Sequence
  Description of Artificial Sequence: Synthetic oligonucleotide
  Target: ATXN1; (+) strand; PAM type: YTN; PAM sequence: CTT
agagtctgtataaccttctt

SEQ ID NO: 290853 - DNA, 20 bp, Artificial Sequence
  Description of Artificial Sequence: Synthetic oligonucleotide
  Target: ATXN1; (+) strand; PAM type: YTN; PAM sequence: TTA
gagtctgtataaccttcttc

SEQ ID NO: 290854 - DNA, 20 bp, Artificial Sequence
  Description of Artificial Sequence: Synthetic oligonucleotide
  Target: ATXN1; (+) strand; PAM type: YTN; PAM sequence: CTG
tataaccttcttctggaaag

SEQ ID NO: 290855 - DNA, 20 bp, Artificial Sequence
  Description of Artificial Sequence: Synthetic oligonucleotide
  Target: ATXN1; (+) strand; PAM type: YTN; PAM sequence: CTT
cttctggaaagggcaatttt

SEQ ID NO: 290856 - DNA, 20 bp, Artificial Sequence
  Description of Artificial Sequence: Synthetic oligonucleotide
  Target: ATXN1; (+) strand; PAM type: YTN; PAM sequence: TTC
ttctggaaagggcaattttt

SEQ ID NO: 290857 - DNA, 20 bp, Artificial Sequence
  Description of Artificial Sequence: Synthetic oligonucleotide
  Target: ATXN1; (+) strand; PAM type: YTN; PAM sequence: CTT
ctggaaagggcaattttttt

SEQ ID NO: 290858 - DNA, 20 bp, Artificial Sequence
  Description of Artificial Sequence: Synthetic oligonucleotide
  Target: ATXN1; (+) strand; PAM type: YTN; PAM sequence: TTC
tggaaagggcaatttttttt

SEQ ID NO: 290859 - DNA, 20 bp, Artificial Sequence
  Description of Artificial Sequence: Synthetic oligonucleotide
  Target: ATXN1; (+) strand; PAM type: YTN; PAM sequence: CTG
gaaagggcaattttttttaa

SEQ ID NO: 290860 - DNA, 20 bp, Artificial Sequence
  Description of Artificial Sequence: Synthetic oligonucleotide
  Target: ATXN1; (+) strand; PAM type: YTN; PAM sequence: TTT
tttttaacatcttgcccatt

SEQ ID NO: 290861 - DNA, 20 bp, Artificial Sequence
  Description of Artificial Sequence: Synthetic oligonucleotide
  Target: ATXN1; (+) strand; PAM type: YTN; PAM sequence: TTT
ttttaacatcttgcccattt

SEQ ID NO: 290862 - DNA, 20 bp, Artificial Sequence
  Description of Artificial Sequence: Synthetic oligonucleotide
  Target: ATXN1; (+) strand; PAM type: YTN; PAM sequence: TTT
tttaacatcttgcccattta

SEQ ID NO: 290863 - DNA, 20 bp, Artificial Sequence
  Description of Artificial Sequence: Synthetic oligonucleotide
  Target: ATXN1; (+) strand; PAM type: YTN; PAM sequence: TTT
ttaacatcttgcccatttat

SEQ ID NO: 290864 - DNA, 20 bp, Artificial Sequence
  Description of Artificial Sequence: Synthetic oligonucleotide
  Target: ATXN1; (+) strand; PAM type: YTN; PAM sequence: TTT
taacatcttgcccatttatt

SEQ ID NO: 290865 - DNA, 20 bp, Artificial Sequence
  Description of Artificial Sequence: Synthetic oligonucleotide
  Target: ATXN1; (+) strand; PAM type: YTN; PAM sequence: TTT
aacatcttgcccatttatta

SEQ ID NO: 290866 - DNA, 20 bp, Artificial Sequence
  Description of Artificial Sequence: Synthetic oligonucleotide
  Target: ATXN1; (+) strand; PAM type: YTN; PAM sequence: TTA
acatcttgcccatttattag

SEQ ID NO: 290867 - DNA, 20 bp, Artificial Sequence
  Description of Artificial Sequence: Synthetic oligonucleotide
  Target: ATXN1; (+) strand; PAM type: YTN; PAM sequence: CTT
gcccatttattagatattat

SEQ ID NO: 290868 - DNA, 20 bp, Artificial Sequence
  Description of Artificial Sequence: Synthetic oligonucleotide
  Target: ATXN1; (+) strand; PAM type: YTN; PAM sequence: TTG
cccatttattagatattata

SEQ ID NO: 290869 - DNA, 20 bp, Artificial Sequence
  Description of Artificial Sequence: Synthetic oligonucleotide
  Target: ATXN1; (+) strand; PAM type: YTN; PAM sequence: TTT
attagatattataaaggtta

SEQ ID NO: 290870 - DNA, 20 bp, Artificial Sequence
  Description of Artificial Sequence: Synthetic oligonucleotide
  Target: ATXN1; (+) strand; PAM type: YTN; PAM sequence: TTA
ttagatattataaaggttaa

SEQ ID NO: 290871 - DNA, 20 bp, Artificial Sequence
  Description of Artificial Sequence: Synthetic oligonucleotide
  Target: ATXN1; (+) strand; PAM type: YTN; PAM sequence: TTA
gatattataaaggttaagat

SEQ ID NO: 290872 - DNA, 20 bp, Artificial Sequence
  Description of Artificial Sequence: Synthetic oligonucleotide
  Target: ATXN1; (+) strand; PAM type: YTN; PAM sequence: TTA
taaaggttaagatgaaaatg

SEQ ID NO: 290873 - DNA, 20 bp, Artificial Sequence
  Description of Artificial Sequence: Synthetic oligonucleotide
  Target: ATXN1; (+) strand; PAM type: YTN; PAM sequence: TTA
agatgaaaatgcttcccaag

SEQ ID NO: 290874 - DNA, 20 bp, Artificial Sequence
  Description of Artificial Sequence: Synthetic oligonucleotide
  Target: ATXN1; (+) strand; PAM type: YTN; PAM sequence: CTT
cccaagggcctgccatgttt

SEQ ID NO: 290875 - DNA, 20 bp, Artificial Sequence
  Description of Artificial Sequence: Synthetic oligonucleotide
  Target: ATXN1; (+) strand; PAM type: YTN; PAM sequence: TTC
ccaagggcctgccatgtttt

SEQ ID NO: 290876 - DNA, 20 bp, Artificial Sequence
  Description of Artificial Sequence: Synthetic oligonucleotide
  Target: ATXN1; (+) strand; PAM type: YTN; PAM sequence: CTG
ccatgtttttcctgtcatat

SEQ ID NO: 290877 - DNA, 20 bp, Artificial Sequence
  Description of Artificial Sequence: Synthetic oligonucleotide
  Target: ATXN1; (+) strand; PAM type: YTN; PAM sequence: TTT
ttcctgtcatataaatcatg

SEQ ID NO: 290878 - DNA, 20 bp, Artificial Sequence
  Description of Artificial Sequence: Synthetic oligonucleotide
  Target: ATXN1; (+) strand; PAM type: YTN; PAM sequence: TTT
tcctgtcatataaatcatgt

SEQ ID NO: 290879 - DNA, 20 bp, Artificial Sequence
  Description of Artificial Sequence: Synthetic oligonucleotide
  Target: ATXN1; (+) strand; PAM type: YTN; PAM sequence: TTT
cctgtcatataaatcatgtc

SEQ ID NO: 290880 - DNA, 20 bp, Artificial Sequence
  Description of Artificial Sequence: Synthetic oligonucleotide
  Target: ATXN1; (+) strand; PAM type: YTN; PAM sequence: TTC
ctgtcatataaatcatgtct

SEQ ID NO: 290881 - DNA, 20 bp, Artificial Sequence
  Description of Artificial Sequence: Synthetic oligonucleotide
  Target: ATXN1; (+) strand; PAM type: YTN; PAM sequence: CTG
tcatataaatcatgtctgta

SEQ ID NO: 290882 - DNA, 20 bp, Artificial Sequence
  Description of Artificial Sequence: Synthetic oligonucleotide
  Target: ATXN1; (+) strand; PAM type: YTN; PAM sequence: CTG
tacgggcagaatcacaaagc

SEQ ID NO: 290883 - DNA, 20 bp, Artificial Sequence
  Description of Artificial Sequence: Synthetic oligonucleotide
  Target: ATXN1; (+) strand; PAM type: YTN; PAM sequence: CTA
gaatgggtctgaggactcct

SEQ ID NO: 290884 - DNA, 20 bp, Artificial Sequence
  Description of Artificial Sequence: Synthetic oligonucleotide
  Target: ATXN1; (+) strand; PAM type: YTN; PAM sequence: CTG
aggactcctcctctcaggca

SEQ ID NO: 290885 - DNA, 20 bp, Artificial Sequence
  Description of Artificial Sequence: Synthetic oligonucleotide
  Target: ATXN1; (+) strand; PAM type: YTN; PAM sequence: CTC
ctcctctcaggcaacttcct

SEQ ID NO: 290886 - DNA, 20 bp, Artificial Sequence
  Description of Artificial Sequence: Synthetic oligonucleotide
  Target: ATXN1; (+) strand; PAM type: YTN; PAM sequence: CTC
ctctcaggcaacttccttcc

SEQ ID NO: 290887 - DNA, 20 bp, Artificial Sequence
  Description of Artificial Sequence: Synthetic oligonucleotide
  Target: ATXN1; (+) strand; PAM type: YTN; PAM sequence: CTC
tcaggcaacttccttccaac

SEQ ID NO: 290888 - DNA, 20 bp, Artificial Sequence
  Description of Artificial Sequence: Synthetic oligonucleotide
  Target: ATXN1; (+) strand; PAM type: YTN; PAM sequence: CTC
aggcaacttccttccaactg

SEQ ID NO: 290889 - DNA, 20 bp, Artificial Sequence
  Description of Artificial Sequence: Synthetic oligonucleotide
  Target: ATXN1; (+) strand; PAM type: YTN; PAM sequence: CTT
ccttccaactgtgggcattc

SEQ ID NO: 290890 - DNA, 20 bp, Artificial Sequence
  Description of Artificial Sequence: Synthetic oligonucleotide
  Target: ATXN1; (+) strand; PAM type: YTN; PAM sequence: TTC
cttccaactgtgggcattcc

SEQ ID NO: 290891 - DNA, 20 bp, Artificial Sequence
  Description of Artificial Sequence: Synthetic oligonucleotide
  Target: ATXN1; (+) strand; PAM type: YTN; PAM sequence: CTT
ccaactgtgggcattccctt

SEQ ID NO: 290892 - DNA, 20 bp, Artificial Sequence
  Description of Artificial Sequence: Synthetic oligonucleotide
  Target: ATXN1; (+) strand; PAM type: YTN; PAM sequence: TTC
caactgtgggcattcccttg

SEQ ID NO: 290893 - DNA, 20 bp, Artificial Sequence
  Description of Artificial Sequence: Synthetic oligonucleotide
  Target: ATXN1; (+) strand; PAM type: YTN; PAM sequence: CTG
tgggcattcccttgggtgcc

SEQ ID NO: 290894 - DNA, 20 bp, Artificial Sequence
  Description of Artificial Sequence: Synthetic oligonucleotide
  Target: ATXN1; (+) strand; PAM type: YTN; PAM sequence: TTC
ccttgggtgccctcttacac

SEQ ID NO: 290895 - DNA, 20 bp, Artificial Sequence
  Description of Artificial Sequence: Synthetic oligonucleotide
  Target: ATXN1; (+) strand; PAM type: YTN; PAM sequence: CTT
gggtgccctcttacactcac

SEQ ID NO: 290896 - DNA, 20 bp, Artificial Sequence
  Description of Artificial Sequence: Synthetic oligonucleotide
  Target: ATXN1; (+) strand; PAM type: YTN; PAM sequence: TTG
ggtgccctcttacactcact

SEQ ID NO: 290897 - DNA, 20 bp, Artificial Sequence
  Description of Artificial Sequence: Synthetic oligonucleotide
  Target: ATXN1; (+) strand; PAM type: YTN; PAM sequence: CTC
ttacactcactgattcaccc

SEQ ID NO: 290898 - DNA, 20 bp, Artificial Sequence
  Description of Artificial Sequence: Synthetic oligonucleotide
  Target: ATXN1; (+) strand; PAM type: YTN; PAM sequence: CTT
acactcactgattcacccaa

SEQ ID NO: 290899 - DNA, 20 bp, Artificial Sequence
  Description of Artificial Sequence: Synthetic oligonucleotide
  Target: ATXN1; (+) strand; PAM type: YTN; PAM sequence: TTA
cactcactgattcacccaac

SEQ ID NO: 290900 - DNA, 20 bp, Artificial Sequence
  Description of Artificial Sequence: Synthetic oligonucleotide
  Target: ATXN1; (+) strand; PAM type: YTN; PAM sequence: CTC
actgattcacccaacattca

SEQ ID NO: 290901 - DNA, 20 bp, Artificial Sequence
  Description of Artificial Sequence: Synthetic oligonucleotide
  Target: ATXN1; (+) strand; PAM type: YTN; PAM sequence: CTG
attcacccaacattcacttg

SEQ ID NO: 290902 - DNA, 20 bp, Artificial Sequence
  Description of Artificial Sequence: Synthetic oligonucleotide
  Target: ATXN1; (+) strand; PAM type: YTN; PAM sequence: TTC
acccaacattcacttgggca

SEQ ID NO: 290903 - DNA, 20 bp, Artificial Sequence
  Description of Artificial Sequence: Synthetic oligonucleotide
  Target: ATXN1; (+) strand; PAM type: YTN; PAM sequence: TTC
acttgggcacttctgcattg

SEQ ID NO: 290904 - DNA, 20 bp, Artificial Sequence
  Description of Artificial Sequence: Synthetic oligonucleotide
  Target: ATXN1; (+) strand; PAM type: YTN; PAM sequence: CTT
gggcacttctgcattgtatg

SEQ ID NO: 290905 - DNA, 20 bp, Artificial Sequence
  Description of Artificial Sequence: Synthetic oligonucleotide
  Target: ATXN1; (+) strand; PAM type: YTN; PAM sequence: TTG
ggcacttctgcattgtatga

SEQ ID NO: 290906 - DNA, 20 bp, Artificial Sequence
  Description of Artificial Sequence: Synthetic oligonucleotide
  Target: ATXN1; (+) strand; PAM type: YTN; PAM sequence: CTT
ctgcattgtatgactctctt

SEQ ID NO: 290907 - DNA, 20 bp, Artificial Sequence
  Description of Artificial Sequence: Synthetic oligonucleotide
  Target: ATXN1; (+) strand; PAM type: YTN; PAM sequence: TTC
tgcattgtatgactctcttg

SEQ ID NO: 290908 - DNA, 20 bp, Artificial Sequence
  Description of Artificial Sequence: Synthetic oligonucleotide
  Target: ATXN1; (+) strand; PAM type: YTN; PAM sequence: CTG
cattgtatgactctcttgag

SEQ ID NO: 290909 - DNA, 20 bp, Artificial Sequence
  Description of Artificial Sequence: Synthetic oligonucleotide
  Target: ATXN1; (+) strand; PAM type: YTN; PAM sequence: TTG
tatgactctcttgaggcaaa

SEQ ID NO: 290910 - DNA, 20 bp, Artificial Sequence
  Description of Artificial Sequence: Synthetic oligonucleotide
  Target: ATXN1; (+) strand; PAM type: YTN; PAM sequence: CTC
tcttgaggcaaacaggaaaa

SEQ ID NO: 290911 - DNA, 20 bp, Artificial Sequence
  Description of Artificial Sequence: Synthetic oligonucleotide
  Target: ATXN1; (+) strand; PAM type: YTN; PAM sequence: CTC
ttgaggcaaacaggaaaaac

SEQ ID NO: 290912 - DNA, 20 bp, Artificial Sequence
  Description of Artificial Sequence: Synthetic oligonucleotide
  Target: ATXN1; (+) strand; PAM type: YTN; PAM sequence: CTT
gaggcaaacaggaaaaacct

SEQ ID NO: 290913 - DNA, 20 bp, Artificial Sequence
  Description of Artificial Sequence: Synthetic oligonucleotide
  Target: ATXN1; (+) strand; PAM type: YTN; PAM sequence: TTG
aggcaaacaggaaaaacctg

SEQ ID NO: 290914 - DNA, 20 bp, Artificial Sequence
  Description of Artificial Sequence: Synthetic oligonucleotide
  Target: ATXN1; (+) strand; PAM type: YTN; PAM sequence: CTG
tatctgccctcaaggggagt

SEQ ID NO: 290915 - DNA, 20 bp, Artificial Sequence
  Description of Artificial Sequence: Synthetic oligonucleotide
  Target: ATXN1; (+) strand; PAM type: YTN; PAM sequence: CTG
ccctcaaggggagtccctcc

SEQ ID NO: 290916 - DNA, 20 bp, Artificial Sequence
  Description of Artificial Sequence: Synthetic oligonucleotide
  Target: ATXN1; (+) strand; PAM type: YTN; PAM sequence: CTC
aaggggagtccctcctagag

SEQ ID NO: 290917 - DNA, 20 bp, Artificial Sequence
  Description of Artificial Sequence: Synthetic oligonucleotide
  Target: ATXN1; (+) strand; PAM type: YTN; PAM sequence: CTC
ctagaggaggacactagcca

SEQ ID NO: 290918 - DNA, 20 bp, Artificial Sequence
  Description of Artificial Sequence: Synthetic oligonucleotide
  Target: ATXN1; (+) strand; PAM type: YTN; PAM sequence: CTA
gaggaggacactagccatac

SEQ ID NO: 290919 - DNA, 20 bp, Artificial Sequence
  Description of Artificial Sequence: Synthetic oligonucleotide
  Target: ATXN1; (+) strand; PAM type: YTN; PAM sequence: CTA
gccataccgttgttatgctg

SEQ ID NO: 290920 - DNA, 20 bp, Artificial Sequence
  Description of Artificial Sequence: Synthetic oligonucleotide
  Target: ATXN1; (+) strand; PAM type: YTN; PAM sequence: TTG
ttatgctgaagttgcgaggt

SEQ ID NO: 290921 - DNA, 20 bp, Artificial Sequence
  Description of Artificial Sequence: Synthetic oligonucleotide
  Target: ATXN1; (+) strand; PAM type: YTN; PAM sequence: TTA
tgctgaagttgcgaggtcca

SEQ ID NO: 290922 - DNA, 20 bp, Artificial Sequence
  Description of Artificial Sequence: Synthetic oligonucleotide
  Target: ATXN1; (+) strand; PAM type: YTN; PAM sequence: CTG
aagttgcgaggtccatttac

SEQ ID NO: 290923 - DNA, 20 bp, Artificial Sequence
  Description of Artificial Sequence: Synthetic oligonucleotide
  Target: ATXN1; (+) strand; PAM type: YTN; PAM sequence: TTG
cgaggtccatttacagaacc

SEQ ID NO: 290924 - DNA, 20 bp, Artificial Sequence
  Description of Artificial Sequence: Synthetic oligonucleotide
  Target: ATXN1; (+) strand; PAM type: YTN; PAM sequence: TTT
acagaaccagccttatcact

SEQ ID NO: 290925 - DNA, 20 bp, Artificial Sequence
  Description of Artificial Sequence: Synthetic oligonucleotide
  Target: ATXN1; (+) strand; PAM type: YTN; PAM sequence: TTA
cagaaccagccttatcactt

SEQ ID NO: 290926 - DNA, 20 bp, Artificial Sequence
  Description of Artificial Sequence: Synthetic oligonucleotide
  Target: ATXN1; (+) strand; PAM type: YTN; PAM sequence: CTT
atcacttagcaatatagccc

SEQ ID NO: 290927 - DNA, 20 bp, Artificial Sequence
  Description of Artificial Sequence: Synthetic oligonucleotide
  Target: ATXN1; (+) strand; PAM type: YTN; PAM sequence: TTA
tcacttagcaatatagccca

SEQ ID NO: 290928 - DNA, 20 bp, Artificial Sequence
  Description of Artificial Sequence: Synthetic oligonucleotide
  Target: ATXN1; (+) strand; PAM type: YTN; PAM sequence: CTT
agcaatatagcccacatacc

SEQ ID NO: 290929 - DNA, 20 bp, Artificial Sequence
  Description of Artificial Sequence: Synthetic oligonucleotide
  Target: ATXN1; (+) strand; PAM type: YTN; PAM sequence: TTA
gcaatatagcccacataccc

SEQ ID NO: 290930 - DNA, 20 bp, Artificial Sequence
  Description of Artificial Sequence: Synthetic oligonucleotide
  Target: ATXN1; (+) strand; PAM type: YTN; PAM sequence: TTC
aagggcctaagtgagtggat

SEQ ID NO: 290931 - DNA, 20 bp, Artificial Sequence
  Description of Artificial Sequence: Synthetic oligonucleotide
  Target: ATXN1; (+) strand; PAM type: YTN; PAM sequence: CTA
agtgagtggatgataatgtg

SEQ ID NO: 290932 - DNA, 20 bp, Artificial Sequence
  Description of Artificial Sequence: Synthetic oligonucleotide
  Target: ATXN1; (+) strand; PAM type: YTN; PAM sequence: CTG
agtcacttagtgggctgatc

SEQ ID NO: 290933 - DNA, 20 bp, Artificial Sequence
  Description of Artificial Sequence: Synthetic oligonucleotide
  Target: ATXN1; (+) strand; PAM type: YTN; PAM sequence: CTT
agtgggctgatcaacagggg

SEQ ID NO: 290934 - DNA, 20 bp, Artificial Sequence
  Description of Artificial Sequence: Synthetic oligonucleotide
  Target: ATXN1; (+) strand; PAM type: YTN; PAM sequence: TTA
gtgggctgatcaacagggga

SEQ ID NO: 290935 - DNA, 20 bp, Artificial Sequence
  Description of Artificial Sequence: Synthetic oligonucleotide
  Target: ATXN1; (+) strand; PAM type: YTN; PAM sequence: CTG
atcaacaggggattcatgga

SEQ ID NO: 290936 - DNA, 20 bp, Artificial Sequence
  Description of Artificial Sequence: Synthetic oligonucleotide
  Target: ATXN1; (+) strand; PAM type: YTN; PAM sequence: TTC
atggaggaaaagctaacaga

SEQ ID NO: 290937 - DNA, 20 bp, Artificial Sequence
  Description of Artificial Sequence: Synthetic oligonucleotide
  Target: ATXN1; (+) strand; PAM type: YTN; PAM sequence: CTA
acagaagtgaccactccaat

SEQ ID NO: 290938 - DNA, 20 bp, Artificial Sequence
  Description of Artificial Sequence: Synthetic oligonucleotide
  Target: ATXN1; (+) strand; PAM type: YTN; PAM sequence: CTC
caatgcattgatgatatcag

SEQ ID NO: 290939 - DNA, 20 bp, Artificial Sequence
  Description of Artificial Sequence: Synthetic oligonucleotide
  Target: ATXN1; (+) strand; PAM type: YTN; PAM sequence: TTG
atgatatcagagcatgacag

SEQ ID NO: 290940 - DNA, 20 bp, Artificial Sequence
  Description of Artificial Sequence: Synthetic oligonucleotide
  Target: ATXN1; (+) strand; PAM type: YTN; PAM sequence: CTC
ctgcaagtcatcatctgctc

SEQ ID NO: 290941 - DNA, 20 bp, Artificial Sequence
  Description of Artificial Sequence: Synthetic oligonucleotide
  Target: ATXN1; (+) strand; PAM type: YTN; PAM sequence: CTG
caagtcatcatctgctcaac

SEQ ID NO: 290942 - DNA, 20 bp, Artificial Sequence
  Description of Artificial Sequence: Synthetic oligonucleotide
  Target: ATXN1; (+) strand; PAM type: YTN; PAM sequence: CTG
ctcaactgtgaatcggcatc

SEQ ID NO: 290943 - DNA, 20 bp, Artificial Sequence
  Description of Artificial Sequence: Synthetic oligonucleotide
  Target: ATXN1; (+) strand; PAM type: YTN; PAM sequence: CTC
aactgtgaatcggcatctga

SEQ ID NO: 290944 - DNA, 20 bp, Artificial Sequence
  Description of Artificial Sequence: Synthetic oligonucleotide
  Target: ATXN1; (+) strand; PAM type: YTN; PAM sequence: CTG
tgaatcggcatctgagaaaa

SEQ ID NO: 290945 - DNA, 20 bp, Artificial Sequence
  Description of Artificial Sequence: Synthetic oligonucleotide
  Target: ATXN1; (+) strand; PAM type: YTN; PAM sequence: CTG
agaaaataagcaacaacctt

SEQ ID NO: 290946 - DNA, 20 bp, Artificial Sequence
  Description of Artificial Sequence: Synthetic oligonucleotide
  Target: ATXN1; (+) strand; PAM type: YTN; PAM sequence: CTT
acctcccaaacaccaacatt

SEQ ID NO: 290947 - DNA, 20 bp, Artificial Sequence
  Description of Artificial Sequence: Synthetic oligonucleotide
  Target: ATXN1; (+) strand; PAM type: YTN; PAM sequence: TTA
cctcccaaacaccaacatta

SEQ ID NO: 290948 - DNA, 20 bp, Artificial Sequence
  Description of Artificial Sequence: Synthetic oligonucleotide
  Target: ATXN1; (+) strand; PAM type: YTN; PAM sequence: CTC
ccaaacaccaacattaaagc

SEQ ID NO: 290949 - DNA, 20 bp, Artificial Sequence
  Description of Artificial Sequence: Synthetic oligonucleotide
  Target: ATXN1; (+) strand; PAM type: YTN; PAM sequence: TTA
aagcaatgcattattaaaat

SEQ ID NO: 290950 - DNA, 20 bp, Artificial Sequence
  Description of Artificial Sequence: Synthetic oligonucleotide
  Target: ATXN1; (+) strand; PAM type: YTN; PAM sequence: TTA
ttaaaatggaggttctcagg

SEQ ID NO: 290951 - DNA, 20 bp, Artificial Sequence
  Description of Artificial Sequence: Synthetic oligonucleotide
  Target: ATXN1; (+) strand; PAM type: YTN; PAM sequence: TTA
aaatggaggttctcaggtag

SEQ ID NO: 290952 - DNA, 20 bp, Artificial Sequence
  Description of Artificial Sequence: Synthetic oligonucleotide
  Target: ATXN1; (+) strand; PAM type: YTN; PAM sequence: TTC
tcaggtagtaaatgaacact

SEQ ID NO: 290953 - DNA, 20 bp, Artificial Sequence
  Description of Artificial Sequence: Synthetic oligonucleotide
  Target: ATXN1; (+) strand; PAM type: YTN; PAM sequence: CTC
aggtagtaaatgaacacttt

SEQ ID NO: 290954 - DNA, 20 bp, Artificial Sequence
  Description of Artificial Sequence: Synthetic oligonucleotide
  Target: ATXN1; (+) strand; PAM type: YTN; PAM sequence: CTT
taaaactcatgcaatcataa

SEQ ID NO: 290955 - DNA, 20 bp, Artificial Sequence
  Description of Artificial Sequence: Synthetic oligonucleotide
  Target: ATXN1; (+) strand; PAM type: YTN; PAM sequence: TTT
aaaactcatgcaatcataaa

SEQ ID NO: 290956 - DNA, 20 bp, Artificial Sequence
  Description of Artificial Sequence: Synthetic oligonucleotide
  Target: ATXN1; (+) strand; PAM type: YTN; PAM sequence: TTA
aaactcatgcaatcataaac

SEQ ID NO: 290957 - DNA, 20 bp, Artificial Sequence
  Description of Artificial Sequence: Synthetic oligonucleotide
  Target: ATXN1; (+) strand; PAM type: YTN; PAM sequence: CTC
atgcaatcataaacattaga

SEQ ID NO: 290958 - DNA, 20 bp, Artificial Sequence
  Description of Artificial Sequence: Synthetic oligonucleotide
  Target: ATXN1; (+) strand; PAM type: YTN; PAM sequence: TTA
gaatatgcagcaaagagata

SEQ ID NO: 290959 - DNA, 20 bp, Artificial Sequence
  Description of Artificial Sequence: Synthetic oligonucleotide
  Target: ATXN1; (+) strand; PAM type: YTN; PAM sequence: CTT
gtcagaagatattaagacga

SEQ ID NO: 290960 - DNA, 20 bp, Artificial Sequence
  Description of Artificial Sequence: Synthetic oligonucleotide
  Target: ATXN1; (+) strand; PAM type: YTN; PAM sequence: TTG
tcagaagatattaagacgac

SEQ ID NO: 290961 - DNA, 20 bp, Artificial Sequence
  Description of Artificial Sequence: Synthetic oligonucleotide
  Target: ATXN1; (+) strand; PAM type: YTN; PAM sequence: TTA
agacgacatggcaataaaag

SEQ ID NO: 290962 - DNA, 20 bp, Artificial Sequence
  Description of Artificial Sequence: Synthetic oligonucleotide
  Target: ATXN1; (+) strand; PAM type: YTN; PAM sequence: CTG
ttcacagagagaatgattct

SEQ ID NO: 290963 - DNA, 20 bp, Artificial Sequence
  Description of Artificial Sequence: Synthetic oligonucleotide
  Target: ATXN1; (+) strand; PAM type: YTN; PAM sequence: TTC
acagagagaatgattctaaa

SEQ ID NO: 290964 - DNA, 20 bp, Artificial Sequence
  Description of Artificial Sequence: Synthetic oligonucleotide
  Target: ATXN1; (+) strand; PAM type: YTN; PAM sequence: TTC
taaatacaaaatggtcagat

SEQ ID NO: 290965 - DNA, 20 bp, Artificial Sequence
  Description of Artificial Sequence: Synthetic oligonucleotide
  Target: ATXN1; (+) strand; PAM type: YTN; PAM sequence: CTA
aatacaaaatggtcagattg

SEQ ID NO: 290966 - DNA, 20 bp, Artificial Sequence
  Description of Artificial Sequence: Synthetic oligonucleotide
  Target: ATXN1; (+) strand; PAM type: YTN; PAM sequence: TTG
atactcagaagtattgctat

SEQ ID NO: 290967 - DNA, 20 bp, Artificial Sequence
  Description of Artificial Sequence: Synthetic oligonucleotide
  Target: ATXN1; (+) strand; PAM type: YTN; PAM sequence: CTC
agaagtattgctattaatag

SEQ ID NO: 290968 - DNA, 20 bp, Artificial Sequence
  Description of Artificial Sequence: Synthetic oligonucleotide
  Target: ATXN1; (+) strand; PAM type: YTN; PAM sequence: TTG
ctattaatagaaataatatt

SEQ ID NO: 290969 - DNA, 20 bp, Artificial Sequence
  Description of Artificial Sequence: Synthetic oligonucleotide
  Target: ATXN1; (+) strand; PAM type: YTN; PAM sequence: CTA
ttaatagaaataatattaga

SEQ ID NO: 290970 - DNA, 20 bp, Artificial Sequence
  Description of Artificial Sequence: Synthetic oligonucleotide
  Target: ATXN1; (+) strand; PAM type: YTN; PAM sequence: TTA
atagaaataatattagagag

SEQ ID NO: 290971 - DNA, 20 bp, Artificial Sequence
  Description of Artificial Sequence: Synthetic oligonucleotide
  Target: ATXN1; (+) strand; PAM type: YTN; PAM sequence: TTA
gagaggtttcattatgtaaa

SEQ ID NO: 290972 - DNA, 20 bp, Artificial Sequence
  Description of Artificial Sequence: Synthetic oligonucleotide
  Target: ATXN1; (+) strand; PAM type: YTN; PAM sequence: TTT
cattatgtaaatggctcatg

SEQ ID NO: 290973 - DNA, 20 bp, Artificial Sequence
  Description of Artificial Sequence: Synthetic oligonucleotide
  Target: ATXN1; (+) strand; PAM type: YTN; PAM sequence: TTC
attatgtaaatggctcatgt

SEQ ID NO: 290974 - DNA, 20 bp, Artificial Sequence
  Description of Artificial Sequence: Synthetic oligonucleotide
  Target: ATXN1; (+) strand; PAM type: YTN; PAM sequence: TTA
tgtaaatggctcatgtgtct

SEQ ID NO: 290975 - DNA, 20 bp, Artificial Sequence
  Description of Artificial Sequence: Synthetic oligonucleotide
  Target: ATXN1; (+) strand; PAM type: YTN; PAM sequence: CTC
atgtgtctgccagaaatgta

SEQ ID NO: 290976 - DNA, 20 bp, Artificial Sequence
  Description of Artificial Sequence: Synthetic oligonucleotide
  Target: ATXN1; (+) strand; PAM type: YTN; PAM sequence: CTG
ccagaaatgtacccagtaat

SEQ ID NO: 290977 - DNA, 20 bp, Artificial Sequence
  Description of Artificial Sequence: Synthetic oligonucleotide
  Target: ATXN1; (+) strand; PAM type: YTN; PAM sequence: TTT
gcatttctgctatagtgaaa

SEQ ID NO: 290978 - DNA, 20 bp, Artificial Sequence
  Description of Artificial Sequence: Synthetic oligonucleotide
  Target: ATXN1; (+) strand; PAM type: YTN; PAM sequence: TTG
catttctgctatagtgaaaa

SEQ ID NO: 290979 - DNA, 20 bp, Artificial Sequence
  Description of Artificial Sequence: Synthetic oligonucleotide
  Target: ATXN1; (+) strand; PAM type: YTN; PAM sequence: TTT
ctgctatagtgaaaatttca

SEQ ID NO: 290980 - DNA, 20 bp, Artificial Sequence
  Description of Artificial Sequence: Synthetic oligonucleotide
  Target: ATXN1; (+) strand; PAM type: YTN; PAM sequence: TTC
tgctatagtgaaaatttcag

SEQ ID NO: 290981 - DNA, 20 bp, Artificial Sequence
  Description of Artificial Sequence: Synthetic oligonucleotide
  Target: ATXN1; (+) strand; PAM type: YTN; PAM sequence: CTG
ctatagtgaaaatttcaggg

SEQ ID NO: 290982 - DNA, 20 bp, Artificial Sequence
  Description of Artificial Sequence: Synthetic oligonucleotide
  Target: ATXN1; (+) strand; PAM type: YTN; PAM sequence: CTA
tagtgaaaatttcagggatg

SEQ ID NO: 290983 - DNA, 20 bp, Artificial Sequence
  Description of Artificial Sequence: Synthetic oligonucleotide
  Target: ATXN1; (+) strand; PAM type: YTN; PAM sequence: TTT
cagggatgtctctttgttgg

SEQ ID NO: 290984 - DNA, 20 bp, Artificial Sequence
  Description of Artificial Sequence: Synthetic oligonucleotide
  Target: ATXN1; (+) strand; PAM type: YTN; PAM sequence: TTC
agggatgtctctttgttggc

SEQ ID NO: 290985 - DNA, 20 bp, Artificial Sequence
  Description of Artificial Sequence: Synthetic oligonucleotide
  Target: ATXN1; (+) strand; PAM type: YTN; PAM sequence: CTC
tttgttggcttatgaaggac

SEQ ID NO: 290986 - DNA, 20 bp, Artificial Sequence
  Description of Artificial Sequence: Synthetic oligonucleotide
  Target: ATXN1; (+) strand; PAM type: YTN; PAM sequence: CTT
tgttggcttatgaaggaccc

SEQ ID NO: 290987 - DNA, 20 bp, Artificial Sequence
  Description of Artificial Sequence: Synthetic oligonucleotide
  Target: ATXN1; (+) strand; PAM type: YTN; PAM sequence: TTT
gttggcttatgaaggaccct

SEQ ID NO: 290988 - DNA, 20 bp, Artificial Sequence
  Description of Artificial Sequence: Synthetic oligonucleotide
  Target: ATXN1; (+) strand; PAM type: YTN; PAM sequence: TTG
ttggcttatgaaggaccctt

SEQ ID NO: 290989 - DNA, 20 bp, Artificial Sequence
  Description of Artificial Sequence: Synthetic oligonucleotide
  Target: ATXN1; (+) strand; PAM type: YTN; PAM sequence: TTG
gcttatgaaggaccctttca

SEQ ID NO: 290990 - DNA, 20 bp, Artificial Sequence
  Description of Artificial Sequence: Synthetic oligonucleotide
  Target: ATXN1; (+) strand; PAM type: YTN; PAM sequence: CTT
atgaaggaccctttcattgg

SEQ ID NO: 290991 - DNA, 20 bp, Artificial Sequence
  Description of Artificial Sequence: Synthetic oligonucleotide
  Target: ATXN1; (+) strand; PAM type: YTN; PAM sequence: TTA
tgaaggaccctttcattggt

SEQ ID NO: 290992 - DNA, 20 bp, Artificial Sequence
  Description of Artificial Sequence: Synthetic oligonucleotide
  Target: ATXN1; (+) strand; PAM type: YTN; PAM sequence: CTT
tcattggtaagccacagttt

SEQ ID NO: 290993 - DNA, 20 bp, Artificial Sequence
  Description of Artificial Sequence: Synthetic oligonucleotide
  Target: ATXN1; (+) strand; PAM type: YTN; PAM sequence: TTT
cattggtaagccacagtttt

SEQ ID NO: 290994 - DNA, 20 bp, Artificial Sequence
  Description of Artificial Sequence: Synthetic oligonucleotide
  Target: ATXN1; (+) strand; PAM type: YTN; PAM sequence: TTC
attggtaagccacagttttt

SEQ ID NO: 290995 - DNA, 20 bp, Artificial Sequence
  Description of Artificial Sequence: Synthetic oligonucleotide
  Target: ATXN1; (+) strand; PAM type: YTN; PAM sequence: TTG
gtaagccacagtttttataa

SEQ ID NO: 290996 - DNA, 20 bp, Artificial Sequence
  Description of Artificial Sequence: Synthetic oligonucleotide
  Target: ATXN1; (+) strand; PAM type: YTN; PAM sequence: TTT
ttataatcatgataagaagg

SEQ ID NO: 290997 - DNA, 20 bp, Artificial Sequence
  Description of Artificial Sequence: Synthetic oligonucleotide
  Target: ATXN1; (+) strand; PAM type: YTN; PAM sequence: TTT
tataatcatgataagaagga

SEQ ID NO: 290998 - DNA, 20 bp, Artificial Sequence
  Description of Artificial Sequence: Synthetic oligonucleotide
  Target: ATXN1; (+) strand; PAM type: YTN; PAM sequence: TTT
ataatcatgataagaaggat

SEQ ID NO: 290999 - DNA, 20 bp, Artificial Sequence
  Description of Artificial Sequence: Synthetic oligonucleotide
  Target: ATXN1; (+) strand; PAM type: YTN; PAM sequence: TTA
taatcatgataagaaggatc

SEQ ID NO: 291000 - DNA, 20 bp, Artificial Sequence
  Description of Artificial Sequence: Synthetic oligonucleotide
  Target: ATXN1; (+) strand; PAM type: YTN; PAM sequence: CTA
tgctctttgttgataataat

SEQ ID NO: 291001 - DNA, 20 bp, Artificial Sequence
  Description of Artificial Sequence: Synthetic oligonucleotide
  Target: ATXN1; (+) strand; PAM type: YTN; PAM sequence: CTC
tttgttgataataataataa

SEQ ID NO: 291002 - DNA, 20 bp, Artificial Sequence
  Description of Artificial Sequence: Synthetic oligonucleotide
  Target: ATXN1; (+) strand; PAM type: YTN; PAM sequence: CTT
tgttgataataataataact

SEQ ID NO: 291003 - DNA, 20 bp, Artificial Sequence
  Description of Artificial Sequence: Synthetic oligonucleotide
  Target: ATXN1; (+) strand; PAM type: YTN; PAM sequence: TTT
gttgataataataataacta

SEQ ID NO: 291004 - DNA, 20 bp, Artificial Sequence
  Description of Artificial Sequence: Synthetic oligonucleotide
  Target: ATXN1; (+) strand; PAM type: YTN; PAM sequence: TTG
ttgataataataataactaa

SEQ ID NO: 291005 - DNA, 20 bp, Artificial Sequence
  Description of Artificial Sequence: Synthetic oligonucleotide
  Target: ATXN1; (+) strand; PAM type: YTN; PAM sequence: TTG
ataataataataactaataa

SEQ ID NO: 291006 - DNA, 20 bp, Artificial Sequence
  Description of Artificial Sequence: Synthetic oligonucleotide
  Target: ATXN1; (+) strand; PAM type: YTN; PAM sequence: CTA
ataagacactcgtgtgtgcc

SEQ ID NO: 291007 - DNA, 20 bp, Artificial Sequence
  Description of Artificial Sequence: Synthetic oligonucleotide
  Target: ATXN1; (+) strand; PAM type: YTN; PAM sequence: CTC
gtgtgtgcctggcactgcgc

SEQ ID NO: 291008 - DNA, 20 bp, Artificial Sequence
  Description of Artificial Sequence: Synthetic oligonucleotide
  Target: ATXN1; (+) strand; PAM type: YTN; PAM sequence: CTG
gcactgcgctgactgccgta

SEQ ID NO: 291009 - DNA, 20 bp, Artificial Sequence
  Description of Artificial Sequence: Synthetic oligonucleotide
  Target: ATXN1; (+) strand; PAM type: YTN; PAM sequence: CTG
cgctgactgccgtatgtgca

SEQ ID NO: 291010 - DNA, 20 bp, Artificial Sequence
  Description of Artificial Sequence: Synthetic oligonucleotide
  Target: ATXN1; (+) strand; PAM type: YTN; PAM sequence: CTG
actgccgtatgtgcagcagt

SEQ ID NO: 291011 - DNA, 20 bp, Artificial Sequence
  Description of Artificial Sequence: Synthetic oligonucleotide
  Target: ATXN1; (+) strand; PAM type: YTN; PAM sequence: CTG
ccgtatgtgcagcagtcctg

SEQ ID NO: 291012 - DNA, 20 bp, Artificial Sequence
  Description of Artificial Sequence: Synthetic oligonucleotide
  Target: ATXN1; (+) strand; PAM type: YTN; PAM sequence: CTG
tgaggcaggattattattca

SEQ ID NO: 291013 - DNA, 20 bp, Artificial Sequence
  Description of Artificial Sequence: Synthetic oligonucleotide
  Target: ATXN1; (+) strand; PAM type: YTN; PAM sequence: TTA
ttattcatgttttaaagctg

SEQ ID NO: 291014 - DNA, 20 bp, Artificial Sequence
  Description of Artificial Sequence: Synthetic oligonucleotide
  Target: ATXN1; (+) strand; PAM type: YTN; PAM sequence: TTA
ttcatgttttaaagctgaga

SEQ ID NO: 291015 - DNA, 20 bp, Artificial Sequence
  Description of Artificial Sequence: Synthetic oligonucleotide
  Target: ATXN1; (+) strand; PAM type: YTN; PAM sequence: TTC
atgttttaaagctgagaaaa

SEQ ID NO: 291016 - DNA, 20 bp, Artificial Sequence
  Description of Artificial Sequence: Synthetic oligonucleotide
  Target: ATXN1; (+) strand; PAM type: YTN; PAM sequence: TTT
taaagctgagaaaacagagg

SEQ ID NO: 291017 - DNA, 20 bp, Artificial Sequence
  Description of Artificial Sequence: Synthetic oligonucleotide
  Target: ATXN1; (+) strand; PAM type: YTN; PAM sequence: TTT
aaagctgagaaaacagaggc

SEQ ID NO: 291018 - DNA, 20 bp, Artificial Sequence
  Description of Artificial Sequence: Synthetic oligonucleotide
  Target: ATXN1; (+) strand; PAM type: YTN; PAM sequence: TTA
aagctgagaaaacagaggct

SEQ ID NO: 291019 - DNA, 20 bp, Artificial Sequence
  Description of Artificial Sequence: Synthetic oligonucleotide
  Target: ATXN1; (+) strand; PAM type: YTN; PAM sequence: CTG
agaaaacagaggcttaggtc

SEQ ID NO: 291020 - DNA, 20 bp, Artificial Sequence
  Description of Artificial Sequence: Synthetic oligonucleotide
  Target: ATXN1; (+) strand; PAM type: YTN; PAM sequence: CTT
aggtcaactttcccagggtc

SEQ ID NO: 291021 - DNA, 20 bp, Artificial Sequence
  Description of Artificial Sequence: Synthetic oligonucleotide
  Target: ATXN1; (+) strand; PAM type: YTN; PAM sequence: TTA
ggtcaactttcccagggtct

SEQ ID NO: 291022 - DNA, 20 bp, Artificial Sequence
  Description of Artificial Sequence: Synthetic oligonucleotide
  Target: ATXN1; (+) strand; PAM type: YTN; PAM sequence: CTT
tcccagggtcttaaagacga

SEQ ID NO: 291023 - DNA, 20 bp, Artificial Sequence
  Description of Artificial Sequence: Synthetic oligonucleotide
  Target: ATXN1; (+) strand; PAM type: YTN; PAM sequence: TTT
cccagggtcttaaagacgat

SEQ ID NO: 291024 - DNA, 20 bp, Artificial Sequence
  Description of Artificial Sequence: Synthetic oligonucleotide
  Target: ATXN1; (+) strand; PAM type: YTN; PAM sequence: TTC
ccagggtcttaaagacgata

SEQ ID NO: 291025 - DNA, 20 bp, Artificial Sequence
  Description of Artificial Sequence: Synthetic oligonucleotide
  Target: ATXN1; (+) strand; PAM type: YTN; PAM sequence: CTT
aaagacgataaattatggag

SEQ ID NO: 291026 - DNA, 20 bp, Artificial Sequence
  Description of Artificial Sequence: Synthetic oligonucleotide
  Target: ATXN1; (+) strand; PAM type: YTN; PAM sequence: TTA
aagacgataaattatggagg

SEQ ID NO: 291027 - DNA, 20 bp, Artificial Sequence
  Description of Artificial Sequence: Synthetic oligonucleotide
  Target: ATXN1; (+) strand; PAM type: YTN; PAM sequence: TTA
tggaggctggatttgaactt

SEQ ID NO: 291028 - DNA, 20 bp, Artificial Sequence
  Description of Artificial Sequence: Synthetic oligonucleotide
  Target: ATXN1; (+) strand; PAM type: YTN; PAM sequence: CTG
gatttgaacttgagtctttc

SEQ ID NO: 291029 - DNA, 20 bp, Artificial Sequence
  Description of Artificial Sequence: Synthetic oligonucleotide
  Target: ATXN1; (+) strand; PAM type: YTN; PAM sequence: TTT
gaacttgagtctttctgact

SEQ ID NO: 291030 - DNA, 20 bp, Artificial Sequence
  Description of Artificial Sequence: Synthetic oligonucleotide
  Target: ATXN1; (+) strand; PAM type: YTN; PAM sequence: TTG
aacttgagtctttctgactc

SEQ ID NO: 291031 - DNA, 20 bp, Artificial Sequence
  Description of Artificial Sequence: Synthetic oligonucleotide
  Target: ATXN1; (+) strand; PAM type: YTN; PAM sequence: CTT
gagtctttctgactccatgc

SEQ ID NO: 291032 - DNA, 20 bp, Artificial Sequence
  Description of Artificial Sequence: Synthetic oligonucleotide
  Target: ATXN1; (+) strand; PAM type: YTN; PAM sequence: TTG
agtctttctgactccatgcc

SEQ ID NO: 291033 - DNA, 20 bp, Artificial Sequence
  Description of Artificial Sequence: Synthetic oligonucleotide
  Target: ATXN1; (+) strand; PAM type: YTN; PAM sequence: CTT
tctgactccatgcccactct

SEQ ID NO: 291034 - DNA, 20 bp, Artificial Sequence
  Description of Artificial Sequence: Synthetic oligonucleotide
  Target: ATXN1; (+) strand; PAM type: YTN; PAM sequence: TTT
ctgactccatgcccactctc

SEQ ID NO: 291035 - DNA, 20 bp, Artificial Sequence
  Description of Artificial Sequence: Synthetic oligonucleotide
  Target: ATXN1; (+) strand; PAM type: YTN; PAM sequence: TTC
tgactccatgcccactctcc

SEQ ID NO: 291036 - DNA, 20 bp, Artificial Sequence
  Description of Artificial Sequence: Synthetic oligonucleotide
  Target: ATXN1; (+) strand; PAM type: YTN; PAM sequence: CTG
actccatgcccactctcctt

SEQ ID NO: 291037 - DNA, 20 bp, Artificial Sequence
  Description of Artificial Sequence: Synthetic oligonucleotide
  Target: ATXN1; (+) strand; PAM type: YTN; PAM sequence: CTC
catgcccactctccttccac

SEQ ID NO: 291038 - DNA, 20 bp, Artificial Sequence
  Description of Artificial Sequence: Synthetic oligonucleotide
  Target: ATXN1; (+) strand; PAM type: YTN; PAM sequence: CTC
tccttccacttgcagcgtaa

SEQ ID NO: 291039 - DNA, 20 bp, Artificial Sequence
  Description of Artificial Sequence: Synthetic oligonucleotide
  Target: ATXN1; (+) strand; PAM type: YTN; PAM sequence: CTC
cttccacttgcagcgtaaac

SEQ ID NO: 291040 - DNA, 20 bp, Artificial Sequence
  Description of Artificial Sequence: Synthetic oligonucleotide
  Target: ATXN1; (+) strand; PAM type: YTN; PAM sequence: CTT
ccacttgcagcgtaaacaca

SEQ ID NO: 291041 - DNA, 20 bp, Artificial Sequence
  Description of Artificial Sequence: Synthetic oligonucleotide
  Target: ATXN1; (+) strand; PAM type: YTN; PAM sequence: TTC
cacttgcagcgtaaacacag

SEQ ID NO: 291042 - DNA, 20 bp, Artificial Sequence
  Description of Artificial Sequence: Synthetic oligonucleotide
  Target: ATXN1; (+) strand; PAM type: YTN; PAM sequence: CTT
gcagcgtaaacacagtggct

SEQ ID NO: 291043 - DNA, 20 bp, Artificial Sequence
  Description of Artificial Sequence: Synthetic oligonucleotide
  Target: ATXN1; (+) strand; PAM type: YTN; PAM sequence: TTG
cagcgtaaacacagtggctc

SEQ ID NO: 291044 - DNA, 20 bp, Artificial Sequence
  Description of Artificial Sequence: Synthetic oligonucleotide
  Target: ATXN1; (+) strand; PAM type: YTN; PAM sequence: CTC
aaactctgtggcttcatgaa

SEQ ID NO: 291045 - DNA, 20 bp, Artificial Sequence
  Description of Artificial Sequence: Synthetic oligonucleotide
  Target: ATXN1; (+) strand; PAM type: YTN; PAM sequence: CTC
tgtggcttcatgaatataat

SEQ ID NO: 291046 - DNA, 20 bp, Artificial Sequence
  Description of Artificial Sequence: Synthetic oligonucleotide
  Target: ATXN1; (+) strand; PAM type: YTN; PAM sequence: CTG
tggcttcatgaatataatgt

SEQ ID NO: 291047 - DNA, 20 bp, Artificial Sequence
  Description of Artificial Sequence: Synthetic oligonucleotide
  Target: ATXN1; (+) strand; PAM type: YTN; PAM sequence: CTT
catgaatataatgtttcaca

SEQ ID NO: 291048 - DNA, 20 bp, Artificial Sequence
  Description of Artificial Sequence: Synthetic oligonucleotide
  Target: ATXN1; (+) strand; PAM type: YTN; PAM sequence: TTC
atgaatataatgtttcacag

SEQ ID NO: 291049 - DNA, 20 bp, Artificial Sequence
  Description of Artificial Sequence: Synthetic oligonucleotide
  Target: ATXN1; (+) strand; PAM type: YTN; PAM sequence: TTT
cacagggtatgcagtgatct

SEQ ID NO: 291050 - DNA, 20 bp, Artificial Sequence
  Description of Artificial Sequence: Synthetic oligonucleotide
  Target: ATXN1; (+) strand; PAM type: YTN; PAM sequence: TTC
acagggtatgcagtgatctt

SEQ ID NO: 291051 - DNA, 20 bp, Artificial Sequence
  Description of Artificial Sequence: Synthetic oligonucleotide
  Target: ATXN1; (+) strand; PAM type: YTN; PAM sequence: CTT
ataagtagaaatgggtctag

SEQ ID NO: 291052 - DNA, 20 bp, Artificial Sequence
  Description of Artificial Sequence: Synthetic oligonucleotide
  Target: ATXN1; (+) strand; PAM type: YTN; PAM sequence: TTA
taagtagaaatgggtctaga

SEQ ID NO: 291053 - DNA, 20 bp, Artificial Sequence
  Description of Artificial Sequence: Synthetic oligonucleotide
  Target: ATXN1; (+) strand; PAM type: YTN; PAM sequence: CTA
gaaagatggacactcctgga

SEQ ID NO: 291054 - DNA, 20 bp, Artificial Sequence
  Description of Artificial Sequence: Synthetic oligonucleotide
  Target: ATXN1; (+) strand; PAM type: YTN; PAM sequence: CTC
ctggacactgcattgcaaat

SEQ ID NO: 291055 - DNA, 20 bp, Artificial Sequence
  Description of Artificial Sequence: Synthetic oligonucleotide
  Target: ATXN1; (+) strand; PAM type: YTN; PAM sequence: CTG
gacactgcattgcaaatctc

SEQ ID NO: 291056 - DNA, 20 bp, Artificial Sequence
  Description of Artificial Sequence: Synthetic oligonucleotide
  Target: ATXN1; (+) strand; PAM type: YTN; PAM sequence: CTG
cattgcaaatctcgctatct

SEQ ID NO: 291057 - DNA, 20 bp, Artificial Sequence
  Description of Artificial Sequence: Synthetic oligonucleotide
  Target: ATXN1; (+) strand; PAM type: YTN; PAM sequence: TTG
caaatctcgctatctgcttt

SEQ ID NO: 291058 - DNA, 20 bp, Artificial Sequence
  Description of Artificial Sequence: Synthetic oligonucleotide
  Target: ATXN1; (+) strand; PAM type: YTN; PAM sequence: CTC
gctatctgctttcactcact

SEQ ID NO: 291059 - DNA, 20 bp, Artificial Sequence
  Description of Artificial Sequence: Synthetic oligonucleotide
  Target: ATXN1; (+) strand; PAM type: YTN; PAM sequence: CTA
tctgctttcactcactgaca

SEQ ID NO: 291060 - DNA, 20 bp, Artificial Sequence
  Description of Artificial Sequence: Synthetic oligonucleotide
  Target: ATXN1; (+) strand; PAM type: YTN; PAM sequence: CTG
ctttcactcactgacaccta

SEQ ID NO: 291061 - DNA, 20 bp, Artificial Sequence
  Description of Artificial Sequence: Synthetic oligonucleotide
  Target: ATXN1; (+) strand; PAM type: YTN; PAM sequence: CTT
tcactcactgacacctatat

SEQ ID NO: 291062 - DNA, 20 bp, Artificial Sequence
  Description of Artificial Sequence: Synthetic oligonucleotide
  Target: ATXN1; (+) strand; PAM type: YTN; PAM sequence: TTT
cactcactgacacctatatt

SEQ ID NO: 291063 - DNA, 20 bp, Artificial Sequence
  Description of Artificial Sequence: Synthetic oligonucleotide
  Target: ATXN1; (+) strand; PAM type: YTN; PAM sequence: TTC
actcactgacacctatattt

SEQ ID NO: 291064 - DNA, 20 bp, Artificial Sequence
  Description of Artificial Sequence: Synthetic oligonucleotide
  Target: ATXN1; (+) strand; PAM type: YTN; PAM sequence: CTC
actgacacctatatttgccc

SEQ ID NO: 291065 - DNA, 20 bp, Artificial Sequence
  Description of Artificial Sequence: Synthetic oligonucleotide
  Target: ATXN1; (+) strand; PAM type: YTN; PAM sequence: CTG
acacctatatttgccccttg

SEQ ID NO: 291066 - DNA, 20 bp, Artificial Sequence
  Description of Artificial Sequence: Synthetic oligonucleotide
  Target: ATXN1; (+) strand; PAM type: YTN; PAM sequence: CTA
tatttgccccttgagtccct

SEQ ID NO: 291067 - DNA, 20 bp, Artificial Sequence
  Description of Artificial Sequence: Synthetic oligonucleotide
  Target: ATXN1; (+) strand; PAM type: YTN; PAM sequence: TTT
gccccttgagtcccttgaat

SEQ ID NO: 291068 - DNA, 20 bp, Artificial Sequence
  Description of Artificial Sequence: Synthetic oligonucleotide
  Target: ATXN1; (+) strand; PAM type: YTN; PAM sequence: TTG
ccccttgagtcccttgaata

SEQ ID NO: 291069 - DNA, 20 bp, Artificial Sequence
  Description of Artificial Sequence: Synthetic oligonucleotide
  Target: ATXN1; (+) strand; PAM type: YTN; PAM sequence: CTT
gagtcccttgaatattggtg

SEQ ID NO: 291070 - DNA, 20 bp, Artificial Sequence
  Description of Artificial Sequence: Synthetic oligonucleotide
  Target: ATXN1; (+) strand; PAM type: YTN; PAM sequence: TTG
agtcccttgaatattggtgc

SEQ ID NO: 291071 - DNA, 20 bp, Artificial Sequence
  Description of Artificial Sequence: Synthetic oligonucleotide
  Target: ATXN1; (+) strand; PAM type: YTN; PAM sequence: CTT
gaatattggtgccacactct

SEQ ID NO: 291072 - DNA, 20 bp, Artificial Sequence
  Description of Artificial Sequence: Synthetic oligonucleotide
  Target: ATXN1; (+) strand; PAM type: YTN; PAM sequence: TTG
aatattggtgccacactctg

SEQ ID NO: 291073 - DNA, 20 bp, Artificial Sequence
  Description of Artificial Sequence: Synthetic oligonucleotide
  Target: ATXN1; (+) strand; PAM type: YTN; PAM sequence: TTG
gtgccacactctgctcagct

SEQ ID NO: 291074 - DNA, 20 bp, Artificial Sequence
  Description of Artificial Sequence: Synthetic oligonucleotide
  Target: ATXN1; (+) strand; PAM type: YTN; PAM sequence: CTC
tgctcagctcttgatatggt

SEQ ID NO: 291075 - DNA, 20 bp, Artificial Sequence
  Description of Artificial Sequence: Synthetic oligonucleotide
  Target: ATXN1; (+) strand; PAM type: YTN; PAM sequence: CTG
ctcagctcttgatatggtgc

SEQ ID NO: 291076 - DNA, 20 bp, Artificial Sequence
  Description of Artificial Sequence: Synthetic oligonucleotide
  Target: ATXN1; (+) strand; PAM type: YTN; PAM sequence: CTC
agctcttgatatggtgcaaa

SEQ ID NO: 291077 - DNA, 20 bp, Artificial Sequence
  Description of Artificial Sequence: Synthetic oligonucleotide
  Target: ATXN1; (+) strand; PAM type: YTN; PAM sequence: CTC
ttgatatggtgcaaagcact

SEQ ID NO: 291078 - DNA, 20 bp, Artificial Sequence
  Description of Artificial Sequence: Synthetic oligonucleotide
  Target: ATXN1; (+) strand; PAM type: YTN; PAM sequence: CTT
gatatggtgcaaagcactaa

SEQ ID NO: 291079 - DNA, 20 bp, Artificial Sequence
  Description of Artificial Sequence: Synthetic oligonucleotide
  Target: ATXN1; (+) strand; PAM type: YTN; PAM sequence: TTG
atatggtgcaaagcactaaa

SEQ ID NO: 291080 - DNA, 20 bp, Artificial Sequence
  Description of Artificial Sequence: Synthetic oligonucleotide
  Target: ATXN1; (+) strand; PAM type: YTN; PAM sequence: CTA
aaatcacacaggtgtcacag

SEQ ID NO: 291081 - DNA, 20 bp, Artificial Sequence
  Description of Artificial Sequence: Synthetic oligonucleotide
  Target: ATXN1; (+) strand; PAM type: YTN; PAM sequence: TTC
tgtatcattccaaagctgac

SEQ ID NO: 291082 - DNA, 20 bp, Artificial Sequence
  Description of Artificial Sequence: Synthetic oligonucleotide
  Target: ATXN1; (+) strand; PAM type: YTN; PAM sequence: CTG
tatcattccaaagctgactt

SEQ ID NO: 291083 - DNA, 20 bp, Artificial Sequence
  Description of Artificial Sequence: Synthetic oligonucleotide
  Target: ATXN1; (+) strand; PAM type: YTN; PAM sequence: TTC
caaagctgacttgtccccca

SEQ ID NO: 291084 - DNA, 20 bp, Artificial Sequence
  Description of Artificial Sequence: Synthetic oligonucleotide
  Target: ATXN1; (+) strand; PAM type: YTN; PAM sequence: CTG
acttgtcccccatcagtccc

SEQ ID NO: 291085 - DNA, 20 bp, Artificial Sequence
  Description of Artificial Sequence: Synthetic oligonucleotide
  Target: ATXN1; (+) strand; PAM type: YTN; PAM sequence: CTT
gtcccccatcagtcccaact

SEQ ID NO: 291086 - DNA, 20 bp, Artificial Sequence
  Description of Artificial Sequence: Synthetic oligonucleotide
  Target: ATXN1; (+) strand; PAM type: YTN; PAM sequence: TTG
tcccccatcagtcccaactc

SEQ ID NO: 291087 - DNA, 20 bp, Artificial Sequence
  Description of Artificial Sequence: Synthetic oligonucleotide
  Target: ATXN1; (+) strand; PAM type: YTN; PAM sequence: CTC
tgccccagaagtctcactga

SEQ ID NO: 291088 - DNA, 20 bp, Artificial Sequence
  Description of Artificial Sequence: Synthetic oligonucleotide
  Target: ATXN1; (+) strand; PAM type: YTN; PAM sequence: CTG
ccccagaagtctcactgaaa

SEQ ID NO: 291089 - DNA, 20 bp, Artificial Sequence
  Description of Artificial Sequence: Synthetic oligonucleotide
  Target: ATXN1; (+) strand; PAM type: YTN; PAM sequence: CTC
actgaaataaagtctccagg

SEQ ID NO: 291090 - DNA, 20 bp, Artificial Sequence
  Description of Artificial Sequence: Synthetic oligonucleotide
  Target: ATXN1; (+) strand; PAM type: YTN; PAM sequence: CTG
aaataaagtctccaggatac

SEQ ID NO: 291091 - DNA, 20 bp, Artificial Sequence
  Description of Artificial Sequence: Synthetic oligonucleotide
  Target: ATXN1; (+) strand; PAM type: YTN; PAM sequence: CTC
caggatacctgtcttgccac

SEQ ID NO: 291092 - DNA, 20 bp, Artificial Sequence
  Description of Artificial Sequence: Synthetic oligonucleotide
  Target: ATXN1; (+) strand; PAM type: YTN; PAM sequence: CTG
tcttgccactcctcattcac

SEQ ID NO: 291093 - DNA, 20 bp, Artificial Sequence
  Description of Artificial Sequence: Synthetic oligonucleotide
  Target: ATXN1; (+) strand; PAM type: YTN; PAM sequence: CTT
gccactcctcattcacatcc

SEQ ID NO: 291094 - DNA, 20 bp, Artificial Sequence
  Description of Artificial Sequence: Synthetic oligonucleotide
  Target: ATXN1; (+) strand; PAM type: YTN; PAM sequence: TTG
ccactcctcattcacatcct

SEQ ID NO: 291095 - DNA, 20 bp, Artificial Sequence
  Description of Artificial Sequence: Synthetic oligonucleotide
  Target: ATXN1; (+) strand; PAM type: YTN; PAM sequence: CTC
ctcattcacatccttggttt

SEQ ID NO: 291096 - DNA, 20 bp, Artificial Sequence
  Description of Artificial Sequence: Synthetic oligonucleotide
  Target: ATXN1; (+) strand; PAM type: YTN; PAM sequence: CTC
attcacatccttggttttat

SEQ ID NO: 291097 - DNA, 20 bp, Artificial Sequence
  Description of Artificial Sequence: Synthetic oligonucleotide
  Target: ATXN1; (+) strand; PAM type: YTN; PAM sequence: TTC
acatccttggttttatgacc

SEQ ID NO: 291098 - DNA, 20 bp, Artificial Sequence
  Description of Artificial Sequence: Synthetic oligonucleotide
  Target: ATXN1; (+) strand; PAM type: YTN; PAM sequence: CTT
ggttttatgacccacacttc

SEQ ID NO: 291099 - DNA, 20 bp, Artificial Sequence
  Description of Artificial Sequence: Synthetic oligonucleotide
  Target: ATXN1; (+) strand; PAM type: YTN; PAM sequence: TTG
gttttatgacccacacttct

SEQ ID NO: 291100 - DNA, 20 bp, Artificial Sequence
  Description of Artificial Sequence: Synthetic oligonucleotide
  Target: ATXN1; (+) strand; PAM type: YTN; PAM sequence: TTT
tatgacccacacttctatag

SEQ ID NO: 291101 - DNA, 20 bp, Artificial Sequence
  Description of Artificial Sequence: Synthetic oligonucleotide
  Target: ATXN1; (+) strand; PAM type: YTN; PAM sequence: TTT
atgacccacacttctatagg

SEQ ID NO: 291102 - DNA, 20 bp, Artificial Sequence
  Description of Artificial Sequence: Synthetic oligonucleotide
  Target: ATXN1; (+) strand; PAM type: YTN; PAM sequence: TTA
tgacccacacttctatagga

SEQ ID NO: 291103 - DNA, 20 bp, Artificial Sequence
  Description of Artificial Sequence: Synthetic oligonucleotide
  Target: ATXN1; (+) strand; PAM type: YTN; PAM sequence: CTT
ctataggactctcccttctt

SEQ ID NO: 291104 - DNA, 20 bp, Artificial Sequence
  Description of Artificial Sequence: Synthetic oligonucleotide
  Target: ATXN1; (+) strand; PAM type: YTN; PAM sequence: TTC
tataggactctcccttcttt

SEQ ID NO: 291105 - DNA, 20 bp, Artificial Sequence
  Description of Artificial Sequence: Synthetic oligonucleotide
  Target: ATXN1; (+) strand; PAM type: YTN; PAM sequence: CTA
taggactctcccttctttag

SEQ ID NO: 291106 - DNA, 20 bp, Artificial Sequence
  Description of Artificial Sequence: Synthetic oligonucleotide
  Target: ATXN1; (+) strand; PAM type: YTN; PAM sequence: CTC
tcccttctttagttctaatt

SEQ ID NO: 291107 - DNA, 20 bp, Artificial Sequence
  Description of Artificial Sequence: Synthetic oligonucleotide
  Target: ATXN1; (+) strand; PAM type: YTN; PAM sequence: CTC
ccttctttagttctaattat

SEQ ID NO: 291108 - DNA, 20 bp, Artificial Sequence
  Description of Artificial Sequence: Synthetic oligonucleotide
  Target: ATXN1; (+) strand; PAM type: YTN; PAM sequence: CTT
ctttagttctaattattaaa

SEQ ID NO: 291109 - DNA, 20 bp, Artificial Sequence
  Description of Artificial Sequence: Synthetic oligonucleotide
  Target: ATXN1; (+) strand; PAM type: YTN; PAM sequence: TTC
tttagttctaattattaaaa

SEQ ID NO: 291110 - DNA, 20 bp, Artificial Sequence
  Description of Artificial Sequence: Synthetic oligonucleotide
  Target: ATXN1; (+) strand; PAM type: YTN; PAM sequence: CTT
tagttctaattattaaaagc

SEQ ID NO: 291111 - DNA, 20 bp, Artificial Sequence
  Description of Artificial Sequence: Synthetic oligonucleotide
  Target: ATXN1; (+) strand; PAM type: YTN; PAM sequence: TTT
agttctaattattaaaagca

SEQ ID NO: 291112 - DNA, 20 bp, Artificial Sequence
  Description of Artificial Sequence: Synthetic oligonucleotide
  Target: ATXN1; (+) strand; PAM type: YTN; PAM sequence: TTA
gttctaattattaaaagcag

SEQ ID NO: 291113 - DNA, 20 bp, Artificial Sequence
  Description of Artificial Sequence: Synthetic oligonucleotide
  Target: ATXN1; (+) strand; PAM type: YTN; PAM sequence: TTC
taattattaaaagcagggtt

SEQ ID NO: 291114 - DNA, 20 bp, Artificial Sequence
  Description of Artificial Sequence: Synthetic oligonucleotide
  Target: ATXN1; (+) strand; PAM type: YTN; PAM sequence: CTA
attattaaaagcagggttct

SEQ ID NO: 291115 - DNA, 20 bp, Artificial Sequence
  Description of Artificial Sequence: Synthetic oligonucleotide
  Target: ATXN1; (+) strand; PAM type: YTN; PAM sequence: TTA
ttaaaagcagggttctgaaa

SEQ ID NO: 291116 - DNA, 20 bp, Artificial Sequence
  Description of Artificial Sequence: Synthetic oligonucleotide
  Target: ATXN1; (+) strand; PAM type: YTN; PAM sequence: TTA
aaagcagggttctgaaatcc

SEQ ID NO: 291117 - DNA, 20 bp, Artificial Sequence
  Description of Artificial Sequence: Synthetic oligonucleotide
  Target: ATXN1; (+) strand; PAM type: YTN; PAM sequence: TTC
tgaaatcccaaggtgattgc

SEQ ID NO: 291118 - DNA, 20 bp, Artificial Sequence
  Description of Artificial Sequence: Synthetic oligonucleotide
  Target: ATXN1; (+) strand; PAM type: YTN; PAM sequence: CTG
aaatcccaaggtgattgcaa

SEQ ID NO: 291119 - DNA, 20 bp, Artificial Sequence
  Description of Artificial Sequence: Synthetic oligonucleotide
  Target: ATXN1; (+) strand; PAM type: YTN; PAM sequence: TTG
caaaactcccatctcagcca

SEQ ID NO: 291120 - DNA, 20 bp, Artificial Sequence
  Description of Artificial Sequence: Synthetic oligonucleotide
  Target: ATXN1; (+) strand; PAM type: YTN; PAM sequence: CTC
ccatctcagccacaaatctt

SEQ ID NO: 291121 - DNA, 20 bp, Artificial Sequence
  Description of Artificial Sequence: Synthetic oligonucleotide
  Target: ATXN1; (+) strand; PAM type: YTN; PAM sequence: CTC
agccacaaatcttcattaga

SEQ ID NO: 291122 - DNA, 20 bp, Artificial Sequence
  Description of Artificial Sequence: Synthetic oligonucleotide
  Target: ATXN1; (+) strand; PAM type: YTN; PAM sequence: CTT
cattagaatggctaatcaat

SEQ ID NO: 291123 - DNA, 20 bp, Artificial Sequence
  Description of Artificial Sequence: Synthetic oligonucleotide
  Target: ATXN1; (+) strand; PAM type: YTN; PAM sequence: TTC
attagaatggctaatcaata

SEQ ID NO: 291124 - DNA, 20 bp, Artificial Sequence
  Description of Artificial Sequence: Synthetic oligonucleotide
  Target: ATXN1; (+) strand; PAM type: YTN; PAM sequence: TTA
gaatggctaatcaataagag

SEQ ID NO: 291125 - DNA, 20 bp, Artificial Sequence
  Description of Artificial Sequence: Synthetic oligonucleotide
  Target: ATXN1; (+) strand; PAM type: YTN; PAM sequence: CTA
atcaataagagttttgtttc

SEQ ID NO: 291126 - DNA, 20 bp, Artificial Sequence
  Description of Artificial Sequence: Synthetic oligonucleotide
  Target: ATXN1; (+) strand; PAM type: YTN; PAM sequence: TTT
tgtttcagatcccaccactt

SEQ ID NO: 291127 - DNA, 20 bp, Artificial Sequence
  Description of Artificial Sequence: Synthetic oligonucleotide
  Target: ATXN1; (+) strand; PAM type: YTN; PAM sequence: TTT
gtttcagatcccaccacttt

SEQ ID NO: 291128 - DNA, 20 bp, Artificial Sequence
  Description of Artificial Sequence: Synthetic oligonucleotide
  Target: ATXN1; (+) strand; PAM type: YTN; PAM sequence: TTG
tttcagatcccaccacttta

SEQ ID NO: 291129 - DNA, 20 bp, Artificial Sequence
  Description of Artificial Sequence: Synthetic oligonucleotide
  Target: ATXN1; (+) strand; PAM type: YTN; PAM sequence: TTT
cagatcccaccactttattt

SEQ ID NO: 291130 - DNA, 20 bp, Artificial Sequence
  Description of Artificial Sequence: Synthetic oligonucleotide
  Target: ATXN1; (+) strand; PAM type: YTN; PAM sequence: TTC
agatcccaccactttatttc

SEQ ID NO: 291131 - DNA, 20 bp, Artificial Sequence
  Description of Artificial Sequence: Synthetic oligonucleotide
  Target: ATXN1; (+) strand; PAM type: YTN; PAM sequence: CTT
tatttcctctgtatgttttt

SEQ ID NO: 291132 - DNA, 20 bp, Artificial Sequence
  Description of Artificial Sequence: Synthetic oligonucleotide
  Target: ATXN1; (+) strand; PAM type: YTN; PAM sequence: TTT
atttcctctgtatgtttttt

SEQ ID NO: 291133 - DNA, 20 bp, Artificial Sequence
  Description of Artificial Sequence: Synthetic oligonucleotide
  Target: ATXN1; (+) strand; PAM type: YTN; PAM sequence: TTA
tttcctctgtatgttttttg

SEQ ID NO: 291134 - DNA, 20 bp, Artificial Sequence
  Description of Artificial Sequence: Synthetic oligonucleotide
  Target: ATXN1; (+) strand; PAM type: YTN; PAM sequence: TTT
cctctgtatgttttttgaag

SEQ ID NO: 291135 - DNA, 20 bp, Artificial Sequence
  Description of Artificial Sequence: Synthetic oligonucleotide
  Target: ATXN1; (+) strand; PAM type: YTN; PAM sequence: TTC
ctctgtatgttttttgaaga

SEQ ID NO: 291136 - DNA, 20 bp, Artificial Sequence
  Description of Artificial Sequence: Synthetic oligonucleotide
  Target: ATXN1; (+) strand; PAM type: YTN; PAM sequence: CTC
tgtatgttttttgaagaatt

SEQ ID NO: 291137 - DNA, 20 bp, Artificial Sequence
  Description of Artificial Sequence: Synthetic oligonucleotide
  Target: ATXN1; (+) strand; PAM type: YTN; PAM sequence: CTG
tatgttttttgaagaatttt

SEQ ID NO: 291138 - DNA, 20 bp, Artificial Sequence
  Description of Artificial Sequence: Synthetic oligonucleotide
  Target: ATXN1; (+) strand; PAM type: YTN; PAM sequence: TTT
tttgaagaatttttcaattt

SEQ ID NO: 291139 - DNA, 20 bp, Artificial Sequence
  Description of Artificial Sequence: Synthetic oligonucleotide
  Target: ATXN1; (+) strand; PAM type: YTN; PAM sequence: TTT
ttgaagaatttttcaatttg

SEQ ID NO: 291140 - DNA, 20 bp, Artificial Sequence
  Description of Artificial Sequence: Synthetic oligonucleotide
  Target: ATXN1; (+) strand; PAM type: YTN; PAM sequence: TTT
tgaagaatttttcaatttgc

SEQ ID NO: 291141 - DNA, 20 bp, Artificial Sequence
  Description of Artificial Sequence: Synthetic oligonucleotide
  Target: ATXN1; (+) strand; PAM type: YTN; PAM sequence: TTT
gaagaatttttcaatttgcc

SEQ ID NO: 291142 - DNA, 20 bp, Artificial Sequence
  Description of Artificial Sequence: Synthetic oligonucleotide
  Target: ATXN1; (+) strand; PAM type: YTN; PAM sequence: TTG
aagaatttttcaatttgcca

SEQ ID NO: 291143 - DNA, 20 bp, Artificial Sequence
  Description of Artificial Sequence: Synthetic oligonucleotide
  Target: ATXN1; (+) strand; PAM type: YTN; PAM sequence: TTT
ttcaatttgccatgatataa

SEQ ID NO: 291144 - DNA, 20 bp, Artificial Sequence
  Description of Artificial Sequence: Synthetic oligonucleotide
  Target: ATXN1; (+) strand; PAM type: YTN; PAM sequence: TTT
tcaatttgccatgatataac

SEQ ID NO: 291145 - DNA, 20 bp, Artificial Sequence
  Description of Artificial Sequence: Synthetic oligonucleotide
  Target: ATXN1; (+) strand; PAM type: YTN; PAM sequence: TTT
caatttgccatgatataact

SEQ ID NO: 291146 - DNA, 20 bp, Artificial Sequence
  Description of Artificial Sequence: Synthetic oligonucleotide
  Target: ATXN1; (+) strand; PAM type: YTN; PAM sequence: TTC
aatttgccatgatataacta

SEQ ID NO: 291147 - DNA, 20 bp, Artificial Sequence
  Description of Artificial Sequence: Synthetic oligonucleotide
  Target: ATXN1; (+) strand; PAM type: YTN; PAM sequence: TTT
gccatgatataactaaaact

SEQ ID NO: 291148 - DNA, 20 bp, Artificial Sequence
  Description of Artificial Sequence: Synthetic oligonucleotide
  Target: ATXN1; (+) strand; PAM type: YTN; PAM sequence: TTG
ccatgatataactaaaactc

SEQ ID NO: 291149 - DNA, 20 bp, Artificial Sequence
  Description of Artificial Sequence: Synthetic oligonucleotide
  Target: ATXN1; (+) strand; PAM type: YTN; PAM sequence: CTA
aaactcaagcatcaacagga

SEQ ID NO: 291150 - DNA, 20 bp, Artificial Sequence
  Description of Artificial Sequence: Synthetic oligonucleotide
  Target: ATXN1; (+) strand; PAM type: YTN; PAM sequence: CTC
aagcatcaacaggaaagagg

SEQ ID NO: 291151 - DNA, 20 bp, Artificial Sequence
  Description of Artificial Sequence: Synthetic oligonucleotide
  Target: ATXN1; (+) strand; PAM type: YTN; PAM sequence: CTC
agaaataagccactagtgct

SEQ ID NO: 291152 - DNA, 20 bp, Artificial Sequence
  Description of Artificial Sequence: Synthetic oligonucleotide
  Target: ATXN1; (+) strand; PAM type: YTN; PAM sequence: CTA
gtgctcgaaaatagggcatg

SEQ ID NO: 291153 - DNA, 20 bp, Artificial Sequence
  Description of Artificial Sequence: Synthetic oligonucleotide
  Target: ATXN1; (+) strand; PAM type: YTN; PAM sequence: CTC
gaaaatagggcatgtgatgt

SEQ ID NO: 291154 - DNA, 20 bp, Artificial Sequence
  Description of Artificial Sequence: Synthetic oligonucleotide
  Target: ATXN1; (+) strand; PAM type: YTN; PAM sequence: TTA
gagctggtttagaatccatg

SEQ ID NO: 291155 - DNA, 20 bp, Artificial Sequence
  Description of Artificial Sequence: Synthetic oligonucleotide
  Target: ATXN1; (+) strand; PAM type: YTN; PAM sequence: CTG
gtttagaatccatgctccac

SEQ ID NO: 291156 - DNA, 20 bp, Artificial Sequence
  Description of Artificial Sequence: Synthetic oligonucleotide
  Target: ATXN1; (+) strand; PAM type: YTN; PAM sequence: TTT
agaatccatgctccactgca

SEQ ID NO: 291157 - DNA, 20 bp, Artificial Sequence
  Description of Artificial Sequence: Synthetic oligonucleotide
  Target: ATXN1; (+) strand; PAM type: YTN; PAM sequence: TTA
gaatccatgctccactgcat

SEQ ID NO: 291158 - DNA, 20 bp, Artificial Sequence
  Description of Artificial Sequence: Synthetic oligonucleotide
  Target: ATXN1; (+) strand; PAM type: YTN; PAM sequence: CTC
cactgcatcgtagctatggt

SEQ ID NO: 291159 - DNA, 20 bp, Artificial Sequence
  Description of Artificial Sequence: Synthetic oligonucleotide
  Target: ATXN1; (+) strand; PAM type: YTN; PAM sequence: CTG
catcgtagctatggtggggc

SEQ ID NO: 291160 - DNA, 20 bp, Artificial Sequence
  Description of Artificial Sequence: Synthetic oligonucleotide
  Target: ATXN1; (+) strand; PAM type: YTN; PAM sequence: CTA
tggtggggcatggattctta

SEQ ID NO: 291161 - DNA, 20 bp, Artificial Sequence
  Description of Artificial Sequence: Synthetic oligonucleotide
  Target: ATXN1; (+) strand; PAM type: YTN; PAM sequence: TTC
ttattattaattagtctcat

SEQ ID NO: 291162 - DNA, 20 bp, Artificial Sequence
  Description of Artificial Sequence: Synthetic oligonucleotide
  Target: ATXN1; (+) strand; PAM type: YTN; PAM sequence: CTT
attattaattagtctcattc

SEQ ID NO: 291163 - DNA, 20 bp, Artificial Sequence
  Description of Artificial Sequence: Synthetic oligonucleotide
  Target: ATXN1; (+) strand; PAM type: YTN; PAM sequence: TTA
ttattaattagtctcattcc

SEQ ID NO: 291164 - DNA, 20 bp, Artificial Sequence
  Description of Artificial Sequence: Synthetic oligonucleotide
  Target: ATXN1; (+) strand; PAM type: YTN; PAM sequence: TTA
ttaattagtctcattccttc

SEQ ID NO: 291165 - DNA, 20 bp, Artificial Sequence
  Description of Artificial Sequence: Synthetic oligonucleotide
  Target: ATXN1; (+) strand; PAM type: YTN; PAM sequence: TTA
attagtctcattccttcact

SEQ ID NO: 291166 - DNA, 20 bp, Artificial Sequence
  Description of Artificial Sequence: Synthetic oligonucleotide
  Target: ATXN1; (+) strand; PAM type: YTN; PAM sequence: TTA
gtctcattccttcacttttg

SEQ ID NO: 291167 - DNA, 20 bp, Artificial Sequence
  Description of Artificial Sequence: Synthetic oligonucleotide
  Target: ATXN1; (+) strand; PAM type: YTN; PAM sequence: CTC
attccttcacttttgtctca

SEQ ID NO: 291168 - DNA, 20 bp, Artificial Sequence
  Description of Artificial Sequence: Synthetic oligonucleotide
  Target: ATXN1; (+) strand; PAM type: YTN; PAM sequence: TTC
cttcacttttgtctcacacc

SEQ ID NO: 291169 - DNA, 20 bp, Artificial Sequence
  Description of Artificial Sequence: Synthetic oligonucleotide
  Target: ATXN1; (+) strand; PAM type: YTN; PAM sequence: CTT
cacttttgtctcacaccacc

SEQ ID NO: 291170 - DNA, 20 bp, Artificial Sequence
  Description of Artificial Sequence: Synthetic oligonucleotide
  Target: ATXN1; (+) strand; PAM type: YTN; PAM sequence: TTC
acttttgtctcacaccacct

SEQ ID NO: 291171 - DNA, 20 bp, Artificial Sequence
  Description of Artificial Sequence: Synthetic oligonucleotide
  Target: ATXN1; (+) strand; PAM type: YTN; PAM sequence: CTT
ttgtctcacaccacctgtaa

SEQ ID NO: 291172 - DNA, 20 bp, Artificial Sequence
  Description of Artificial Sequence: Synthetic oligonucleotide
  Target: ATXN1; (+) strand; PAM type: YTN; PAM sequence: TTT
tgtctcacaccacctgtaaa

SEQ ID NO: 291173 - DNA, 20 bp, Artificial Sequence
  Description of Artificial Sequence: Synthetic oligonucleotide
  Target: ATXN1; (+) strand; PAM type: YTN; PAM sequence: TTT
gtctcacaccacctgtaaaa

SEQ ID NO: 291174 - DNA, 20 bp, Artificial Sequence
  Description of Artificial Sequence: Synthetic oligonucleotide
  Target: ATXN1; (+) strand; PAM type: YTN; PAM sequence: TTG
tctcacaccacctgtaaaac

SEQ ID NO: 291175 - DNA, 20 bp, Artificial Sequence
  Description of Artificial Sequence: Synthetic oligonucleotide
  Target: ATXN1; (+) strand; PAM type: YTN; PAM sequence: CTC
acaccacctgtaaaacaaaa

SEQ ID NO: 291176 - DNA, 20 bp, Artificial Sequence
  Description of Artificial Sequence: Synthetic oligonucleotide
  Target: ATXN1; (+) strand; PAM type: YTN; PAM sequence: CTG
taaaacaaaagcaataatgc

SEQ ID NO: 291177 - DNA, 20 bp, Artificial Sequence
  Description of Artificial Sequence: Synthetic oligonucleotide
  Target: ATXN1; (+) strand; PAM type: YTN; PAM sequence: CTT
acttcatggggtagtgagga

SEQ ID NO: 291178 - DNA, 20 bp, Artificial Sequence
  Description of Artificial Sequence: Synthetic oligonucleotide
  Target: ATXN1; (+) strand; PAM type: YTN; PAM sequence: TTA
cttcatggggtagtgaggag

SEQ ID NO: 291179 - DNA, 20 bp, Artificial Sequence
  Description of Artificial Sequence: Synthetic oligonucleotide
  Target: ATXN1; (+) strand; PAM type: YTN; PAM sequence: CTT
catggggtagtgaggaggtt

SEQ ID NO: 291180 - DNA, 20 bp, Artificial Sequence
  Description of Artificial Sequence: Synthetic oligonucleotide
  Target: ATXN1; (+) strand; PAM type: YTN; PAM sequence: TTC
atggggtagtgaggaggttt

SEQ ID NO: 291181 - DNA, 20 bp, Artificial Sequence
  Description of Artificial Sequence: Synthetic oligonucleotide
  Target: ATXN1; (+) strand; PAM type: YTN; PAM sequence: TTT
aaatgagaggctacagctaa

SEQ ID NO: 291182 - DNA, 20 bp, Artificial Sequence
  Description of Artificial Sequence: Synthetic oligonucleotide
  Target: ATXN1; (+) strand; PAM type: YTN; PAM sequence: TTA
aatgagaggctacagctaat

SEQ ID NO: 291183 - DNA, 20 bp, Artificial Sequence
  Description of Artificial Sequence: Synthetic oligonucleotide
  Target: ATXN1; (+) strand; PAM type: YTN; PAM sequence: CTA
cagctaatgctcttaatgag

SEQ ID NO: 291184 - DNA, 20 bp, Artificial Sequence
  Description of Artificial Sequence: Synthetic oligonucleotide
  Target: ATXN1; (+) strand; PAM type: YTN; PAM sequence: CTA
atgctcttaatgagatgcct

SEQ ID NO: 291185 - DNA, 20 bp, Artificial Sequence
  Description of Artificial Sequence: Synthetic oligonucleotide
  Target: ATXN1; (+) strand; PAM type: YTN; PAM sequence: CTC
ttaatgagatgccttccttt

SEQ ID NO: 291186 - DNA, 20 bp, Artificial Sequence
  Description of Artificial Sequence: Synthetic oligonucleotide
  Target: ATXN1; (+) strand; PAM type: YTN; PAM sequence: CTT
aatgagatgccttccttttc

SEQ ID NO: 291187 - DNA, 20 bp, Artificial Sequence
  Description of Artificial Sequence: Synthetic oligonucleotide
  Target: ATXN1; (+) strand; PAM type: YTN; PAM sequence: TTA
atgagatgccttccttttcc

SEQ ID NO: 291188 - DNA, 20 bp, Artificial Sequence
  Description of Artificial Sequence: Synthetic oligonucleotide
  Target: ATXN1; (+) strand; PAM type: YTN; PAM sequence: CTT
ccttttcctctctggccagt

SEQ ID NO: 291189 - DNA, 20 bp, Artificial Sequence
  Description of Artificial Sequence: Synthetic oligonucleotide
  Target: ATXN1; (+) strand; PAM type: YTN; PAM sequence: TTC
cttttcctctctggccagtg

SEQ ID NO: 291190 - DNA, 20 bp, Artificial Sequence
  Description of Artificial Sequence: Synthetic oligonucleotide
  Target: ATXN1; (+) strand; PAM type: YTN; PAM sequence: CTT
ttcctctctggccagtgagg

SEQ ID NO: 291191 - DNA, 20 bp, Artificial Sequence
  Description of Artificial Sequence: Synthetic oligonucleotide
  Target: ATXN1; (+) strand; PAM type: YTN; PAM sequence: TTT
tcctctctggccagtgaggg

SEQ ID NO: 291192 - DNA, 20 bp, Artificial Sequence
  Description of Artificial Sequence: Synthetic oligonucleotide
  Target: ATXN1; (+) strand; PAM type: YTN; PAM sequence: TTT
cctctctggccagtgagggg

SEQ ID NO: 291193 - DNA, 20 bp, Artificial Sequence
  Description of Artificial Sequence: Synthetic oligonucleotide
  Target: ATXN1; (+) strand; PAM type: YTN; PAM sequence: TTC
ctctctggccagtgaggggt

SEQ ID NO: 291194 - DNA, 20 bp, Artificial Sequence
  Description of Artificial Sequence: Synthetic oligonucleotide
  Target: ATXN1; (+) strand; PAM type: YTN; PAM sequence: CTC
tctggccagtgaggggtgga

SEQ ID NO: 291195 - DNA, 20 bp, Artificial Sequence
  Description of Artificial Sequence: Synthetic oligonucleotide
  Target: ATXN1; (+) strand; PAM type: YTN; PAM sequence: CTC
tggccagtgaggggtggatc

SEQ ID NO: 291196 - DNA, 20 bp, Artificial Sequence
  Description of Artificial Sequence: Synthetic oligonucleotide
  Target: ATXN1; (+) strand; PAM type: YTN; PAM sequence: CTG
gccagtgaggggtggatcat

SEQ ID NO: 291197 - DNA, 20 bp, Artificial Sequence
  Description of Artificial Sequence: Synthetic oligonucleotide
  Target: ATXN1; (+) strand; PAM type: YTN; PAM sequence: CTC
ctttccctattcactcttct

SEQ ID NO: 291198 - DNA, 20 bp, Artificial Sequence
  Description of Artificial Sequence: Synthetic oligonucleotide
  Target: ATXN1; (+) strand; PAM type: YTN; PAM sequence: CTT
tccctattcactcttcttcc

SEQ ID NO: 291199 - DNA, 20 bp, Artificial Sequence
  Description of Artificial Sequence: Synthetic oligonucleotide
  Target: ATXN1; (+) strand; PAM type: YTN; PAM sequence: TTT
ccctattcactcttcttccc

SEQ ID NO: 291200 - DNA, 20 bp, Artificial Sequence
  Description of Artificial Sequence: Synthetic oligonucleotide
  Target: ATXN1; (+) strand; PAM type: YTN; PAM sequence: TTC
cctattcactcttcttcccc

SEQ ID NO: 291201 - DNA, 20 bp, Artificial Sequence
  Description of Artificial Sequence: Synthetic oligonucleotide
  Target: ATXN1; (+) strand; PAM type: YTN; PAM sequence: CTA
ttcactcttcttccccaact

SEQ ID NO: 291202 - DNA, 20 bp, Artificial Sequence
  Description of Artificial Sequence: Synthetic oligonucleotide
  Target: ATXN1; (+) strand; PAM type: YTN; PAM sequence: TTC
actcttcttccccaactaat

SEQ ID NO: 291203 - DNA, 20 bp, Artificial Sequence
  Description of Artificial Sequence: Synthetic oligonucleotide
  Target: ATXN1; (+) strand; PAM type: YTN; PAM sequence: CTC
ttcttccccaactaatcccc

SEQ ID NO: 291204 - DNA, 20 bp, Artificial Sequence
  Description of Artificial Sequence: Synthetic oligonucleotide
  Target: ATXN1; (+) strand; PAM type: YTN; PAM sequence: CTT
cttccccaactaatcccctc

SEQ ID NO: 291205 - DNA, 20 bp, Artificial Sequence
  Description of Artificial Sequence: Synthetic oligonucleotide
  Target: ATXN1; (+) strand; PAM type: YTN; PAM sequence: TTC
ttccccaactaatcccctca

SEQ ID NO: 291206 - DNA, 20 bp, Artificial Sequence
  Description of Artificial Sequence: Synthetic oligonucleotide
  Target: ATXN1; (+) strand; PAM type: YTN; PAM sequence: CTT
ccccaactaatcccctcagc

SEQ ID NO: 291207 - DNA, 20 bp, Artificial Sequence
  Description of Artificial Sequence: Synthetic oligonucleotide
  Target: ATXN1; (+) strand; PAM type: YTN; PAM sequence: TTC
cccaactaatcccctcagcc

SEQ ID NO: 291208 - DNA, 20 bp, Artificial Sequence
  Description of Artificial Sequence: Synthetic oligonucleotide
  Target: ATXN1; (+) strand; PAM type: YTN; PAM sequence: CTA
atcccctcagccactggcac

SEQ ID NO: 291209 - DNA, 20 bp, Artificial Sequence
  Description of Artificial Sequence: Synthetic oligonucleotide
  Target: ATXN1; (+) strand; PAM type: YTN; PAM sequence: CTC
agccactggcaccatgttcc

SEQ ID NO: 291210 - DNA, 20 bp, Artificial Sequence
  Description of Artificial Sequence: Synthetic oligonucleotide
  Target: ATXN1; (+) strand; PAM type: YTN; PAM sequence: CTG
gcaccatgttccgcatgtta

SEQ ID NO: 291211 - DNA, 20 bp, Artificial Sequence
  Description of Artificial Sequence: Synthetic oligonucleotide
  Target: ATXN1; (+) strand; PAM type: YTN; PAM sequence: TTC
cgcatgttagaggcatcctt

SEQ ID NO: 291212 - DNA, 20 bp, Artificial Sequence
  Description of Artificial Sequence: Synthetic oligonucleotide
  Target: ATXN1; (+) strand; PAM type: YTN; PAM sequence: TTA
gaggcatccttcctggggca

SEQ ID NO: 291213 - DNA, 20 bp, Artificial Sequence
  Description of Artificial Sequence: Synthetic oligonucleotide
  Target: ATXN1; (+) strand; PAM type: YTN; PAM sequence: CTT
cctggggcagtgagacacat

SEQ ID NO: 291214 - DNA, 20 bp, Artificial Sequence
  Description of Artificial Sequence: Synthetic oligonucleotide
  Target: ATXN1; (+) strand; PAM type: YTN; PAM sequence: TTC
ctggggcagtgagacacatc

SEQ ID NO: 291215 - DNA, 20 bp, Artificial Sequence
  Description of Artificial Sequence: Synthetic oligonucleotide
  Target: ATXN1; (+) strand; PAM type: YTN; PAM sequence: CTG
gggcagtgagacacatcctg

SEQ ID NO: 291216 - DNA, 20 bp, Artificial Sequence
  Description of Artificial Sequence: Synthetic oligonucleotide
  Target: ATXN1; (+) strand; PAM type: YTN; PAM sequence: CTG
aatcagccttgtcaccctaa

SEQ ID NO: 291217 - DNA, 20 bp, Artificial Sequence
  Description of Artificial Sequence: Synthetic oligonucleotide
  Target: ATXN1; (+) strand; PAM type: YTN; PAM sequence: CTT
gtcaccctaaaggggacctt

SEQ ID NO: 291218 - DNA, 20 bp, Artificial Sequence
  Description of Artificial Sequence: Synthetic oligonucleotide
  Target: ATXN1; (+) strand; PAM type: YTN; PAM sequence: TTG
tcaccctaaaggggaccttg

SEQ ID NO: 291219 - DNA, 20 bp, Artificial Sequence
  Description of Artificial Sequence: Synthetic oligonucleotide
  Target: ATXN1; (+) strand; PAM type: YTN; PAM sequence: CTA
aaggggaccttgcaacgttt

SEQ ID NO: 291220 - DNA, 20 bp, Artificial Sequence
  Description of Artificial Sequence: Synthetic oligonucleotide
  Target: ATXN1; (+) strand; PAM type: YTN; PAM sequence: CTT
gcaacgtttgctcgtgggtc

SEQ ID NO: 291221 - DNA, 20 bp, Artificial Sequence
  Description of Artificial Sequence: Synthetic oligonucleotide
  Target: ATXN1; (+) strand; PAM type: YTN; PAM sequence: TTG
caacgtttgctcgtgggtcg

SEQ ID NO: 291222 - DNA, 20 bp, Artificial Sequence
  Description of Artificial Sequence: Synthetic oligonucleotide
  Target: ATXN1; (+) strand; PAM type: YTN; PAM sequence: TTT
gctcgtgggtcgacaacacc

SEQ ID NO: 291223 - DNA, 20 bp, Artificial Sequence
  Description of Artificial Sequence: Synthetic oligonucleotide
  Target: ATXN1; (+) strand; PAM type: YTN; PAM sequence: TTG
ctcgtgggtcgacaacacca

SEQ ID NO: 291224 - DNA, 20 bp, Artificial Sequence
  Description of Artificial Sequence: Synthetic oligonucleotide
  Target: ATXN1; (+) strand; PAM type: YTN; PAM sequence: CTC
gtgggtcgacaacaccacac

SEQ ID NO: 291225 - DNA, 20 bp, Artificial Sequence
  Description of Artificial Sequence: Synthetic oligonucleotide
  Target: ATXN1; (+) strand; PAM type: YTN; PAM sequence: CTG
acatgaggatgacatgtgac

SEQ ID NO: 291226 - DNA, 20 bp, Artificial Sequence
  Description of Artificial Sequence: Synthetic oligonucleotide
  Target: ATXN1; (+) strand; PAM type: YTN; PAM sequence: CTT
agagcctgctaaatgaacac

SEQ ID NO: 291227 - DNA, 20 bp, Artificial Sequence
  Description of Artificial Sequence: Synthetic oligonucleotide
  Target: ATXN1; (+) strand; PAM type: YTN; PAM sequence: TTA
gagcctgctaaatgaacaca

SEQ ID NO: 291228 - DNA, 20 bp, Artificial Sequence
  Description of Artificial Sequence: Synthetic oligonucleotide
  Target: ATXN1; (+) strand; PAM type: YTN; PAM sequence: CTG
ctaaatgaacacatgagcta

SEQ ID NO: 291229 - DNA, 20 bp, Artificial Sequence
  Description of Artificial Sequence: Synthetic oligonucleotide
  Target: ATXN1; (+) strand; PAM type: YTN; PAM sequence: CTA
aatgaacacatgagctaaat

SEQ ID NO: 291230 - DNA, 20 bp, Artificial Sequence
  Description of Artificial Sequence: Synthetic oligonucleotide
  Target: ATXN1; (+) strand; PAM type: YTN; PAM sequence: CTA
aatgctaggtaccactgtgc

SEQ ID NO: 291231 - DNA, 20 bp, Artificial Sequence
  Description of Artificial Sequence: Synthetic oligonucleotide
  Target: ATXN1; (+) strand; PAM type: YTN; PAM sequence: CTA
ggtaccactgtgctttccat

SEQ ID NO: 291232 - DNA, 20 bp, Artificial Sequence
  Description of Artificial Sequence: Synthetic oligonucleotide
  Target: ATXN1; (+) strand; PAM type: YTN; PAM sequence: CTG
tgctttccatgagattgtta

SEQ ID NO: 291233 - DNA, 20 bp, Artificial Sequence
  Description of Artificial Sequence: Synthetic oligonucleotide
  Target: ATXN1; (+) strand; PAM type: YTN; PAM sequence: CTT
tccatgagattgttaggcag

SEQ ID NO: 291234 - DNA, 20 bp, Artificial Sequence
  Description of Artificial Sequence: Synthetic oligonucleotide
  Target: ATXN1; (+) strand; PAM type: YTN; PAM sequence: TTT
ccatgagattgttaggcaga

SEQ ID NO: 291235 - DNA, 20 bp, Artificial Sequence
  Description of Artificial Sequence: Synthetic oligonucleotide
  Target: ATXN1; (+) strand; PAM type: YTN; PAM sequence: TTC
catgagattgttaggcagaa

SEQ ID NO: 291236 - DNA, 20 bp, Artificial Sequence
  Description of Artificial Sequence: Synthetic oligonucleotide
  Target: ATXN1; (+) strand; PAM type: YTN; PAM sequence: TTG
ttaggcagaaggaaaacact

SEQ ID NO: 291237 - DNA, 20 bp, Artificial Sequence
  Description of Artificial Sequence: Synthetic oligonucleotide
  Target: ATXN1; (+) strand; PAM type: YTN; PAM sequence: TTA
ggcagaaggaaaacactgaa

SEQ ID NO: 291238 - DNA, 20 bp, Artificial Sequence
  Description of Artificial Sequence: Synthetic oligonucleotide
  Target: ATXN1; (+) strand; PAM type: YTN; PAM sequence: CTG
aatctttgctctccaaagtt

SEQ ID NO: 291239 - DNA, 20 bp, Artificial Sequence
  Description of Artificial Sequence: Synthetic oligonucleotide
  Target: ATXN1; (+) strand; PAM type: YTN; PAM sequence: CTT
tgctctccaaagttttgatt

SEQ ID NO: 291240 - DNA, 20 bp, Artificial Sequence
  Description of Artificial Sequence: Synthetic oligonucleotide
  Target: ATXN1; (+) strand; PAM type: YTN; PAM sequence: TTT
gctctccaaagttttgattt

SEQ ID NO: 291241 - DNA, 20 bp, Artificial Sequence
  Description of Artificial Sequence: Synthetic oligonucleotide
  Target: ATXN1; (+) strand; PAM type: YTN; PAM sequence: TTG
ctctccaaagttttgatttg

SEQ ID NO: 291242 - DNA, 20 bp, Artificial Sequence
  Description of Artificial Sequence: Synthetic oligonucleotide
  Target: ATXN1; (+) strand; PAM type: YTN; PAM sequence: CTC
tccaaagttttgatttgaat

SEQ ID NO: 291243 - DNA, 20 bp, Artificial Sequence
  Description of Artificial Sequence: Synthetic oligonucleotide
  Target: ATXN1; (+) strand; PAM type: YTN; PAM sequence: CTC
caaagttttgatttgaattc

SEQ ID NO: 291244 - DNA, 20 bp, Artificial Sequence
  Description of Artificial Sequence: Synthetic oligonucleotide
  Target: ATXN1; (+) strand; PAM type: YTN; PAM sequence: TTT
tgatttgaattcacacaggc

SEQ ID NO: 291245 - DNA, 20 bp, Artificial Sequence
  Description of Artificial Sequence: Synthetic oligonucleotide
  Target: ATXN1; (+) strand; PAM type: YTN; PAM sequence: TTT
gatttgaattcacacaggca

SEQ ID NO: 291246 - DNA, 20 bp, Artificial Sequence
  Description of Artificial Sequence: Synthetic oligonucleotide
  Target: ATXN1; (+) strand; PAM type: YTN; PAM sequence: TTG
atttgaattcacacaggcaa

SEQ ID NO: 291247 - DNA, 20 bp, Artificial Sequence
  Description of Artificial Sequence: Synthetic oligonucleotide
  Target: ATXN1; (+) strand; PAM type: YTN; PAM sequence: TTT
gaattcacacaggcaagatt

SEQ ID NO: 291248 - DNA, 20 bp, Artificial Sequence
  Description of Artificial Sequence: Synthetic oligonucleotide
  Target: ATXN1; (+) strand; PAM type: YTN; PAM sequence: TTG
aattcacacaggcaagattc

SEQ ID NO: 291249 - DNA, 20 bp, Artificial Sequence
  Description of Artificial Sequence: Synthetic oligonucleotide
  Target: ATXN1; (+) strand; PAM type: YTN; PAM sequence: TTC
acacaggcaagattcttgtc

SEQ ID NO: 291250 - DNA, 20 bp, Artificial Sequence
  Description of Artificial Sequence: Synthetic oligonucleotide
  Target: ATXN1; (+) strand; PAM type: YTN; PAM sequence: TTC
ttgtcaatgacccagaatca

SEQ ID NO: 291251 - DNA, 20 bp, Artificial Sequence
  Description of Artificial Sequence: Synthetic oligonucleotide
  Target: ATXN1; (+) strand; PAM type: YTN; PAM sequence: CTT
gtcaatgacccagaatcact

SEQ ID NO: 291252 - DNA, 20 bp, Artificial Sequence
  Description of Artificial Sequence: Synthetic oligonucleotide
  Target: ATXN1; (+) strand; PAM type: YTN; PAM sequence: TTG
tcaatgacccagaatcactt

SEQ ID NO: 291253 - DNA, 20 bp, Artificial Sequence
  Description of Artificial Sequence: Synthetic oligonucleotide
  Target: ATXN1; (+) strand; PAM type: YTN; PAM sequence: CTT
aagccccgagggggccatgc

SEQ ID NO: 291254 - DNA, 20 bp, Artificial Sequence
  Description of Artificial Sequence: Synthetic oligonucleotide
  Target: ATXN1; (+) strand; PAM type: YTN; PAM sequence: TTA
agccccgagggggccatgcc

SEQ ID NO: 291255 - DNA, 20 bp, Artificial Sequence
  Description of Artificial Sequence: Synthetic oligonucleotide
  Target: ATXN1; (+) strand; PAM type: YTN; PAM sequence: CTG
ggatgcggggttgggggctg

SEQ ID NO: 291256 - DNA, 20 bp, Artificial Sequence
  Description of Artificial Sequence: Synthetic oligonucleotide
  Target: ATXN1; (+) strand; PAM type: YTN; PAM sequence: TTG
ggggctgtaagggtctcgct

SEQ ID NO: 291257 - DNA, 20 bp, Artificial Sequence
  Description of Artificial Sequence: Synthetic oligonucleotide
  Target: ATXN1; (+) strand; PAM type: YTN; PAM sequence: CTG
taagggtctcgctgtcaaga

SEQ ID NO: 291258 - DNA, 20 bp, Artificial Sequence
  Description of Artificial Sequence: Synthetic oligonucleotide
  Target: ATXN1; (+) strand; PAM type: YTN; PAM sequence: CTC
gctgtcaagatgtggcccca

SEQ ID NO: 291259 - DNA, 20 bp, Artificial Sequence
  Description of Artificial Sequence: Synthetic oligonucleotide
  Target: ATXN1; (+) strand; PAM type: YTN; PAM sequence: CTG
tcaagatgtggccccaccag

SEQ ID NO: 291260 - DNA, 20 bp, Artificial Sequence
  Description of Artificial Sequence: Synthetic oligonucleotide
  Target: ATXN1; (+) strand; PAM type: YTN; PAM sequence: CTA
agtttatagtgctccaaaag

SEQ ID NO: 291261 - DNA, 20 bp, Artificial Sequence
  Description of Artificial Sequence: Synthetic oligonucleotide
  Target: ATXN1; (+) strand; PAM type: YTN; PAM sequence: TTT
atagtgctccaaaagccagg

SEQ ID NO: 291262 - DNA, 20 bp, Artificial Sequence
  Description of Artificial Sequence: Synthetic oligonucleotide
  Target: ATXN1; (+) strand; PAM type: YTN; PAM sequence: TTA
tagtgctccaaaagccagga

SEQ ID NO: 291263 - DNA, 20 bp, Artificial Sequence
  Description of Artificial Sequence: Synthetic oligonucleotide
  Target: ATXN1; (+) strand; PAM type: YTN; PAM sequence: CTC
caaaagccaggaggggggtt

SEQ ID NO: 291264 - DNA, 20 bp, Artificial Sequence
  Description of Artificial Sequence: Synthetic oligonucleotide
  Target: ATXN1; (+) strand; PAM type: YTN; PAM sequence: TTA
agaaaaaaaaaatgcaaaaa

SEQ ID NO: 291265 - DNA, 20 bp, Artificial Sequence
  Description of Artificial Sequence: Synthetic oligonucleotide
  Target: ATXN1; (+) strand; PAM type: YTN; PAM sequence: TTA
ccatgccacaaacatgaacc

SEQ ID NO: 291266 - DNA, 20 bp, Artificial Sequence
  Description of Artificial Sequence: Synthetic oligonucleotide
  Target: ATXN1; (+) strand; PAM type: YTN; PAM sequence: CTC
tacagaacctagaaaatgtg

SEQ ID NO: 291267 - DNA, 20 bp, Artificial Sequence
  Description of Artificial Sequence: Synthetic oligonucleotide
  Target: ATXN1; (+) strand; PAM type: YTN; PAM sequence: CTA
cagaacctagaaaatgtgaa

SEQ ID NO: 291268 - DNA, 20 bp, Artificial Sequence
  Description of Artificial Sequence: Synthetic oligonucleotide
  Target: ATXN1; (+) strand; PAM type: YTN; PAM sequence: CTA
gaaaatgtgaaattgggcca

SEQ ID NO: 291269 - DNA, 20 bp, Artificial Sequence
  Description of Artificial Sequence: Synthetic oligonucleotide
  Target: ATXN1; (+) strand; PAM type: YTN; PAM sequence: TTG
ggccaggctcacatctgtag

SEQ ID NO: 291270 - DNA, 20 bp, Artificial Sequence
  Description of Artificial Sequence: Synthetic oligonucleotide
  Target: ATXN1; (+) strand; PAM type: YTN; PAM sequence: CTC
acatctgtagtcccagcact

SEQ ID NO: 291271 - DNA, 20 bp, Artificial Sequence
  Description of Artificial Sequence: Synthetic oligonucleotide
  Target: ATXN1; (+) strand; PAM type: YTN; PAM sequence: CTG
tagtcccagcactttaggag

SEQ ID NO: 291272 - DNA, 20 bp, Artificial Sequence
  Description of Artificial Sequence: Synthetic oligonucleotide
  Target: ATXN1; (+) strand; PAM type: YTN; PAM sequence: CTT
taggaggcagaggtgaatgg

SEQ ID NO: 291273 - DNA, 20 bp, Artificial Sequence
  Description of Artificial Sequence: Synthetic oligonucleotide
  Target: ATXN1; (+) strand; PAM type: YTN; PAM sequence: TTT
aggaggcagaggtgaatgga

SEQ ID NO: 291274 - DNA, 20 bp, Artificial Sequence
  Description of Artificial Sequence: Synthetic oligonucleotide
  Target: ATXN1; (+) strand; PAM type: YTN; PAM sequence: TTA
ggaggcagaggtgaatggat

SEQ ID NO: 291275 - DNA, 20 bp, Artificial Sequence
  Description of Artificial Sequence: Synthetic oligonucleotide
  Target: ATXN1; (+) strand; PAM type: YTN; PAM sequence: CTG
aggtctggagttcgagacct

SEQ ID NO: 291276 - DNA, 20 bp, Artificial Sequence
  Description of Artificial Sequence: Synthetic oligonucleotide
  Target: ATXN1; (+) strand; PAM type: YTN; PAM sequence: CTG
gagttcgagacctcgtcgct

SEQ ID NO: 291277 - DNA, 20 bp, Artificial Sequence
  Description of Artificial Sequence: Synthetic oligonucleotide
  Target: ATXN1; (+) strand; PAM type: YTN; PAM sequence: TTC
gagacctcgtcgctactaat

SEQ ID NO: 291278 - DNA, 20 bp, Artificial Sequence
  Description of Artificial Sequence: Synthetic oligonucleotide
  Target: ATXN1; (+) strand; PAM type: YTN; PAM sequence: CTC
gtcgctactaataacacaaa

SEQ ID NO: 291279 - DNA, 20 bp, Artificial Sequence
  Description of Artificial Sequence: Synthetic oligonucleotide
  Target: ATXN1; (+) strand; PAM type: YTN; PAM sequence: CTA
ctaataacacaaaaaaatta

SEQ ID NO: 291280 - DNA, 20 bp, Artificial Sequence
  Description of Artificial Sequence: Synthetic oligonucleotide
  Target: ATXN1; (+) strand; PAM type: YTN; PAM sequence: CTA
ataacacaaaaaaattagcc

SEQ ID NO: 291281 - DNA, 20 bp, Artificial Sequence
  Description of Artificial Sequence: Synthetic oligonucleotide
  Target: ATXN1; (+) strand; PAM type: YTN; PAM sequence: TTA
gccgggtgtggtggcatgcg

SEQ ID NO: 291282 - DNA, 20 bp, Artificial Sequence
  Description of Artificial Sequence: Synthetic oligonucleotide
  Target: ATXN1; (+) strand; PAM type: YTN; PAM sequence: CTG
taatcccagctacttgggag

SEQ ID NO: 291283 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgagacagga

SEQ ID NO: 291284 - DNA, 20 bp, Artificial Sequence
  Description of Artificial Sequence: Synthetic oligonucleotide
  Target: ATXN1; (+) strand; PAM type: YTN; PAM sequence: CTT
gggaggctgagacaggagaa

SEQ ID NO: 291285 - DNA, 20 bp, Artificial Sequence
  Description of Artificial Sequence: Synthetic oligonucleotide
  Target: ATXN1; (+) strand; PAM type: YTN; PAM sequence: TTG
ggaggctgagacaggagaat

SEQ ID NO: 291286 - DNA, 20 bp, Artificial Sequence
  Description of Artificial Sequence: Synthetic oligonucleotide
  Target: ATXN1; (+) strand; PAM type: YTN; PAM sequence: CTG
agacaggagaatcgcttgaa

SEQ ID NO: 291287 - DNA, 20 bp, Artificial Sequence
  Description of Artificial Sequence: Synthetic oligonucleotide
  Target: ATXN1; (+) strand; PAM type: YTN; PAM sequence: CTT
gaacctgggaggtggaggtt

SEQ ID NO: 291288 - DNA, 20 bp, Artificial Sequence
  Description of Artificial Sequence: Synthetic oligonucleotide
  Target: ATXN1; (+) strand; PAM type: YTN; PAM sequence: TTG
aacctgggaggtggaggttg

SEQ ID NO: 291289 - DNA, 20 bp, Artificial Sequence
  Description of Artificial Sequence: Synthetic oligonucleotide
  Target: ATXN1; (+) strand; PAM type: YTN; PAM sequence: CTG
ggaggtggaggttgcagtga

SEQ ID NO: 291290 - DNA, 20 bp, Artificial Sequence
  Description of Artificial Sequence: Synthetic oligonucleotide
  Target: ATXN1; (+) strand; PAM type: YTN; PAM sequence: TTG
cagtgagccaagatcacgtc

SEQ ID NO: 291291 - DNA, 20 bp, Artificial Sequence
  Description of Artificial Sequence: Synthetic oligonucleotide
  Target: ATXN1; (+) strand; PAM type: YTN; PAM sequence: TTG
ctctctagcctgggcaacaa

SEQ ID NO: 291292 - DNA, 20 bp, Artificial Sequence
  Description of Artificial Sequence: Synthetic oligonucleotide
  Target: ATXN1; (+) strand; PAM type: YTN; PAM sequence: CTC
tctagcctgggcaacaagag

SEQ ID NO: 291293 - DNA, 20 bp, Artificial Sequence
  Description of Artificial Sequence: Synthetic oligonucleotide
  Target: ATXN1; (+) strand; PAM type: YTN; PAM sequence: CTC
tagcctgggcaacaagagca

SEQ ID NO: 291294 - DNA, 20 bp, Artificial Sequence
  Description of Artificial Sequence: Synthetic oligonucleotide
  Target: ATXN1; (+) strand; PAM type: YTN; PAM sequence: CTA
gcctgggcaacaagagcaaa

SEQ ID NO: 291295 - DNA, 20 bp, Artificial Sequence
  Description of Artificial Sequence: Synthetic oligonucleotide
  Target: ATXN1; (+) strand; PAM type: YTN; PAM sequence: CTG
ggcaacaagagcaaaactcc

SEQ ID NO: 291296 - DNA, 20 bp, Artificial Sequence
  Description of Artificial Sequence: Synthetic oligonucleotide
  Target: ATXN1; (+) strand; PAM type: YTN; PAM sequence: CTC
cgcctcaaaaaaaaaaaaaa

SEQ ID NO: 291297 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaagaaaag

SEQ ID NO: 291298 - DNA, 20 bp, Artificial Sequence
  Description of Artificial Sequence: Synthetic oligonucleotide
  Target: ATXN1; (+) strand; PAM type: YTN; PAM sequence: TTG
ttaagacaatttggagttta

SEQ ID NO: 291299 - DNA, 20 bp, Artificial Sequence
  Description of Artificial Sequence: Synthetic oligonucleotide
  Target: ATXN1; (+) strand; PAM type: YTN; PAM sequence: TTA
agacaatttggagtttaagg

SEQ ID NO: 291300 - DNA, 20 bp, Artificial Sequence
  Description of Artificial Sequence: Synthetic oligonucleotide
  Target: ATXN1; (+) strand; PAM type: YTN; PAM sequence: TTT
ggagtttaagggaaaagcac

SEQ ID NO: 291301 - DNA, 20 bp, Artificial Sequence
  Description of Artificial Sequence: Synthetic oligonucleotide
  Target: ATXN1; (+) strand; PAM type: YTN; PAM sequence: TTG
gagtttaagggaaaagcaca

SEQ ID NO: 291302 - DNA, 20 bp, Artificial Sequence
  Description of Artificial Sequence: Synthetic oligonucleotide
  Target: ATXN1; (+) strand; PAM type: YTN; PAM sequence: TTT
aagggaaaagcacatttttg

SEQ ID NO: 291303 - DNA, 20 bp, Artificial Sequence
  Description of Artificial Sequence: Synthetic oligonucleotide
  Target: ATXN1; (+) strand; PAM type: YTN; PAM sequence: TTA
agggaaaagcacatttttga

SEQ ID NO: 291304 - DNA, 20 bp, Artificial Sequence
  Description of Artificial Sequence: Synthetic oligonucleotide
  Target: ATXN1; (+) strand; PAM type: YTN; PAM sequence: TTT
ttgaaagtggaaaatagatg

SEQ ID NO: 291305 - DNA, 20 bp, Artificial Sequence
  Description of Artificial Sequence: Synthetic oligonucleotide
  Target: ATXN1; (+) strand; PAM type: YTN; PAM sequence: TTT
tgaaagtggaaaatagatga

SEQ ID NO: 291306 - DNA, 20 bp, Artificial Sequence
  Description of Artificial Sequence: Synthetic oligonucleotide
  Target: ATXN1; (+) strand; PAM type: YTN; PAM sequence: TTT
gaaagtggaaaatagatgag

SEQ ID NO: 291307 - DNA, 20 bp, Artificial Sequence
  Description of Artificial Sequence: Synthetic oligonucleotide
  Target: ATXN1; (+) strand; PAM type: YTN; PAM sequence: TTG
aaagtggaaaatagatgaga

SEQ ID NO: 291308 - DNA, 20 bp, Artificial Sequence
  Description of Artificial Sequence: Synthetic oligonucleotide
  Target: ATXN1; (+) strand; PAM type: YTN; PAM sequence: TTT
gctacgcattgttacagtct

SEQ ID NO: 291309 - DNA, 20 bp, Artificial Sequence
  Description of Artificial Sequence: Synthetic oligonucleotide
  Target: ATXN1; (+) strand; PAM type: YTN; PAM sequence: TTG
ctacgcattgttacagtctg

SEQ ID NO: 291310 - DNA, 20 bp, Artificial Sequence
  Description of Artificial Sequence: Synthetic oligonucleotide
  Target: ATXN1; (+) strand; PAM type: YTN; PAM sequence: CTA
cgcattgttacagtctgtta

SEQ ID NO: 291311 - DNA, 20 bp, Artificial Sequence
  Description of Artificial Sequence: Synthetic oligonucleotide
  Target: ATXN1; (+) strand; PAM type: YTN; PAM sequence: TTG
ttacagtctgttattgatat

SEQ ID NO: 291312 - DNA, 20 bp, Artificial Sequence
  Description of Artificial Sequence: Synthetic oligonucleotide
  Target: ATXN1; (+) strand; PAM type: YTN; PAM sequence: TTA
cagtctgttattgatatatg

SEQ ID NO: 291313 - DNA, 20 bp, Artificial Sequence
  Description of Artificial Sequence: Synthetic oligonucleotide
  Target: ATXN1; (+) strand; PAM type: YTN; PAM sequence: CTG
ttattgatatatggtcattt

SEQ ID NO: 291314 - DNA, 20 bp, Artificial Sequence
  Description of Artificial Sequence: Synthetic oligonucleotide
  Target: ATXN1; (+) strand; PAM type: YTN; PAM sequence: TTA
ttgatatatggtcattttgt

SEQ ID NO: 291315 - DNA, 20 bp, Artificial Sequence
  Description of Artificial Sequence: Synthetic oligonucleotide
  Target: ATXN1; (+) strand; PAM type: YTN; PAM sequence: TTG
atatatggtcattttgttat

SEQ ID NO: 291316 - DNA, 20 bp, Artificial Sequence
  Description of Artificial Sequence: Synthetic oligonucleotide
  Target: ATXN1; (+) strand; PAM type: YTN; PAM sequence: TTT
tgttataaagaaacatttaa

SEQ ID NO: 291317 - DNA, 20 bp, Artificial Sequence
  Description of Artificial Sequence: Synthetic oligonucleotide
  Target: ATXN1; (+) strand; PAM type: YTN; PAM sequence: TTT
gttataaagaaacatttaaa

SEQ ID NO: 291318 - DNA, 20 bp, Artificial Sequence
  Description of Artificial Sequence: Synthetic oligonucleotide
  Target: ATXN1; (+) strand; PAM type: YTN; PAM sequence: TTG
ttataaagaaacatttaaaa

SEQ ID NO: 291319 - DNA, 20 bp, Artificial Sequence
  Description of Artificial Sequence: Synthetic oligonucleotide
  Target: ATXN1; (+) strand; PAM type: YTN; PAM sequence: TTA
taaagaaacatttaaaagga

SEQ ID NO: 291320 - DNA, 20 bp, Artificial Sequence
  Description of Artificial Sequence: Synthetic oligonucleotide
  Target: ATXN1; (+) strand; PAM type: YTN; PAM sequence: TTT
aaaaggaggcatgtttcacc

SEQ ID NO: 291321 - DNA, 20 bp, Artificial Sequence
  Description of Artificial Sequence: Synthetic oligonucleotide
  Target: ATXN1; (+) strand; PAM type: YTN; PAM sequence: TTA
aaaggaggcatgtttcacct

SEQ ID NO: 291322 - DNA, 20 bp, Artificial Sequence
  Description of Artificial Sequence: Synthetic oligonucleotide
  Target: ATXN1; (+) strand; PAM type: YTN; PAM sequence: TTT
cacctgttaacttgtttact

SEQ ID NO: 291323 - DNA, 20 bp, Artificial Sequence
  Description of Artificial Sequence: Synthetic oligonucleotide
  Target: ATXN1; (+) strand; PAM type: YTN; PAM sequence: TTC
acctgttaacttgtttactt

SEQ ID NO: 291324 - DNA, 20 bp, Artificial Sequence
  Description of Artificial Sequence: Synthetic oligonucleotide
  Target: ATXN1; (+) strand; PAM type: YTN; PAM sequence: CTG
ttaacttgtttacttcataa

SEQ ID NO: 291325 - DNA, 20 bp, Artificial Sequence
  Description of Artificial Sequence: Synthetic oligonucleotide
  Target: ATXN1; (+) strand; PAM type: YTN; PAM sequence: TTA
acttgtttacttcataagat

SEQ ID NO: 291326 - DNA, 20 bp, Artificial Sequence
  Description of Artificial Sequence: Synthetic oligonucleotide
  Target: ATXN1; (+) strand; PAM type: YTN; PAM sequence: CTT
gtttacttcataagattctc

SEQ ID NO: 291327 - DNA, 20 bp, Artificial Sequence
  Description of Artificial Sequence: Synthetic oligonucleotide
  Target: ATXN1; (+) strand; PAM type: YTN; PAM sequence: TTG
tttacttcataagattctct

SEQ ID NO: 291328 - DNA, 20 bp, Artificial Sequence
  Description of Artificial Sequence: Synthetic oligonucleotide
  Target: ATXN1; (+) strand; PAM type: YTN; PAM sequence: TTT
acttcataagattctcttgt

SEQ ID NO: 291329 - DNA, 20 bp, Artificial Sequence
  Description of Artificial Sequence: Synthetic oligonucleotide
  Target: ATXN1; (+) strand; PAM type: YTN; PAM sequence: TTA
cttcataagattctcttgtt

SEQ ID NO: 291330 - DNA, 20 bp, Artificial Sequence
  Description of Artificial Sequence: Synthetic oligonucleotide
  Target: ATXN1; (+) strand; PAM type: YTN; PAM sequence: CTT
cataagattctcttgttggg

SEQ ID NO: 291331 - DNA, 20 bp, Artificial Sequence
  Description of Artificial Sequence: Synthetic oligonucleotide
  Target: ATXN1; (+) strand; PAM type: YTN; PAM sequence: TTC
ataagattctcttgttgggt

SEQ ID NO: 291332 - DNA, 20 bp, Artificial Sequence
  Description of Artificial Sequence: Synthetic oligonucleotide
  Target: ATXN1; (+) strand; PAM type: YTN; PAM sequence: TTC
tcttgttgggtagatttaca

SEQ ID NO: 291333 - DNA, 20 bp, Artificial Sequence
  Description of Artificial Sequence: Synthetic oligonucleotide
  Target: ATXN1; (+) strand; PAM type: YTN; PAM sequence: CTC
ttgttgggtagatttacaga

SEQ ID NO: 291334 - DNA, 20 bp, Artificial Sequence
  Description of Artificial Sequence: Synthetic oligonucleotide
  Target: ATXN1; (+) strand; PAM type: YTN; PAM sequence: CTT
gttgggtagatttacagatt

SEQ ID NO: 291335 - DNA, 20 bp, Artificial Sequence
  Description of Artificial Sequence: Synthetic oligonucleotide
  Target: ATXN1; (+) strand; PAM type: YTN; PAM sequence: TTG
ttgggtagatttacagattt

SEQ ID NO: 291336 - DNA, 20 bp, Artificial Sequence
  Description of Artificial Sequence: Synthetic oligonucleotide
  Target: ATXN1; (+) strand; PAM type: YTN; PAM sequence: TTG
ggtagatttacagatttaag

SEQ ID NO: 291337 - DNA, 20 bp, Artificial Sequence
  Description of Artificial Sequence: Synthetic oligonucleotide
  Target: ATXN1; (+) strand; PAM type: YTN; PAM sequence: TTT
acagatttaaggcactgcca

SEQ ID NO: 291338 - DNA, 20 bp, Artificial Sequence
  Description of Artificial Sequence: Synthetic oligonucleotide
  Target: ATXN1; (+) strand; PAM type: YTN; PAM sequence: TTA
cagatttaaggcactgccat

SEQ ID NO: 291339 - DNA, 20 bp, Artificial Sequence
  Description of Artificial Sequence: Synthetic oligonucleotide
  Target: ATXN1; (+) strand; PAM type: YTN; PAM sequence: TTT
aaggcactgccataaatctt

SEQ ID NO: 291340 - DNA, 20 bp, Artificial Sequence
  Description of Artificial Sequence: Synthetic oligonucleotide
  Target: ATXN1; (+) strand; PAM type: YTN; PAM sequence: TTA
aggcactgccataaatcttt

SEQ ID NO: 291341 - DNA, 20 bp, Artificial Sequence
  Description of Artificial Sequence: Synthetic oligonucleotide
  Target: ATXN1; (+) strand; PAM type: YTN; PAM sequence: CTG
ccataaatcttttcaaaaca

SEQ ID NO: 291342 - DNA, 20 bp, Artificial Sequence
  Description of Artificial Sequence: Synthetic oligonucleotide
  Target: ATXN1; (+) strand; PAM type: YTN; PAM sequence: CTT
ttcaaaacaaggaagattat

SEQ ID NO: 291343 - DNA, 20 bp, Artificial Sequence
  Description of Artificial Sequence: Synthetic oligonucleotide
  Target: ATXN1; (+) strand; PAM type: YTN; PAM sequence: TTT
tcaaaacaaggaagattata

SEQ ID NO: 291344 - DNA, 20 bp, Artificial Sequence
  Description of Artificial Sequence: Synthetic oligonucleotide
  Target: ATXN1; (+) strand; PAM type: YTN; PAM sequence: TTT
caaaacaaggaagattataa

SEQ ID NO: 291345 - DNA, 20 bp, Artificial Sequence
  Description of Artificial Sequence: Synthetic oligonucleotide
  Target: ATXN1; (+) strand; PAM type: YTN; PAM sequence: TTC
aaaacaaggaagattataaa

SEQ ID NO: 291346 - DNA, 20 bp, Artificial Sequence
  Description of Artificial Sequence: Synthetic oligonucleotide
  Target: ATXN1; (+) strand; PAM type: YTN; PAM sequence: TTA
taaacaaggtaattaattaa

SEQ ID NO: 291347 - DNA, 20 bp, Artificial Sequence
  Description of Artificial Sequence: Synthetic oligonucleotide
  Target: ATXN1; (+) strand; PAM type: YTN; PAM sequence: TTA
attaattatttaattaattc

SEQ ID NO: 291348 - DNA, 20 bp, Artificial Sequence
  Description of Artificial Sequence: Synthetic oligonucleotide
  Target: ATXN1; (+) strand; PAM type: YTN; PAM sequence: TTA
attatttaattaattcggca

SEQ ID NO: 291349 - DNA, 20 bp, Artificial Sequence
  Description of Artificial Sequence: Synthetic oligonucleotide
  Target: ATXN1; (+) strand; PAM type: YTN; PAM sequence: TTA
tttaattaattcggcaaaca

SEQ ID NO: 291350 - DNA, 20 bp, Artificial Sequence
  Description of Artificial Sequence: Synthetic oligonucleotide
  Target: ATXN1; (+) strand; PAM type: YTN; PAM sequence: TTT
aattaattcggcaaacaagt

SEQ ID NO: 291351 - DNA, 20 bp, Artificial Sequence
  Description of Artificial Sequence: Synthetic oligonucleotide
  Target: ATXN1; (+) strand; PAM type: YTN; PAM sequence: TTA
attaattcggcaaacaagtc

SEQ ID NO: 291352 - DNA, 20 bp, Artificial Sequence
  Description of Artificial Sequence: Synthetic oligonucleotide
  Target: ATXN1; (+) strand; PAM type: YTN; PAM sequence: TTA
attcggcaaacaagtcaccc

SEQ ID NO: 291353 - DNA, 20 bp, Artificial Sequence
  Description of Artificial Sequence: Synthetic oligonucleotide
  Target: ATXN1; (+) strand; PAM type: YTN; PAM sequence: TTC
ggcaaacaagtcacccattg

SEQ ID NO: 291354 - DNA, 20 bp, Artificial Sequence
  Description of Artificial Sequence: Synthetic oligonucleotide
  Target: ATXN1; (+) strand; PAM type: YTN; PAM sequence: TTG
acaagcctagaaaaaaatgc

SEQ ID NO: 291355 - DNA, 20 bp, Artificial Sequence
  Description of Artificial Sequence: Synthetic oligonucleotide
  Target: ATXN1; (+) strand; PAM type: YTN; PAM sequence: CTA
gaaaaaaatgccacccaatg

SEQ ID NO: 291356 - DNA, 20 bp, Artificial Sequence
  Description of Artificial Sequence: Synthetic oligonucleotide
  Target: ATXN1; (+) strand; PAM type: YTN; PAM sequence: TTT
gttttatcagttttcttttc

SEQ ID NO: 291357 - DNA, 20 bp, Artificial Sequence
  Description of Artificial Sequence: Synthetic oligonucleotide
  Target: ATXN1; (+) strand; PAM type: YTN; PAM sequence: TTG
ttttatcagttttcttttcc

SEQ ID NO: 291358 - DNA, 20 bp, Artificial Sequence
  Description of Artificial Sequence: Synthetic oligonucleotide
  Target: ATXN1; (+) strand; PAM type: YTN; PAM sequence: TTT
tatcagttttcttttccagt

SEQ ID NO: 291359 - DNA, 20 bp, Artificial Sequence
  Description of Artificial Sequence: Synthetic oligonucleotide
  Target: ATXN1; (+) strand; PAM type: YTN; PAM sequence: TTT
atcagttttcttttccagtt

SEQ ID NO: 291360 - DNA, 20 bp, Artificial Sequence
  Description of Artificial Sequence: Synthetic oligonucleotide
  Target: ATXN1; (+) strand; PAM type: YTN; PAM sequence: TTA
tcagttttcttttccagttt

SEQ ID NO: 291361 - DNA, 20 bp, Artificial Sequence
  Description of Artificial Sequence: Synthetic oligonucleotide
  Target: ATXN1; (+) strand; PAM type: YTN; PAM sequence: TTT
tcttttccagttttggaagg

SEQ ID NO: 291362 - DNA, 20 bp, Artificial Sequence
  Description of Artificial Sequence: Synthetic oligonucleotide
  Target: ATXN1; (+) strand; PAM type: YTN; PAM sequence: TTT
cttttccagttttggaaggg

SEQ ID NO: 291363 - DNA, 20 bp, Artificial Sequence
  Description of Artificial Sequence: Synthetic oligonucleotide
  Target: ATXN1; (+) strand; PAM type: YTN; PAM sequence: TTC
ttttccagttttggaaggga

SEQ ID NO: 291364 - DNA, 20 bp, Artificial Sequence
  Description of Artificial Sequence: Synthetic oligonucleotide
  Target: ATXN1; (+) strand; PAM type: YTN; PAM sequence: CTT
ttccagttttggaagggaaa

SEQ ID NO: 291365 - DNA, 20 bp, Artificial Sequence
  Description of Artificial Sequence: Synthetic oligonucleotide
  Target: ATXN1; (+) strand; PAM type: YTN; PAM sequence: TTT
tccagttttggaagggaaag

SEQ ID NO: 291366 - DNA, 20 bp, Artificial Sequence
  Description of Artificial Sequence: Synthetic oligonucleotide
  Target: ATXN1; (+) strand; PAM type: YTN; PAM sequence: TTT
ccagttttggaagggaaagc

SEQ ID NO: 291367 - DNA, 20 bp, Artificial Sequence
  Description of Artificial Sequence: Synthetic oligonucleotide
  Target: ATXN1; (+) strand; PAM type: YTN; PAM sequence: TTC
cagttttggaagggaaagcc

SEQ ID NO: 291368 - DNA, 20 bp, Artificial Sequence
  Description of Artificial Sequence: Synthetic oligonucleotide
  Target: ATXN1; (+) strand; PAM type: YTN; PAM sequence: TTT
tggaagggaaagcccttgaa

SEQ ID NO: 291369 - DNA, 20 bp, Artificial Sequence
  Description of Artificial Sequence: Synthetic oligonucleotide
  Target: ATXN1; (+) strand; PAM type: YTN; PAM sequence: TTT
ggaagggaaagcccttgaaa

SEQ ID NO: 291370 - DNA, 20 bp, Artificial Sequence
  Description of Artificial Sequence: Synthetic oligonucleotide
  Target: ATXN1; (+) strand; PAM type: YTN; PAM sequence: TTG
gaagggaaagcccttgaaac

SEQ ID NO: 291371 - DNA, 20 bp, Artificial Sequence
  Description of Artificial Sequence: Synthetic oligonucleotide
  Target: ATXN1; (+) strand; PAM type: YTN; PAM sequence: CTT
gaaacaaacatgaccacacg

SEQ ID NO: 291372 - DNA, 20 bp, Artificial Sequence
  Description of Artificial Sequence: Synthetic oligonucleotide
  Target: ATXN1; (+) strand; PAM type: YTN; PAM sequence: TTG
aaacaaacatgaccacacga

SEQ ID NO: 291373 - DNA, 20 bp, Artificial Sequence
  Description of Artificial Sequence: Synthetic oligonucleotide
  Target: ATXN1; (+) strand; PAM type: YTN; PAM sequence: CTC
attgtaatgtttttccccaa

SEQ ID NO: 291374 - DNA, 20 bp, Artificial Sequence
  Description of Artificial Sequence: Synthetic oligonucleotide
  Target: ATXN1; (+) strand; PAM type: YTN; PAM sequence: TTG
taatgtttttccccaagcac

SEQ ID NO: 291375 - DNA, 20 bp, Artificial Sequence
  Description of Artificial Sequence: Synthetic oligonucleotide
  Target: ATXN1; (+) strand; PAM type: YTN; PAM sequence: TTT
ttccccaagcacccacaatt

SEQ ID NO: 291376 - DNA, 20 bp, Artificial Sequence
  Description of Artificial Sequence: Synthetic oligonucleotide
  Target: ATXN1; (+) strand; PAM type: YTN; PAM sequence: TTT
tccccaagcacccacaattc

SEQ ID NO: 291377 - DNA, 20 bp, Artificial Sequence
  Description of Artificial Sequence: Synthetic oligonucleotide
  Target: ATXN1; (+) strand; PAM type: YTN; PAM sequence: TTT
ccccaagcacccacaattcc

SEQ ID NO: 291378 - DNA, 20 bp, Artificial Sequence
  Description of Artificial Sequence: Synthetic oligonucleotide
  Target: ATXN1; (+) strand; PAM type: YTN; PAM sequence: TTC
cccaagcacccacaattcca

SEQ ID NO: 291379 - DNA, 20 bp, Artificial Sequence
  Description of Artificial Sequence: Synthetic oligonucleotide
  Target: ATXN1; (+) strand; PAM type: YTN; PAM sequence: TTC
caggtcctcccaatttgctt

SEQ ID NO: 291380 - DNA, 20 bp, Artificial Sequence
  Description of Artificial Sequence: Synthetic oligonucleotide
  Target: ATXN1; (+) strand; PAM type: YTN; PAM sequence: CTC
ccaatttgcttccagttctt

SEQ ID NO: 291381 - DNA, 20 bp, Artificial Sequence
  Description of Artificial Sequence: Synthetic oligonucleotide
  Target: ATXN1; (+) strand; PAM type: YTN; PAM sequence: TTT
gcttccagttcttgcccaag

SEQ ID NO: 291382 - DNA, 20 bp, Artificial Sequence
  Description of Artificial Sequence: Synthetic oligonucleotide
  Target: ATXN1; (+) strand; PAM type: YTN; PAM sequence: TTG
cttccagttcttgcccaagt

SEQ ID NO: 291383 - DNA, 20 bp, Artificial Sequence
  Description of Artificial Sequence: Synthetic oligonucleotide
  Target: ATXN1; (+) strand; PAM type: YTN; PAM sequence: CTT
ccagttcttgcccaagttta

SEQ ID NO: 291384 - DNA, 20 bp, Artificial Sequence
  Description of Artificial Sequence: Synthetic oligonucleotide
  Target: ATXN1; (+) strand; PAM type: YTN; PAM sequence: TTC
cagttcttgcccaagtttaa

SEQ ID NO: 291385 - DNA, 20 bp, Artificial Sequence
  Description of Artificial Sequence: Synthetic oligonucleotide
  Target: ATXN1; (+) strand; PAM type: YTN; PAM sequence: TTC
ttgcccaagtttaaactctt

SEQ ID NO: 291386 - DNA, 20 bp, Artificial Sequence
  Description of Artificial Sequence: Synthetic oligonucleotide
  Target: ATXN1; (+) strand; PAM type: YTN; PAM sequence: CTT
gcccaagtttaaactcttaa

SEQ ID NO: 291387 - DNA, 20 bp, Artificial Sequence
  Description of Artificial Sequence: Synthetic oligonucleotide
  Target: ATXN1; (+) strand; PAM type: YTN; PAM sequence: TTG
cccaagtttaaactcttaac

SEQ ID NO: 291388 - DNA, 20 bp, Artificial Sequence
  Description of Artificial Sequence: Synthetic oligonucleotide
  Target: ATXN1; (+) strand; PAM type: YTN; PAM sequence: TTT
aaactcttaaccaatgccta

SEQ ID NO: 291389 - DNA, 20 bp, Artificial Sequence
  Description of Artificial Sequence: Synthetic oligonucleotide
  Target: ATXN1; (+) strand; PAM type: YTN; PAM sequence: TTA
aactcttaaccaatgcctac

SEQ ID NO: 291390 - DNA, 20 bp, Artificial Sequence
  Description of Artificial Sequence: Synthetic oligonucleotide
  Target: ATXN1; (+) strand; PAM type: YTN; PAM sequence: CTC
ttaaccaatgcctactatct

SEQ ID NO: 291391 - DNA, 20 bp, Artificial Sequence
  Description of Artificial Sequence: Synthetic oligonucleotide
  Target: ATXN1; (+) strand; PAM type: YTN; PAM sequence: CTT
aaccaatgcctactatctgc

SEQ ID NO: 291392 - DNA, 20 bp, Artificial Sequence
  Description of Artificial Sequence: Synthetic oligonucleotide
  Target: ATXN1; (+) strand; PAM type: YTN; PAM sequence: TTA
accaatgcctactatctgca

SEQ ID NO: 291393 - DNA, 20 bp, Artificial Sequence
  Description of Artificial Sequence: Synthetic oligonucleotide
  Target: ATXN1; (+) strand; PAM type: YTN; PAM sequence: CTA
ctatctgcagcctcaaaggg

SEQ ID NO: 291394 - DNA, 20 bp, Artificial Sequence
  Description of Artificial Sequence: Synthetic oligonucleotide
  Target: ATXN1; (+) strand; PAM type: YTN; PAM sequence: CTA
tctgcagcctcaaagggagc

SEQ ID NO: 291395 - DNA, 20 bp, Artificial Sequence
  Description of Artificial Sequence: Synthetic oligonucleotide
  Target: ATXN1; (+) strand; PAM type: YTN; PAM sequence: CTG
cagcctcaaagggagctgag

SEQ ID NO: 291396 - DNA, 20 bp, Artificial Sequence
  Description of Artificial Sequence: Synthetic oligonucleotide
  Target: ATXN1; (+) strand; PAM type: YTN; PAM sequence: CTC
aaagggagctgagtacttgc

SEQ ID NO: 291397 - DNA, 20 bp, Artificial Sequence
  Description of Artificial Sequence: Synthetic oligonucleotide
  Target: ATXN1; (+) strand; PAM type: YTN; PAM sequence: CTG
agtacttgccaacagacacc

SEQ ID NO: 291398 - DNA, 20 bp, Artificial Sequence
  Description of Artificial Sequence: Synthetic oligonucleotide
  Target: ATXN1; (+) strand; PAM type: YTN; PAM sequence: CTT
gccaacagacaccgccacct

SEQ ID NO: 291399 - DNA, 20 bp, Artificial Sequence
  Description of Artificial Sequence: Synthetic oligonucleotide
  Target: ATXN1; (+) strand; PAM type: YTN; PAM sequence: TTG
ccaacagacaccgccacctc

SEQ ID NO: 291400 - DNA, 20 bp, Artificial Sequence
  Description of Artificial Sequence: Synthetic oligonucleotide
  Target: ATXN1; (+) strand; PAM type: YTN; PAM sequence: CTC
ccctccctgaggttcctgcc

SEQ ID NO: 291401 - DNA, 20 bp, Artificial Sequence
  Description of Artificial Sequence: Synthetic oligonucleotide
  Target: ATXN1; (+) strand; PAM type: YTN; PAM sequence: CTC
cctgaggttcctgccttgcg

SEQ ID NO: 291402 - DNA, 20 bp, Artificial Sequence
  Description of Artificial Sequence: Synthetic oligonucleotide
  Target: ATXN1; (+) strand; PAM type: YTN; PAM sequence: CTG
aggttcctgccttgcgagag

SEQ ID NO: 291403 - DNA, 20 bp, Artificial Sequence
  Description of Artificial Sequence: Synthetic oligonucleotide
  Target: ATXN1; (+) strand; PAM type: YTN; PAM sequence: TTC
ctgccttgcgagagtgtgtc

SEQ ID NO: 291404 - DNA, 20 bp, Artificial Sequence
  Description of Artificial Sequence: Synthetic oligonucleotide
  Target: ATXN1; (+) strand; PAM type: YTN; PAM sequence: CTG
ccttgcgagagtgtgtcatg

SEQ ID NO: 291405 - DNA, 20 bp, Artificial Sequence
  Description of Artificial Sequence: Synthetic oligonucleotide
  Target: ATXN1; (+) strand; PAM type: YTN; PAM sequence: CTT
gcgagagtgtgtcatgtggc

SEQ ID NO: 291406 - DNA, 20 bp, Artificial Sequence
  Description of Artificial Sequence: Synthetic oligonucleotide
  Target: ATXN1; (+) strand; PAM type: YTN; PAM sequence: TTG
cgagagtgtgtcatgtggct

SEQ ID NO: 291407 - DNA, 20 bp, Artificial Sequence
  Description of Artificial Sequence: Synthetic oligonucleotide
  Target: ATXN1; (+) strand; PAM type: YTN; PAM sequence: CTG
ccagggcaaggcagaagtgt

SEQ ID NO: 291408 - DNA, 20 bp, Artificial Sequence
  Description of Artificial Sequence: Synthetic oligonucleotide
  Target: ATXN1; (+) strand; PAM type: YTN; PAM sequence: CTC
acaggttgtccaggaggatt

SEQ ID NO: 291409 - DNA, 20 bp, Artificial Sequence
  Description of Artificial Sequence: Synthetic oligonucleotide
  Target: ATXN1; (+) strand; PAM type: YTN; PAM sequence: TTG
tccaggaggattagagcaaa

SEQ ID NO: 291410 - DNA, 20 bp, Artificial Sequence
  Description of Artificial Sequence: Synthetic oligonucleotide
  Target: ATXN1; (+) strand; PAM type: YTN; PAM sequence: TTA
gagcaaatatgtccagagca

SEQ ID NO: 291411 - DNA, 20 bp, Artificial Sequence
  Description of Artificial Sequence: Synthetic oligonucleotide
  Target: ATXN1; (+) strand; PAM type: YTN; PAM sequence: TTT
caagttgactatagaaccaa

SEQ ID NO: 291412 - DNA, 20 bp, Artificial Sequence
  Description of Artificial Sequence: Synthetic oligonucleotide
  Target: ATXN1; (+) strand; PAM type: YTN; PAM sequence: TTC
aagttgactatagaaccaag

SEQ ID NO: 291413 - DNA, 20 bp, Artificial Sequence
  Description of Artificial Sequence: Synthetic oligonucleotide
  Target: ATXN1; (+) strand; PAM type: YTN; PAM sequence: TTG
actatagaaccaaggctccg

SEQ ID NO: 291414 - DNA, 20 bp, Artificial Sequence
  Description of Artificial Sequence: Synthetic oligonucleotide
  Target: ATXN1; (+) strand; PAM type: YTN; PAM sequence: CTA
tagaaccaaggctccgagct

SEQ ID NO: 291415 - DNA, 20 bp, Artificial Sequence
  Description of Artificial Sequence: Synthetic oligonucleotide
  Target: ATXN1; (+) strand; PAM type: YTN; PAM sequence: CTC
cgagctaattaatagaaagt

SEQ ID NO: 291416 - DNA, 20 bp, Artificial Sequence
  Description of Artificial Sequence: Synthetic oligonucleotide
  Target: ATXN1; (+) strand; PAM type: YTN; PAM sequence: CTA
attaatagaaagtgaagcaa

SEQ ID NO: 291417 - DNA, 20 bp, Artificial Sequence
  Description of Artificial Sequence: Synthetic oligonucleotide
  Target: ATXN1; (+) strand; PAM type: YTN; PAM sequence: TTA
atagaaagtgaagcaatgat

SEQ ID NO: 291418 - DNA, 20 bp, Artificial Sequence
  Description of Artificial Sequence: Synthetic oligonucleotide
  Target: ATXN1; (+) strand; PAM type: YTN; PAM sequence: CTC
aaggcaagggtgtgaagctc

SEQ ID NO: 291419 - DNA, 20 bp, Artificial Sequence
  Description of Artificial Sequence: Synthetic oligonucleotide
  Target: ATXN1; (+) strand; PAM type: YTN; PAM sequence: CTC
atgtcattcggtaaagacag

SEQ ID NO: 291420 - DNA, 20 bp, Artificial Sequence
  Description of Artificial Sequence: Synthetic oligonucleotide
  Target: ATXN1; (+) strand; PAM type: YTN; PAM sequence: TTC
ggtaaagacagtccaaggaa

SEQ ID NO: 291421 - DNA, 20 bp, Artificial Sequence
  Description of Artificial Sequence: Synthetic oligonucleotide
  Target: ATXN1; (+) strand; PAM type: YTN; PAM sequence: TTT
acgcttgcaccttatttgct

SEQ ID NO: 291422 - DNA, 20 bp, Artificial Sequence
  Description of Artificial Sequence: Synthetic oligonucleotide
  Target: ATXN1; (+) strand; PAM type: YTN; PAM sequence: TTA
cgcttgcaccttatttgctt

SEQ ID NO: 291423 - DNA, 20 bp, Artificial Sequence
  Description of Artificial Sequence: Synthetic oligonucleotide
  Target: ATXN1; (+) strand; PAM type: YTN; PAM sequence: CTT
gcaccttatttgctttgcag

SEQ ID NO: 291424 - DNA, 20 bp, Artificial Sequence
  Description of Artificial Sequence: Synthetic oligonucleotide
  Target: ATXN1; (+) strand; PAM type: YTN; PAM sequence: TTG
caccttatttgctttgcaga

SEQ ID NO: 291425 - DNA, 20 bp, Artificial Sequence
  Description of Artificial Sequence: Synthetic oligonucleotide
  Target: ATXN1; (+) strand; PAM type: YTN; PAM sequence: CTT
atttgctttgcagactaaca

SEQ ID NO: 291426 - DNA, 20 bp, Artificial Sequence
  Description of Artificial Sequence: Synthetic oligonucleotide
  Target: ATXN1; (+) strand; PAM type: YTN; PAM sequence: TTA
tttgctttgcagactaacac

SEQ ID NO: 291427 - DNA, 20 bp, Artificial Sequence
  Description of Artificial Sequence: Synthetic oligonucleotide
  Target: ATXN1; (+) strand; PAM type: YTN; PAM sequence: TTT
gctttgcagactaacacatt

SEQ ID NO: 291428 - DNA, 20 bp, Artificial Sequence
  Description of Artificial Sequence: Synthetic oligonucleotide
  Target: ATXN1; (+) strand; PAM type: YTN; PAM sequence: TTG
ctttgcagactaacacattt

SEQ ID NO: 291429 - DNA, 20 bp, Artificial Sequence
  Description of Artificial Sequence: Synthetic oligonucleotide
  Target: ATXN1; (+) strand; PAM type: YTN; PAM sequence: CTT
tgcagactaacacatttctg

SEQ ID NO: 291430 - DNA, 20 bp, Artificial Sequence
  Description of Artificial Sequence: Synthetic oligonucleotide
  Target: ATXN1; (+) strand; PAM type: YTN; PAM sequence: TTT
gcagactaacacatttctgt

SEQ ID NO: 291431 - DNA, 20 bp, Artificial Sequence
  Description of Artificial Sequence: Synthetic oligonucleotide
  Target: ATXN1; (+) strand; PAM type: YTN; PAM sequence: TTG
cagactaacacatttctgtt

SEQ ID NO: 291432 - DNA, 20 bp, Artificial Sequence
  Description of Artificial Sequence: Synthetic oligonucleotide
  Target: ATXN1; (+) strand; PAM type: YTN; PAM sequence: CTA
acacatttctgttagaaata

SEQ ID NO: 291433 - DNA, 20 bp, Artificial Sequence
  Description of Artificial Sequence: Synthetic oligonucleotide
  Target: ATXN1; (+) strand; PAM type: YTN; PAM sequence: TTT
ctgttagaaatatgtcttta

SEQ ID NO: 291434 - DNA, 20 bp, Artificial Sequence
  Description of Artificial Sequence: Synthetic oligonucleotide
  Target: ATXN1; (+) strand; PAM type: YTN; PAM sequence: TTC
tgttagaaatatgtctttac

SEQ ID NO: 291435 - DNA, 20 bp, Artificial Sequence
  Description of Artificial Sequence: Synthetic oligonucleotide
  Target: ATXN1; (+) strand; PAM type: YTN; PAM sequence: CTG
ttagaaatatgtctttacac

SEQ ID NO: 291436 - DNA, 20 bp, Artificial Sequence
  Description of Artificial Sequence: Synthetic oligonucleotide
  Target: ATXN1; (+) strand; PAM type: YTN; PAM sequence: TTA
gaaatatgtctttacactcc

SEQ ID NO: 291437 - DNA, 20 bp, Artificial Sequence
  Description of Artificial Sequence: Synthetic oligonucleotide
  Target: ATXN1; (+) strand; PAM type: YTN; PAM sequence: CTT
tacactccagagagatgtta

SEQ ID NO: 291438 - DNA, 20 bp, Artificial Sequence
  Description of Artificial Sequence: Synthetic oligonucleotide
  Target: ATXN1; (+) strand; PAM type: YTN; PAM sequence: TTT
acactccagagagatgttac

SEQ ID NO: 291439 - DNA, 20 bp, Artificial Sequence
  Description of Artificial Sequence: Synthetic oligonucleotide
  Target: ATXN1; (+) strand; PAM type: YTN; PAM sequence: TTA
cactccagagagatgttaca

SEQ ID NO: 291440 - DNA, 20 bp, Artificial Sequence
  Description of Artificial Sequence: Synthetic oligonucleotide
  Target: ATXN1; (+) strand; PAM type: YTN; PAM sequence: CTC
cagagagatgttacaaggtg

SEQ ID NO: 291441 - DNA, 20 bp, Artificial Sequence
  Description of Artificial Sequence: Synthetic oligonucleotide
  Target: ATXN1; (+) strand; PAM type: YTN; PAM sequence: TTA
caaggtgtcggcctgctact

SEQ ID NO: 291442 - DNA, 20 bp, Artificial Sequence
  Description of Artificial Sequence: Synthetic oligonucleotide
  Target: ATXN1; (+) strand; PAM type: YTN; PAM sequence: CTG
ctactaattacagcaagccc

SEQ ID NO: 291443 - DNA, 20 bp, Artificial Sequence
  Description of Artificial Sequence: Synthetic oligonucleotide
  Target: ATXN1; (+) strand; PAM type: YTN; PAM sequence: CTA
ctaattacagcaagcccgca

SEQ ID NO: 291444 - DNA, 20 bp, Artificial Sequence
  Description of Artificial Sequence: Synthetic oligonucleotide
  Target: ATXN1; (+) strand; PAM type: YTN; PAM sequence: CTA
attacagcaagcccgcacta

SEQ ID NO: 291445 - DNA, 20 bp, Artificial Sequence
  Description of Artificial Sequence: Synthetic oligonucleotide
  Target: ATXN1; (+) strand; PAM type: YTN; PAM sequence: TTA
cagcaagcccgcactacagc

SEQ ID NO: 291446 - DNA, 20 bp, Artificial Sequence
  Description of Artificial Sequence: Synthetic oligonucleotide
  Target: ATXN1; (+) strand; PAM type: YTN; PAM sequence: CTA
cagctaacaatataactcta

SEQ ID NO: 291447 - DNA, 20 bp, Artificial Sequence
  Description of Artificial Sequence: Synthetic oligonucleotide
  Target: ATXN1; (+) strand; PAM type: YTN; PAM sequence: CTA
acaatataactctaaattca

SEQ ID NO: 291448 - DNA, 20 bp, Artificial Sequence
  Description of Artificial Sequence: Synthetic oligonucleotide
  Target: ATXN1; (+) strand; PAM type: YTN; PAM sequence: CTC
taaattcacttgcttctgat

SEQ ID NO: 291449 - DNA, 20 bp, Artificial Sequence
  Description of Artificial Sequence: Synthetic oligonucleotide
  Target: ATXN1; (+) strand; PAM type: YTN; PAM sequence: CTA
aattcacttgcttctgatta

SEQ ID NO: 291450 - DNA, 20 bp, Artificial Sequence
  Description of Artificial Sequence: Synthetic oligonucleotide
  Target: ATXN1; (+) strand; PAM type: YTN; PAM sequence: TTC
acttgcttctgattacctac

SEQ ID NO: 291451 - DNA, 20 bp, Artificial Sequence
  Description of Artificial Sequence: Synthetic oligonucleotide
  Target: ATXN1; (+) strand; PAM type: YTN; PAM sequence: CTT
gcttctgattacctacctgt

SEQ ID NO: 291452 - DNA, 20 bp, Artificial Sequence
  Description of Artificial Sequence: Synthetic oligonucleotide
  Target: ATXN1; (+) strand; PAM type: YTN; PAM sequence: TTG
cttctgattacctacctgtc

SEQ ID NO: 291453 - DNA, 20 bp, Artificial Sequence
  Description of Artificial Sequence: Synthetic oligonucleotide
  Target: ATXN1; (+) strand; PAM type: YTN; PAM sequence: CTT
ctgattacctacctgtcata

SEQ ID NO: 291454 - DNA, 20 bp, Artificial Sequence
  Description of Artificial Sequence: Synthetic oligonucleotide
  Target: ATXN1; (+) strand; PAM type: YTN; PAM sequence: TTC
tgattacctacctgtcatat

SEQ ID NO: 291455 - DNA, 20 bp, Artificial Sequence
  Description of Artificial Sequence: Synthetic oligonucleotide
  Target: ATXN1; (+) strand; PAM type: YTN; PAM sequence: CTG
attacctacctgtcatatga

SEQ ID NO: 291456 - DNA, 20 bp, Artificial Sequence
  Description of Artificial Sequence: Synthetic oligonucleotide
  Target: ATXN1; (+) strand; PAM type: YTN; PAM sequence: TTA
cctacctgtcatatgaaagg

SEQ ID NO: 291457 - DNA, 20 bp, Artificial Sequence
  Description of Artificial Sequence: Synthetic oligonucleotide
  Target: ATXN1; (+) strand; PAM type: YTN; PAM sequence: CTA
cctgtcatatgaaaggctat

SEQ ID NO: 291458 - DNA, 20 bp, Artificial Sequence
  Description of Artificial Sequence: Synthetic oligonucleotide
  Target: ATXN1; (+) strand; PAM type: YTN; PAM sequence: CTG
tcatatgaaaggctattctt

SEQ ID NO: 291459 - DNA, 20 bp, Artificial Sequence
  Description of Artificial Sequence: Synthetic oligonucleotide
  Target: ATXN1; (+) strand; PAM type: YTN; PAM sequence: CTA
ttcttcactccagttgaaca

SEQ ID NO: 291460 - DNA, 20 bp, Artificial Sequence
  Description of Artificial Sequence: Synthetic oligonucleotide
  Target: ATXN1; (+) strand; PAM type: YTN; PAM sequence: TTC
ttcactccagttgaacaaac

SEQ ID NO: 291461 - DNA, 20 bp, Artificial Sequence
  Description of Artificial Sequence: Synthetic oligonucleotide
  Target: ATXN1; (+) strand; PAM type: YTN; PAM sequence: CTT
cactccagttgaacaaacct

SEQ ID NO: 291462 - DNA, 20 bp, Artificial Sequence
  Description of Artificial Sequence: Synthetic oligonucleotide
  Target: ATXN1; (+) strand; PAM type: YTN; PAM sequence: TTC
actccagttgaacaaaccta

SEQ ID NO: 291463 - DNA, 20 bp, Artificial Sequence
  Description of Artificial Sequence: Synthetic oligonucleotide
  Target: ATXN1; (+) strand; PAM type: YTN; PAM sequence: CTC
cagttgaacaaacctattag

SEQ ID NO: 291464 - DNA, 20 bp, Artificial Sequence
  Description of Artificial Sequence: Synthetic oligonucleotide
  Target: ATXN1; (+) strand; PAM type: YTN; PAM sequence: TTG
aacaaacctattagatgtct

SEQ ID NO: 291465 - DNA, 20 bp, Artificial Sequence
  Description of Artificial Sequence: Synthetic oligonucleotide
  Target: ATXN1; (+) strand; PAM type: YTN; PAM sequence: CTA
ttagatgtctggtttcttga

SEQ ID NO: 291466 - DNA, 20 bp, Artificial Sequence
  Description of Artificial Sequence: Synthetic oligonucleotide
  Target: ATXN1; (+) strand; PAM type: YTN; PAM sequence: TTA
gatgtctggtttcttgatgt

SEQ ID NO: 291467 - DNA, 20 bp, Artificial Sequence
  Description of Artificial Sequence: Synthetic oligonucleotide
  Target: ATXN1; (+) strand; PAM type: YTN; PAM sequence: CTG
gtttcttgatgtttaactct

SEQ ID NO: 291468 - DNA, 20 bp, Artificial Sequence
  Description of Artificial Sequence: Synthetic oligonucleotide
  Target: ATXN1; (+) strand; PAM type: YTN; PAM sequence: TTT
cttgatgtttaactctcaca

SEQ ID NO: 291469 - DNA, 20 bp, Artificial Sequence
  Description of Artificial Sequence: Synthetic oligonucleotide
  Target: ATXN1; (+) strand; PAM type: YTN; PAM sequence: TTC
ttgatgtttaactctcacaa

SEQ ID NO: 291470 - DNA, 20 bp, Artificial Sequence
  Description of Artificial Sequence: Synthetic oligonucleotide
  Target: ATXN1; (+) strand; PAM type: YTN; PAM sequence: CTT
gatgtttaactctcacaagc

SEQ ID NO: 291471 - DNA, 20 bp, Artificial Sequence
  Description of Artificial Sequence: Synthetic oligonucleotide
  Target: ATXN1; (+) strand; PAM type: YTN; PAM sequence: TTG
atgtttaactctcacaagca

SEQ ID NO: 291472 - DNA, 20 bp, Artificial Sequence
  Description of Artificial Sequence: Synthetic oligonucleotide
  Target: ATXN1; (+) strand; PAM type: YTN; PAM sequence: TTT
aactctcacaagcaattatc

SEQ ID NO: 291473 - DNA, 20 bp, Artificial Sequence
  Description of Artificial Sequence: Synthetic oligonucleotide
  Target: ATXN1; (+) strand; PAM type: YTN; PAM sequence: TTA
actctcacaagcaattatct

SEQ ID NO: 291474 - DNA, 20 bp, Artificial Sequence
  Description of Artificial Sequence: Synthetic oligonucleotide
  Target: ATXN1; (+) strand; PAM type: YTN; PAM sequence: CTC
tcacaagcaattatctccag

SEQ ID NO: 291475 - DNA, 20 bp, Artificial Sequence
  Description of Artificial Sequence: Synthetic oligonucleotide
  Target: ATXN1; (+) strand; PAM type: YTN; PAM sequence: CTC
acaagcaattatctccagct

SEQ ID NO: 291476 - DNA, 20 bp, Artificial Sequence
  Description of Artificial Sequence: Synthetic oligonucleotide
  Target: ATXN1; (+) strand; PAM type: YTN; PAM sequence: TTA
tctccagcttgaaatgccct

SEQ ID NO: 291477 - DNA, 20 bp, Artificial Sequence
  Description of Artificial Sequence: Synthetic oligonucleotide
  Target: ATXN1; (+) strand; PAM type: YTN; PAM sequence: CTC
cagcttgaaatgcccttttg

SEQ ID NO: 291478 - DNA, 20 bp, Artificial Sequence
  Description of Artificial Sequence: Synthetic oligonucleotide
  Target: ATXN1; (+) strand; PAM type: YTN; PAM sequence: CTT
gaaatgcccttttgtcttct

SEQ ID NO: 291479 - DNA, 20 bp, Artificial Sequence
  Description of Artificial Sequence: Synthetic oligonucleotide
  Target: ATXN1; (+) strand; PAM type: YTN; PAM sequence: TTG
aaatgcccttttgtcttctt

SEQ ID NO: 291480 - DNA, 20 bp, Artificial Sequence
  Description of Artificial Sequence: Synthetic oligonucleotide
  Target: ATXN1; (+) strand; PAM type: YTN; PAM sequence: CTT
ttgtcttctttatacaatca

SEQ ID NO: 291481 - DNA, 20 bp, Artificial Sequence
  Description of Artificial Sequence: Synthetic oligonucleotide
  Target: ATXN1; (+) strand; PAM type: YTN; PAM sequence: TTT
tgtcttctttatacaatcac

SEQ ID NO: 291482 - DNA, 20 bp, Artificial Sequence
  Description of Artificial Sequence: Synthetic oligonucleotide
  Target: ATXN1; (+) strand; PAM type: YTN; PAM sequence: TTT
gtcttctttatacaatcact

SEQ ID NO: 291483 - DNA, 20 bp, Artificial Sequence
  Description of Artificial Sequence: Synthetic oligonucleotide
  Target: ATXN1; (+) strand; PAM type: YTN; PAM sequence: TTG
tcttctttatacaatcacta

SEQ ID NO: 291484 - DNA, 20 bp, Artificial Sequence
  Description of Artificial Sequence: Synthetic oligonucleotide
  Target: ATXN1; (+) strand; PAM type: YTN; PAM sequence: CTT
ctttatacaatcactactct

SEQ ID NO: 291485 - DNA, 20 bp, Artificial Sequence
  Description of Artificial Sequence: Synthetic oligonucleotide
  Target: ATXN1; (+) strand; PAM type: YTN; PAM sequence: TTC
tttatacaatcactactctt

SEQ ID NO: 291486 - DNA, 20 bp, Artificial Sequence
  Description of Artificial Sequence: Synthetic oligonucleotide
  Target: ATXN1; (+) strand; PAM type: YTN; PAM sequence: CTT
tatacaatcactactctttc

SEQ ID NO: 291487 - DNA, 20 bp, Artificial Sequence
  Description of Artificial Sequence: Synthetic oligonucleotide
  Target: ATXN1; (+) strand; PAM type: YTN; PAM sequence: TTT
atacaatcactactctttct

SEQ ID NO: 291488 - DNA, 20 bp, Artificial Sequence
  Description of Artificial Sequence: Synthetic oligonucleotide
  Target: ATXN1; (+) strand; PAM type: YTN; PAM sequence: TTA
tacaatcactactctttctt

SEQ ID NO: 291489 - DNA, 20 bp, Artificial Sequence
  Description of Artificial Sequence: Synthetic oligonucleotide
  Target: ATXN1; (+) strand; PAM type: YTN; PAM sequence: CTA
ctctttcttcttagaaaaca

SEQ ID NO: 291490 - DNA, 20 bp, Artificial Sequence
  Description of Artificial Sequence: Synthetic oligonucleotide
  Target: ATXN1; (+) strand; PAM type: YTN; PAM sequence: CTC
tttcttcttagaaaacacag

SEQ ID NO: 291491 - DNA, 20 bp, Artificial Sequence
  Description of Artificial Sequence: Synthetic oligonucleotide
  Target: ATXN1; (+) strand; PAM type: YTN; PAM sequence: CTT
tcttcttagaaaacacagtt

SEQ ID NO: 291492 - DNA, 20 bp, Artificial Sequence
  Description of Artificial Sequence: Synthetic oligonucleotide
  Target: ATXN1; (+) strand; PAM type: YTN; PAM sequence: TTT
cttcttagaaaacacagttt

SEQ ID NO: 291493 - DNA, 20 bp, Artificial Sequence
  Description of Artificial Sequence: Synthetic oligonucleotide
  Target: ATXN1; (+) strand; PAM type: YTN; PAM sequence: TTC
ttcttagaaaacacagttta

SEQ ID NO: 291494 - DNA, 20 bp, Artificial Sequence
  Description of Artificial Sequence: Synthetic oligonucleotide
  Target: ATXN1; (+) strand; PAM type: YTN; PAM sequence: CTT
cttagaaaacacagtttaaa

SEQ ID NO: 291495 - DNA, 20 bp, Artificial Sequence
  Description of Artificial Sequence: Synthetic oligonucleotide
  Target: ATXN1; (+) strand; PAM type: YTN; PAM sequence: TTC
ttagaaaacacagtttaaac

SEQ ID NO: 291496 - DNA, 20 bp, Artificial Sequence
  Description of Artificial Sequence: Synthetic oligonucleotide
  Target: ATXN1; (+) strand; PAM type: YTN; PAM sequence: CTT
agaaaacacagtttaaacca

SEQ ID NO: 291497 - DNA, 20 bp, Artificial Sequence
  Description of Artificial Sequence: Synthetic oligonucleotide
  Target: ATXN1; (+) strand; PAM type: YTN; PAM sequence: TTA
gaaaacacagtttaaaccac

SEQ ID NO: 291498 - DNA, 20 bp, Artificial Sequence
  Description of Artificial Sequence: Synthetic oligonucleotide
  Target: ATXN1; (+) strand; PAM type: YTN; PAM sequence: TTT
aaaccacttcctcccttaat

SEQ ID NO: 291499 - DNA, 20 bp, Artificial Sequence
  Description of Artificial Sequence: Synthetic oligonucleotide
  Target: ATXN1; (+) strand; PAM type: YTN; PAM sequence: TTA
aaccacttcctcccttaatc

SEQ ID NO: 291500 - DNA, 20 bp, Artificial Sequence
  Description of Artificial Sequence: Synthetic oligonucleotide
  Target: ATXN1; (+) strand; PAM type: YTN; PAM sequence: CTT
cctcccttaatccatctaaa

SEQ ID NO: 291501 - DNA, 20 bp, Artificial Sequence
  Description of Artificial Sequence: Synthetic oligonucleotide
  Target: ATXN1; (+) strand; PAM type: YTN; PAM sequence: TTC
ctcccttaatccatctaaac

SEQ ID NO: 291502 - DNA, 20 bp, Artificial Sequence
  Description of Artificial Sequence: Synthetic oligonucleotide
  Target: ATXN1; (+) strand; PAM type: YTN; PAM sequence: CTC
ccttaatccatctaaactaa

SEQ ID NO: 291503 - DNA, 20 bp, Artificial Sequence
  Description of Artificial Sequence: Synthetic oligonucleotide
  Target: ATXN1; (+) strand; PAM type: YTN; PAM sequence: CTT
aatccatctaaactaacccc

SEQ ID NO: 291504 - DNA, 20 bp, Artificial Sequence
  Description of Artificial Sequence: Synthetic oligonucleotide
  Target: ATXN1; (+) strand; PAM type: YTN; PAM sequence: TTA
atccatctaaactaacccca

SEQ ID NO: 291505 - DNA, 20 bp, Artificial Sequence
  Description of Artificial Sequence: Synthetic oligonucleotide
  Target: ATXN1; (+) strand; PAM type: YTN; PAM sequence: CTA
aactaaccccatctagttct

SEQ ID NO: 291506 - DNA, 20 bp, Artificial Sequence
  Description of Artificial Sequence: Synthetic oligonucleotide
  Target: ATXN1; (+) strand; PAM type: YTN; PAM sequence: CTA
accccatctagttctggcat

SEQ ID NO: 291507 - DNA, 20 bp, Artificial Sequence
  Description of Artificial Sequence: Synthetic oligonucleotide
  Target: ATXN1; (+) strand; PAM type: YTN; PAM sequence: CTA
gttctggcatccatgcaatc

SEQ ID NO: 291508 - DNA, 20 bp, Artificial Sequence
  Description of Artificial Sequence: Synthetic oligonucleotide
  Target: ATXN1; (+) strand; PAM type: YTN; PAM sequence: TTC
tggcatccatgcaatcaata

SEQ ID NO: 291509 - DNA, 20 bp, Artificial Sequence
  Description of Artificial Sequence: Synthetic oligonucleotide
  Target: ATXN1; (+) strand; PAM type: YTN; PAM sequence: CTG
gcatccatgcaatcaataga

SEQ ID NO: 291510 - DNA, 20 bp, Artificial Sequence
  Description of Artificial Sequence: Synthetic oligonucleotide
  Target: ATXN1; (+) strand; PAM type: YTN; PAM sequence: TTT
agcatttacttagcaagcac

SEQ ID NO: 291511 - DNA, 20 bp, Artificial Sequence
  Description of Artificial Sequence: Synthetic oligonucleotide
  Target: ATXN1; (+) strand; PAM type: YTN; PAM sequence: TTA
gcatttacttagcaagcact

SEQ ID NO: 291512 - DNA, 20 bp, Artificial Sequence
  Description of Artificial Sequence: Synthetic oligonucleotide
  Target: ATXN1; (+) strand; PAM type: YTN; PAM sequence: TTT
acttagcaagcactaccatg

SEQ ID NO: 291513 - DNA, 20 bp, Artificial Sequence
  Description of Artificial Sequence: Synthetic oligonucleotide
  Target: ATXN1; (+) strand; PAM type: YTN; PAM sequence: TTA
cttagcaagcactaccatgg

SEQ ID NO: 291514 - DNA, 20 bp, Artificial Sequence
  Description of Artificial Sequence: Synthetic oligonucleotide
  Target: ATXN1; (+) strand; PAM type: YTN; PAM sequence: CTT
agcaagcactaccatggatt

SEQ ID NO: 291515 - DNA, 20 bp, Artificial Sequence
  Description of Artificial Sequence: Synthetic oligonucleotide
  Target: ATXN1; (+) strand; PAM type: YTN; PAM sequence: TTA
gcaagcactaccatggattt

SEQ ID NO: 291516 - DNA, 20 bp, Artificial Sequence
  Description of Artificial Sequence: Synthetic oligonucleotide
  Target: ATXN1; (+) strand; PAM type: YTN; PAM sequence: CTA
ccatggatttctctgtaatg

SEQ ID NO: 291517 - DNA, 20 bp, Artificial Sequence
  Description of Artificial Sequence: Synthetic oligonucleotide
  Target: ATXN1; (+) strand; PAM type: YTN; PAM sequence: TTT
ctctgtaatgaaaaagttaa

SEQ ID NO: 291518 - DNA, 20 bp, Artificial Sequence
  Description of Artificial Sequence: Synthetic oligonucleotide
  Target: ATXN1; (+) strand; PAM type: YTN; PAM sequence: TTC
tctgtaatgaaaaagttaat

SEQ ID NO: 291519 - DNA, 20 bp, Artificial Sequence
  Description of Artificial Sequence: Synthetic oligonucleotide
  Target: ATXN1; (+) strand; PAM type: YTN; PAM sequence: CTC
tgtaatgaaaaagttaatcc

SEQ ID NO: 291520 - DNA, 20 bp, Artificial Sequence
  Description of Artificial Sequence: Synthetic oligonucleotide
  Target: ATXN1; (+) strand; PAM type: YTN; PAM sequence: CTG
taatgaaaaagttaatccta

SEQ ID NO: 291521 - DNA, 20 bp, Artificial Sequence
  Description of Artificial Sequence: Synthetic oligonucleotide
  Target: ATXN1; (+) strand; PAM type: YTN; PAM sequence: TTA
atcctacatatgccttatat

SEQ ID NO: 291522 - DNA, 20 bp, Artificial Sequence
  Description of Artificial Sequence: Synthetic oligonucleotide
  Target: ATXN1; (+) strand; PAM type: YTN; PAM sequence: CTA
catatgccttatatgtaatc

SEQ ID NO: 291523 - DNA, 20 bp, Artificial Sequence
  Description of Artificial Sequence: Synthetic oligonucleotide
  Target: ATXN1; (+) strand; PAM type: YTN; PAM sequence: CTT
atatgtaatcttgagcaggt

SEQ ID NO: 291524 - DNA, 20 bp, Artificial Sequence
  Description of Artificial Sequence: Synthetic oligonucleotide
  Target: ATXN1; (+) strand; PAM type: YTN; PAM sequence: TTA
tatgtaatcttgagcaggtt

SEQ ID NO: 291525 - DNA, 20 bp, Artificial Sequence
  Description of Artificial Sequence: Synthetic oligonucleotide
  Target: ATXN1; (+) strand; PAM type: YTN; PAM sequence: CTT
gagcaggttctcctcttttc

SEQ ID NO: 291526 - DNA, 20 bp, Artificial Sequence
  Description of Artificial Sequence: Synthetic oligonucleotide
  Target: ATXN1; (+) strand; PAM type: YTN; PAM sequence: TTG
agcaggttctcctcttttct

SEQ ID NO: 291527 - DNA, 20 bp, Artificial Sequence
  Description of Artificial Sequence: Synthetic oligonucleotide
  Target: ATXN1; (+) strand; PAM type: YTN; PAM sequence: TTC
tcctcttttctgggcctcgg

SEQ ID NO: 291528 - DNA, 20 bp, Artificial Sequence
  Description of Artificial Sequence: Synthetic oligonucleotide
  Target: ATXN1; (+) strand; PAM type: YTN; PAM sequence: CTC
ctcttttctgggcctcggtt

SEQ ID NO: 291529 - DNA, 20 bp, Artificial Sequence
  Description of Artificial Sequence: Synthetic oligonucleotide
  Target: ATXN1; (+) strand; PAM type: YTN; PAM sequence: CTC
ttttctgggcctcggttttc

SEQ ID NO: 291530 - DNA, 20 bp, Artificial Sequence
  Description of Artificial Sequence: Synthetic oligonucleotide
  Target: ATXN1; (+) strand; PAM type: YTN; PAM sequence: CTT
ttctgggcctcggttttctc

SEQ ID NO: 291531 - DNA, 20 bp, Artificial Sequence
  Description of Artificial Sequence: Synthetic oligonucleotide
  Target: ATXN1; (+) strand; PAM type: YTN; PAM sequence: TTT
tctgggcctcggttttctca

SEQ ID NO: 291532 - DNA, 20 bp, Artificial Sequence
  Description of Artificial Sequence: Synthetic oligonucleotide
  Target: ATXN1; (+) strand; PAM type: YTN; PAM sequence: TTT
ctgggcctcggttttctcat

SEQ ID NO: 291533 - DNA, 20 bp, Artificial Sequence
  Description of Artificial Sequence: Synthetic oligonucleotide
  Target: ATXN1; (+) strand; PAM type: YTN; PAM sequence: TTC
tgggcctcggttttctcatc

SEQ ID NO: 291534 - DNA, 20 bp, Artificial Sequence
  Description of Artificial Sequence: Synthetic oligonucleotide
  Target: ATXN1; (+) strand; PAM type: YTN; PAM sequence: CTG
ggcctcggttttctcatctg

SEQ ID NO: 291535 - DNA, 20 bp, Artificial Sequence
  Description of Artificial Sequence: Synthetic oligonucleotide
  Target: ATXN1; (+) strand; PAM type: YTN; PAM sequence: CTC
ggttttctcatctgtaggag

SEQ ID NO: 291536 - DNA, 20 bp, Artificial Sequence
  Description of Artificial Sequence: Synthetic oligonucleotide
  Target: ATXN1; (+) strand; PAM type: YTN; PAM sequence: TTT
tctcatctgtaggaggataa

SEQ ID NO: 291537 - DNA, 20 bp, Artificial Sequence
  Description of Artificial Sequence: Synthetic oligonucleotide
  Target: ATXN1; (+) strand; PAM type: YTN; PAM sequence: TTT
ctcatctgtaggaggataat

SEQ ID NO: 291538 - DNA, 20 bp, Artificial Sequence
  Description of Artificial Sequence: Synthetic oligonucleotide
  Target: ATXN1; (+) strand; PAM type: YTN; PAM sequence: TTC
tcatctgtaggaggataata

SEQ ID NO: 291539 - DNA, 20 bp, Artificial Sequence
  Description of Artificial Sequence: Synthetic oligonucleotide
  Target: ATXN1; (+) strand; PAM type: YTN; PAM sequence: CTC
atctgtaggaggataatact

SEQ ID NO: 291540 - DNA, 20 bp, Artificial Sequence
  Description of Artificial Sequence: Synthetic oligonucleotide
  Target: ATXN1; (+) strand; PAM type: YTN; PAM sequence: CTG
taggaggataatactcccta

SEQ ID NO: 291541 - DNA, 20 bp, Artificial Sequence
  Description of Artificial Sequence: Synthetic oligonucleotide
  Target: ATXN1; (+) strand; PAM type: YTN; PAM sequence: CTC
cctacctcatagggttgttt

SEQ ID NO: 291542 - DNA, 20 bp, Artificial Sequence
  Description of Artificial Sequence: Synthetic oligonucleotide
  Target: ATXN1; (+) strand; PAM type: YTN; PAM sequence: CTA
cctcatagggttgtttctga

SEQ ID NO: 291543 - DNA, 20 bp, Artificial Sequence
  Description of Artificial Sequence: Synthetic oligonucleotide
  Target: ATXN1; (+) strand; PAM type: YTN; PAM sequence: CTC
atagggttgtttctgagaat

SEQ ID NO: 291544 - DNA, 20 bp, Artificial Sequence
  Description of Artificial Sequence: Synthetic oligonucleotide
  Target: ATXN1; (+) strand; PAM type: YTN; PAM sequence: TTG
tttctgagaattaaacattt

SEQ ID NO: 291545 - DNA, 20 bp, Artificial Sequence
  Description of Artificial Sequence: Synthetic oligonucleotide
  Target: ATXN1; (+) strand; PAM type: YTN; PAM sequence: TTT
ctgagaattaaacatttatt

SEQ ID NO: 291546 - DNA, 20 bp, Artificial Sequence
  Description of Artificial Sequence: Synthetic oligonucleotide
  Target: ATXN1; (+) strand; PAM type: YTN; PAM sequence: TTC
tgagaattaaacatttattt

SEQ ID NO: 291547 - DNA, 20 bp, Artificial Sequence
  Description of Artificial Sequence: Synthetic oligonucleotide
  Target: ATXN1; (+) strand; PAM type: YTN; PAM sequence: CTG
agaattaaacatttattttt

SEQ ID NO: 291548 - DNA, 20 bp, Artificial Sequence
  Description of Artificial Sequence: Synthetic oligonucleotide
  Target: ATXN1; (+) strand; PAM type: YTN; PAM sequence: TTA
aacatttatttttaaaaaaa

SEQ ID NO: 291549 - DNA, 20 bp, Artificial Sequence
  Description of Artificial Sequence: Synthetic oligonucleotide
  Target: ATXN1; (+) strand; PAM type: YTN; PAM sequence: TTT
atttttaaaaaaacagcttt

SEQ ID NO: 291550 - DNA, 20 bp, Artificial Sequence
  Description of Artificial Sequence: Synthetic oligonucleotide
  Target: ATXN1; (+) strand; PAM type: YTN; PAM sequence: TTA
tttttaaaaaaacagcttta

SEQ ID NO: 291551 - DNA, 20 bp, Artificial Sequence
  Description of Artificial Sequence: Synthetic oligonucleotide
  Target: ATXN1; (+) strand; PAM type: YTN; PAM sequence: TTT
ttaaaaaaacagctttatta

SEQ ID NO: 291552 - DNA, 20 bp, Artificial Sequence
  Description of Artificial Sequence: Synthetic oligonucleotide
  Target: ATXN1; (+) strand; PAM type: YTN; PAM sequence: TTT
taaaaaaacagctttattaa

SEQ ID NO: 291553 - DNA, 20 bp, Artificial Sequence
  Description of Artificial Sequence: Synthetic oligonucleotide
  Target: ATXN1; (+) strand; PAM type: YTN; PAM sequence: TTT
aaaaaaacagctttattaag

SEQ ID NO: 291554 - DNA, 20 bp, Artificial Sequence
  Description of Artificial Sequence: Synthetic oligonucleotide
  Target: ATXN1; (+) strand; PAM type: YTN; PAM sequence: TTA
aaaaaacagctttattaaga

SEQ ID NO: 291555 - DNA, 20 bp, Artificial Sequence
  Description of Artificial Sequence: Synthetic oligonucleotide
  Target: ATXN1; (+) strand; PAM type: YTN; PAM sequence: CTT
tattaagatttaatttacat

SEQ ID NO: 291556 - DNA, 20 bp, Artificial Sequence
  Description of Artificial Sequence: Synthetic oligonucleotide
  Target: ATXN1; (+) strand; PAM type: YTN; PAM sequence: TTT
attaagatttaatttacata

SEQ ID NO: 291557 - DNA, 20 bp, Artificial Sequence
  Description of Artificial Sequence: Synthetic oligonucleotide
  Target: ATXN1; (+) strand; PAM type: YTN; PAM sequence: TTA
ttaagatttaatttacatat

SEQ ID NO: 291558 - DNA, 20 bp, Artificial Sequence
  Description of Artificial Sequence: Synthetic oligonucleotide
  Target: ATXN1; (+) strand; PAM type: YTN; PAM sequence: TTA
agatttaatttacatataac

SEQ ID NO: 291559 - DNA, 20 bp, Artificial Sequence
  Description of Artificial Sequence: Synthetic oligonucleotide
  Target: ATXN1; (+) strand; PAM type: YTN; PAM sequence: TTT
aatttacatataactcaagt

SEQ ID NO: 291560 - DNA, 20 bp, Artificial Sequence
  Description of Artificial Sequence: Synthetic oligonucleotide
  Target: ATXN1; (+) strand; PAM type: YTN; PAM sequence: TTA
atttacatataactcaagtg

SEQ ID NO: 291561 - DNA, 20 bp, Artificial Sequence
  Description of Artificial Sequence: Synthetic oligonucleotide
  Target: ATXN1; (+) strand; PAM type: YTN; PAM sequence: TTT
acatataactcaagtgtata

SEQ ID NO: 291562 - DNA, 20 bp, Artificial Sequence
  Description of Artificial Sequence: Synthetic oligonucleotide
  Target: ATXN1; (+) strand; PAM type: YTN; PAM sequence: TTA
catataactcaagtgtataa

SEQ ID NO: 291563 - DNA, 20 bp, Artificial Sequence
  Description of Artificial Sequence: Synthetic oligonucleotide
  Target: ATXN1; (+) strand; PAM type: YTN; PAM sequence: CTC
aagtgtataactcaaatgtt

SEQ ID NO: 291564 - DNA, 20 bp, Artificial Sequence
  Description of Artificial Sequence: Synthetic oligonucleotide
  Target: ATXN1; (+) strand; PAM type: YTN; PAM sequence: CTC
aaatgttttttagtatagtc

SEQ ID NO: 291565 - DNA, 20 bp, Artificial Sequence
  Description of Artificial Sequence: Synthetic oligonucleotide
  Target: ATXN1; (+) strand; PAM type: YTN; PAM sequence: TTT
tttagtatagtcactgtttt

SEQ ID NO: 291566 - DNA, 20 bp, Artificial Sequence
  Description of Artificial Sequence: Synthetic oligonucleotide
  Target: ATXN1; (+) strand; PAM type: YTN; PAM sequence: TTT
ttagtatagtcactgttttg

SEQ ID NO: 291567 - DNA, 20 bp, Artificial Sequence
  Description of Artificial Sequence: Synthetic oligonucleotide
  Target: ATXN1; (+) strand; PAM type: YTN; PAM sequence: TTT
tagtatagtcactgttttgt

SEQ ID NO: 291568 - DNA, 20 bp, Artificial Sequence
  Description of Artificial Sequence: Synthetic oligonucleotide
  Target: ATXN1; (+) strand; PAM type: YTN; PAM sequence: TTT
agtatagtcactgttttgta

SEQ ID NO: 291569 - DNA, 20 bp, Artificial Sequence
  Description of Artificial Sequence: Synthetic oligonucleotide
  Target: ATXN1; (+) strand; PAM type: YTN; PAM sequence: TTA
gtatagtcactgttttgtaa

SEQ ID NO: 291570 - DNA, 20 bp, Artificial Sequence
  Description of Artificial Sequence: Synthetic oligonucleotide
  Target: ATXN1; (+) strand; PAM type: YTN; PAM sequence: CTG
ttttgtaaaaccaacatcac

SEQ ID NO: 291571 - DNA, 20 bp, Artificial Sequence
  Description of Artificial Sequence: Synthetic oligonucleotide
  Target: ATXN1; (+) strand; PAM type: YTN; PAM sequence: TTT
tgtaaaaccaacatcacaat

SEQ ID NO: 291572 - DNA, 20 bp, Artificial Sequence
  Description of Artificial Sequence: Synthetic oligonucleotide
  Target: ATXN1; (+) strand; PAM type: YTN; PAM sequence: TTT
gtaaaaccaacatcacaatc

SEQ ID NO: 291573 - DNA, 20 bp, Artificial Sequence
  Description of Artificial Sequence: Synthetic oligonucleotide
  Target: ATXN1; (+) strand; PAM type: YTN; PAM sequence: TTG
taaaaccaacatcacaatct

SEQ ID NO: 291574 - DNA, 20 bp, Artificial Sequence
  Description of Artificial Sequence: Synthetic oligonucleotide
  Target: ATXN1; (+) strand; PAM type: YTN; PAM sequence: CTA
attttagattttcttctcca

SEQ ID NO: 291575 - DNA, 20 bp, Artificial Sequence
  Description of Artificial Sequence: Synthetic oligonucleotide
  Target: ATXN1; (+) strand; PAM type: YTN; PAM sequence: TTT
tagattttcttctccaaaaa

SEQ ID NO: 291576 - DNA, 20 bp, Artificial Sequence
  Description of Artificial Sequence: Synthetic oligonucleotide
  Target: ATXN1; (+) strand; PAM type: YTN; PAM sequence: TTT
agattttcttctccaaaaaa

SEQ ID NO: 291577 - DNA, 20 bp, Artificial Sequence
  Description of Artificial Sequence: Synthetic oligonucleotide
  Target: ATXN1; (+) strand; PAM type: YTN; PAM sequence: TTA
gattttcttctccaaaaaag

SEQ ID NO: 291578 - DNA, 20 bp, Artificial Sequence
  Description of Artificial Sequence: Synthetic oligonucleotide
  Target: ATXN1; (+) strand; PAM type: YTN; PAM sequence: TTT
tcttctccaaaaaagaaacc

SEQ ID NO: 291579 - DNA, 20 bp, Artificial Sequence
  Description of Artificial Sequence: Synthetic oligonucleotide
  Target: ATXN1; (+) strand; PAM type: YTN; PAM sequence: TTT
cttctccaaaaaagaaaccc

SEQ ID NO: 291580 - DNA, 20 bp, Artificial Sequence
  Description of Artificial Sequence: Synthetic oligonucleotide
  Target: ATXN1; (+) strand; PAM type: YTN; PAM sequence: TTC
ttctccaaaaaagaaaccct

SEQ ID NO: 291581 - DNA, 20 bp, Artificial Sequence
  Description of Artificial Sequence: Synthetic oligonucleotide
  Target: ATXN1; (+) strand; PAM type: YTN; PAM sequence: CTT
ctccaaaaaagaaaccctgt

SEQ ID NO: 291582 - DNA, 20 bp, Artificial Sequence
  Description of Artificial Sequence: Synthetic oligonucleotide
  Target: ATXN1; (+) strand; PAM type: YTN; PAM sequence: TTC
tccaaaaaagaaaccctgtg

SEQ ID NO: 291583 - DNA, 20 bp, Artificial Sequence
  Description of Artificial Sequence: Synthetic oligonucleotide
  Target: ATXN1; (+) strand; PAM type: YTN; PAM sequence: CTC
caaaaaagaaaccctgtgta

SEQ ID NO: 291584 - DNA, 20 bp, Artificial Sequence
  Description of Artificial Sequence: Synthetic oligonucleotide
  Target: ATXN1; (+) strand; PAM type: YTN; PAM sequence: CTG
tgtacattagcagtcactct

SEQ ID NO: 291585 - DNA, 20 bp, Artificial Sequence
  Description of Artificial Sequence: Synthetic oligonucleotide
  Target: ATXN1; (+) strand; PAM type: YTN; PAM sequence: TTA
gcagtcactctgcattcctc

SEQ ID NO: 291586 - DNA, 20 bp, Artificial Sequence
  Description of Artificial Sequence: Synthetic oligonucleotide
  Target: ATXN1; (+) strand; PAM type: YTN; PAM sequence: CTC
tgcattcctctcccacctcc

SEQ ID NO: 291587 - DNA, 20 bp, Artificial Sequence
  Description of Artificial Sequence: Synthetic oligonucleotide
  Target: ATXN1; (+) strand; PAM type: YTN; PAM sequence: CTG
cattcctctcccacctccgg

SEQ ID NO: 291588 - DNA, 20 bp, Artificial Sequence
  Description of Artificial Sequence: Synthetic oligonucleotide
  Target: ATXN1; (+) strand; PAM type: YTN; PAM sequence: TTC
ctctcccacctccggcctct

SEQ ID NO: 291589 - DNA, 20 bp, Artificial Sequence
  Description of Artificial Sequence: Synthetic oligonucleotide
  Target: ATXN1; (+) strand; PAM type: YTN; PAM sequence: CTC
tcccacctccggcctctgca

SEQ ID NO: 291590 - DNA, 20 bp, Artificial Sequence
  Description of Artificial Sequence: Synthetic oligonucleotide
  Target: ATXN1; (+) strand; PAM type: YTN; PAM sequence: CTC
ccacctccggcctctgcaac

SEQ ID NO: 291591 - DNA, 20 bp, Artificial Sequence
  Description of Artificial Sequence: Synthetic oligonucleotide
  Target: ATXN1; (+) strand; PAM type: YTN; PAM sequence: CTC
cggcctctgcaacccccaaa

SEQ ID NO: 291592 - DNA, 20 bp, Artificial Sequence
  Description of Artificial Sequence: Synthetic oligonucleotide
  Target: ATXN1; (+) strand; PAM type: YTN; PAM sequence: CTC
tgcaacccccaaactaactt

SEQ ID NO: 291593 - DNA, 20 bp, Artificial Sequence
  Description of Artificial Sequence: Synthetic oligonucleotide
  Target: ATXN1; (+) strand; PAM type: YTN; PAM sequence: CTG
caacccccaaactaacttct

SEQ ID NO: 291594 - DNA, 20 bp, Artificial Sequence
  Description of Artificial Sequence: Synthetic oligonucleotide
  Target: ATXN1; (+) strand; PAM type: YTN; PAM sequence: CTA
acttctgtctctatggattt

SEQ ID NO: 291595 - DNA, 20 bp, Artificial Sequence
  Description of Artificial Sequence: Synthetic oligonucleotide
  Target: ATXN1; (+) strand; PAM type: YTN; PAM sequence: CTT
ctgtctctatggatttgtct

SEQ ID NO: 291596 - DNA, 20 bp, Artificial Sequence
  Description of Artificial Sequence: Synthetic oligonucleotide
  Target: ATXN1; (+) strand; PAM type: YTN; PAM sequence: TTC
tgtctctatggatttgtcta

SEQ ID NO: 291597 - DNA, 20 bp, Artificial Sequence
  Description of Artificial Sequence: Synthetic oligonucleotide
  Target: ATXN1; (+) strand; PAM type: YTN; PAM sequence: CTG
tctctatggatttgtctatt

SEQ ID NO: 291598 - DNA, 20 bp, Artificial Sequence
  Description of Artificial Sequence: Synthetic oligonucleotide
  Target: ATXN1; (+) strand; PAM type: YTN; PAM sequence: CTC
tatggatttgtctattctgg

SEQ ID NO: 291599 - DNA, 20 bp, Artificial Sequence
  Description of Artificial Sequence: Synthetic oligonucleotide
  Target: ATXN1; (+) strand; PAM type: YTN; PAM sequence: CTA
tggatttgtctattctggac

SEQ ID NO: 291600 - DNA, 20 bp, Artificial Sequence
  Description of Artificial Sequence: Synthetic oligonucleotide
  Target: ATXN1; (+) strand; PAM type: YTN; PAM sequence: TTT
gtctattctggacctttcat

SEQ ID NO: 291601 - DNA, 20 bp, Artificial Sequence
  Description of Artificial Sequence: Synthetic oligonucleotide
  Target: ATXN1; (+) strand; PAM type: YTN; PAM sequence: TTG
tctattctggacctttcata

SEQ ID NO: 291602 - DNA, 20 bp, Artificial Sequence
  Description of Artificial Sequence: Synthetic oligonucleotide
  Target: ATXN1; (+) strand; PAM type: YTN; PAM sequence: CTA
ttctggacctttcatataaa

SEQ ID NO: 291603 - DNA, 20 bp, Artificial Sequence
  Description of Artificial Sequence: Synthetic oligonucleotide
  Target: ATXN1; (+) strand; PAM type: YTN; PAM sequence: TTC
tggacctttcatataaatga

SEQ ID NO: 291604 - DNA, 20 bp, Artificial Sequence
  Description of Artificial Sequence: Synthetic oligonucleotide
  Target: ATXN1; (+) strand; PAM type: YTN; PAM sequence: CTG
gacctttcatataaatgaaa

SEQ ID NO: 291605 - DNA, 20 bp, Artificial Sequence
  Description of Artificial Sequence: Synthetic oligonucleotide
  Target: ATXN1; (+) strand; PAM type: YTN; PAM sequence: CTT
tcatataaatgaaattgaag

SEQ ID NO: 291606 - DNA, 20 bp, Artificial Sequence
  Description of Artificial Sequence: Synthetic oligonucleotide
  Target: ATXN1; (+) strand; PAM type: YTN; PAM sequence: TTT
catataaatgaaattgaagt

SEQ ID NO: 291607 - DNA, 20 bp, Artificial Sequence
  Description of Artificial Sequence: Synthetic oligonucleotide
  Target: ATXN1; (+) strand; PAM type: YTN; PAM sequence: TTC
atataaatgaaattgaagta

SEQ ID NO: 291608 - DNA, 20 bp, Artificial Sequence
  Description of Artificial Sequence: Synthetic oligonucleotide
  Target: ATXN1; (+) strand; PAM type: YTN; PAM sequence: TTG
aagtatgtggtctctcaatt

SEQ ID NO: 291609 - DNA, 20 bp, Artificial Sequence
  Description of Artificial Sequence: Synthetic oligonucleotide
  Target: ATXN1; (+) strand; PAM type: YTN; PAM sequence: CTC
tcaattcacatgatgttttg

SEQ ID NO: 291610 - DNA, 20 bp, Artificial Sequence
  Description of Artificial Sequence: Synthetic oligonucleotide
  Target: ATXN1; (+) strand; PAM type: YTN; PAM sequence: CTC
aattcacatgatgttttgag

SEQ ID NO: 291611 - DNA, 20 bp, Artificial Sequence
  Description of Artificial Sequence: Synthetic oligonucleotide
  Target: ATXN1; (+) strand; PAM type: YTN; PAM sequence: TTC
acatgatgttttgaggttca

SEQ ID NO: 291612 - DNA, 20 bp, Artificial Sequence
  Description of Artificial Sequence: Synthetic oligonucleotide
  Target: ATXN1; (+) strand; PAM type: YTN; PAM sequence: TTT
tgaggttcatctatgttgta

SEQ ID NO: 291613 - DNA, 20 bp, Artificial Sequence
  Description of Artificial Sequence: Synthetic oligonucleotide
  Target: ATXN1; (+) strand; PAM type: YTN; PAM sequence: TTT
gaggttcatctatgttgtag

SEQ ID NO: 291614 - DNA, 20 bp, Artificial Sequence
  Description of Artificial Sequence: Synthetic oligonucleotide
  Target: ATXN1; (+) strand; PAM type: YTN; PAM sequence: TTG
aggttcatctatgttgtagc

SEQ ID NO: 291615 - DNA, 20 bp, Artificial Sequence
  Description of Artificial Sequence: Synthetic oligonucleotide
  Target: ATXN1; (+) strand; PAM type: YTN; PAM sequence: TTC
atctatgttgtagcatgtat

SEQ ID NO: 291616 - DNA, 20 bp, Artificial Sequence
  Description of Artificial Sequence: Synthetic oligonucleotide
  Target: ATXN1; (+) strand; PAM type: YTN; PAM sequence: CTA
tgttgtagcatgtattaata

SEQ ID NO: 291617 - DNA, 20 bp, Artificial Sequence
  Description of Artificial Sequence: Synthetic oligonucleotide
  Target: ATXN1; (+) strand; PAM type: YTN; PAM sequence: TTG
tagcatgtattaatactttg

SEQ ID NO: 291618 - DNA, 20 bp, Artificial Sequence
  Description of Artificial Sequence: Synthetic oligonucleotide
  Target: ATXN1; (+) strand; PAM type: YTN; PAM sequence: TTA
atactttgcttactggttgt

SEQ ID NO: 291619 - DNA, 20 bp, Artificial Sequence
  Description of Artificial Sequence: Synthetic oligonucleotide
  Target: ATXN1; (+) strand; PAM type: YTN; PAM sequence: CTT
tgcttactggttgttttttt

SEQ ID NO: 291620 - DNA, 20 bp, Artificial Sequence
  Description of Artificial Sequence: Synthetic oligonucleotide
  Target: ATXN1; (+) strand; PAM type: YTN; PAM sequence: TTT
gcttactggttgtttttttc

SEQ ID NO: 291621 - DNA, 20 bp, Artificial Sequence
  Description of Artificial Sequence: Synthetic oligonucleotide
  Target: ATXN1; (+) strand; PAM type: YTN; PAM sequence: TTG
cttactggttgtttttttcc

SEQ ID NO: 291622 - DNA, 20 bp, Artificial Sequence
  Description of Artificial Sequence: Synthetic oligonucleotide
  Target: ATXN1; (+) strand; PAM type: YTN; PAM sequence: CTT
actggttgtttttttcctga

SEQ ID NO: 291623 - DNA, 20 bp, Artificial Sequence
  Description of Artificial Sequence: Synthetic oligonucleotide
  Target: ATXN1; (+) strand; PAM type: YTN; PAM sequence: TTA
ctggttgtttttttcctgat

SEQ ID NO: 291624 - DNA, 20 bp, Artificial Sequence
  Description of Artificial Sequence: Synthetic oligonucleotide
  Target: ATXN1; (+) strand; PAM type: YTN; PAM sequence: CTG
gttgtttttttcctgatcaa

SEQ ID NO: 291625 - DNA, 20 bp, Artificial Sequence
  Description of Artificial Sequence: Synthetic oligonucleotide
  Target: ATXN1; (+) strand; PAM type: YTN; PAM sequence: TTG
tttttttcctgatcaatatt

SEQ ID NO: 291626 - DNA, 20 bp, Artificial Sequence
  Description of Artificial Sequence: Synthetic oligonucleotide
  Target: ATXN1; (+) strand; PAM type: YTN; PAM sequence: TTT
ttttcctgatcaatattcca

SEQ ID NO: 291627 - DNA, 20 bp, Artificial Sequence
  Description of Artificial Sequence: Synthetic oligonucleotide
  Target: ATXN1; (+) strand; PAM type: YTN; PAM sequence: TTT
tttcctgatcaatattccat

SEQ ID NO: 291628 - DNA, 20 bp, Artificial Sequence
  Description of Artificial Sequence: Synthetic oligonucleotide
  Target: ATXN1; (+) strand; PAM type: YTN; PAM sequence: TTT
ttcctgatcaatattccatt

SEQ ID NO: 291629 - DNA, 20 bp, Artificial Sequence
  Description of Artificial Sequence: Synthetic oligonucleotide
  Target: ATXN1; (+) strand; PAM type: YTN; PAM sequence: TTT
tcctgatcaatattccatta

SEQ ID NO: 291630 - DNA, 20 bp, Artificial Sequence
  Description of Artificial Sequence: Synthetic oligonucleotide
  Target: ATXN1; (+) strand; PAM type: YTN; PAM sequence: TTT
cctgatcaatattccattaa

SEQ ID NO: 291631 - DNA, 20 bp, Artificial Sequence
  Description of Artificial Sequence: Synthetic oligonucleotide
  Target: ATXN1; (+) strand; PAM type: YTN; PAM sequence: TTC
ctgatcaatattccattaaa

SEQ ID NO: 291632 - DNA, 20 bp, Artificial Sequence
  Description of Artificial Sequence: Synthetic oligonucleotide
  Target: ATXN1; (+) strand; PAM type: YTN; PAM sequence: CTG
atcaatattccattaaacat

SEQ ID NO: 291633 - DNA, 20 bp, Artificial Sequence
  Description of Artificial Sequence: Synthetic oligonucleotide
  Target: ATXN1; (+) strand; PAM type: YTN; PAM sequence: TTC
cattaaacatttattttgcg

SEQ ID NO: 291634 - DNA, 20 bp, Artificial Sequence
  Description of Artificial Sequence: Synthetic oligonucleotide
  Target: ATXN1; (+) strand; PAM type: YTN; PAM sequence: TTA
aacatttattttgcgtgtgt

SEQ ID NO: 291635 - DNA, 20 bp, Artificial Sequence
  Description of Artificial Sequence: Synthetic oligonucleotide
  Target: ATXN1; (+) strand; PAM type: YTN; PAM sequence: TTT
attttgcgtgtgtgtgtgtg

SEQ ID NO: 291636 - DNA, 20 bp, Artificial Sequence
  Description of Artificial Sequence: Synthetic oligonucleotide
  Target: ATXN1; (+) strand; PAM type: YTN; PAM sequence: TTA
ttttgcgtgtgtgtgtgtga

SEQ ID NO: 291637 - DNA, 20 bp, Artificial Sequence
  Description of Artificial Sequence: Synthetic oligonucleotide
  Target: ATXN1; (+) strand; PAM type: YTN; PAM sequence: TTT
tgcgtgtgtgtgtgtgagga

SEQ ID NO: 291638 - DNA, 20 bp, Artificial Sequence
  Description of Artificial Sequence: Synthetic oligonucleotide
  Target: ATXN1; (+) strand; PAM type: YTN; PAM sequence: TTT
gcgtgtgtgtgtgtgaggag

SEQ ID NO: 291639 - DNA, 20 bp, Artificial Sequence
  Description of Artificial Sequence: Synthetic oligonucleotide
  Target: ATXN1; (+) strand; PAM type: YTN; PAM sequence: TTG
cgtgtgtgtgtgtgaggagg

SEQ ID NO: 291640 - DNA, 20 bp, Artificial Sequence
  Description of Artificial Sequence: Synthetic oligonucleotide
  Target: ATXN1; (+) strand; PAM type: YTN; PAM sequence: TTT
catgagtgcagagtgctcag

SEQ ID NO: 291641 - DNA, 20 bp, Artificial Sequence
  Description of Artificial Sequence: Synthetic oligonucleotide
  Target: ATXN1; (+) strand; PAM type: YTN; PAM sequence: TTC
atgagtgcagagtgctcagc

SEQ ID NO: 291642 - DNA, 20 bp, Artificial Sequence
  Description of Artificial Sequence: Synthetic oligonucleotide
  Target: ATXN1; (+) strand; PAM type: YTN; PAM sequence: CTC
agctcagtacttggagacac

SEQ ID NO: 291643 - DNA, 20 bp, Artificial Sequence
  Description of Artificial Sequence: Synthetic oligonucleotide
  Target: ATXN1; (+) strand; PAM type: YTN; PAM sequence: CTC
agtacttggagacacagcac

SEQ ID NO: 291644 - DNA, 20 bp, Artificial Sequence
  Description of Artificial Sequence: Synthetic oligonucleotide
  Target: ATXN1; (+) strand; PAM type: YTN; PAM sequence: CTT
ggagacacagcactctgaaa

SEQ ID NO: 291645 - DNA, 20 bp, Artificial Sequence
  Description of Artificial Sequence: Synthetic oligonucleotide
  Target: ATXN1; (+) strand; PAM type: YTN; PAM sequence: TTG
gagacacagcactctgaaaa

SEQ ID NO: 291646 - DNA, 20 bp, Artificial Sequence
  Description of Artificial Sequence: Synthetic oligonucleotide
  Target: ATXN1; (+) strand; PAM type: YTN; PAM sequence: CTC
tgaaaatgtctgtagctttc

SEQ ID NO: 291647 - DNA, 20 bp, Artificial Sequence
  Description of Artificial Sequence: Synthetic oligonucleotide
  Target: ATXN1; (+) strand; PAM type: YTN; PAM sequence: CTG
aaaatgtctgtagctttcat

SEQ ID NO: 291648 - DNA, 20 bp, Artificial Sequence
  Description of Artificial Sequence: Synthetic oligonucleotide
  Target: ATXN1; (+) strand; PAM type: YTN; PAM sequence: CTG
tagctttcattaccattggc

SEQ ID NO: 291649 - DNA, 20 bp, Artificial Sequence
  Description of Artificial Sequence: Synthetic oligonucleotide
  Target: ATXN1; (+) strand; PAM type: YTN; PAM sequence: CTT
tcattaccattggcattatt

SEQ ID NO: 291650 - DNA, 20 bp, Artificial Sequence
  Description of Artificial Sequence: Synthetic oligonucleotide
  Target: ATXN1; (+) strand; PAM type: YTN; PAM sequence: TTT
cattaccattggcattatta

SEQ ID NO: 291651 - DNA, 20 bp, Artificial Sequence
  Description of Artificial Sequence: Synthetic oligonucleotide
  Target: ATXN1; (+) strand; PAM type: YTN; PAM sequence: TTC
attaccattggcattattac

SEQ ID NO: 291652 - DNA, 20 bp, Artificial Sequence
  Description of Artificial Sequence: Synthetic oligonucleotide
  Target: ATXN1; (+) strand; PAM type: YTN; PAM sequence: TTA
ccattggcattattactatc

SEQ ID NO: 291653 - DNA, 20 bp, Artificial Sequence
  Description of Artificial Sequence: Synthetic oligonucleotide
  Target: ATXN1; (+) strand; PAM type: YTN; PAM sequence: TTG
gcattattactatcgttttg

SEQ ID NO: 291654 - DNA, 20 bp, Artificial Sequence
  Description of Artificial Sequence: Synthetic oligonucleotide
  Target: ATXN1; (+) strand; PAM type: YTN; PAM sequence: TTA
ttactatcgttttgtcactt

SEQ ID NO: 291655 - DNA, 20 bp, Artificial Sequence
  Description of Artificial Sequence: Synthetic oligonucleotide
  Target: ATXN1; (+) strand; PAM type: YTN; PAM sequence: TTA
ctatcgttttgtcacttttg

SEQ ID NO: 291656 - DNA, 20 bp, Artificial Sequence
  Description of Artificial Sequence: Synthetic oligonucleotide
  Target: ATXN1; (+) strand; PAM type: YTN; PAM sequence: CTA
tcgttttgtcacttttgttt

SEQ ID NO: 291657 - DNA, 20 bp, Artificial Sequence
  Description of Artificial Sequence: Synthetic oligonucleotide
  Target: ATXN1; (+) strand; PAM type: YTN; PAM sequence: TTT
tgtcacttttgtttacaatt

SEQ ID NO: 291658 - DNA, 20 bp, Artificial Sequence
  Description of Artificial Sequence: Synthetic oligonucleotide
  Target: ATXN1; (+) strand; PAM type: YTN; PAM sequence: TTT
gtcacttttgtttacaattg

SEQ ID NO: 291659 - DNA, 20 bp, Artificial Sequence
  Description of Artificial Sequence: Synthetic oligonucleotide
  Target: ATXN1; (+) strand; PAM type: YTN; PAM sequence: TTG
tcacttttgtttacaattgc

SEQ ID NO: 291660 - DNA, 20 bp, Artificial Sequence
  Description of Artificial Sequence: Synthetic oligonucleotide
  Target: ATXN1; (+) strand; PAM type: YTN; PAM sequence: CTT
ttgtttacaattgcactggt

SEQ ID NO: 291661 - DNA, 20 bp, Artificial Sequence
  Description of Artificial Sequence: Synthetic oligonucleotide
  Target: ATXN1; (+) strand; PAM type: YTN; PAM sequence: TTT
tgtttacaattgcactggtc

SEQ ID NO: 291662 - DNA, 20 bp, Artificial Sequence
  Description of Artificial Sequence: Synthetic oligonucleotide
  Target: ATXN1; (+) strand; PAM type: YTN; PAM sequence: TTT
gtttacaattgcactggtct

SEQ ID NO: 291663 - DNA, 20 bp, Artificial Sequence
  Description of Artificial Sequence: Synthetic oligonucleotide
  Target: ATXN1; (+) strand; PAM type: YTN; PAM sequence: TTG
tttacaattgcactggtctc

SEQ ID NO: 291664 - DNA, 20 bp, Artificial Sequence
  Description of Artificial Sequence: Synthetic oligonucleotide
  Target: ATXN1; (+) strand; PAM type: YTN; PAM sequence: TTT
acaattgcactggtctccac

SEQ ID NO: 291665 - DNA, 20 bp, Artificial Sequence
  Description of Artificial Sequence: Synthetic oligonucleotide
  Target: ATXN1; (+) strand; PAM type: YTN; PAM sequence: TTA
caattgcactggtctccacc

SEQ ID NO: 291666 - DNA, 20 bp, Artificial Sequence
  Description of Artificial Sequence: Synthetic oligonucleotide
  Target: ATXN1; (+) strand; PAM type: YTN; PAM sequence: TTG
cactggtctccaccagttga

SEQ ID NO: 291667 - DNA, 20 bp, Artificial Sequence
  Description of Artificial Sequence: Synthetic oligonucleotide
  Target: ATXN1; (+) strand; PAM type: YTN; PAM sequence: CTG
gtctccaccagttgattatt

SEQ ID NO: 291668 - DNA, 20 bp, Artificial Sequence
  Description of Artificial Sequence: Synthetic oligonucleotide
  Target: ATXN1; (+) strand; PAM type: YTN; PAM sequence: CTC
caccagttgattattaagct

SEQ ID NO: 291669 - DNA, 20 bp, Artificial Sequence
  Description of Artificial Sequence: Synthetic oligonucleotide
  Target: ATXN1; (+) strand; PAM type: YTN; PAM sequence: TTG
attattaagctctagagcag

SEQ ID NO: 291670 - DNA, 20 bp, Artificial Sequence
  Description of Artificial Sequence: Synthetic oligonucleotide
  Target: ATXN1; (+) strand; PAM type: YTN; PAM sequence: TTA
ttaagctctagagcaggggt

SEQ ID NO: 291671 - DNA, 20 bp, Artificial Sequence
  Description of Artificial Sequence: Synthetic oligonucleotide
  Target: ATXN1; (+) strand; PAM type: YTN; PAM sequence: TTA
agctctagagcaggggttcc

SEQ ID NO: 291672 - DNA, 20 bp, Artificial Sequence
  Description of Artificial Sequence: Synthetic oligonucleotide
  Target: ATXN1; (+) strand; PAM type: YTN; PAM sequence: CTC
tagagcaggggttcccaacc

SEQ ID NO: 291673 - DNA, 20 bp, Artificial Sequence
  Description of Artificial Sequence: Synthetic oligonucleotide
  Target: ATXN1; (+) strand; PAM type: YTN; PAM sequence: CTA
gagcaggggttcccaacccc

SEQ ID NO: 291674 - DNA, 20 bp, Artificial Sequence
  Description of Artificial Sequence: Synthetic oligonucleotide
  Target: ATXN1; (+) strand; PAM type: YTN; PAM sequence: TTC
ccaacccctgggctacagac

SEQ ID NO: 291675 - DNA, 20 bp, Artificial Sequence
  Description of Artificial Sequence: Synthetic oligonucleotide
  Target: ATXN1; (+) strand; PAM type: YTN; PAM sequence: CTG
ggctacagacctcctgcaca

SEQ ID NO: 291676 - DNA, 20 bp, Artificial Sequence
  Description of Artificial Sequence: Synthetic oligonucleotide
  Target: ATXN1; (+) strand; PAM type: YTN; PAM sequence: CTA
cagacctcctgcacaacagg

SEQ ID NO: 291677 - DNA, 20 bp, Artificial Sequence
  Description of Artificial Sequence: Synthetic oligonucleotide
  Target: ATXN1; (+) strand; PAM type: YTN; PAM sequence: CTC
ctgcacaacaggaggtgagc

SEQ ID NO: 291678 - DNA, 20 bp, Artificial Sequence
  Description of Artificial Sequence: Synthetic oligonucleotide
  Target: ATXN1; (+) strand; PAM type: YTN; PAM sequence: CTG
cacaacaggaggtgagcagt

SEQ ID NO: 291679 - DNA, 20 bp, Artificial Sequence
  Description of Artificial Sequence: Synthetic oligonucleotide
  Target: ATXN1; (+) strand; PAM type: YTN; PAM sequence: CTT
catctgtatttacagccact

SEQ ID NO: 291680 - DNA, 20 bp, Artificial Sequence
  Description of Artificial Sequence: Synthetic oligonucleotide
  Target: ATXN1; (+) strand; PAM type: YTN; PAM sequence: TTC
atctgtatttacagccactc

SEQ ID NO: 291681 - DNA, 20 bp, Artificial Sequence
  Description of Artificial Sequence: Synthetic oligonucleotide
  Target: ATXN1; (+) strand; PAM type: YTN; PAM sequence: CTG
tatttacagccactccccat

SEQ ID NO: 291682 - DNA, 20 bp, Artificial Sequence
  Description of Artificial Sequence: Synthetic oligonucleotide
  Target: ATXN1; (+) strand; PAM type: YTN; PAM sequence: TTT
acagccactccccattgttc

SEQ ID NO: 291683 - DNA, 20 bp, Artificial Sequence
  Description of Artificial Sequence: Synthetic oligonucleotide
  Target: ATXN1; (+) strand; PAM type: YTN; PAM sequence: TTA
cagccactccccattgttca

SEQ ID NO: 291684 - DNA, 20 bp, Artificial Sequence
  Description of Artificial Sequence: Synthetic oligonucleotide
  Target: ATXN1; (+) strand; PAM type: YTN; PAM sequence: CTC
cccattgttcaaattaccac

SEQ ID NO: 291685 - DNA, 20 bp, Artificial Sequence
  Description of Artificial Sequence: Synthetic oligonucleotide
  Target: ATXN1; (+) strand; PAM type: YTN; PAM sequence: TTG
ttcaaattaccacctgagct

SEQ ID NO: 291686 - DNA, 20 bp, Artificial Sequence
  Description of Artificial Sequence: Synthetic oligonucleotide
  Target: ATXN1; (+) strand; PAM type: YTN; PAM sequence: TTC
aaattaccacctgagctctg

SEQ ID NO: 291687 - DNA, 20 bp, Artificial Sequence
  Description of Artificial Sequence: Synthetic oligonucleotide
  Target: ATXN1; (+) strand; PAM type: YTN; PAM sequence: TTA
ccacctgagctctgcctcct

SEQ ID NO: 291688 - DNA, 20 bp, Artificial Sequence
  Description of Artificial Sequence: Synthetic oligonucleotide
  Target: ATXN1; (+) strand; PAM type: YTN; PAM sequence: CTG
agctctgcctcctgtcaggt

SEQ ID NO: 291689 - DNA, 20 bp, Artificial Sequence
  Description of Artificial Sequence: Synthetic oligonucleotide
  Target: ATXN1; (+) strand; PAM type: YTN; PAM sequence: CTC
tgcctcctgtcaggtcagca

SEQ ID NO: 291690 - DNA, 20 bp, Artificial Sequence
  Description of Artificial Sequence: Synthetic oligonucleotide
  Target: ATXN1; (+) strand; PAM type: YTN; PAM sequence: CTG
cctcctgtcaggtcagcaac

SEQ ID NO: 291691 - DNA, 20 bp, Artificial Sequence
  Description of Artificial Sequence: Synthetic oligonucleotide
  Target: ATXN1; (+) strand; PAM type: YTN; PAM sequence: CTC
ctgtcaggtcagcaacggca

SEQ ID NO: 291692 - DNA, 20 bp, Artificial Sequence
  Description of Artificial Sequence: Synthetic oligonucleotide
  Target: ATXN1; (+) strand; PAM type: YTN; PAM sequence: CTG
tcaggtcagcaacggcatga

SEQ ID NO: 291693 - DNA, 20 bp, Artificial Sequence
  Description of Artificial Sequence: Synthetic oligonucleotide
  Target: ATXN1; (+) strand; PAM type: YTN; PAM sequence: TTC
tcataggagcgtgaacccta

SEQ ID NO: 291694 - DNA, 20 bp, Artificial Sequence
  Description of Artificial Sequence: Synthetic oligonucleotide
  Target: ATXN1; (+) strand; PAM type: YTN; PAM sequence: CTC
ataggagcgtgaaccctatt

SEQ ID NO: 291695 - DNA, 20 bp, Artificial Sequence
  Description of Artificial Sequence: Synthetic oligonucleotide
  Target: ATXN1; (+) strand; PAM type: YTN; PAM sequence: CTA
ttgtgaactgcacatgtgag

SEQ ID NO: 291696 - DNA, 20 bp, Artificial Sequence
  Description of Artificial Sequence: Synthetic oligonucleotide
  Target: ATXN1; (+) strand; PAM type: YTN; PAM sequence: TTG
tgaactgcacatgtgaggga

SEQ ID NO: 291697 - DNA, 20 bp, Artificial Sequence
  Description of Artificial Sequence: Synthetic oligonucleotide
  Target: ATXN1; (+) strand; PAM type: YTN; PAM sequence: CTG
cacatgtgagggatgtaggt

SEQ ID NO: 291698 - DNA, 20 bp, Artificial Sequence
  Description of Artificial Sequence: Synthetic oligonucleotide
  Target: ATXN1; (+) strand; PAM type: YTN; PAM sequence: TTG
caccctctttatgagaatct

SEQ ID NO: 291699 - DNA, 20 bp, Artificial Sequence
  Description of Artificial Sequence: Synthetic oligonucleotide
  Target: ATXN1; (+) strand; PAM type: YTN; PAM sequence: CTC
tttatgagaatctaatgcct

SEQ ID NO: 291700 - DNA, 20 bp, Artificial Sequence
  Description of Artificial Sequence: Synthetic oligonucleotide
  Target: ATXN1; (+) strand; PAM type: YTN; PAM sequence: CTT
tatgagaatctaatgcctga

SEQ ID NO: 291701 - DNA, 20 bp, Artificial Sequence
  Description of Artificial Sequence: Synthetic oligonucleotide
  Target: ATXN1; (+) strand; PAM type: YTN; PAM sequence: TTT
atgagaatctaatgcctgat

SEQ ID NO: 291702 - DNA, 20 bp, Artificial Sequence
  Description of Artificial Sequence: Synthetic oligonucleotide
  Target: ATXN1; (+) strand; PAM type: YTN; PAM sequence: TTA
tgagaatctaatgcctgatg

SEQ ID NO: 291703 - DNA, 20 bp, Artificial Sequence
  Description of Artificial Sequence: Synthetic oligonucleotide
  Target: ATXN1; (+) strand; PAM type: YTN; PAM sequence: CTA
atgcctgatgatctgtcact

SEQ ID NO: 291704 - DNA, 20 bp, Artificial Sequence
  Description of Artificial Sequence: Synthetic oligonucleotide
  Target: ATXN1; (+) strand; PAM type: YTN; PAM sequence: CTG
atgatctgtcactgtctccc

SEQ ID NO: 291705 - DNA, 20 bp, Artificial Sequence
  Description of Artificial Sequence: Synthetic oligonucleotide
  Target: ATXN1; (+) strand; PAM type: YTN; PAM sequence: CTG
tcactgtctcccatcacccc

SEQ ID NO: 291706 - DNA, 20 bp, Artificial Sequence
  Description of Artificial Sequence: Synthetic oligonucleotide
  Target: ATXN1; (+) strand; PAM type: YTN; PAM sequence: CTG
tctcccatcacccctagatg

SEQ ID NO: 291707 - DNA, 20 bp, Artificial Sequence
  Description of Artificial Sequence: Synthetic oligonucleotide
  Target: ATXN1; (+) strand; PAM type: YTN; PAM sequence: CTC
ccatcacccctagatgggac

SEQ ID NO: 291708 - DNA, 20 bp, Artificial Sequence
  Description of Artificial Sequence: Synthetic oligonucleotide
  Target: ATXN1; (+) strand; PAM type: YTN; PAM sequence: CTA
gatgggaccgttttgttgca

SEQ ID NO: 291709 - DNA, 20 bp, Artificial Sequence
  Description of Artificial Sequence: Synthetic oligonucleotide
  Target: ATXN1; (+) strand; PAM type: YTN; PAM sequence: TTT
tgttgcaggaaaacaagctc

SEQ ID NO: 291710 - DNA, 20 bp, Artificial Sequence
  Description of Artificial Sequence: Synthetic oligonucleotide
  Target: ATXN1; (+) strand; PAM type: YTN; PAM sequence: TTT
gttgcaggaaaacaagctca

SEQ ID NO: 291711 - DNA, 20 bp, Artificial Sequence
  Description of Artificial Sequence: Synthetic oligonucleotide
  Target: ATXN1; (+) strand; PAM type: YTN; PAM sequence: TTG
ttgcaggaaaacaagctcaa

SEQ ID NO: 291712 - DNA, 20 bp, Artificial Sequence
  Description of Artificial Sequence: Synthetic oligonucleotide
  Target: ATXN1; (+) strand; PAM type: YTN; PAM sequence: TTG
caggaaaacaagctcaagga

SEQ ID NO: 291713 - DNA, 20 bp, Artificial Sequence
  Description of Artificial Sequence: Synthetic oligonucleotide
  Target: ATXN1; (+) strand; PAM type: YTN; PAM sequence: CTC
aaggatctcactgattctac

SEQ ID NO: 291714 - DNA, 20 bp, Artificial Sequence
  Description of Artificial Sequence: Synthetic oligonucleotide
  Target: ATXN1; (+) strand; PAM type: YTN; PAM sequence: CTC
actgattctacattatggtg

SEQ ID NO: 291715 - DNA, 20 bp, Artificial Sequence
  Description of Artificial Sequence: Synthetic oligonucleotide
  Target: ATXN1; (+) strand; PAM type: YTN; PAM sequence: CTG
attctacattatggtgagtt

SEQ ID NO: 291716 - DNA, 20 bp, Artificial Sequence
  Description of Artificial Sequence: Synthetic oligonucleotide
  Target: ATXN1; (+) strand; PAM type: YTN; PAM sequence: TTC
tacattatggtgagttgcat

SEQ ID NO: 291717 - DNA, 20 bp, Artificial Sequence
  Description of Artificial Sequence: Synthetic oligonucleotide
  Target: ATXN1; (+) strand; PAM type: YTN; PAM sequence: CTA
cattatggtgagttgcataa

SEQ ID NO: 291718 - DNA, 20 bp, Artificial Sequence
  Description of Artificial Sequence: Synthetic oligonucleotide
  Target: ATXN1; (+) strand; PAM type: YTN; PAM sequence: TTA
tggtgagttgcataattatt

SEQ ID NO: 291719 - DNA, 20 bp, Artificial Sequence
  Description of Artificial Sequence: Synthetic oligonucleotide
  Target: ATXN1; (+) strand; PAM type: YTN; PAM sequence: TTG
cataattatttcattatata

SEQ ID NO: 291720 - DNA, 20 bp, Artificial Sequence
  Description of Artificial Sequence: Synthetic oligonucleotide
  Target: ATXN1; (+) strand; PAM type: YTN; PAM sequence: TTA
tttcattatatattacaaca

SEQ ID NO: 291721 - DNA, 20 bp, Artificial Sequence
  Description of Artificial Sequence: Synthetic oligonucleotide
  Target: ATXN1; (+) strand; PAM type: YTN; PAM sequence: TTT
cattatatattacaacataa

SEQ ID NO: 291722 - DNA, 20 bp, Artificial Sequence
  Description of Artificial Sequence: Synthetic oligonucleotide
  Target: ATXN1; (+) strand; PAM type: YTN; PAM sequence: TTC
attatatattacaacataat

SEQ ID NO: 291723 - DNA, 20 bp, Artificial Sequence
  Description of Artificial Sequence: Synthetic oligonucleotide
  Target: ATXN1; (+) strand; PAM type: YTN; PAM sequence: TTA
tatattacaacataataata

SEQ ID NO: 291724 - DNA, 20 bp, Artificial Sequence
  Description of Artificial Sequence: Synthetic oligonucleotide
  Target: ATXN1; (+) strand; PAM type: YTN; PAM sequence: TTA
caacataataatataaataa

SEQ ID NO: 291725 - DNA, 20 bp, Artificial Sequence
  Description of Artificial Sequence: Synthetic oligonucleotide
  Target: ATXN1; (+) strand; PAM type: YTN; PAM sequence: TTT
gaatcatcccaaaaccatcc

SEQ ID NO: 291726 - DNA, 20 bp, Artificial Sequence
  Description of Artificial Sequence: Synthetic oligonucleotide
  Target: ATXN1; (+) strand; PAM type: YTN; PAM sequence: TTG
aatcatcccaaaaccatccc

SEQ ID NO: 291727 - DNA, 20 bp, Artificial Sequence
  Description of Artificial Sequence: Synthetic oligonucleotide
  Target: ATXN1; (+) strand; PAM type: YTN; PAM sequence: CTC
caccctagtctgtggaaaaa

SEQ ID NO: 291728 - DNA, 20 bp, Artificial Sequence
  Description of Artificial Sequence: Synthetic oligonucleotide
  Target: ATXN1; (+) strand; PAM type: YTN; PAM sequence: CTA
gtctgtggaaaaactgtctt

SEQ ID NO: 291729 - DNA, 20 bp, Artificial Sequence
  Description of Artificial Sequence: Synthetic oligonucleotide
  Target: ATXN1; (+) strand; PAM type: YTN; PAM sequence: CTG
tggaaaaactgtcttccatg

SEQ ID NO: 291730 - DNA, 20 bp, Artificial Sequence
  Description of Artificial Sequence: Synthetic oligonucleotide
  Target: ATXN1; (+) strand; PAM type: YTN; PAM sequence: CTG
tcttccatgaaaccagtccc

SEQ ID NO: 291731 - DNA, 20 bp, Artificial Sequence
  Description of Artificial Sequence: Synthetic oligonucleotide
  Target: ATXN1; (+) strand; PAM type: YTN; PAM sequence: CTT
ccatgaaaccagtccctggt

SEQ ID NO: 291732 - DNA, 20 bp, Artificial Sequence
  Description of Artificial Sequence: Synthetic oligonucleotide
  Target: ATXN1; (+) strand; PAM type: YTN; PAM sequence: TTC
catgaaaccagtccctggtg

SEQ ID NO: 291733 - DNA, 20 bp, Artificial Sequence
  Description of Artificial Sequence: Synthetic oligonucleotide
  Target: ATXN1; (+) strand; PAM type: YTN; PAM sequence: CTG
gtgccaaaaaggttagggac

SEQ ID NO: 291734 - DNA, 20 bp, Artificial Sequence
  Description of Artificial Sequence: Synthetic oligonucleotide
  Target: ATXN1; (+) strand; PAM type: YTN; PAM sequence: TTA
gggaccactggtctagagag

SEQ ID NO: 291735 - DNA, 20 bp, Artificial Sequence
  Description of Artificial Sequence: Synthetic oligonucleotide
  Target: ATXN1; (+) strand; PAM type: YTN; PAM sequence: CTG
gtctagagagaaggagctct

SEQ ID NO: 291736 - DNA, 20 bp, Artificial Sequence
  Description of Artificial Sequence: Synthetic oligonucleotide
  Target: ATXN1; (+) strand; PAM type: YTN; PAM sequence: CTA
gagagaaggagctcttctta

SEQ ID NO: 291737 - DNA, 20 bp, Artificial Sequence
  Description of Artificial Sequence: Synthetic oligonucleotide
  Target: ATXN1; (+) strand; PAM type: YTN; PAM sequence: CTC
ttcttacacactgcccagaa

SEQ ID NO: 291738 - DNA, 20 bp, Artificial Sequence
  Description of Artificial Sequence: Synthetic oligonucleotide
  Target: ATXN1; (+) strand; PAM type: YTN; PAM sequence: CTT
cttacacactgcccagaaac

SEQ ID NO: 291739 - DNA, 20 bp, Artificial Sequence
  Description of Artificial Sequence: Synthetic oligonucleotide
  Target: ATXN1; (+) strand; PAM type: YTN; PAM sequence: TTC
ttacacactgcccagaaact

SEQ ID NO: 291740 - DNA, 20 bp, Artificial Sequence
  Description of Artificial Sequence: Synthetic oligonucleotide
  Target: ATXN1; (+) strand; PAM type: YTN; PAM sequence: CTT
acacactgcccagaaactga

SEQ ID NO: 291741 - DNA, 20 bp, Artificial Sequence
  Description of Artificial Sequence: Synthetic oligonucleotide
  Target: ATXN1; (+) strand; PAM type: YTN; PAM sequence: TTA
cacactgcccagaaactgag

SEQ ID NO: 291742 - DNA, 20 bp, Artificial Sequence
  Description of Artificial Sequence: Synthetic oligonucleotide
  Target: ATXN1; (+) strand; PAM type: YTN; PAM sequence: CTG
cccagaaactgaggatgtga

SEQ ID NO: 291743 - DNA, 20 bp, Artificial Sequence
  Description of Artificial Sequence: Synthetic oligonucleotide
  Target: ATXN1; (+) strand; PAM type: YTN; PAM sequence: CTG
aggatgtgacagaagttcaa

SEQ ID NO: 291744 - DNA, 20 bp, Artificial Sequence
  Description of Artificial Sequence: Synthetic oligonucleotide
  Target: ATXN1; (+) strand; PAM type: YTN; PAM sequence: TTC
aacgagagctaactaaacaa

SEQ ID NO: 291745 - DNA, 20 bp, Artificial Sequence
  Description of Artificial Sequence: Synthetic oligonucleotide
  Target: ATXN1; (+) strand; PAM type: YTN; PAM sequence: CTA
actaaacaactaagtagcaa

SEQ ID NO: 291746 - DNA, 20 bp, Artificial Sequence
  Description of Artificial Sequence: Synthetic oligonucleotide
  Target: ATXN1; (+) strand; PAM type: YTN; PAM sequence: CTA
aacaactaagtagcaacctg

SEQ ID NO: 291747 - DNA, 20 bp, Artificial Sequence
  Description of Artificial Sequence: Synthetic oligonucleotide
  Target: ATXN1; (+) strand; PAM type: YTN; PAM sequence: CTA
agtagcaacctgacaagggc

SEQ ID NO: 291748 - DNA, 20 bp, Artificial Sequence
  Description of Artificial Sequence: Synthetic oligonucleotide
  Target: ATXN1; (+) strand; PAM type: YTN; PAM sequence: CTG
acaagggctcagacagctcc

SEQ ID NO: 291749 - DNA, 20 bp, Artificial Sequence
  Description of Artificial Sequence: Synthetic oligonucleotide
  Target: ATXN1; (+) strand; PAM type: YTN; PAM sequence: CTC
agacagctccaactaaacct

SEQ ID NO: 291750 - DNA, 20 bp, Artificial Sequence
  Description of Artificial Sequence: Synthetic oligonucleotide
  Target: ATXN1; (+) strand; PAM type: YTN; PAM sequence: CTC
caactaaacctacactgctg

SEQ ID NO: 291751 - DNA, 20 bp, Artificial Sequence
  Description of Artificial Sequence: Synthetic oligonucleotide
  Target: ATXN1; (+) strand; PAM type: YTN; PAM sequence: CTA
aacctacactgctgctgccg

SEQ ID NO: 291752 - DNA, 20 bp, Artificial Sequence
  Description of Artificial Sequence: Synthetic oligonucleotide
  Target: ATXN1; (+) strand; PAM type: YTN; PAM sequence: CTA
cactgctgctgccgcttaca

SEQ ID NO: 291753 - DNA, 20 bp, Artificial Sequence
  Description of Artificial Sequence: Synthetic oligonucleotide
  Target: ATXN1; (+) strand; PAM type: YTN; PAM sequence: CTG
ctgctgccgcttacaaaagc

SEQ ID NO: 291754 - DNA, 20 bp, Artificial Sequence
  Description of Artificial Sequence: Synthetic oligonucleotide
  Target: ATXN1; (+) strand; PAM type: YTN; PAM sequence: CTG
ctgccgcttacaaaagctca

SEQ ID NO: 291755 - DNA, 20 bp, Artificial Sequence
  Description of Artificial Sequence: Synthetic oligonucleotide
  Target: ATXN1; (+) strand; PAM type: YTN; PAM sequence: CTG
ccgcttacaaaagctcattc

SEQ ID NO: 291756 - DNA, 20 bp, Artificial Sequence
  Description of Artificial Sequence: Synthetic oligonucleotide
  Target: ATXN1; (+) strand; PAM type: YTN; PAM sequence: CTT
acaaaagctcattcatatgt

SEQ ID NO: 291757 - DNA, 20 bp, Artificial Sequence
  Description of Artificial Sequence: Synthetic oligonucleotide
  Target: ATXN1; (+) strand; PAM type: YTN; PAM sequence: TTA
caaaagctcattcatatgtg

SEQ ID NO: 291758 - DNA, 20 bp, Artificial Sequence
  Description of Artificial Sequence: Synthetic oligonucleotide
  Target: ATXN1; (+) strand; PAM type: YTN; PAM sequence: CTC
attcatatgtgtgagttcag

SEQ ID NO: 291759 - DNA, 20 bp, Artificial Sequence
  Description of Artificial Sequence: Synthetic oligonucleotide
  Target: ATXN1; (+) strand; PAM type: YTN; PAM sequence: TTC
atatgtgtgagttcaggcaa

SEQ ID NO: 291760 - DNA, 20 bp, Artificial Sequence
  Description of Artificial Sequence: Synthetic oligonucleotide
  Target: ATXN1; (+) strand; PAM type: YTN; PAM sequence: TTC
aggcaaaaacacagtcgtta

SEQ ID NO: 291761 - DNA, 20 bp, Artificial Sequence
  Description of Artificial Sequence: Synthetic oligonucleotide
  Target: ATXN1; (+) strand; PAM type: YTN; PAM sequence: TTA
tctgattctttaggcaggac

SEQ ID NO: 291762 - DNA, 20 bp, Artificial Sequence
  Description of Artificial Sequence: Synthetic oligonucleotide
  Target: ATXN1; (+) strand; PAM type: YTN; PAM sequence: CTG
attctttaggcaggacattg

SEQ ID NO: 291763 - DNA, 20 bp, Artificial Sequence
  Description of Artificial Sequence: Synthetic oligonucleotide
  Target: ATXN1; (+) strand; PAM type: YTN; PAM sequence: TTC
tttaggcaggacattgacca

SEQ ID NO: 291764 - DNA, 20 bp, Artificial Sequence
  Description of Artificial Sequence: Synthetic oligonucleotide
  Target: ATXN1; (+) strand; PAM type: YTN; PAM sequence: CTT
taggcaggacattgaccaga

SEQ ID NO: 291765 - DNA, 20 bp, Artificial Sequence
  Description of Artificial Sequence: Synthetic oligonucleotide
  Target: ATXN1; (+) strand; PAM type: YTN; PAM sequence: TTT
aggcaggacattgaccagat

SEQ ID NO: 291766 - DNA, 20 bp, Artificial Sequence
  Description of Artificial Sequence: Synthetic oligonucleotide
  Target: ATXN1; (+) strand; PAM type: YTN; PAM sequence: TTA
ggcaggacattgaccagata

SEQ ID NO: 291767 - DNA, 20 bp, Artificial Sequence
  Description of Artificial Sequence: Synthetic oligonucleotide
  Target: ATXN1; (+) strand; PAM type: YTN; PAM sequence: TTG
accagataaataaatatgtc

SEQ ID NO: 291768 - DNA, 20 bp, Artificial Sequence
  Description of Artificial Sequence: Synthetic oligonucleotide
  Target: ATXN1; (+) strand; PAM type: YTN; PAM sequence: CTG
aatctgcagagaaataattt

SEQ ID NO: 291769 - DNA, 20 bp, Artificial Sequence
  Description of Artificial Sequence: Synthetic oligonucleotide
  Target: ATXN1; (+) strand; PAM type: YTN; PAM sequence: CTG
cagagaaataatttcaaaag

SEQ ID NO: 291770 - DNA, 20 bp, Artificial Sequence
  Description of Artificial Sequence: Synthetic oligonucleotide
  Target: ATXN1; (+) strand; PAM type: YTN; PAM sequence: TTT
caaaagggcttcagaaggag

SEQ ID NO: 291771 - DNA, 20 bp, Artificial Sequence
  Description of Artificial Sequence: Synthetic oligonucleotide
  Target: ATXN1; (+) strand; PAM type: YTN; PAM sequence: TTC
aaaagggcttcagaaggaga

SEQ ID NO: 291772 - DNA, 20 bp, Artificial Sequence
  Description of Artificial Sequence: Synthetic oligonucleotide
  Target: ATXN1; (+) strand; PAM type: YTN; PAM sequence: CTT
cagaaggagaaggaaaatcc

SEQ ID NO: 291773 - DNA, 20 bp, Artificial Sequence
  Description of Artificial Sequence: Synthetic oligonucleotide
  Target: ATXN1; (+) strand; PAM type: YTN; PAM sequence: TTC
agaaggagaaggaaaatcca

SEQ ID NO: 291774 - DNA, 20 bp, Artificial Sequence
  Description of Artificial Sequence: Synthetic oligonucleotide
  Target: ATXN1; (+) strand; PAM type: YTN; PAM sequence: CTG
tagccagaagcatccaaaag

SEQ ID NO: 291775 - DNA, 20 bp, Artificial Sequence
  Description of Artificial Sequence: Synthetic oligonucleotide
  Target: ATXN1; (+) strand; PAM type: YTN; PAM sequence: CTG
aaaacatgagtggaggaagg

SEQ ID NO: 291776 - DNA, 20 bp, Artificial Sequence
  Description of Artificial Sequence: Synthetic oligonucleotide
  Target: ATXN1; (+) strand; PAM type: YTN; PAM sequence: CTG
agcaggtgtgggctggggag

SEQ ID NO: 291777 - DNA, 20 bp, Artificial Sequence
  Description of Artificial Sequence: Synthetic oligonucleotide
  Target: ATXN1; (+) strand; PAM type: YTN; PAM sequence: CTG
gggaggcaggcaaccccgca

SEQ ID NO: 291778 - DNA, 20 bp, Artificial Sequence
  Description of Artificial Sequence: Synthetic oligonucleotide
  Target: ATXN1; (+) strand; PAM type: YTN; PAM sequence: CTG
tgctggggaagcacaggcag

SEQ ID NO: 291779 - DNA, 20 bp, Artificial Sequence
  Description of Artificial Sequence: Synthetic oligonucleotide
  Target: ATXN1; (+) strand; PAM type: YTN; PAM sequence: CTG
gggaagcacaggcagcacag

SEQ ID NO: 291780 - DNA, 20 bp, Artificial Sequence
  Description of Artificial Sequence: Synthetic oligonucleotide
  Target: ATXN1; (+) strand; PAM type: YTN; PAM sequence: CTC
cctacaaggtgttttcaagg

SEQ ID NO: 291781 - DNA, 20 bp, Artificial Sequence
  Description of Artificial Sequence: Synthetic oligonucleotide
  Target: ATXN1; (+) strand; PAM type: YTN; PAM sequence: CTA
caaggtgttttcaaggttcc

SEQ ID NO: 291782 - DNA, 20 bp, Artificial Sequence
  Description of Artificial Sequence: Synthetic oligonucleotide
  Target: ATXN1; (+) strand; PAM type: YTN; PAM sequence: TTT
tcaaggttccggtttcccca

SEQ ID NO: 291783 - DNA, 20 bp, Artificial Sequence
  Description of Artificial Sequence: Synthetic oligonucleotide
  Target: ATXN1; (+) strand; PAM type: YTN; PAM sequence: TTT
caaggttccggtttccccag

SEQ ID NO: 291784 - DNA, 20 bp, Artificial Sequence
  Description of Artificial Sequence: Synthetic oligonucleotide
  Target: ATXN1; (+) strand; PAM type: YTN; PAM sequence: TTC
aaggttccggtttccccaga

SEQ ID NO: 291785 - DNA, 20 bp, Artificial Sequence
  Description of Artificial Sequence: Synthetic oligonucleotide
  Target: ATXN1; (+) strand; PAM type: YTN; PAM sequence: TTC
cggtttccccagagcacaac

SEQ ID NO: 291786 - DNA, 20 bp, Artificial Sequence
  Description of Artificial Sequence: Synthetic oligonucleotide
  Target: ATXN1; (+) strand; PAM type: YTN; PAM sequence: TTT
ccccagagcacaaccctaac

SEQ ID NO: 291787 - DNA, 20 bp, Artificial Sequence
  Description of Artificial Sequence: Synthetic oligonucleotide
  Target: ATXN1; (+) strand; PAM type: YTN; PAM sequence: TTC
cccagagcacaaccctaacc

SEQ ID NO: 291788 - DNA, 20 bp, Artificial Sequence
  Description of Artificial Sequence: Synthetic oligonucleotide
  Target: ATXN1; (+) strand; PAM type: YTN; PAM sequence: CTA
acctcaggcagtgcacagtt

SEQ ID NO: 291789 - DNA, 20 bp, Artificial Sequence
  Description of Artificial Sequence: Synthetic oligonucleotide
  Target: ATXN1; (+) strand; PAM type: YTN; PAM sequence: CTC
aggcagtgcacagttctccc

SEQ ID NO: 291790 - DNA, 20 bp, Artificial Sequence
  Description of Artificial Sequence: Synthetic oligonucleotide
  Target: ATXN1; (+) strand; PAM type: YTN; PAM sequence: TTC
tcccaataaaagtcactcgc

SEQ ID NO: 291791 - DNA, 20 bp, Artificial Sequence
  Description of Artificial Sequence: Synthetic oligonucleotide
  Target: ATXN1; (+) strand; PAM type: YTN; PAM sequence: CTC
ccaataaaagtcactcgccc

SEQ ID NO: 291792 - DNA, 20 bp, Artificial Sequence
  Description of Artificial Sequence: Synthetic oligonucleotide
  Target: ATXN1; (+) strand; PAM type: YTN; PAM sequence: CTC
gcccgtggagatcaccgaac

SEQ ID NO: 291793 - DNA, 20 bp, Artificial Sequence
  Description of Artificial Sequence: Synthetic oligonucleotide
  Target: ATXN1; (+) strand; PAM type: YTN; PAM sequence: CTG
aattgacaccacgggcactt

SEQ ID NO: 291794 - DNA, 20 bp, Artificial Sequence
  Description of Artificial Sequence: Synthetic oligonucleotide
  Target: ATXN1; (+) strand; PAM type: YTN; PAM sequence: TTG
acaccacgggcacttccaac

SEQ ID NO: 291795 - DNA, 20 bp, Artificial Sequence
  Description of Artificial Sequence: Synthetic oligonucleotide
  Target: ATXN1; (+) strand; PAM type: YTN; PAM sequence: CTT
ccaacctgtgttcctgacca

SEQ ID NO: 291796 - DNA, 20 bp, Artificial Sequence
  Description of Artificial Sequence: Synthetic oligonucleotide
  Target: ATXN1; (+) strand; PAM type: YTN; PAM sequence: TTC
caacctgtgttcctgaccac

SEQ ID NO: 291797 - DNA, 20 bp, Artificial Sequence
  Description of Artificial Sequence: Synthetic oligonucleotide
  Target: ATXN1; (+) strand; PAM type: YTN; PAM sequence: CTG
tgttcctgaccaccctcccc

SEQ ID NO: 291798 - DNA, 20 bp, Artificial Sequence
  Description of Artificial Sequence: Synthetic oligonucleotide
  Target: ATXN1; (+) strand; PAM type: YTN; PAM sequence: TTC
ctgaccaccctccccatgac

SEQ ID NO: 291799 - DNA, 20 bp, Artificial Sequence
  Description of Artificial Sequence: Synthetic oligonucleotide
  Target: ATXN1; (+) strand; PAM type: YTN; PAM sequence: CTG
accaccctccccatgacctg

SEQ ID NO: 291800 - DNA, 20 bp, Artificial Sequence
  Description of Artificial Sequence: Synthetic oligonucleotide
  Target: ATXN1; (+) strand; PAM type: YTN; PAM sequence: CTC
cccatgacctgcctccctta

SEQ ID NO: 291801 - DNA, 20 bp, Artificial Sequence
  Description of Artificial Sequence: Synthetic oligonucleotide
  Target: ATXN1; (+) strand; PAM type: YTN; PAM sequence: CTG
cctcccttacatcatttctg

SEQ ID NO: 291802 - DNA, 20 bp, Artificial Sequence
  Description of Artificial Sequence: Synthetic oligonucleotide
  Target: ATXN1; (+) strand; PAM type: YTN; PAM sequence: CTC
ccttacatcatttctgtttt

SEQ ID NO: 291803 - DNA, 20 bp, Artificial Sequence
  Description of Artificial Sequence: Synthetic oligonucleotide
  Target: ATXN1; (+) strand; PAM type: YTN; PAM sequence: CTT
acatcatttctgttttcctt

SEQ ID NO: 291804 - DNA, 20 bp, Artificial Sequence
  Description of Artificial Sequence: Synthetic oligonucleotide
  Target: ATXN1; (+) strand; PAM type: YTN; PAM sequence: TTA
catcatttctgttttccttt

SEQ ID NO: 291805 - DNA, 20 bp, Artificial Sequence
  Description of Artificial Sequence: Synthetic oligonucleotide
  Target: ATXN1; (+) strand; PAM type: YTN; PAM sequence: TTT
ctgttttcctttcccatggt

SEQ ID NO: 291806 - DNA, 20 bp, Artificial Sequence
  Description of Artificial Sequence: Synthetic oligonucleotide
  Target: ATXN1; (+) strand; PAM type: YTN; PAM sequence: TTC
tgttttcctttcccatggtc

SEQ ID NO: 291807 - DNA, 20 bp, Artificial Sequence
  Description of Artificial Sequence: Synthetic oligonucleotide
  Target: ATXN1; (+) strand; PAM type: YTN; PAM sequence: CTG
ttttcctttcccatggtcct

SEQ ID NO: 291808 - DNA, 20 bp, Artificial Sequence
  Description of Artificial Sequence: Synthetic oligonucleotide
  Target: ATXN1; (+) strand; PAM type: YTN; PAM sequence: TTT
tcctttcccatggtcctgtg

SEQ ID NO: 291809 - DNA, 20 bp, Artificial Sequence
  Description of Artificial Sequence: Synthetic oligonucleotide
  Target: ATXN1; (+) strand; PAM type: YTN; PAM sequence: TTT
cctttcccatggtcctgtga

SEQ ID NO: 291810 - DNA, 20 bp, Artificial Sequence
  Description of Artificial Sequence: Synthetic oligonucleotide
  Target: ATXN1; (+) strand; PAM type: YTN; PAM sequence: TTC
ctttcccatggtcctgtgac

SEQ ID NO: 291811 - DNA, 20 bp, Artificial Sequence
  Description of Artificial Sequence: Synthetic oligonucleotide
  Target: ATXN1; (+) strand; PAM type: YTN; PAM sequence: CTT
tcccatggtcctgtgacttc

SEQ ID NO: 291812 - DNA, 20 bp, Artificial Sequence
  Description of Artificial Sequence: Synthetic oligonucleotide
  Target: ATXN1; (+) strand; PAM type: YTN; PAM sequence: TTT
cccatggtcctgtgacttct

SEQ ID NO: 291813 - DNA, 20 bp, Artificial Sequence
  Description of Artificial Sequence: Synthetic oligonucleotide
  Target: ATXN1; (+) strand; PAM type: YTN; PAM sequence: TTC
ccatggtcctgtgacttctc

SEQ ID NO: 291814 - DNA, 20 bp, Artificial Sequence
  Description of Artificial Sequence: Synthetic oligonucleotide
  Target: ATXN1; (+) strand; PAM type: YTN; PAM sequence: CTG
tgacttctcttactctttca

SEQ ID NO: 291815 - DNA, 20 bp, Artificial Sequence
  Description of Artificial Sequence: Synthetic oligonucleotide
  Target: ATXN1; (+) strand; PAM type: YTN; PAM sequence: CTT
ctcttactctttcaaatgca

SEQ ID NO: 291816 - DNA, 20 bp, Artificial Sequence
  Description of Artificial Sequence: Synthetic oligonucleotide
  Target: ATXN1; (+) strand; PAM type: YTN; PAM sequence: TTC
tcttactctttcaaatgcaa

SEQ ID NO: 291817 - DNA, 20 bp, Artificial Sequence
  Description of Artificial Sequence: Synthetic oligonucleotide
  Target: ATXN1; (+) strand; PAM type: YTN; PAM sequence: CTC
ttactctttcaaatgcaaaa

SEQ ID NO: 291818 - DNA, 20 bp, Artificial Sequence
  Description of Artificial Sequence: Synthetic oligonucleotide
  Target: ATXN1; (+) strand; PAM type: YTN; PAM sequence: CTT
actctttcaaatgcaaaatg

SEQ ID NO: 291819 - DNA, 20 bp, Artificial Sequence
  Description of Artificial Sequence: Synthetic oligonucleotide
  Target: ATXN1; (+) strand; PAM type: YTN; PAM sequence: TTA
ctctttcaaatgcaaaatgt

SEQ ID NO: 291820 - DNA, 20 bp, Artificial Sequence
  Description of Artificial Sequence: Synthetic oligonucleotide
  Target: ATXN1; (+) strand; PAM type: YTN; PAM sequence: CTC
tttcaaatgcaaaatgtcac

SEQ ID NO: 291821 - DNA, 20 bp, Artificial Sequence
  Description of Artificial Sequence: Synthetic oligonucleotide
  Target: ATXN1; (+) strand; PAM type: YTN; PAM sequence: CTT
tcaaatgcaaaatgtcacag

SEQ ID NO: 291822 - DNA, 20 bp, Artificial Sequence
  Description of Artificial Sequence: Synthetic oligonucleotide
  Target: ATXN1; (+) strand; PAM type: YTN; PAM sequence: TTT
caaatgcaaaatgtcacagc

SEQ ID NO: 291823 - DNA, 20 bp, Artificial Sequence
  Description of Artificial Sequence: Synthetic oligonucleotide
  Target: ATXN1; (+) strand; PAM type: YTN; PAM sequence: TTC
aaatgcaaaatgtcacagct

SEQ ID NO: 291824 - DNA, 20 bp, Artificial Sequence
  Description of Artificial Sequence: Synthetic oligonucleotide
  Target: ATXN1; (+) strand; PAM type: YTN; PAM sequence: CTG
aagggaaggaacctccaagg

SEQ ID NO: 291825 - DNA, 20 bp, Artificial Sequence
  Description of Artificial Sequence: Synthetic oligonucleotide
  Target: ATXN1; (+) strand; PAM type: YTN; PAM sequence: CTC
caaggatgatctgggctact

SEQ ID NO: 291826 - DNA, 20 bp, Artificial Sequence
  Description of Artificial Sequence: Synthetic oligonucleotide
  Target: ATXN1; (+) strand; PAM type: YTN; PAM sequence: CTG
ggctactgctttcttcttca

SEQ ID NO: 291827 - DNA, 20 bp, Artificial Sequence
  Description of Artificial Sequence: Synthetic oligonucleotide
  Target: ATXN1; (+) strand; PAM type: YTN; PAM sequence: CTA
ctgctttcttcttcataggg

SEQ ID NO: 291828 - DNA, 20 bp, Artificial Sequence
  Description of Artificial Sequence: Synthetic oligonucleotide
  Target: ATXN1; (+) strand; PAM type: YTN; PAM sequence: CTG
ctttcttcttcataggggag

SEQ ID NO: 291829 - DNA, 20 bp, Artificial Sequence
  Description of Artificial Sequence: Synthetic oligonucleotide
  Target: ATXN1; (+) strand; PAM type: YTN; PAM sequence: CTT
tcttcttcataggggaggaa

SEQ ID NO: 291830 - DNA, 20 bp, Artificial Sequence
  Description of Artificial Sequence: Synthetic oligonucleotide
  Target: ATXN1; (+) strand; PAM type: YTN; PAM sequence: TTT
cttcttcataggggaggaaa

SEQ ID NO: 291831 - DNA, 20 bp, Artificial Sequence
  Description of Artificial Sequence: Synthetic oligonucleotide
  Target: ATXN1; (+) strand; PAM type: YTN; PAM sequence: TTC
ttcttcataggggaggaaac

SEQ ID NO: 291832 - DNA, 20 bp, Artificial Sequence
  Description of Artificial Sequence: Synthetic oligonucleotide
  Target: ATXN1; (+) strand; PAM type: YTN; PAM sequence: CTT
cttcataggggaggaaactg

SEQ ID NO: 291833 - DNA, 20 bp, Artificial Sequence
  Description of Artificial Sequence: Synthetic oligonucleotide
  Target: ATXN1; (+) strand; PAM type: YTN; PAM sequence: TTC
ttcataggggaggaaactga

SEQ ID NO: 291834 - DNA, 20 bp, Artificial Sequence
  Description of Artificial Sequence: Synthetic oligonucleotide
  Target: ATXN1; (+) strand; PAM type: YTN; PAM sequence: CTT
cataggggaggaaactgaga

SEQ ID NO: 291835 - DNA, 20 bp, Artificial Sequence
  Description of Artificial Sequence: Synthetic oligonucleotide
  Target: ATXN1; (+) strand; PAM type: YTN; PAM sequence: TTC
ataggggaggaaactgagat

SEQ ID NO: 291836 - DNA, 20 bp, Artificial Sequence
  Description of Artificial Sequence: Synthetic oligonucleotide
  Target: ATXN1; (+) strand; PAM type: YTN; PAM sequence: CTG
agattccagagaggttggta

SEQ ID NO: 291837 - DNA, 20 bp, Artificial Sequence
  Description of Artificial Sequence: Synthetic oligonucleotide
  Target: ATXN1; (+) strand; PAM type: YTN; PAM sequence: TTC
cagagaggttggtaactttc

SEQ ID NO: 291838 - DNA, 20 bp, Artificial Sequence
  Description of Artificial Sequence: Synthetic oligonucleotide
  Target: ATXN1; (+) strand; PAM type: YTN; PAM sequence: TTG
gtaactttcccaaggttaca

SEQ ID NO: 291839 - DNA, 20 bp, Artificial Sequence
  Description of Artificial Sequence: Synthetic oligonucleotide
  Target: ATXN1; (+) strand; PAM type: YTN; PAM sequence: CTT
tcccaaggttacaaaattag

SEQ ID NO: 291840 - DNA, 20 bp, Artificial Sequence
  Description of Artificial Sequence: Synthetic oligonucleotide
  Target: ATXN1; (+) strand; PAM type: YTN; PAM sequence: TTT
cccaaggttacaaaattagc

SEQ ID NO: 291841 - DNA, 20 bp, Artificial Sequence
  Description of Artificial Sequence: Synthetic oligonucleotide
  Target: ATXN1; (+) strand; PAM type: YTN; PAM sequence: TTC
ccaaggttacaaaattagca

SEQ ID NO: 291842 - DNA, 20 bp, Artificial Sequence
  Description of Artificial Sequence: Synthetic oligonucleotide
  Target: ATXN1; (+) strand; PAM type: YTN; PAM sequence: TTA
caaaattagcagtgcagccg

SEQ ID NO: 291843 - DNA, 20 bp, Artificial Sequence
  Description of Artificial Sequence: Synthetic oligonucleotide
  Target: ATXN1; (+) strand; PAM type: YTN; PAM sequence: TTA
gcagtgcagccggaactgaa

SEQ ID NO: 291844 - DNA, 20 bp, Artificial Sequence
  Description of Artificial Sequence: Synthetic oligonucleotide
  Target: ATXN1; (+) strand; PAM type: YTN; PAM sequence: CTG
aaacctacattgtgtgacca

SEQ ID NO: 291845 - DNA, 20 bp, Artificial Sequence
  Description of Artificial Sequence: Synthetic oligonucleotide
  Target: ATXN1; (+) strand; PAM type: YTN; PAM sequence: CTA
cattgtgtgaccactctcct

SEQ ID NO: 291846 - DNA, 20 bp, Artificial Sequence
  Description of Artificial Sequence: Synthetic oligonucleotide
  Target: ATXN1; (+) strand; PAM type: YTN; PAM sequence: TTG
tgtgaccactctcctcctcc

SEQ ID NO: 291847 - DNA, 20 bp, Artificial Sequence
  Description of Artificial Sequence: Synthetic oligonucleotide
  Target: ATXN1; (+) strand; PAM type: YTN; PAM sequence: CTC
tcctcctcccaaagcaattt

SEQ ID NO: 291848 - DNA, 20 bp, Artificial Sequence
  Description of Artificial Sequence: Synthetic oligonucleotide
  Target: ATXN1; (+) strand; PAM type: YTN; PAM sequence: CTC
ctcctcccaaagcaatttag

SEQ ID NO: 291849 - DNA, 20 bp, Artificial Sequence
  Description of Artificial Sequence: Synthetic oligonucleotide
  Target: ATXN1; (+) strand; PAM type: YTN; PAM sequence: CTC
ctcccaaagcaatttagttt

SEQ ID NO: 291850 - DNA, 20 bp, Artificial Sequence
  Description of Artificial Sequence: Synthetic oligonucleotide
  Target: ATXN1; (+) strand; PAM type: YTN; PAM sequence: CTC
ccaaagcaatttagtttcca

SEQ ID NO: 291851 - DNA, 20 bp, Artificial Sequence
  Description of Artificial Sequence: Synthetic oligonucleotide
  Target: ATXN1; (+) strand; PAM type: YTN; PAM sequence: TTT
agtttccaactggacctcat

SEQ ID NO: 291852 - DNA, 20 bp, Artificial Sequence
  Description of Artificial Sequence: Synthetic oligonucleotide
  Target: ATXN1; (+) strand; PAM type: YTN; PAM sequence: TTA
gtttccaactggacctcatc

SEQ ID NO: 291853 - DNA, 20 bp, Artificial Sequence
  Description of Artificial Sequence: Synthetic oligonucleotide
  Target: ATXN1; (+) strand; PAM type: YTN; PAM sequence: TTT
ccaactggacctcatctgcc

SEQ ID NO: 291854 - DNA, 20 bp, Artificial Sequence
  Description of Artificial Sequence: Synthetic oligonucleotide
  Target: ATXN1; (+) strand; PAM type: YTN; PAM sequence: TTC
caactggacctcatctgcct

SEQ ID NO: 291855 - DNA, 20 bp, Artificial Sequence
  Description of Artificial Sequence: Synthetic oligonucleotide
  Target: ATXN1; (+) strand; PAM type: YTN; PAM sequence: CTG
gacctcatctgcctacttgt

SEQ ID NO: 291856 - DNA, 20 bp, Artificial Sequence
  Description of Artificial Sequence: Synthetic oligonucleotide
  Target: ATXN1; (+) strand; PAM type: YTN; PAM sequence: CTC
atctgcctacttgtttctcc

SEQ ID NO: 291857 - DNA, 20 bp, Artificial Sequence
  Description of Artificial Sequence: Synthetic oligonucleotide
  Target: ATXN1; (+) strand; PAM type: YTN; PAM sequence: CTG
cctacttgtttctcccccag

SEQ ID NO: 291858 - DNA, 20 bp, Artificial Sequence
  Description of Artificial Sequence: Synthetic oligonucleotide
  Target: ATXN1; (+) strand; PAM type: YTN; PAM sequence: CTA
cttgtttctcccccagcccc

SEQ ID NO: 291859 - DNA, 20 bp, Artificial Sequence
  Description of Artificial Sequence: Synthetic oligonucleotide
  Target: ATXN1; (+) strand; PAM type: YTN; PAM sequence: CTT
gtttctcccccagcccccag

SEQ ID NO: 291860 - DNA, 20 bp, Artificial Sequence
  Description of Artificial Sequence: Synthetic oligonucleotide
  Target: ATXN1; (+) strand; PAM type: YTN; PAM sequence: TTG
tttctcccccagcccccagg

SEQ ID NO: 291861 - DNA, 20 bp, Artificial Sequence
  Description of Artificial Sequence: Synthetic oligonucleotide
  Target: ATXN1; (+) strand; PAM type: YTN; PAM sequence: TTT
ctcccccagcccccaggcag

SEQ ID NO: 291862 - DNA, 20 bp, Artificial Sequence
  Description of Artificial Sequence: Synthetic oligonucleotide
  Target: ATXN1; (+) strand; PAM type: YTN; PAM sequence: TTC
tcccccagcccccaggcagc

SEQ ID NO: 291863 - DNA, 20 bp, Artificial Sequence
  Description of Artificial Sequence: Synthetic oligonucleotide
  Target: ATXN1; (+) strand; PAM type: YTN; PAM sequence: CTC
ccccagcccccaggcagccc

SEQ ID NO: 291864 - DNA, 20 bp, Artificial Sequence
  Description of Artificial Sequence: Synthetic oligonucleotide
  Target: ATXN1; (+) strand; PAM type: YTN; PAM sequence: CTT
cactgtggctgctgagtcat

SEQ ID NO: 291865 - DNA, 20 bp, Artificial Sequence
  Description of Artificial Sequence: Synthetic oligonucleotide
  Target: ATXN1; (+) strand; PAM type: YTN; PAM sequence: TTC
actgtggctgctgagtcatc

SEQ ID NO: 291866 - DNA, 20 bp, Artificial Sequence
  Description of Artificial Sequence: Synthetic oligonucleotide
  Target: ATXN1; (+) strand; PAM type: YTN; PAM sequence: CTG
tggctgctgagtcatcagga

SEQ ID NO: 291867 - DNA, 20 bp, Artificial Sequence
  Description of Artificial Sequence: Synthetic oligonucleotide
  Target: ATXN1; (+) strand; PAM type: YTN; PAM sequence: CTG
ctgagtcatcaggatgagct

SEQ ID NO: 291868 - DNA, 20 bp, Artificial Sequence
  Description of Artificial Sequence: Synthetic oligonucleotide
  Target: ATXN1; (+) strand; PAM type: YTN; PAM sequence: CTG
agtcatcaggatgagctttg

SEQ ID NO: 291869 - DNA, 20 bp, Artificial Sequence
  Description of Artificial Sequence: Synthetic oligonucleotide
  Target: ATXN1; (+) strand; PAM type: YTN; PAM sequence: CTT
tgttctcaagcaagccactg

SEQ ID NO: 291870 - DNA, 20 bp, Artificial Sequence
  Description of Artificial Sequence: Synthetic oligonucleotide
  Target: ATXN1; (+) strand; PAM type: YTN; PAM sequence: TTT
gttctcaagcaagccactgg

SEQ ID NO: 291871 - DNA, 20 bp, Artificial Sequence
  Description of Artificial Sequence: Synthetic oligonucleotide
  Target: ATXN1; (+) strand; PAM type: YTN; PAM sequence: TTG
ttctcaagcaagccactggg

SEQ ID NO: 291872 - DNA, 20 bp, Artificial Sequence
  Description of Artificial Sequence: Synthetic oligonucleotide
  Target: ATXN1; (+) strand; PAM type: YTN; PAM sequence: TTC
tcaagcaagccactgggaca

SEQ ID NO: 291873 - DNA, 20 bp, Artificial Sequence
  Description of Artificial Sequence: Synthetic oligonucleotide
  Target: ATXN1; (+) strand; PAM type: YTN; PAM sequence: CTC
aagcaagccactgggacagg

SEQ ID NO: 291874 - DNA, 20 bp, Artificial Sequence
  Description of Artificial Sequence: Synthetic oligonucleotide
  Target: ATXN1; (+) strand; PAM type: YTN; PAM sequence: CTG
ggacaggccctcatgtcttg

SEQ ID NO: 291875 - DNA, 20 bp, Artificial Sequence
  Description of Artificial Sequence: Synthetic oligonucleotide
  Target: ATXN1; (+) strand; PAM type: YTN; PAM sequence: CTC
atgtcttgagtaggacaaag

SEQ ID NO: 291876 - DNA, 20 bp, Artificial Sequence
  Description of Artificial Sequence: Synthetic oligonucleotide
  Target: ATXN1; (+) strand; PAM type: YTN; PAM sequence: CTT
gagtaggacaaagtatattt

SEQ ID NO: 291877 - DNA, 20 bp, Artificial Sequence
  Description of Artificial Sequence: Synthetic oligonucleotide
  Target: ATXN1; (+) strand; PAM type: YTN; PAM sequence: TTG
agtaggacaaagtatatttg

SEQ ID NO: 291878 - DNA, 20 bp, Artificial Sequence
  Description of Artificial Sequence: Synthetic oligonucleotide
  Target: ATXN1; (+) strand; PAM type: YTN; PAM sequence: TTT
ggccactccccactttgtgg

SEQ ID NO: 291879 - DNA, 20 bp, Artificial Sequence
  Description of Artificial Sequence: Synthetic oligonucleotide
  Target: ATXN1; (+) strand; PAM type: YTN; PAM sequence: TTG
gccactccccactttgtggt

SEQ ID NO: 291880 - DNA, 20 bp, Artificial Sequence
  Description of Artificial Sequence: Synthetic oligonucleotide
  Target: ATXN1; (+) strand; PAM type: YTN; PAM sequence: CTC
cccactttgtggtcaccctg

SEQ ID NO: 291881 - DNA, 20 bp, Artificial Sequence
  Description of Artificial Sequence: Synthetic oligonucleotide
  Target: ATXN1; (+) strand; PAM type: YTN; PAM sequence: CTT
tgtggtcaccctgctctgcc

SEQ ID NO: 291882 - DNA, 20 bp, Artificial Sequence
  Description of Artificial Sequence: Synthetic oligonucleotide
  Target: ATXN1; (+) strand; PAM type: YTN; PAM sequence: TTT
gtggtcaccctgctctgcct

SEQ ID NO: 291883 - DNA, 20 bp, Artificial Sequence
  Description of Artificial Sequence: Synthetic oligonucleotide
  Target: ATXN1; (+) strand; PAM type: YTN; PAM sequence: TTG
tggtcaccctgctctgcctg

SEQ ID NO: 291884 - DNA, 20 bp, Artificial Sequence
  Description of Artificial Sequence: Synthetic oligonucleotide
  Target: ATXN1; (+) strand; PAM type: YTN; PAM sequence: CTG
ctctgcctgatgcatgggca

SEQ ID NO: 291885 - DNA, 20 bp, Artificial Sequence
  Description of Artificial Sequence: Synthetic oligonucleotide
  Target: ATXN1; (+) strand; PAM type: YTN; PAM sequence: CTC
tgcctgatgcatgggcacct

SEQ ID NO: 291886 - DNA, 20 bp, Artificial Sequence
  Description of Artificial Sequence: Synthetic oligonucleotide
  Target: ATXN1; (+) strand; PAM type: YTN; PAM sequence: CTG
cctgatgcatgggcaccttc

SEQ ID NO: 291887 - DNA, 20 bp, Artificial Sequence
  Description of Artificial Sequence: Synthetic oligonucleotide
  Target: ATXN1; (+) strand; PAM type: YTN; PAM sequence: CTG
atgcatgggcaccttctgcc

SEQ ID NO: 291888 - DNA, 20 bp, Artificial Sequence
  Description of Artificial Sequence: Synthetic oligonucleotide
  Target: ATXN1; (+) strand; PAM type: YTN; PAM sequence: CTT
ctgcccatgacaactgtcat

SEQ ID NO: 291889 - DNA, 20 bp, Artificial Sequence
  Description of Artificial Sequence: Synthetic oligonucleotide
  Target: ATXN1; (+) strand; PAM type: YTN; PAM sequence: TTC
tgcccatgacaactgtcatt

SEQ ID NO: 291890 - DNA, 20 bp, Artificial Sequence
  Description of Artificial Sequence: Synthetic oligonucleotide
  Target: ATXN1; (+) strand; PAM type: YTN; PAM sequence: CTG
cccatgacaactgtcattcg

SEQ ID NO: 291891 - DNA, 20 bp, Artificial Sequence
  Description of Artificial Sequence: Synthetic oligonucleotide
  Target: ATXN1; (+) strand; PAM type: YTN; PAM sequence: CTG
tcattcgccctgaatagtct

SEQ ID NO: 291892 - DNA, 20 bp, Artificial Sequence
  Description of Artificial Sequence: Synthetic oligonucleotide
  Target: ATXN1; (+) strand; PAM type: YTN; PAM sequence: TTC
gccctgaatagtctatgcca

SEQ ID NO: 291893 - DNA, 20 bp, Artificial Sequence
  Description of Artificial Sequence: Synthetic oligonucleotide
  Target: ATXN1; (+) strand; PAM type: YTN; PAM sequence: CTG
aatagtctatgccatcacac

SEQ ID NO: 291894 - DNA, 20 bp, Artificial Sequence
  Description of Artificial Sequence: Synthetic oligonucleotide
  Target: ATXN1; (+) strand; PAM type: YTN; PAM sequence: CTA
tgccatcacacctccttatg

SEQ ID NO: 291895 - DNA, 20 bp, Artificial Sequence
  Description of Artificial Sequence: Synthetic oligonucleotide
  Target: ATXN1; (+) strand; PAM type: YTN; PAM sequence: CTC
cttatggctactaacataaa

SEQ ID NO: 291896 - DNA, 20 bp, Artificial Sequence
  Description of Artificial Sequence: Synthetic oligonucleotide
  Target: ATXN1; (+) strand; PAM type: YTN; PAM sequence: CTT
atggctactaacataaaagg

SEQ ID NO: 291897 - DNA, 20 bp, Artificial Sequence
  Description of Artificial Sequence: Synthetic oligonucleotide
  Target: ATXN1; (+) strand; PAM type: YTN; PAM sequence: TTA
tggctactaacataaaaggt

SEQ ID NO: 291898 - DNA, 20 bp, Artificial Sequence
  Description of Artificial Sequence: Synthetic oligonucleotide
  Target: ATXN1; (+) strand; PAM type: YTN; PAM sequence: CTA
ctaacataaaaggtaagtga

SEQ ID NO: 291899 - DNA, 20 bp, Artificial Sequence
  Description of Artificial Sequence: Synthetic oligonucleotide
  Target: ATXN1; (+) strand; PAM type: YTN; PAM sequence: CTA
acataaaaggtaagtgacta

SEQ ID NO: 291900 - DNA, 20 bp, Artificial Sequence
  Description of Artificial Sequence: Synthetic oligonucleotide
  Target: ATXN1; (+) strand; PAM type: YTN; PAM sequence: CTA
ataaatggtatcatgaatta

SEQ ID NO: 291901 - DNA, 20 bp, Artificial Sequence
  Description of Artificial Sequence: Synthetic oligonucleotide
  Target: ATXN1; (+) strand; PAM type: YTN; PAM sequence: TTA
atatgaaaccttttatacag

SEQ ID NO: 291902 - DNA, 20 bp, Artificial Sequence
  Description of Artificial Sequence: Synthetic oligonucleotide
  Target: ATXN1; (+) strand; PAM type: YTN; PAM sequence: CTT
ttatacagacaaatatttga

SEQ ID NO: 291903 - DNA, 20 bp, Artificial Sequence
  Description of Artificial Sequence: Synthetic oligonucleotide
  Target: ATXN1; (+) strand; PAM type: YTN; PAM sequence: TTT
tatacagacaaatatttgat

SEQ ID NO: 291904 - DNA, 20 bp, Artificial Sequence
  Description of Artificial Sequence: Synthetic oligonucleotide
  Target: ATXN1; (+) strand; PAM type: YTN; PAM sequence: TTT
atacagacaaatatttgatt

SEQ ID NO: 291905 - DNA, 20 bp, Artificial Sequence
  Description of Artificial Sequence: Synthetic oligonucleotide
  Target: ATXN1; (+) strand; PAM type: YTN; PAM sequence: TTA
tacagacaaatatttgattc

SEQ ID NO: 291906 - DNA, 20 bp, Artificial Sequence
  Description of Artificial Sequence: Synthetic oligonucleotide
  Target: ATXN1; (+) strand; PAM type: YTN; PAM sequence: TTT
gattcctcagttatattttc

SEQ ID NO: 291907 - DNA, 20 bp, Artificial Sequence
  Description of Artificial Sequence: Synthetic oligonucleotide
  Target: ATXN1; (+) strand; PAM type: YTN; PAM sequence: TTG
attcctcagttatattttct

SEQ ID NO: 291908 - DNA, 20 bp, Artificial Sequence
  Description of Artificial Sequence: Synthetic oligonucleotide
  Target: ATXN1; (+) strand; PAM type: YTN; PAM sequence: TTC
ctcagttatattttcttggg

SEQ ID NO: 291909 - DNA, 20 bp, Artificial Sequence
  Description of Artificial Sequence: Synthetic oligonucleotide
  Target: ATXN1; (+) strand; PAM type: YTN; PAM sequence: CTC
agttatattttcttgggatc

SEQ ID NO: 291910 - DNA, 20 bp, Artificial Sequence
  Description of Artificial Sequence: Synthetic oligonucleotide
  Target: ATXN1; (+) strand; PAM type: YTN; PAM sequence: TTA
tattttcttgggatcttttc

SEQ ID NO: 291911 - DNA, 20 bp, Artificial Sequence
  Description of Artificial Sequence: Synthetic oligonucleotide
  Target: ATXN1; (+) strand; PAM type: YTN; PAM sequence: TTT
tcttgggatcttttcttccc

SEQ ID NO: 291912 - DNA, 20 bp, Artificial Sequence
  Description of Artificial Sequence: Synthetic oligonucleotide
  Target: ATXN1; (+) strand; PAM type: YTN; PAM sequence: TTT
cttgggatcttttcttccca

SEQ ID NO: 291913 - DNA, 20 bp, Artificial Sequence
  Description of Artificial Sequence: Synthetic oligonucleotide
  Target: ATXN1; (+) strand; PAM type: YTN; PAM sequence: TTC
ttgggatcttttcttcccag

SEQ ID NO: 291914 - DNA, 20 bp, Artificial Sequence
  Description of Artificial Sequence: Synthetic oligonucleotide
  Target: ATXN1; (+) strand; PAM type: YTN; PAM sequence: CTT
gggatcttttcttcccaggt

SEQ ID NO: 291915 - DNA, 20 bp, Artificial Sequence
  Description of Artificial Sequence: Synthetic oligonucleotide
  Target: ATXN1; (+) strand; PAM type: YTN; PAM sequence: TTG
ggatcttttcttcccaggtc

SEQ ID NO: 291916 - DNA, 20 bp, Artificial Sequence
  Description of Artificial Sequence: Synthetic oligonucleotide
  Target: ATXN1; (+) strand; PAM type: YTN; PAM sequence: CTT
ttcttcccaggtcatagcag

SEQ ID NO: 291917 - DNA, 20 bp, Artificial Sequence
  Description of Artificial Sequence: Synthetic oligonucleotide
  Target: ATXN1; (+) strand; PAM type: YTN; PAM sequence: TTT
tcttcccaggtcatagcagt

SEQ ID NO: 291918 - DNA, 20 bp, Artificial Sequence
  Description of Artificial Sequence: Synthetic oligonucleotide
  Target: ATXN1; (+) strand; PAM type: YTN; PAM sequence: TTT
cttcccaggtcatagcagtg

SEQ ID NO: 291919 - DNA, 20 bp, Artificial Sequence
  Description of Artificial Sequence: Synthetic oligonucleotide
  Target: ATXN1; (+) strand; PAM type: YTN; PAM sequence: TTC
ttcccaggtcatagcagtgc

SEQ ID NO: 291920 - DNA, 20 bp, Artificial Sequence
  Description of Artificial Sequence: Synthetic oligonucleotide
  Target: ATXN1; (+) strand; PAM type: YTN; PAM sequence: CTT
cccaggtcatagcagtgctg

SEQ ID NO: 291921 - DNA, 20 bp, Artificial Sequence
  Description of Artificial Sequence: Synthetic oligonucleotide
  Target: ATXN1; (+) strand; PAM type: YTN; PAM sequence: TTC
ccaggtcatagcagtgctgt

SEQ ID NO: 291922 - DNA, 20 bp, Artificial Sequence
  Description of Artificial Sequence: Synthetic oligonucleotide
  Target: ATXN1; (+) strand; PAM type: YTN; PAM sequence: CTG
tttcaacaggaaatgtcata

SEQ ID NO: 291923 - DNA, 20 bp, Artificial Sequence
  Description of Artificial Sequence: Synthetic oligonucleotide
  Target: ATXN1; (+) strand; PAM type: YTN; PAM sequence: TTT
caacaggaaatgtcatagct

SEQ ID NO: 291924 - DNA, 20 bp, Artificial Sequence
  Description of Artificial Sequence: Synthetic oligonucleotide
  Target: ATXN1; (+) strand; PAM type: YTN; PAM sequence: TTC
aacaggaaatgtcatagctt

SEQ ID NO: 291925 - DNA, 20 bp, Artificial Sequence
  Description of Artificial Sequence: Synthetic oligonucleotide
  Target: ATXN1; (+) strand; PAM type: YTN; PAM sequence: CTT
gaatgccaggtgcactttaa

SEQ ID NO: 291926 - DNA, 20 bp, Artificial Sequence
  Description of Artificial Sequence: Synthetic oligonucleotide
  Target: ATXN1; (+) strand; PAM type: YTN; PAM sequence: TTG
aatgccaggtgcactttaaa

SEQ ID NO: 291927 - DNA, 20 bp, Artificial Sequence
  Description of Artificial Sequence: Synthetic oligonucleotide
  Target: ATXN1; (+) strand; PAM type: YTN; PAM sequence: CTT
taaaaaataatctaaactaa

SEQ ID NO: 291928 - DNA, 20 bp, Artificial Sequence
  Description of Artificial Sequence: Synthetic oligonucleotide
  Target: ATXN1; (+) strand; PAM type: YTN; PAM sequence: TTT
aaaaaataatctaaactaaa

SEQ ID NO: 291929 - DNA, 20 bp, Artificial Sequence
  Description of Artificial Sequence: Synthetic oligonucleotide
  Target: ATXN1; (+) strand; PAM type: YTN; PAM sequence: TTA
aaaaataatctaaactaaat

SEQ ID NO: 291930 - DNA, 20 bp, Artificial Sequence
  Description of Artificial Sequence: Synthetic oligonucleotide
  Target: ATXN1; (+) strand; PAM type: YTN; PAM sequence: CTA
aactaaattagcttttacac

SEQ ID NO: 291931 - DNA, 20 bp, Artificial Sequence
  Description of Artificial Sequence: Synthetic oligonucleotide
  Target: ATXN1; (+) strand; PAM type: YTN; PAM sequence: CTA
aattagcttttacacctaac

SEQ ID NO: 291932 - DNA, 20 bp, Artificial Sequence
  Description of Artificial Sequence: Synthetic oligonucleotide
  Target: ATXN1; (+) strand; PAM type: YTN; PAM sequence: TTA
gcttttacacctaacgacgg

SEQ ID NO: 291933 - DNA, 20 bp, Artificial Sequence
  Description of Artificial Sequence: Synthetic oligonucleotide
  Target: ATXN1; (+) strand; PAM type: YTN; PAM sequence: CTT
ttacacctaacgacggcctg

SEQ ID NO: 291934 - DNA, 20 bp, Artificial Sequence
  Description of Artificial Sequence: Synthetic oligonucleotide
  Target: ATXN1; (+) strand; PAM type: YTN; PAM sequence: TTT
tacacctaacgacggcctgg

SEQ ID NO: 291935 - DNA, 20 bp, Artificial Sequence
  Description of Artificial Sequence: Synthetic oligonucleotide
  Target: ATXN1; (+) strand; PAM type: YTN; PAM sequence: TTT
acacctaacgacggcctggg

SEQ ID NO: 291936 - DNA, 20 bp, Artificial Sequence
  Description of Artificial Sequence: Synthetic oligonucleotide
  Target: ATXN1; (+) strand; PAM type: YTN; PAM sequence: TTA
cacctaacgacggcctggga

SEQ ID NO: 291937 - DNA, 20 bp, Artificial Sequence
  Description of Artificial Sequence: Synthetic oligonucleotide
  Target: ATXN1; (+) strand; PAM type: YTN; PAM sequence: CTA
acgacggcctgggaataata

SEQ ID NO: 291938 - DNA, 20 bp, Artificial Sequence
  Description of Artificial Sequence: Synthetic oligonucleotide
  Target: ATXN1; (+) strand; PAM type: YTN; PAM sequence: CTG
ggaataataaaggaactctt

SEQ ID NO: 291939 - DNA, 20 bp, Artificial Sequence
  Description of Artificial Sequence: Synthetic oligonucleotide
  Target: ATXN1; (+) strand; PAM type: YTN; PAM sequence: CTC
tttgaaaaaggaagaaagtg

SEQ ID NO: 291940 - DNA, 20 bp, Artificial Sequence
  Description of Artificial Sequence: Synthetic oligonucleotide
  Target: ATXN1; (+) strand; PAM type: YTN; PAM sequence: CTT
tgaaaaaggaagaaagtgga

SEQ ID NO: 291941 - DNA, 20 bp, Artificial Sequence
  Description of Artificial Sequence: Synthetic oligonucleotide
  Target: ATXN1; (+) strand; PAM type: YTN; PAM sequence: TTT
gaaaaaggaagaaagtggag

SEQ ID NO: 291942 - DNA, 20 bp, Artificial Sequence
  Description of Artificial Sequence: Synthetic oligonucleotide
  Target: ATXN1; (+) strand; PAM type: YTN; PAM sequence: TTG
aaaaaggaagaaagtggaga

SEQ ID NO: 291943 - DNA, 20 bp, Artificial Sequence
  Description of Artificial Sequence: Synthetic oligonucleotide
  Target: ATXN1; (+) strand; PAM type: YTN; PAM sequence: CTT
ttacactgttggtgggcctg

SEQ ID NO: 291944 - DNA, 20 bp, Artificial Sequence
  Description of Artificial Sequence: Synthetic oligonucleotide
  Target: ATXN1; (+) strand; PAM type: YTN; PAM sequence: TTT
tacactgttggtgggcctgc

SEQ ID NO: 291945 - DNA, 20 bp, Artificial Sequence
  Description of Artificial Sequence: Synthetic oligonucleotide
  Target: ATXN1; (+) strand; PAM type: YTN; PAM sequence: TTT
acactgttggtgggcctgca

SEQ ID NO: 291946 - DNA, 20 bp, Artificial Sequence
  Description of Artificial Sequence: Synthetic oligonucleotide
  Target: ATXN1; (+) strand; PAM type: YTN; PAM sequence: TTA
cactgttggtgggcctgcaa

SEQ ID NO: 291947 - DNA, 20 bp, Artificial Sequence
  Description of Artificial Sequence: Synthetic oligonucleotide
  Target: ATXN1; (+) strand; PAM type: YTN; PAM sequence: CTG
ttggtgggcctgcaaactag

SEQ ID NO: 291948 - DNA, 20 bp, Artificial Sequence
  Description of Artificial Sequence: Synthetic oligonucleotide
  Target: ATXN1; (+) strand; PAM type: YTN; PAM sequence: TTG
gtgggcctgcaaactagttc

SEQ ID NO: 291949 - DNA, 20 bp, Artificial Sequence
  Description of Artificial Sequence: Synthetic oligonucleotide
  Target: ATXN1; (+) strand; PAM type: YTN; PAM sequence: CTG
caaactagttcaaccattgt

SEQ ID NO: 291950 - DNA, 20 bp, Artificial Sequence
  Description of Artificial Sequence: Synthetic oligonucleotide
  Target: ATXN1; (+) strand; PAM type: YTN; PAM sequence: CTA
gttcaaccattgtggaagac

SEQ ID NO: 291951 - DNA, 20 bp, Artificial Sequence
  Description of Artificial Sequence: Synthetic oligonucleotide
  Target: ATXN1; (+) strand; PAM type: YTN; PAM sequence: TTC
aaccattgtggaagacagtg

SEQ ID NO: 291952 - DNA, 20 bp, Artificial Sequence
  Description of Artificial Sequence: Synthetic oligonucleotide
  Target: ATXN1; (+) strand; PAM type: YTN; PAM sequence: TTG
tggaagacagtgtggcgatt

SEQ ID NO: 291953 - DNA, 20 bp, Artificial Sequence
  Description of Artificial Sequence: Synthetic oligonucleotide
  Target: ATXN1; (+) strand; PAM type: YTN; PAM sequence: TTC
ctcaaggatctagaactaga

SEQ ID NO: 291954 - DNA, 20 bp, Artificial Sequence
  Description of Artificial Sequence: Synthetic oligonucleotide
  Target: ATXN1; (+) strand; PAM type: YTN; PAM sequence: CTC
aaggatctagaactagaaat

SEQ ID NO: 291955 - DNA, 20 bp, Artificial Sequence
  Description of Artificial Sequence: Synthetic oligonucleotide
  Target: ATXN1; (+) strand; PAM type: YTN; PAM sequence: CTA
gaactagaaataccatttga

SEQ ID NO: 291956 - DNA, 20 bp, Artificial Sequence
  Description of Artificial Sequence: Synthetic oligonucleotide
  Target: ATXN1; (+) strand; PAM type: YTN; PAM sequence: CTA
gaaataccatttgacccagc

SEQ ID NO: 291957 - DNA, 20 bp, Artificial Sequence
  Description of Artificial Sequence: Synthetic oligonucleotide
  Target: ATXN1; (+) strand; PAM type: YTN; PAM sequence: TTT
gacccagccatcccattact

SEQ ID NO: 291958 - DNA, 20 bp, Artificial Sequence
  Description of Artificial Sequence: Synthetic oligonucleotide
  Target: ATXN1; (+) strand; PAM type: YTN; PAM sequence: TTG
acccagccatcccattactg

SEQ ID NO: 291959 - DNA, 20 bp, Artificial Sequence
  Description of Artificial Sequence: Synthetic oligonucleotide
  Target: ATXN1; (+) strand; PAM type: YTN; PAM sequence: TTA
ctggggatatacccaaagga

SEQ ID NO: 291960 - DNA, 20 bp, Artificial Sequence
  Description of Artificial Sequence: Synthetic oligonucleotide
  Target: ATXN1; (+) strand; PAM type: YTN; PAM sequence: CTG
gggatatacccaaaggatta

SEQ ID NO: 291961 - DNA, 20 bp, Artificial Sequence
  Description of Artificial Sequence: Synthetic oligonucleotide
  Target: ATXN1; (+) strand; PAM type: YTN; PAM sequence: TTA
taaatcatgctgctataaag

SEQ ID NO: 291962 - DNA, 20 bp, Artificial Sequence
  Description of Artificial Sequence: Synthetic oligonucleotide
  Target: ATXN1; (+) strand; PAM type: YTN; PAM sequence: CTG
ctataaaggcacatgcgcac

SEQ ID NO: 291963 - DNA, 20 bp, Artificial Sequence
  Description of Artificial Sequence: Synthetic oligonucleotide
  Target: ATXN1; (+) strand; PAM type: YTN; PAM sequence: CTA
taaaggcacatgcgcacgta

SEQ ID NO: 291964 - DNA, 20 bp, Artificial Sequence
  Description of Artificial Sequence: Synthetic oligonucleotide
  Target: ATXN1; (+) strand; PAM type: YTN; PAM sequence: TTT
attgcggcactattcacaat

SEQ ID NO: 291965 - DNA, 20 bp, Artificial Sequence
  Description of Artificial Sequence: Synthetic oligonucleotide
  Target: ATXN1; (+) strand; PAM type: YTN; PAM sequence: TTA
ttgcggcactattcacaata

SEQ ID NO: 291966 - DNA, 20 bp, Artificial Sequence
  Description of Artificial Sequence: Synthetic oligonucleotide
  Target: ATXN1; (+) strand; PAM type: YTN; PAM sequence: TTG
cggcactattcacaatagca

SEQ ID NO: 291967 - DNA, 20 bp, Artificial Sequence
  Description of Artificial Sequence: Synthetic oligonucleotide
  Target: ATXN1; (+) strand; PAM type: YTN; PAM sequence: CTA
ttcacaatagcaaagacttg

SEQ ID NO: 291968 - DNA, 20 bp, Artificial Sequence
  Description of Artificial Sequence: Synthetic oligonucleotide
  Target: ATXN1; (+) strand; PAM type: YTN; PAM sequence: TTC
acaatagcaaagacttggaa

SEQ ID NO: 291969 - DNA, 20 bp, Artificial Sequence
  Description of Artificial Sequence: Synthetic oligonucleotide
  Target: ATXN1; (+) strand; PAM type: YTN; PAM sequence: CTT
ggaaccaacccaaatgtcca

SEQ ID NO: 291970 - DNA, 20 bp, Artificial Sequence
  Description of Artificial Sequence: Synthetic oligonucleotide
  Target: ATXN1; (+) strand; PAM type: YTN; PAM sequence: TTG
gaaccaacccaaatgtccat

SEQ ID NO: 291971 - DNA, 20 bp, Artificial Sequence
  Description of Artificial Sequence: Synthetic oligonucleotide
  Target: ATXN1; (+) strand; PAM type: YTN; PAM sequence: CTG
gattaagaaaatgtggcaca

SEQ ID NO: 291972 - DNA, 20 bp, Artificial Sequence
  Description of Artificial Sequence: Synthetic oligonucleotide
  Target: ATXN1; (+) strand; PAM type: YTN; PAM sequence: TTA
agaaaatgtggcacatatac

SEQ ID NO: 291973 - DNA, 20 bp, Artificial Sequence
  Description of Artificial Sequence: Synthetic oligonucleotide
  Target: ATXN1; (+) strand; PAM type: YTN; PAM sequence: CTA
tgtagccataaaaaaggatg

SEQ ID NO: 291974 - DNA, 20 bp, Artificial Sequence
  Description of Artificial Sequence: Synthetic oligonucleotide
  Target: ATXN1; (+) strand; PAM type: YTN; PAM sequence: TTC
atgtcctttgttgggacatg

SEQ ID NO: 291975 - DNA, 20 bp, Artificial Sequence
  Description of Artificial Sequence: Synthetic oligonucleotide
  Target: ATXN1; (+) strand; PAM type: YTN; PAM sequence: CTT
tgttgggacatggatgaagc

SEQ ID NO: 291976 - DNA, 20 bp, Artificial Sequence
  Description of Artificial Sequence: Synthetic oligonucleotide
  Target: ATXN1; (+) strand; PAM type: YTN; PAM sequence: TTT
gttgggacatggatgaagct

SEQ ID NO: 291977 - DNA, 20 bp, Artificial Sequence
  Description of Artificial Sequence: Synthetic oligonucleotide
  Target: ATXN1; (+) strand; PAM type: YTN; PAM sequence: TTG
ttgggacatggatgaagctg

SEQ ID NO: 291978 - DNA, 20 bp, Artificial Sequence
  Description of Artificial Sequence: Synthetic oligonucleotide
  Target: ATXN1; (+) strand; PAM type: YTN; PAM sequence: TTG
ggacatggatgaagctggaa

SEQ ID NO: 291979 - DNA, 20 bp, Artificial Sequence
  Description of Artificial Sequence: Synthetic oligonucleotide
  Target: ATXN1; (+) strand; PAM type: YTN; PAM sequence: CTG
gaaaccatcattctcagcaa

SEQ ID NO: 291980 - DNA, 20 bp, Artificial Sequence
  Description of Artificial Sequence: Synthetic oligonucleotide
  Target: ATXN1; (+) strand; PAM type: YTN; PAM sequence: TTC
tcagcaaattatcgcaagga

SEQ ID NO: 291981 - DNA, 20 bp, Artificial Sequence
  Description of Artificial Sequence: Synthetic oligonucleotide
  Target: ATXN1; (+) strand; PAM type: YTN; PAM sequence: CTC
agcaaattatcgcaaggaca

SEQ ID NO: 291982 - DNA, 20 bp, Artificial Sequence
  Description of Artificial Sequence: Synthetic oligonucleotide
  Target: ATXN1; (+) strand; PAM type: YTN; PAM sequence: TTA
tcgcaaggacaaaaaaccaa

SEQ ID NO: 291983 - DNA, 20 bp, Artificial Sequence
  Description of Artificial Sequence: Synthetic oligonucleotide
  Target: ATXN1; (+) strand; PAM type: YTN; PAM sequence: TTC
tcactcataggtgggaattg

SEQ ID NO: 291984 - DNA, 20 bp, Artificial Sequence
  Description of Artificial Sequence: Synthetic oligonucleotide
  Target: ATXN1; (+) strand; PAM type: YTN; PAM sequence: CTC
actcataggtgggaattgaa

SEQ ID NO: 291985 - DNA, 20 bp, Artificial Sequence
  Description of Artificial Sequence: Synthetic oligonucleotide
  Target: ATXN1; (+) strand; PAM type: YTN; PAM sequence: CTC
ataggtgggaattgaacaat

SEQ ID NO: 291986 - DNA, 20 bp, Artificial Sequence
  Description of Artificial Sequence: Synthetic oligonucleotide
  Target: ATXN1; (+) strand; PAM type: YTN; PAM sequence: TTG
aacaatgagaacacttggtc

SEQ ID NO: 291987 - DNA, 20 bp, Artificial Sequence
  Description of Artificial Sequence: Synthetic oligonucleotide
  Target: ATXN1; (+) strand; PAM type: YTN; PAM sequence: CTT
ggtcacaggaaggggaacat

SEQ ID NO: 291988 - DNA, 20 bp, Artificial Sequence
  Description of Artificial Sequence: Synthetic oligonucleotide
  Target: ATXN1; (+) strand; PAM type: YTN; PAM sequence: TTG
gtcacaggaaggggaacatc

SEQ ID NO: 291989 - DNA, 20 bp, Artificial Sequence
  Description of Artificial Sequence: Synthetic oligonucleotide
  Target: ATXN1; (+) strand; PAM type: YTN; PAM sequence: CTG
tcatggagtggggggagggg

SEQ ID NO: 291990 - DNA, 20 bp, Artificial Sequence
  Description of Artificial Sequence: Synthetic oligonucleotide
  Target: ATXN1; (+) strand; PAM type: YTN; PAM sequence: CTT
taggagatatacctaatgta

SEQ ID NO: 291991 - DNA, 20 bp, Artificial Sequence
  Description of Artificial Sequence: Synthetic oligonucleotide
  Target: ATXN1; (+) strand; PAM type: YTN; PAM sequence: TTT
aggagatatacctaatgtaa

SEQ ID NO: 291992 - DNA, 20 bp, Artificial Sequence
  Description of Artificial Sequence: Synthetic oligonucleotide
  Target: ATXN1; (+) strand; PAM type: YTN; PAM sequence: TTA
ggagatatacctaatgtaaa

SEQ ID NO: 291993 - DNA, 20 bp, Artificial Sequence
  Description of Artificial Sequence: Synthetic oligonucleotide
  Target: ATXN1; (+) strand; PAM type: YTN; PAM sequence: CTA
atgtaaatgatgagttaatg

SEQ ID NO: 291994 - DNA, 20 bp, Artificial Sequence
  Description of Artificial Sequence: Synthetic oligonucleotide
  Target: ATXN1; (+) strand; PAM type: YTN; PAM sequence: TTA
atgggtgcagcacaccaaca

SEQ ID NO: 291995 - DNA, 20 bp, Artificial Sequence
  Description of Artificial Sequence: Synthetic oligonucleotide
  Target: ATXN1; (+) strand; PAM type: YTN; PAM sequence: CTG
cacattgtgcacatgtaccc

SEQ ID NO: 291996 - DNA, 20 bp, Artificial Sequence
  Description of Artificial Sequence: Synthetic oligonucleotide
  Target: ATXN1; (+) strand; PAM type: YTN; PAM sequence: TTG
tgcacatgtaccctagaact

SEQ ID NO: 291997 - DNA, 20 bp, Artificial Sequence
  Description of Artificial Sequence: Synthetic oligonucleotide
  Target: ATXN1; (+) strand; PAM type: YTN; PAM sequence: CTA
gaacttaaagtataataaaa

SEQ ID NO: 291998 - DNA, 20 bp, Artificial Sequence
  Description of Artificial Sequence: Synthetic oligonucleotide
  Target: ATXN1; (+) strand; PAM type: YTN; PAM sequence: CTT
aaagtataataaaaaataaa

SEQ ID NO: 291999 - DNA, 20 bp, Artificial Sequence
  Description of Artificial Sequence: Synthetic oligonucleotide
  Target: ATXN1; (+) strand; PAM type: YTN; PAM sequence: TTA
aagtataataaaaaataaat

SEQ ID NO: 292000 - DNA, 20 bp, Artificial Sequence
  Description of Artificial Sequence: Synthetic oligonucleotide
  Target: ATXN1; (+) strand; PAM type: YTN; PAM sequence: CTA
attgagcacactagaagtca

SEQ ID NO: 292001 - DNA, 20 bp, Artificial Sequence
  Description of Artificial Sequence: Synthetic oligonucleotide
  Target: ATXN1; (+) strand; PAM type: YTN; PAM sequence: TTG
agcacactagaagtcaacag

SEQ ID NO: 292002 - DNA, 20 bp, Artificial Sequence
  Description of Artificial Sequence: Synthetic oligonucleotide
  Target: ATXN1; (+) strand; PAM type: YTN; PAM sequence: CTA
gaagtcaacagctgtttctc

SEQ ID NO: 292003 - DNA, 20 bp, Artificial Sequence
  Description of Artificial Sequence: Synthetic oligonucleotide
  Target: ATXN1; (+) strand; PAM type: YTN; PAM sequence: CTG
tttctccaattagagtcacc

SEQ ID NO: 292004 - DNA, 20 bp, Artificial Sequence
  Description of Artificial Sequence: Synthetic oligonucleotide
  Target: ATXN1; (+) strand; PAM type: YTN; PAM sequence: TTT
ctccaattagagtcacctat

SEQ ID NO: 292005 - DNA, 20 bp, Artificial Sequence
  Description of Artificial Sequence: Synthetic oligonucleotide
  Target: ATXN1; (+) strand; PAM type: YTN; PAM sequence: TTC
tccaattagagtcacctata

SEQ ID NO: 292006 - DNA, 20 bp, Artificial Sequence
  Description of Artificial Sequence: Synthetic oligonucleotide
  Target: ATXN1; (+) strand; PAM type: YTN; PAM sequence: CTC
caattagagtcacctataac

SEQ ID NO: 292007 - DNA, 20 bp, Artificial Sequence
  Description of Artificial Sequence: Synthetic oligonucleotide
  Target: ATXN1; (+) strand; PAM type: YTN; PAM sequence: TTA
gagtcacctataacaagtga

SEQ ID NO: 292008 - DNA, 20 bp, Artificial Sequence
  Description of Artificial Sequence: Synthetic oligonucleotide
  Target: ATXN1; (+) strand; PAM type: YTN; PAM sequence: CTA
taacaagtgaattcttagca

SEQ ID NO: 292009 - DNA, 20 bp, Artificial Sequence
  Description of Artificial Sequence: Synthetic oligonucleotide
  Target: ATXN1; (+) strand; PAM type: YTN; PAM sequence: TTC
ttagcagggaaaatcacctt

SEQ ID NO: 292010 - DNA, 20 bp, Artificial Sequence
  Description of Artificial Sequence: Synthetic oligonucleotide
  Target: ATXN1; (+) strand; PAM type: YTN; PAM sequence: CTT
agcagggaaaatcaccttaa

SEQ ID NO: 292011 - DNA, 20 bp, Artificial Sequence
  Description of Artificial Sequence: Synthetic oligonucleotide
  Target: ATXN1; (+) strand; PAM type: YTN; PAM sequence: TTA
gcagggaaaatcaccttaaa

SEQ ID NO: 292012 - DNA, 20 bp, Artificial Sequence
  Description of Artificial Sequence: Synthetic oligonucleotide
  Target: ATXN1; (+) strand; PAM type: YTN; PAM sequence: CTT
aaaatatccatgtcgagtta

SEQ ID NO: 292013 - DNA, 20 bp, Artificial Sequence
  Description of Artificial Sequence: Synthetic oligonucleotide
  Target: ATXN1; (+) strand; PAM type: YTN; PAM sequence: TTA
aaatatccatgtcgagttag

SEQ ID NO: 292014 - DNA, 20 bp, Artificial Sequence
  Description of Artificial Sequence: Synthetic oligonucleotide
  Target: ATXN1; (+) strand; PAM type: YTN; PAM sequence: TTA
ggaaaaaatgtttcataaaa

SEQ ID NO: 292015 - DNA, 20 bp, Artificial Sequence
  Description of Artificial Sequence: Synthetic oligonucleotide
  Target: ATXN1; (+) strand; PAM type: YTN; PAM sequence: TTT
cataaaatagctattaaatt

SEQ ID NO: 292016 - DNA, 20 bp, Artificial Sequence
  Description of Artificial Sequence: Synthetic oligonucleotide
  Target: ATXN1; (+) strand; PAM type: YTN; PAM sequence: TTC
ataaaatagctattaaatta

SEQ ID NO: 292017 - DNA, 20 bp, Artificial Sequence
  Description of Artificial Sequence: Synthetic oligonucleotide
  Target: ATXN1; (+) strand; PAM type: YTN; PAM sequence: CTA
ttaaattaattttcttgaat

SEQ ID NO: 292018 - DNA, 20 bp, Artificial Sequence
  Description of Artificial Sequence: Synthetic oligonucleotide
  Target: ATXN1; (+) strand; PAM type: YTN; PAM sequence: TTA
aattaattttcttgaattgg

SEQ ID NO: 292019 - DNA, 20 bp, Artificial Sequence
  Description of Artificial Sequence: Synthetic oligonucleotide
  Target: ATXN1; (+) strand; PAM type: YTN; PAM sequence: TTA
attttcttgaattggcatgg

SEQ ID NO: 292020 - DNA, 20 bp, Artificial Sequence
  Description of Artificial Sequence: Synthetic oligonucleotide
  Target: ATXN1; (+) strand; PAM type: YTN; PAM sequence: TTT
tcttgaattggcatgggaca

SEQ ID NO: 292021 - DNA, 20 bp, Artificial Sequence
  Description of Artificial Sequence: Synthetic oligonucleotide
  Target: ATXN1; (+) strand; PAM type: YTN; PAM sequence: TTT
cttgaattggcatgggacaa

SEQ ID NO: 292022 - DNA, 20 bp, Artificial Sequence
  Description of Artificial Sequence: Synthetic oligonucleotide
  Target: ATXN1; (+) strand; PAM type: YTN; PAM sequence: TTC
ttgaattggcatgggacaag

SEQ ID NO: 292023 - DNA, 20 bp, Artificial Sequence
  Description of Artificial Sequence: Synthetic oligonucleotide
  Target: ATXN1; (+) strand; PAM type: YTN; PAM sequence: CTT
gaattggcatgggacaagaa

SEQ ID NO: 292024 - DNA, 20 bp, Artificial Sequence
  Description of Artificial Sequence: Synthetic oligonucleotide
  Target: ATXN1; (+) strand; PAM type: YTN; PAM sequence: TTG
aattggcatgggacaagaag

SEQ ID NO: 292025 - DNA, 20 bp, Artificial Sequence
  Description of Artificial Sequence: Synthetic oligonucleotide
  Target: ATXN1; (+) strand; PAM type: YTN; PAM sequence: TTG
gcatgggacaagaagctata

SEQ ID NO: 292026 - DNA, 20 bp, Artificial Sequence
  Description of Artificial Sequence: Synthetic oligonucleotide
  Target: ATXN1; (+) strand; PAM type: YTN; PAM sequence: CTA
tatagttcagttctgctaaa

SEQ ID NO: 292027 - DNA, 20 bp, Artificial Sequence
  Description of Artificial Sequence: Synthetic oligonucleotide
  Target: ATXN1; (+) strand; PAM type: YTN; PAM sequence: TTC
agttctgctaaacacctaaa

SEQ ID NO: 292028 - DNA, 20 bp, Artificial Sequence
  Description of Artificial Sequence: Synthetic oligonucleotide
  Target: ATXN1; (+) strand; PAM type: YTN; PAM sequence: TTC
tgctaaacacctaaaaaact

SEQ ID NO: 292029 - DNA, 20 bp, Artificial Sequence
  Description of Artificial Sequence: Synthetic oligonucleotide
  Target: ATXN1; (+) strand; PAM type: YTN; PAM sequence: CTG
ctaaacacctaaaaaactct

SEQ ID NO: 292030 - DNA, 20 bp, Artificial Sequence
  Description of Artificial Sequence: Synthetic oligonucleotide
  Target: ATXN1; (+) strand; PAM type: YTN; PAM sequence: CTA
aacacctaaaaaactctgat

SEQ ID NO: 292031 - DNA, 20 bp, Artificial Sequence
  Description of Artificial Sequence: Synthetic oligonucleotide
  Target: ATXN1; (+) strand; PAM type: YTN; PAM sequence: CTA
aaaaactctgatatactaca

SEQ ID NO: 292032 - DNA, 20 bp, Artificial Sequence
  Description of Artificial Sequence: Synthetic oligonucleotide
  Target: ATXN1; (+) strand; PAM type: YTN; PAM sequence: CTC
tgatatactacagctacgcc

SEQ ID NO: 292033 - DNA, 20 bp, Artificial Sequence
  Description of Artificial Sequence: Synthetic oligonucleotide
  Target: ATXN1; (+) strand; PAM type: YTN; PAM sequence: CTG
atatactacagctacgccag

SEQ ID NO: 292034 - DNA, 20 bp, Artificial Sequence
  Description of Artificial Sequence: Synthetic oligonucleotide
  Target: ATXN1; (+) strand; PAM type: YTN; PAM sequence: CTA
cagctacgccaggcaaatcg

SEQ ID NO: 292035 - DNA, 20 bp, Artificial Sequence
  Description of Artificial Sequence: Synthetic oligonucleotide
  Target: ATXN1; (+) strand; PAM type: YTN; PAM sequence: CTA
cgccaggcaaatcgcaagtt

SEQ ID NO: 292036 - DNA, 20 bp, Artificial Sequence
  Description of Artificial Sequence: Synthetic oligonucleotide
  Target: ATXN1; (+) strand; PAM type: YTN; PAM sequence: TTG
ttggggggcgattcccagaa

SEQ ID NO: 292037 - DNA, 20 bp, Artificial Sequence
  Description of Artificial Sequence: Synthetic oligonucleotide
  Target: ATXN1; (+) strand; PAM type: YTN; PAM sequence: TTG
gggggcgattcccagaaata

SEQ ID NO: 292038 - DNA, 20 bp, Artificial Sequence
  Description of Artificial Sequence: Synthetic oligonucleotide
  Target: ATXN1; (+) strand; PAM type: YTN; PAM sequence: TTC
ccagaaatatgtgaatcacg

SEQ ID NO: 292039 - DNA, 20 bp, Artificial Sequence
  Description of Artificial Sequence: Synthetic oligonucleotide
  Target: ATXN1; (+) strand; PAM type: YTN; PAM sequence: TTG
tgactcatcagtttgggaaa

SEQ ID NO: 292040 - DNA, 20 bp, Artificial Sequence
  Description of Artificial Sequence: Synthetic oligonucleotide
  Target: ATXN1; (+) strand; PAM type: YTN; PAM sequence: CTC
atcagtttgggaaatttagg

SEQ ID NO: 292041 - DNA, 20 bp, Artificial Sequence
  Description of Artificial Sequence: Synthetic oligonucleotide
  Target: ATXN1; (+) strand; PAM type: YTN; PAM sequence: TTT
gggaaatttaggacatgatc

SEQ ID NO: 292042 - DNA, 20 bp, Artificial Sequence
  Description of Artificial Sequence: Synthetic oligonucleotide
  Target: ATXN1; (+) strand; PAM type: YTN; PAM sequence: TTG
ggaaatttaggacatgatca

SEQ ID NO: 292043 - DNA, 20 bp, Artificial Sequence
  Description of Artificial Sequence: Synthetic oligonucleotide
  Target: ATXN1; (+) strand; PAM type: YTN; PAM sequence: TTT
aggacatgatcactatcagt

SEQ ID NO: 292044 - DNA, 20 bp, Artificial Sequence
  Description of Artificial Sequence: Synthetic oligonucleotide
  Target: ATXN1; (+) strand; PAM type: YTN; PAM sequence: TTA
ggacatgatcactatcagtc

SEQ ID NO: 292045 - DNA, 20 bp, Artificial Sequence
  Description of Artificial Sequence: Synthetic oligonucleotide
  Target: ATXN1; (+) strand; PAM type: YTN; PAM sequence: CTA
tcagtcaaacatgatattat

SEQ ID NO: 292046 - DNA, 20 bp, Artificial Sequence
  Description of Artificial Sequence: Synthetic oligonucleotide
  Target: ATXN1; (+) strand; PAM type: YTN; PAM sequence: TTA
ttatctgccaaatgtccaag

SEQ ID NO: 292047 - DNA, 20 bp, Artificial Sequence
  Description of Artificial Sequence: Synthetic oligonucleotide
  Target: ATXN1; (+) strand; PAM type: YTN; PAM sequence: TTA
tctgccaaatgtccaagata

SEQ ID NO: 292048 - DNA, 20 bp, Artificial Sequence
  Description of Artificial Sequence: Synthetic oligonucleotide
  Target: ATXN1; (+) strand; PAM type: YTN; PAM sequence: CTG
ccaaatgtccaagatataaa

SEQ ID NO: 292049 - DNA, 20 bp, Artificial Sequence
  Description of Artificial Sequence: Synthetic oligonucleotide
  Target: ATXN1; (+) strand; PAM type: YTN; PAM sequence: TTT
ccttggaaacagctggcaga

SEQ ID NO: 292050 - DNA, 20 bp, Artificial Sequence
  Description of Artificial Sequence: Synthetic oligonucleotide
  Target: ATXN1; (+) strand; PAM type: YTN; PAM sequence: TTC
cttggaaacagctggcagag

SEQ ID NO: 292051 - DNA, 20 bp, Artificial Sequence
  Description of Artificial Sequence: Synthetic oligonucleotide
  Target: ATXN1; (+) strand; PAM type: YTN; PAM sequence: CTT
ggaaacagctggcagaggta

SEQ ID NO: 292052 - DNA, 20 bp, Artificial Sequence
  Description of Artificial Sequence: Synthetic oligonucleotide
  Target: ATXN1; (+) strand; PAM type: YTN; PAM sequence: TTG
gaaacagctggcagaggtag

SEQ ID NO: 292053 - DNA, 20 bp, Artificial Sequence
  Description of Artificial Sequence: Synthetic oligonucleotide
  Target: ATXN1; (+) strand; PAM type: YTN; PAM sequence: CTG
gcagaggtaggcatagccct

SEQ ID NO: 292054 - DNA, 20 bp, Artificial Sequence
  Description of Artificial Sequence: Synthetic oligonucleotide
  Target: ATXN1; (+) strand; PAM type: YTN; PAM sequence: CTT
taattttcctaatttgtggg

SEQ ID NO: 292055 - DNA, 20 bp, Artificial Sequence
  Description of Artificial Sequence: Synthetic oligonucleotide
  Target: ATXN1; (+) strand; PAM type: YTN; PAM sequence: TTT
aattttcctaatttgtgggc

SEQ ID NO: 292056 - DNA, 20 bp, Artificial Sequence
  Description of Artificial Sequence: Synthetic oligonucleotide
  Target: ATXN1; (+) strand; PAM type: YTN; PAM sequence: TTA
attttcctaatttgtgggct

SEQ ID NO: 292057 - DNA, 20 bp, Artificial Sequence
  Description of Artificial Sequence: Synthetic oligonucleotide
  Target: ATXN1; (+) strand; PAM type: YTN; PAM sequence: TTT
tcctaatttgtgggctagca

SEQ ID NO: 292058 - DNA, 20 bp, Artificial Sequence
  Description of Artificial Sequence: Synthetic oligonucleotide
  Target: ATXN1; (+) strand; PAM type: YTN; PAM sequence: TTT
cctaatttgtgggctagcag

SEQ ID NO: 292059 - DNA, 20 bp, Artificial Sequence
  Description of Artificial Sequence: Synthetic oligonucleotide
  Target: ATXN1; (+) strand; PAM type: YTN; PAM sequence: TTC
ctaatttgtgggctagcaga

SEQ ID NO: 292060 - DNA, 20 bp, Artificial Sequence
  Description of Artificial Sequence: Synthetic oligonucleotide
  Target: ATXN1; (+) strand; PAM type: YTN; PAM sequence: CTA
atttgtgggctagcagattt

SEQ ID NO: 292061 - DNA, 20 bp, Artificial Sequence
  Description of Artificial Sequence: Synthetic oligonucleotide
  Target: ATXN1; (+) strand; PAM type: YTN; PAM sequence: TTT
gtgggctagcagattttttg

SEQ ID NO: 292062 - DNA, 20 bp, Artificial Sequence
  Description of Artificial Sequence: Synthetic oligonucleotide
  Target: ATXN1; (+) strand; PAM type: YTN; PAM sequence: TTG
tgggctagcagattttttgg

SEQ ID NO: 292063 - DNA, 20 bp, Artificial Sequence
  Description of Artificial Sequence: Synthetic oligonucleotide
  Target: ATXN1; (+) strand; PAM type: YTN; PAM sequence: CTA
gcagattttttggaatttca

SEQ ID NO: 292064 - DNA, 20 bp, Artificial Sequence
  Description of Artificial Sequence: Synthetic oligonucleotide
  Target: ATXN1; (+) strand; PAM type: YTN; PAM sequence: TTT
tttggaatttcacatactag

SEQ ID NO: 292065 - DNA, 20 bp, Artificial Sequence
  Description of Artificial Sequence: Synthetic oligonucleotide
  Target: ATXN1; (+) strand; PAM type: YTN; PAM sequence: TTT
ttggaatttcacatactagt

SEQ ID NO: 292066 - DNA, 20 bp, Artificial Sequence
  Description of Artificial Sequence: Synthetic oligonucleotide
  Target: ATXN1; (+) strand; PAM type: YTN; PAM sequence: TTT
tggaatttcacatactagta

SEQ ID NO: 292067 - DNA, 20 bp, Artificial Sequence
  Description of Artificial Sequence: Synthetic oligonucleotide
  Target: ATXN1; (+) strand; PAM type: YTN; PAM sequence: TTT
ggaatttcacatactagtat

SEQ ID NO: 292068 - DNA, 20 bp, Artificial Sequence
  Description of Artificial Sequence: Synthetic oligonucleotide
  Target: ATXN1; (+) strand; PAM type: YTN; PAM sequence: TTG
gaatttcacatactagtatg

SEQ ID NO: 292069 - DNA, 20 bp, Artificial Sequence
  Description of Artificial Sequence: Synthetic oligonucleotide
  Target: ATXN1; (+) strand; PAM type: YTN; PAM sequence: TTT
cacatactagtatgaaagag

SEQ ID NO: 292070 - DNA, 20 bp, Artificial Sequence
  Description of Artificial Sequence: Synthetic oligonucleotide
  Target: ATXN1; (+) strand; PAM type: YTN; PAM sequence: TTC
acatactagtatgaaagaga

SEQ ID NO: 292071 - DNA, 20 bp, Artificial Sequence
  Description of Artificial Sequence: Synthetic oligonucleotide
  Target: ATXN1; (+) strand; PAM type: YTN; PAM sequence: CTA
gtatgaaagagaaataaata

SEQ ID NO: 292072 - DNA, 20 bp, Artificial Sequence
  Description of Artificial Sequence: Synthetic oligonucleotide
  Target: ATXN1; (+) strand; PAM type: YTN; PAM sequence: TTT
taattaatgcatacatatgc

SEQ ID NO: 292073 - DNA, 20 bp, Artificial Sequence
  Description of Artificial Sequence: Synthetic oligonucleotide
  Target: ATXN1; (+) strand; PAM type: YTN; PAM sequence: TTT
aattaatgcatacatatgca

SEQ ID NO: 292074 - DNA, 20 bp, Artificial Sequence
  Description of Artificial Sequence: Synthetic oligonucleotide
  Target: ATXN1; (+) strand; PAM type: YTN; PAM sequence: TTA
attaatgcatacatatgcac

SEQ ID NO: 292075 - DNA, 20 bp, Artificial Sequence
  Description of Artificial Sequence: Synthetic oligonucleotide
  Target: ATXN1; (+) strand; PAM type: YTN; PAM sequence: TTA
atgcatacatatgcacagtt

SEQ ID NO: 292076 - DNA, 20 bp, Artificial Sequence
  Description of Artificial Sequence: Synthetic oligonucleotide
  Target: ATXN1; (+) strand; PAM type: YTN; PAM sequence: TTT
aaacatattcataatcaggg

SEQ ID NO: 292077 - DNA, 20 bp, Artificial Sequence
  Description of Artificial Sequence: Synthetic oligonucleotide
  Target: ATXN1; (+) strand; PAM type: YTN; PAM sequence: TTA
aacatattcataatcagggg

SEQ ID NO: 292078 - DNA, 20 bp, Artificial Sequence
  Description of Artificial Sequence: Synthetic oligonucleotide
  Target: ATXN1; (+) strand; PAM type: YTN; PAM sequence: TTC
ataatcaggggtggatccag

SEQ ID NO: 292079 - DNA, 20 bp, Artificial Sequence
  Description of Artificial Sequence: Synthetic oligonucleotide
  Target: ATXN1; (+) strand; PAM type: YTN; PAM sequence: CTG
tgaggtctgcagtttataaa

SEQ ID NO: 292080 - DNA, 20 bp, Artificial Sequence
  Description of Artificial Sequence: Synthetic oligonucleotide
  Target: ATXN1; (+) strand; PAM type: YTN; PAM sequence: CTG
cagtttataaaactagtcaa

SEQ ID NO: 292081 - DNA, 20 bp, Artificial Sequence
  Description of Artificial Sequence: Synthetic oligonucleotide
  Target: ATXN1; (+) strand; PAM type: YTN; PAM sequence: TTT
ataaaactagtcaaggggta

SEQ ID NO: 292082 - DNA, 20 bp, Artificial Sequence
  Description of Artificial Sequence: Synthetic oligonucleotide
  Target: ATXN1; (+) strand; PAM type: YTN; PAM sequence: TTA
taaaactagtcaaggggtag

SEQ ID NO: 292083 - DNA, 20 bp, Artificial Sequence
  Description of Artificial Sequence: Synthetic oligonucleotide
  Target: ATXN1; (+) strand; PAM type: YTN; PAM sequence: CTA
gtcaaggggtagaggagtgt

SEQ ID NO: 292084 - DNA, 20 bp, Artificial Sequence
  Description of Artificial Sequence: Synthetic oligonucleotide
  Target: ATXN1; (+) strand; PAM type: YTN; PAM sequence: TTA
gggtctttaagaaaagatct

SEQ ID NO: 292085 - DNA, 20 bp, Artificial Sequence
  Description of Artificial Sequence: Synthetic oligonucleotide
  Target: ATXN1; (+) strand; PAM type: YTN; PAM sequence: CTT
taagaaaagatctcaaaggc

SEQ ID NO: 292086 - DNA, 20 bp, Artificial Sequence
  Description of Artificial Sequence: Synthetic oligonucleotide
  Target: ATXN1; (+) strand; PAM type: YTN; PAM sequence: TTT
aagaaaagatctcaaaggcc

SEQ ID NO: 292087 - DNA, 20 bp, Artificial Sequence
  Description of Artificial Sequence: Synthetic oligonucleotide
  Target: ATXN1; (+) strand; PAM type: YTN; PAM sequence: TTA
agaaaagatctcaaaggcca

SEQ ID NO: 292088 - DNA, 20 bp, Artificial Sequence
  Description of Artificial Sequence: Synthetic oligonucleotide
  Target: ATXN1; (+) strand; PAM type: YTN; PAM sequence: CTC
aaaggccagccatggtcact

SEQ ID NO: 292089 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagaact

SEQ ID NO: 292090 - DNA, 20 bp, Artificial Sequence
  Description of Artificial Sequence: Synthetic oligonucleotide
  Target: ATXN1; (+) strand; PAM type: YTN; PAM sequence: CTG
taatcccagaactttgggag

SEQ ID NO: 292091 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgaagtggagga

SEQ ID NO: 292092 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaagtggaggat

SEQ ID NO: 292093 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaagtggaggatc

SEQ ID NO: 292094 - DNA, 20 bp, Artificial Sequence
  Description of Artificial Sequence: Synthetic oligonucleotide
  Target: ATXN1; (+) strand; PAM type: YTN; PAM sequence: CTG
aagtggaggatcgcttgagc

SEQ ID NO: 292095 - DNA, 20 bp, Artificial Sequence
  Description of Artificial Sequence: Synthetic oligonucleotide
  Target: ATXN1; (+) strand; PAM type: YTN; PAM sequence: CTT
gagcccaggagttcaagaca

SEQ ID NO: 292096 - DNA, 20 bp, Artificial Sequence
  Description of Artificial Sequence: Synthetic oligonucleotide
  Target: ATXN1; (+) strand; PAM type: YTN; PAM sequence: TTG
agcccaggagttcaagacaa

SEQ ID NO: 292097 - DNA, 20 bp, Artificial Sequence
  Description of Artificial Sequence: Synthetic oligonucleotide
  Target: ATXN1; (+) strand; PAM type: YTN; PAM sequence: TTC
aagacaaaactgggcaacat

SEQ ID NO: 292098 - DNA, 20 bp, Artificial Sequence
  Description of Artificial Sequence: Synthetic oligonucleotide
  Target: ATXN1; (+) strand; PAM type: YTN; PAM sequence: CTG
ggcaacatagtgagaccccc

SEQ ID NO: 292099 - DNA, 20 bp, Artificial Sequence
  Description of Artificial Sequence: Synthetic oligonucleotide
  Target: ATXN1; (+) strand; PAM type: YTN; PAM sequence: CTC
tacaaaaaaatacaaaaatt

SEQ ID NO: 292100 - DNA, 20 bp, Artificial Sequence
  Description of Artificial Sequence: Synthetic oligonucleotide
  Target: ATXN1; (+) strand; PAM type: YTN; PAM sequence: CTA
caaaaaaatacaaaaattag

SEQ ID NO: 292101 - DNA, 20 bp, Artificial Sequence
  Description of Artificial Sequence: Synthetic oligonucleotide
  Target: ATXN1; (+) strand; PAM type: YTN; PAM sequence: TTA
gctgagcatggtggcatatg

SEQ ID NO: 292102 - DNA, 20 bp, Artificial Sequence
  Description of Artificial Sequence: Synthetic oligonucleotide
  Target: ATXN1; (+) strand; PAM type: YTN; PAM sequence: CTG
agcatggtggcatatgtatc

SEQ ID NO: 292103 - DNA, 20 bp, Artificial Sequence
  Description of Artificial Sequence: Synthetic oligonucleotide
  Target: ATXN1; (+) strand; PAM type: YTN; PAM sequence: CTG
ctcacagctactcagaaggc

SEQ ID NO: 292104 - DNA, 20 bp, Artificial Sequence
  Description of Artificial Sequence: Synthetic oligonucleotide
  Target: ATXN1; (+) strand; PAM type: YTN; PAM sequence: CTC
acagctactcagaaggctca

SEQ ID NO: 292105 - DNA, 20 bp, Artificial Sequence
  Description of Artificial Sequence: Synthetic oligonucleotide
  Target: ATXN1; (+) strand; PAM type: YTN; PAM sequence: CTA
ctcagaaggctcaggtggga

SEQ ID NO: 292106 - DNA, 20 bp, Artificial Sequence
  Description of Artificial Sequence: Synthetic oligonucleotide
  Target: ATXN1; (+) strand; PAM type: YTN; PAM sequence: CTC
agaaggctcaggtgggagga

SEQ ID NO: 292107 - DNA, 20 bp, Artificial Sequence
  Description of Artificial Sequence: Synthetic oligonucleotide
  Target: ATXN1; (+) strand; PAM type: YTN; PAM sequence: CTC
aggtgggaggatcacttgag

SEQ ID NO: 292108 - DNA, 20 bp, Artificial Sequence
  Description of Artificial Sequence: Synthetic oligonucleotide
  Target: ATXN1; (+) strand; PAM type: YTN; PAM sequence: CTT
gagcctgggaggttgaggct

SEQ ID NO: 292109 - DNA, 20 bp, Artificial Sequence
  Description of Artificial Sequence: Synthetic oligonucleotide
  Target: ATXN1; (+) strand; PAM type: YTN; PAM sequence: TTG
agcctgggaggttgaggctg

SEQ ID NO: 292110 - DNA, 20 bp, Artificial Sequence
  Description of Artificial Sequence: Synthetic oligonucleotide
  Target: ATXN1; (+) strand; PAM type: YTN; PAM sequence: CTG
ggaggttgaggctgcagtga

SEQ ID NO: 292111 - DNA, 20 bp, Artificial Sequence
  Description of Artificial Sequence: Synthetic oligonucleotide
  Target: ATXN1; (+) strand; PAM type: YTN; PAM sequence: TTG
aggctgcagtgagccaagat

SEQ ID NO: 292112 - DNA, 20 bp, Artificial Sequence
  Description of Artificial Sequence: Synthetic oligonucleotide
  Target: ATXN1; (+) strand; PAM type: YTN; PAM sequence: CTG
cagtgagccaagatcacaac

SEQ ID NO: 292113 - DNA, 20 bp, Artificial Sequence
  Description of Artificial Sequence: Synthetic oligonucleotide
  Target: ATXN1; (+) strand; PAM type: YTN; PAM sequence: CTG
caatccagcctggatgacag

SEQ ID NO: 292114 - DNA, 20 bp, Artificial Sequence
  Description of Artificial Sequence: Synthetic oligonucleotide
  Target: ATXN1; (+) strand; PAM type: YTN; PAM sequence: CTG
gatgacagagctagacgctg

SEQ ID NO: 292115 - DNA, 20 bp, Artificial Sequence
  Description of Artificial Sequence: Synthetic oligonucleotide
  Target: ATXN1; (+) strand; PAM type: YTN; PAM sequence: CTA
gacgctgcctcaaaaaaaaa

SEQ ID NO: 292116 - DNA, 20 bp, Artificial Sequence
  Description of Artificial Sequence: Synthetic oligonucleotide
  Target: ATXN1; (+) strand; PAM type: YTN; PAM sequence: CTG
cctcaaaaaaaaaaaaaaaa

SEQ ID NO: 292117 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaaaaaa

SEQ ID NO: 292118 - DNA, 20 bp, Artificial Sequence
  Description of Artificial Sequence: Synthetic oligonucleotide
  Target: ATXN1; (+) strand; PAM type: YTN; PAM sequence: CTG
cacaaaattatcaacataaa

SEQ ID NO: 292119 - DNA, 20 bp, Artificial Sequence
  Description of Artificial Sequence: Synthetic oligonucleotide
  Target: ATXN1; (+) strand; PAM type: YTN; PAM sequence: TTA
tcaacataaaattaggtaca

SEQ ID NO: 292120 - DNA, 20 bp, Artificial Sequence
  Description of Artificial Sequence: Synthetic oligonucleotide
  Target: ATXN1; (+) strand; PAM type: YTN; PAM sequence: TTA
ggtacagggtcttacaaagg

SEQ ID NO: 292121 - DNA, 20 bp, Artificial Sequence
  Description of Artificial Sequence: Synthetic oligonucleotide
  Target: ATXN1; (+) strand; PAM type: YTN; PAM sequence: CTT
acaaagggcctgcaggagcg

SEQ ID NO: 292122 - DNA, 20 bp, Artificial Sequence
  Description of Artificial Sequence: Synthetic oligonucleotide
  Target: ATXN1; (+) strand; PAM type: YTN; PAM sequence: TTA
caaagggcctgcaggagcga

SEQ ID NO: 292123 - DNA, 20 bp, Artificial Sequence
  Description of Artificial Sequence: Synthetic oligonucleotide
  Target: ATXN1; (+) strand; PAM type: YTN; PAM sequence: CTG
caggagcgagacgccttgac

SEQ ID NO: 292124 - DNA, 20 bp, Artificial Sequence
  Description of Artificial Sequence: Synthetic oligonucleotide
  Target: ATXN1; (+) strand; PAM type: YTN; PAM sequence: CTT
gacgctgaagtgtcactagc

SEQ ID NO: 292125 - DNA, 20 bp, Artificial Sequence
  Description of Artificial Sequence: Synthetic oligonucleotide
  Target: ATXN1; (+) strand; PAM type: YTN; PAM sequence: TTG
acgctgaagtgtcactagct

SEQ ID NO: 292126 - DNA, 20 bp, Artificial Sequence
  Description of Artificial Sequence: Synthetic oligonucleotide
  Target: ATXN1; (+) strand; PAM type: YTN; PAM sequence: CTG
aagtgtcactagcttccaga

SEQ ID NO: 292127 - DNA, 20 bp, Artificial Sequence
  Description of Artificial Sequence: Synthetic oligonucleotide
  Target: ATXN1; (+) strand; PAM type: YTN; PAM sequence: CTA
gcttccagataaaacctcct

SEQ ID NO: 292128 - DNA, 20 bp, Artificial Sequence
  Description of Artificial Sequence: Synthetic oligonucleotide
  Target: ATXN1; (+) strand; PAM type: YTN; PAM sequence: CTT
ccagataaaacctcctggcc

SEQ ID NO: 292129 - DNA, 20 bp, Artificial Sequence
  Description of Artificial Sequence: Synthetic oligonucleotide
  Target: ATXN1; (+) strand; PAM type: YTN; PAM sequence: TTC
cagataaaacctcctggccc

SEQ ID NO: 292130 - DNA, 20 bp, Artificial Sequence
  Description of Artificial Sequence: Synthetic oligonucleotide
  Target: ATXN1; (+) strand; PAM type: YTN; PAM sequence: CTC
ctggcccacaatgcatgcac

SEQ ID NO: 292131 - DNA, 20 bp, Artificial Sequence
  Description of Artificial Sequence: Synthetic oligonucleotide
  Target: ATXN1; (+) strand; PAM type: YTN; PAM sequence: CTG
gcccacaatgcatgcacaca

SEQ ID NO: 292132 - DNA, 20 bp, Artificial Sequence
  Description of Artificial Sequence: Synthetic oligonucleotide
  Target: ATXN1; (+) strand; PAM type: YTN; PAM sequence: CTA
taaatgaccaagatcaacat

SEQ ID NO: 292133 - DNA, 20 bp, Artificial Sequence
  Description of Artificial Sequence: Synthetic oligonucleotide
  Target: ATXN1; (+) strand; PAM type: YTN; PAM sequence: TTT
cattataattcccttcaatg

SEQ ID NO: 292134 - DNA, 20 bp, Artificial Sequence
  Description of Artificial Sequence: Synthetic oligonucleotide
  Target: ATXN1; (+) strand; PAM type: YTN; PAM sequence: TTC
attataattcccttcaatgc

SEQ ID NO: 292135 - DNA, 20 bp, Artificial Sequence
  Description of Artificial Sequence: Synthetic oligonucleotide
  Target: ATXN1; (+) strand; PAM type: YTN; PAM sequence: TTA
taattcccttcaatgccaag

SEQ ID NO: 292136 - DNA, 20 bp, Artificial Sequence
  Description of Artificial Sequence: Synthetic oligonucleotide
  Target: ATXN1; (+) strand; PAM type: YTN; PAM sequence: TTC
ccttcaatgccaagtatatg

SEQ ID NO: 292137 - DNA, 20 bp, Artificial Sequence
  Description of Artificial Sequence: Synthetic oligonucleotide
  Target: ATXN1; (+) strand; PAM type: YTN; PAM sequence: CTT
caatgccaagtatatggtaa

SEQ ID NO: 292138 - DNA, 20 bp, Artificial Sequence
  Description of Artificial Sequence: Synthetic oligonucleotide
  Target: ATXN1; (+) strand; PAM type: YTN; PAM sequence: TTC
aatgccaagtatatggtaaa

SEQ ID NO: 292139 - DNA, 20 bp, Artificial Sequence
  Description of Artificial Sequence: Synthetic oligonucleotide
  Target: ATXN1; (+) strand; PAM type: YTN; PAM sequence: CTT
tagtatacatttttgctgag

SEQ ID NO: 292140 - DNA, 20 bp, Artificial Sequence
  Description of Artificial Sequence: Synthetic oligonucleotide
  Target: ATXN1; (+) strand; PAM type: YTN; PAM sequence: TTT
agtatacatttttgctgagt

SEQ ID NO: 292141 - DNA, 20 bp, Artificial Sequence
  Description of Artificial Sequence: Synthetic oligonucleotide
  Target: ATXN1; (+) strand; PAM type: YTN; PAM sequence: TTA
gtatacatttttgctgagta

SEQ ID NO: 292142 - DNA, 20 bp, Artificial Sequence
  Description of Artificial Sequence: Synthetic oligonucleotide
  Target: ATXN1; (+) strand; PAM type: YTN; PAM sequence: TTT
ttgctgagtacacgtgacta

SEQ ID NO: 292143 - DNA, 20 bp, Artificial Sequence
  Description of Artificial Sequence: Synthetic oligonucleotide
  Target: ATXN1; (+) strand; PAM type: YTN; PAM sequence: TTT
tgctgagtacacgtgactaa

SEQ ID NO: 292144 - DNA, 20 bp, Artificial Sequence
  Description of Artificial Sequence: Synthetic oligonucleotide
  Target: ATXN1; (+) strand; PAM type: YTN; PAM sequence: TTT
gctgagtacacgtgactaaa

SEQ ID NO: 292145 - DNA, 20 bp, Artificial Sequence
  Description of Artificial Sequence: Synthetic oligonucleotide
  Target: ATXN1; (+) strand; PAM type: YTN; PAM sequence: TTG
ctgagtacacgtgactaaat

SEQ ID NO: 292146 - DNA, 20 bp, Artificial Sequence
  Description of Artificial Sequence: Synthetic oligonucleotide
  Target: ATXN1; (+) strand; PAM type: YTN; PAM sequence: CTG
agtacacgtgactaaataga

SEQ ID NO: 292147 - DNA, 20 bp, Artificial Sequence
  Description of Artificial Sequence: Synthetic oligonucleotide
  Target: ATXN1; (+) strand; PAM type: YTN; PAM sequence: CTA
aatagaaatgtttacaaatt

SEQ ID NO: 292148 - DNA, 20 bp, Artificial Sequence
  Description of Artificial Sequence: Synthetic oligonucleotide
  Target: ATXN1; (+) strand; PAM type: YTN; PAM sequence: TTT
acaaattatgttgtcgagct

SEQ ID NO: 292149 - DNA, 20 bp, Artificial Sequence
  Description of Artificial Sequence: Synthetic oligonucleotide
  Target: ATXN1; (+) strand; PAM type: YTN; PAM sequence: TTA
caaattatgttgtcgagctg

SEQ ID NO: 292150 - DNA, 20 bp, Artificial Sequence
  Description of Artificial Sequence: Synthetic oligonucleotide
  Target: ATXN1; (+) strand; PAM type: YTN; PAM sequence: TTA
tgttgtcgagctgttaaatg

SEQ ID NO: 292151 - DNA, 20 bp, Artificial Sequence
  Description of Artificial Sequence: Synthetic oligonucleotide
  Target: ATXN1; (+) strand; PAM type: YTN; PAM sequence: TTG
tcgagctgttaaatgaattc

SEQ ID NO: 292152 - DNA, 20 bp, Artificial Sequence
  Description of Artificial Sequence: Synthetic oligonucleotide
  Target: ATXN1; (+) strand; PAM type: YTN; PAM sequence: CTG
ttaaatgaattccaatatgt

SEQ ID NO: 292153 - DNA, 20 bp, Artificial Sequence
  Description of Artificial Sequence: Synthetic oligonucleotide
  Target: ATXN1; (+) strand; PAM type: YTN; PAM sequence: TTA
aatgaattccaatatgtggc

SEQ ID NO: 292154 - DNA, 20 bp, Artificial Sequence
  Description of Artificial Sequence: Synthetic oligonucleotide
  Target: ATXN1; (+) strand; PAM type: YTN; PAM sequence: TTC
caatatgtggctttactacc

SEQ ID NO: 292155 - DNA, 20 bp, Artificial Sequence
  Description of Artificial Sequence: Synthetic oligonucleotide
  Target: ATXN1; (+) strand; PAM type: YTN; PAM sequence: CTT
tactacctcatcaggaaaac

SEQ ID NO: 292156 - DNA, 20 bp, Artificial Sequence
  Description of Artificial Sequence: Synthetic oligonucleotide
  Target: ATXN1; (+) strand; PAM type: YTN; PAM sequence: TTT
actacctcatcaggaaaacc

SEQ ID NO: 292157 - DNA, 20 bp, Artificial Sequence
  Description of Artificial Sequence: Synthetic oligonucleotide
  Target: ATXN1; (+) strand; PAM type: YTN; PAM sequence: TTA
ctacctcatcaggaaaacct

SEQ ID NO: 292158 - DNA, 20 bp, Artificial Sequence
  Description of Artificial Sequence: Synthetic oligonucleotide
  Target: ATXN1; (+) strand; PAM type: YTN; PAM sequence: CTA
cctcatcaggaaaacctgta

SEQ ID NO: 292159 - DNA, 20 bp, Artificial Sequence
  Description of Artificial Sequence: Synthetic oligonucleotide
  Target: ATXN1; (+) strand; PAM type: YTN; PAM sequence: CTC
atcaggaaaacctgtatccc

SEQ ID NO: 292160 - DNA, 20 bp, Artificial Sequence
  Description of Artificial Sequence: Synthetic oligonucleotide
  Target: ATXN1; (+) strand; PAM type: YTN; PAM sequence: CTG
tatcccacagtcatttatca

SEQ ID NO: 292161 - DNA, 20 bp, Artificial Sequence
  Description of Artificial Sequence: Synthetic oligonucleotide
  Target: ATXN1; (+) strand; PAM type: YTN; PAM sequence: TTT
atcaggcagcaatgtctagc

SEQ ID NO: 292162 - DNA, 20 bp, Artificial Sequence
  Description of Artificial Sequence: Synthetic oligonucleotide
  Target: ATXN1; (+) strand; PAM type: YTN; PAM sequence: TTA
tcaggcagcaatgtctagct

SEQ ID NO: 292163 - DNA, 20 bp, Artificial Sequence
  Description of Artificial Sequence: Synthetic oligonucleotide
  Target: ATXN1; (+) strand; PAM type: YTN; PAM sequence: CTA
gcttatggaaacccatctgc

SEQ ID NO: 292164 - DNA, 20 bp, Artificial Sequence
  Description of Artificial Sequence: Synthetic oligonucleotide
  Target: ATXN1; (+) strand; PAM type: YTN; PAM sequence: CTT
atggaaacccatctgcaggt

SEQ ID NO: 292165 - DNA, 20 bp, Artificial Sequence
  Description of Artificial Sequence: Synthetic oligonucleotide
  Target: ATXN1; (+) strand; PAM type: YTN; PAM sequence: TTA
tggaaacccatctgcaggtt

SEQ ID NO: 292166 - DNA, 20 bp, Artificial Sequence
  Description of Artificial Sequence: Synthetic oligonucleotide
  Target: ATXN1; (+) strand; PAM type: YTN; PAM sequence: CTG
caggttcctaagcaagtagc

SEQ ID NO: 292167 - DNA, 20 bp, Artificial Sequence
  Description of Artificial Sequence: Synthetic oligonucleotide
  Target: ATXN1; (+) strand; PAM type: YTN; PAM sequence: TTC
ctaagcaagtagcccagatt

SEQ ID NO: 292168 - DNA, 20 bp, Artificial Sequence
  Description of Artificial Sequence: Synthetic oligonucleotide
  Target: ATXN1; (+) strand; PAM type: YTN; PAM sequence: CTA
agcaagtagcccagattaat

SEQ ID NO: 292169 - DNA, 20 bp, Artificial Sequence
  Description of Artificial Sequence: Synthetic oligonucleotide
  Target: ATXN1; (+) strand; PAM type: YTN; PAM sequence: TTA
atatcatagtgcagctagtc

SEQ ID NO: 292170 - DNA, 20 bp, Artificial Sequence
  Description of Artificial Sequence: Synthetic oligonucleotide
  Target: ATXN1; (+) strand; PAM type: YTN; PAM sequence: CTA
gtcggtggctataattaaat

SEQ ID NO: 292171 - DNA, 20 bp, Artificial Sequence
  Description of Artificial Sequence: Synthetic oligonucleotide
  Target: ATXN1; (+) strand; PAM type: YTN; PAM sequence: CTA
taattaaatgcagaagtggt

SEQ ID NO: 292172 - DNA, 20 bp, Artificial Sequence
  Description of Artificial Sequence: Synthetic oligonucleotide
  Target: ATXN1; (+) strand; PAM type: YTN; PAM sequence: TTA
aatgcagaagtggtattgag

SEQ ID NO: 292173 - DNA, 20 bp, Artificial Sequence
  Description of Artificial Sequence: Synthetic oligonucleotide
  Target: ATXN1; (+) strand; PAM type: YTN; PAM sequence: TTG
agaggtgaagccagctggac

SEQ ID NO: 292174 - DNA, 20 bp, Artificial Sequence
  Description of Artificial Sequence: Synthetic oligonucleotide
  Target: ATXN1; (+) strand; PAM type: YTN; PAM sequence: CTG
gacttcttgggtcgagtggg

SEQ ID NO: 292175 - DNA, 20 bp, Artificial Sequence
  Description of Artificial Sequence: Synthetic oligonucleotide
  Target: ATXN1; (+) strand; PAM type: YTN; PAM sequence: CTT
cttgggtcgagtggggactt

SEQ ID NO: 292176 - DNA, 20 bp, Artificial Sequence
  Description of Artificial Sequence: Synthetic oligonucleotide
  Target: ATXN1; (+) strand; PAM type: YTN; PAM sequence: TTC
ttgggtcgagtggggacttg

SEQ ID NO: 292177 - DNA, 20 bp, Artificial Sequence
  Description of Artificial Sequence: Synthetic oligonucleotide
  Target: ATXN1; (+) strand; PAM type: YTN; PAM sequence: CTT
gggtcgagtggggacttgga

SEQ ID NO: 292178 - DNA, 20 bp, Artificial Sequence
  Description of Artificial Sequence: Synthetic oligonucleotide
  Target: ATXN1; (+) strand; PAM type: YTN; PAM sequence: TTG
ggtcgagtggggacttggag

SEQ ID NO: 292179 - DNA, 20 bp, Artificial Sequence
  Description of Artificial Sequence: Synthetic oligonucleotide
  Target: ATXN1; (+) strand; PAM type: YTN; PAM sequence: CTT
ggagaacttttctgtcttac

SEQ ID NO: 292180 - DNA, 20 bp, Artificial Sequence
  Description of Artificial Sequence: Synthetic oligonucleotide
  Target: ATXN1; (+) strand; PAM type: YTN; PAM sequence: TTG
gagaacttttctgtcttaca

SEQ ID NO: 292181 - DNA, 20 bp, Artificial Sequence
  Description of Artificial Sequence: Synthetic oligonucleotide
  Target: ATXN1; (+) strand; PAM type: YTN; PAM sequence: CTT
ttctgtcttacaaggggatt

SEQ ID NO: 292182 - DNA, 20 bp, Artificial Sequence
  Description of Artificial Sequence: Synthetic oligonucleotide
  Target: ATXN1; (+) strand; PAM type: YTN; PAM sequence: TTT
tctgtcttacaaggggattg

SEQ ID NO: 292183 - DNA, 20 bp, Artificial Sequence
  Description of Artificial Sequence: Synthetic oligonucleotide
  Target: ATXN1; (+) strand; PAM type: YTN; PAM sequence: TTT
ctgtcttacaaggggattgt

SEQ ID NO: 292184 - DNA, 20 bp, Artificial Sequence
  Description of Artificial Sequence: Synthetic oligonucleotide
  Target: ATXN1; (+) strand; PAM type: YTN; PAM sequence: TTC
tgtcttacaaggggattgta

SEQ ID NO: 292185 - DNA, 20 bp, Artificial Sequence
  Description of Artificial Sequence: Synthetic oligonucleotide
  Target: ATXN1; (+) strand; PAM type: YTN; PAM sequence: CTG
tcttacaaggggattgtaaa

SEQ ID NO: 292186 - DNA, 20 bp, Artificial Sequence
  Description of Artificial Sequence: Synthetic oligonucleotide
  Target: ATXN1; (+) strand; PAM type: YTN; PAM sequence: CTT
acaaggggattgtaaaatgc

SEQ ID NO: 292187 - DNA, 20 bp, Artificial Sequence
  Description of Artificial Sequence: Synthetic oligonucleotide
  Target: ATXN1; (+) strand; PAM type: YTN; PAM sequence: TTA
caaggggattgtaaaatgca

SEQ ID NO: 292188 - DNA, 20 bp, Artificial Sequence
  Description of Artificial Sequence: Synthetic oligonucleotide
  Target: ATXN1; (+) strand; PAM type: YTN; PAM sequence: TTG
taaaatgcaccaatgagtgc

SEQ ID NO: 292189 - DNA, 20 bp, Artificial Sequence
  Description of Artificial Sequence: Synthetic oligonucleotide
  Target: ATXN1; (+) strand; PAM type: YTN; PAM sequence: CTC
tgtaaaaacacaccaatcag

SEQ ID NO: 292190 - DNA, 20 bp, Artificial Sequence
  Description of Artificial Sequence: Synthetic oligonucleotide
  Target: ATXN1; (+) strand; PAM type: YTN; PAM sequence: CTG
taaaaacacaccaatcagcg

SEQ ID NO: 292191 - DNA, 20 bp, Artificial Sequence
  Description of Artificial Sequence: Synthetic oligonucleotide
  Target: ATXN1; (+) strand; PAM type: YTN; PAM sequence: CTC
tgtagctagcttgaggtttg

SEQ ID NO: 292192 - DNA, 20 bp, Artificial Sequence
  Description of Artificial Sequence: Synthetic oligonucleotide
  Target: ATXN1; (+) strand; PAM type: YTN; PAM sequence: CTG
tagctagcttgaggtttgta

SEQ ID NO: 292193 - DNA, 20 bp, Artificial Sequence
  Description of Artificial Sequence: Synthetic oligonucleotide
  Target: ATXN1; (+) strand; PAM type: YTN; PAM sequence: CTA
gcttgaggtttgtaaaatgg

SEQ ID NO: 292194 - DNA, 20 bp, Artificial Sequence
  Description of Artificial Sequence: Synthetic oligonucleotide
  Target: ATXN1; (+) strand; PAM type: YTN; PAM sequence: CTT
gaggtttgtaaaatggacca

SEQ ID NO: 292195 - DNA, 20 bp, Artificial Sequence
  Description of Artificial Sequence: Synthetic oligonucleotide
  Target: ATXN1; (+) strand; PAM type: YTN; PAM sequence: TTG
aggtttgtaaaatggaccaa

SEQ ID NO: 292196 - DNA, 20 bp, Artificial Sequence
  Description of Artificial Sequence: Synthetic oligonucleotide
  Target: ATXN1; (+) strand; PAM type: YTN; PAM sequence: TTT
gtaaaatggaccaatcagca

SEQ ID NO: 292197 - DNA, 20 bp, Artificial Sequence
  Description of Artificial Sequence: Synthetic oligonucleotide
  Target: ATXN1; (+) strand; PAM type: YTN; PAM sequence: TTG
taaaatggaccaatcagcac

SEQ ID NO: 292198 - DNA, 20 bp, Artificial Sequence
  Description of Artificial Sequence: Synthetic oligonucleotide
  Target: ATXN1; (+) strand; PAM type: YTN; PAM sequence: CTC
tgtaaaatggaccaatcagt

SEQ ID NO: 292199 - DNA, 20 bp, Artificial Sequence
  Description of Artificial Sequence: Synthetic oligonucleotide
  Target: ATXN1; (+) strand; PAM type: YTN; PAM sequence: CTG
taaaatggaccaatcagtgc

SEQ ID NO: 292200 - DNA, 20 bp, Artificial Sequence
  Description of Artificial Sequence: Synthetic oligonucleotide
  Target: ATXN1; (+) strand; PAM type: YTN; PAM sequence: CTC
tgtagaatggaccaatcagc

SEQ ID NO: 292201 - DNA, 20 bp, Artificial Sequence
  Description of Artificial Sequence: Synthetic oligonucleotide
  Target: ATXN1; (+) strand; PAM type: YTN; PAM sequence: CTG
tagaatggaccaatcagcag

SEQ ID NO: 292202 - DNA, 20 bp, Artificial Sequence
  Description of Artificial Sequence: Synthetic oligonucleotide
  Target: ATXN1; (+) strand; PAM type: YTN; PAM sequence: CTG
gccacgccagccagcagaga

SEQ ID NO: 292203 - DNA, 20 bp, Artificial Sequence
  Description of Artificial Sequence: Synthetic oligonucleotide
  Target: ATXN1; (+) strand; PAM type: YTN; PAM sequence: CTC
gggtccccttccacgctgtg

SEQ ID NO: 292204 - DNA, 20 bp, Artificial Sequence
  Description of Artificial Sequence: Synthetic oligonucleotide
  Target: ATXN1; (+) strand; PAM type: YTN; PAM sequence: CTT
ccacgctgtggaaggtttgt

SEQ ID NO: 292205 - DNA, 20 bp, Artificial Sequence
  Description of Artificial Sequence: Synthetic oligonucleotide
  Target: ATXN1; (+) strand; PAM type: YTN; PAM sequence: TTC
cacgctgtggaaggtttgtt

SEQ ID NO: 292206 - DNA, 20 bp, Artificial Sequence
  Description of Artificial Sequence: Synthetic oligonucleotide
  Target: ATXN1; (+) strand; PAM type: YTN; PAM sequence: CTG
tggaaggtttgttctttcgc

SEQ ID NO: 292207 - DNA, 20 bp, Artificial Sequence
  Description of Artificial Sequence: Synthetic oligonucleotide
  Target: ATXN1; (+) strand; PAM type: YTN; PAM sequence: TTT
gttctttcgctcctcacaat

SEQ ID NO: 292208 - DNA, 20 bp, Artificial Sequence
  Description of Artificial Sequence: Synthetic oligonucleotide
  Target: ATXN1; (+) strand; PAM type: YTN; PAM sequence: TTG
ttctttcgctcctcacaata

SEQ ID NO: 292209 - DNA, 20 bp, Artificial Sequence
  Description of Artificial Sequence: Synthetic oligonucleotide
  Target: ATXN1; (+) strand; PAM type: YTN; PAM sequence: TTC
tttcgctcctcacaataaat

SEQ ID NO: 292210 - DNA, 20 bp, Artificial Sequence
  Description of Artificial Sequence: Synthetic oligonucleotide
  Target: ATXN1; (+) strand; PAM type: YTN; PAM sequence: CTT
tcgctcctcacaataaatct

SEQ ID NO: 292211 - DNA, 20 bp, Artificial Sequence
  Description of Artificial Sequence: Synthetic oligonucleotide
  Target: ATXN1; (+) strand; PAM type: YTN; PAM sequence: TTT
cgctcctcacaataaatctt

SEQ ID NO: 292212 - DNA, 20 bp, Artificial Sequence
  Description of Artificial Sequence: Synthetic oligonucleotide
  Target: ATXN1; (+) strand; PAM type: YTN; PAM sequence: TTC
gctcctcacaataaatcttg

SEQ ID NO: 292213 - DNA, 20 bp, Artificial Sequence
  Description of Artificial Sequence: Synthetic oligonucleotide
  Target: ATXN1; (+) strand; PAM type: YTN; PAM sequence: CTC
ctcacaataaatcttgctac

SEQ ID NO: 292214 - DNA, 20 bp, Artificial Sequence
  Description of Artificial Sequence: Synthetic oligonucleotide
  Target: ATXN1; (+) strand; PAM type: YTN; PAM sequence: CTC
acaataaatcttgctactgc

SEQ ID NO: 292215 - DNA, 20 bp, Artificial Sequence
  Description of Artificial Sequence: Synthetic oligonucleotide
  Target: ATXN1; (+) strand; PAM type: YTN; PAM sequence: CTT
gctactgctcgctctttggg

SEQ ID NO: 292216 - DNA, 20 bp, Artificial Sequence
  Description of Artificial Sequence: Synthetic oligonucleotide
  Target: ATXN1; (+) strand; PAM type: YTN; PAM sequence: TTG
ctactgctcgctctttgggt

SEQ ID NO: 292217 - DNA, 20 bp, Artificial Sequence
  Description of Artificial Sequence: Synthetic oligonucleotide
  Target: ATXN1; (+) strand; PAM type: YTN; PAM sequence: CTA
ctgctcgctctttgggtccc

SEQ ID NO: 292218 - DNA, 20 bp, Artificial Sequence
  Description of Artificial Sequence: Synthetic oligonucleotide
  Target: ATXN1; (+) strand; PAM type: YTN; PAM sequence: CTG
ctcgctctttgggtccctac

SEQ ID NO: 292219 - DNA, 20 bp, Artificial Sequence
  Description of Artificial Sequence: Synthetic oligonucleotide
  Target: ATXN1; (+) strand; PAM type: YTN; PAM sequence: CTC
gctctttgggtccctaccat

SEQ ID NO: 292220 - DNA, 20 bp, Artificial Sequence
  Description of Artificial Sequence: Synthetic oligonucleotide
  Target: ATXN1; (+) strand; PAM type: YTN; PAM sequence: CTC
tttgggtccctaccatcttt

SEQ ID NO: 292221 - DNA, 20 bp, Artificial Sequence
  Description of Artificial Sequence: Synthetic oligonucleotide
  Target: ATXN1; (+) strand; PAM type: YTN; PAM sequence: CTT
tgggtccctaccatctttaa

SEQ ID NO: 292222 - DNA, 20 bp, Artificial Sequence
  Description of Artificial Sequence: Synthetic oligonucleotide
  Target: ATXN1; (+) strand; PAM type: YTN; PAM sequence: TTT
gggtccctaccatctttaag

SEQ ID NO: 292223 - DNA, 20 bp, Artificial Sequence
  Description of Artificial Sequence: Synthetic oligonucleotide
  Target: ATXN1; (+) strand; PAM type: YTN; PAM sequence: TTG
ggtccctaccatctttaaga

SEQ ID NO: 292224 - DNA, 20 bp, Artificial Sequence
  Description of Artificial Sequence: Synthetic oligonucleotide
  Target: ATXN1; (+) strand; PAM type: YTN; PAM sequence: CTA
ccatctttaagagctgtaac

SEQ ID NO: 292225 - DNA, 20 bp, Artificial Sequence
  Description of Artificial Sequence: Synthetic oligonucleotide
  Target: ATXN1; (+) strand; PAM type: YTN; PAM sequence: CTT
taagagctgtaacactcact

SEQ ID NO: 292226 - DNA, 20 bp, Artificial Sequence
  Description of Artificial Sequence: Synthetic oligonucleotide
  Target: ATXN1; (+) strand; PAM type: YTN; PAM sequence: TTT
aagagctgtaacactcactg

SEQ ID NO: 292227 - DNA, 20 bp, Artificial Sequence
  Description of Artificial Sequence: Synthetic oligonucleotide
  Target: ATXN1; (+) strand; PAM type: YTN; PAM sequence: TTA
agagctgtaacactcactgt

SEQ ID NO: 292228 - DNA, 20 bp, Artificial Sequence
  Description of Artificial Sequence: Synthetic oligonucleotide
  Target: ATXN1; (+) strand; PAM type: YTN; PAM sequence: CTG
taacactcactgtgaaggtc

SEQ ID NO: 292229 - DNA, 20 bp, Artificial Sequence
  Description of Artificial Sequence: Synthetic oligonucleotide
  Target: ATXN1; (+) strand; PAM type: YTN; PAM sequence: CTC
actgtgaaggtccgtggctc

SEQ ID NO: 292230 - DNA, 20 bp, Artificial Sequence
  Description of Artificial Sequence: Synthetic oligonucleotide
  Target: ATXN1; (+) strand; PAM type: YTN; PAM sequence: CTG
tgaaggtccgtggctccatt

SEQ ID NO: 292231 - DNA, 20 bp, Artificial Sequence
  Description of Artificial Sequence: Synthetic oligonucleotide
  Target: ATXN1; (+) strand; PAM type: YTN; PAM sequence: CTC
cattcttgaagtcagcaaga

SEQ ID NO: 292232 - DNA, 20 bp, Artificial Sequence
  Description of Artificial Sequence: Synthetic oligonucleotide
  Target: ATXN1; (+) strand; PAM type: YTN; PAM sequence: TTC
ttgaagtcagcaagaccaca

SEQ ID NO: 292233 - DNA, 20 bp, Artificial Sequence
  Description of Artificial Sequence: Synthetic oligonucleotide
  Target: ATXN1; (+) strand; PAM type: YTN; PAM sequence: CTT
gaagtcagcaagaccacaaa

SEQ ID NO: 292234 - DNA, 20 bp, Artificial Sequence
  Description of Artificial Sequence: Synthetic oligonucleotide
  Target: ATXN1; (+) strand; PAM type: YTN; PAM sequence: TTG
aagtcagcaagaccacaaac

SEQ ID NO: 292235 - DNA, 20 bp, Artificial Sequence
  Description of Artificial Sequence: Synthetic oligonucleotide
  Target: ATXN1; (+) strand; PAM type: YTN; PAM sequence: CTA
tcggaaggaaccaactccag

SEQ ID NO: 292236 - DNA, 20 bp, Artificial Sequence
  Description of Artificial Sequence: Synthetic oligonucleotide
  Target: ATXN1; (+) strand; PAM type: YTN; PAM sequence: CTC
cagacacaggctcaccgcaa

SEQ ID NO: 292237 - DNA, 20 bp, Artificial Sequence
  Description of Artificial Sequence: Synthetic oligonucleotide
  Target: ATXN1; (+) strand; PAM type: YTN; PAM sequence: CTC
accgcaacctccacctccta

SEQ ID NO: 292238 - DNA, 20 bp, Artificial Sequence
  Description of Artificial Sequence: Synthetic oligonucleotide
  Target: ATXN1; (+) strand; PAM type: YTN; PAM sequence: CTC
cacctcctaggttcaagcga

SEQ ID NO: 292239 - DNA, 20 bp, Artificial Sequence
  Description of Artificial Sequence: Synthetic oligonucleotide
  Target: ATXN1; (+) strand; PAM type: YTN; PAM sequence: CTC
ctaggttcaagcgattctcc

SEQ ID NO: 292240 - DNA, 20 bp, Artificial Sequence
  Description of Artificial Sequence: Synthetic oligonucleotide
  Target: ATXN1; (+) strand; PAM type: YTN; PAM sequence: CTA
ggttcaagcgattctcctgc

SEQ ID NO: 292241 - DNA, 20 bp, Artificial Sequence
  Description of Artificial Sequence: Synthetic oligonucleotide
  Target: ATXN1; (+) strand; PAM type: YTN; PAM sequence: TTC
aagcgattctcctgcctcag

SEQ ID NO: 292242 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagccgcctaag

SEQ ID NO: 292243 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagccgcctaagta

SEQ ID NO: 292244 - DNA, 20 bp, Artificial Sequence
  Description of Artificial Sequence: Synthetic oligonucleotide
  Target: ATXN1; (+) strand; PAM type: YTN; PAM sequence: CTG
cctcagccgcctaagtagct

SEQ ID NO: 292245 - DNA, 20 bp, Artificial Sequence
  Description of Artificial Sequence: Synthetic oligonucleotide
  Target: ATXN1; (+) strand; PAM type: YTN; PAM sequence: CTC
agccgcctaagtagctggga

SEQ ID NO: 292246 - DNA, 20 bp, Artificial Sequence
  Description of Artificial Sequence: Synthetic oligonucleotide
  Target: ATXN1; (+) strand; PAM type: YTN; PAM sequence: CTA
agtagctgggattacaggca

SEQ ID NO: 292247 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcatgccccac

SEQ ID NO: 292248 - DNA, 20 bp, Artificial Sequence
  Description of Artificial Sequence: Synthetic oligonucleotide
  Target: ATXN1; (+) strand; PAM type: YTN; PAM sequence: TTA
caggcatgccccaccacacc

SEQ ID NO: 292249 - DNA, 20 bp, Artificial Sequence
  Description of Artificial Sequence: Synthetic oligonucleotide
  Target: ATXN1; (+) strand; PAM type: YTN; PAM sequence: CTA
attttgtatttttagtagag

SEQ ID NO: 292250 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagatgg

SEQ ID NO: 292251 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagatggg

SEQ ID NO: 292252 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagatgggg

SEQ ID NO: 292253 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatggggtttct

SEQ ID NO: 292254 - DNA, 20 bp, Artificial Sequence
  Description of Artificial Sequence: Synthetic oligonucleotide
  Target: ATXN1; (+) strand; PAM type: YTN; PAM sequence: TTT
tagtagagatggggtttctc

SEQ ID NO: 292255 - DNA, 20 bp, Artificial Sequence
  Description of Artificial Sequence: Synthetic oligonucleotide
  Target: ATXN1; (+) strand; PAM type: YTN; PAM sequence: TTT
agtagagatggggtttctcc

SEQ ID NO: 292256 - DNA, 20 bp, Artificial Sequence
  Description of Artificial Sequence: Synthetic oligonucleotide
  Target: ATXN1; (+) strand; PAM type: YTN; PAM sequence: TTA
gtagagatggggtttctcca

SEQ ID NO: 292257 - DNA, 20 bp, Artificial Sequence
  Description of Artificial Sequence: Synthetic oligonucleotide
  Target: ATXN1; (+) strand; PAM type: YTN; PAM sequence: TTT
ctccatgttggtcaggctgg

SEQ ID NO: 292258 - DNA, 20 bp, Artificial Sequence
  Description of Artificial Sequence: Synthetic oligonucleotide
  Target: ATXN1; (+) strand; PAM type: YTN; PAM sequence: TTC
tccatgttggtcaggctggt

SEQ ID NO: 292259 - DNA, 20 bp, Artificial Sequence
  Description of Artificial Sequence: Synthetic oligonucleotide
  Target: ATXN1; (+) strand; PAM type: YTN; PAM sequence: CTC
catgttggtcaggctggttc

SEQ ID NO: 292260 - DNA, 20 bp, Artificial Sequence
  Description of Artificial Sequence: Synthetic oligonucleotide
  Target: ATXN1; (+) strand; PAM type: YTN; PAM sequence: TTG
gtcaggctggttcttgaact

SEQ ID NO: 292261 - DNA, 20 bp, Artificial Sequence
  Description of Artificial Sequence: Synthetic oligonucleotide
  Target: ATXN1; (+) strand; PAM type: YTN; PAM sequence: CTG
gttcttgaactcccaacctc

SEQ ID NO: 292262 - DNA, 20 bp, Artificial Sequence
  Description of Artificial Sequence: Synthetic oligonucleotide
  Target: ATXN1; (+) strand; PAM type: YTN; PAM sequence: TTC
ttgaactcccaacctcaggt

SEQ ID NO: 292263 - DNA, 20 bp, Artificial Sequence
  Description of Artificial Sequence: Synthetic oligonucleotide
  Target: ATXN1; (+) strand; PAM type: YTN; PAM sequence: CTT
gaactcccaacctcaggtga

SEQ ID NO: 292264 - DNA, 20 bp, Artificial Sequence
  Description of Artificial Sequence: Synthetic oligonucleotide
  Target: ATXN1; (+) strand; PAM type: YTN; PAM sequence: TTG
aactcccaacctcaggtgat

SEQ ID NO: 292265 - DNA, 20 bp, Artificial Sequence
  Description of Artificial Sequence: Synthetic oligonucleotide
  Target: ATXN1; (+) strand; PAM type: YTN; PAM sequence: CTC
ccaacctcaggtgattcgcc

SEQ ID NO: 292266 - DNA, 20 bp, Artificial Sequence
  Description of Artificial Sequence: Synthetic oligonucleotide
  Target: ATXN1; (+) strand; PAM type: YTN; PAM sequence: CTC
aggtgattcgcctgcctcag

SEQ ID NO: 292267 - DNA, 20 bp, Artificial Sequence
  Description of Artificial Sequence: Synthetic oligonucleotide
  Target: ATXN1; (+) strand; PAM type: YTN; PAM sequence: TTC
gcctgcctcagcttcccaag

SEQ ID NO: 292268 - DNA, 20 bp, Artificial Sequence
  Description of Artificial Sequence: Synthetic oligonucleotide
  Target: ATXN1; (+) strand; PAM type: YTN; PAM sequence: CTG
cctcagcttcccaaggtgct

SEQ ID NO: 292269 - DNA, 20 bp, Artificial Sequence
  Description of Artificial Sequence: Synthetic oligonucleotide
  Target: ATXN1; (+) strand; PAM type: YTN; PAM sequence: CTC
agcttcccaaggtgctggga

SEQ ID NO: 292270 - DNA, 20 bp, Artificial Sequence
  Description of Artificial Sequence: Synthetic oligonucleotide
  Target: ATXN1; (+) strand; PAM type: YTN; PAM sequence: CTT
cccaaggtgctgggattaca

SEQ ID NO: 292271 - DNA, 20 bp, Artificial Sequence
  Description of Artificial Sequence: Synthetic oligonucleotide
  Target: ATXN1; (+) strand; PAM type: YTN; PAM sequence: TTC
ccaaggtgctgggattacag

SEQ ID NO: 292272 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcctgagccat

SEQ ID NO: 292273 - DNA, 20 bp, Artificial Sequence
  Description of Artificial Sequence: Synthetic oligonucleotide
  Target: ATXN1; (+) strand; PAM type: YTN; PAM sequence: TTA
caggcctgagccattgcgcc

SEQ ID NO: 292274 - DNA, 20 bp, Artificial Sequence
  Description of Artificial Sequence: Synthetic oligonucleotide
  Target: ATXN1; (+) strand; PAM type: YTN; PAM sequence: CTG
agccattgcgcccggcccct

SEQ ID NO: 292275 - DNA, 20 bp, Artificial Sequence
  Description of Artificial Sequence: Synthetic oligonucleotide
  Target: ATXN1; (+) strand; PAM type: YTN; PAM sequence: TTG
cgcccggcccctgggtttct

SEQ ID NO: 292276 - DNA, 20 bp, Artificial Sequence
  Description of Artificial Sequence: Synthetic oligonucleotide
  Target: ATXN1; (+) strand; PAM type: YTN; PAM sequence: CTG
ggtttctttcttaaggcttt

SEQ ID NO: 292277 - DNA, 20 bp, Artificial Sequence
  Description of Artificial Sequence: Synthetic oligonucleotide
  Target: ATXN1; (+) strand; PAM type: YTN; PAM sequence: TTT
ctttcttaaggcttttggag

SEQ ID NO: 292278 - DNA, 20 bp, Artificial Sequence
  Description of Artificial Sequence: Synthetic oligonucleotide
  Target: ATXN1; (+) strand; PAM type: YTN; PAM sequence: TTC
tttcttaaggcttttggagc

SEQ ID NO: 292279 - DNA, 20 bp, Artificial Sequence
  Description of Artificial Sequence: Synthetic oligonucleotide
  Target: ATXN1; (+) strand; PAM type: YTN; PAM sequence: CTT
tcttaaggcttttggagctc

SEQ ID NO: 292280 - DNA, 20 bp, Artificial Sequence
  Description of Artificial Sequence: Synthetic oligonucleotide
  Target: ATXN1; (+) strand; PAM type: YTN; PAM sequence: TTT
cttaaggcttttggagctcc

SEQ ID NO: 292281 - DNA, 20 bp, Artificial Sequence
  Description of Artificial Sequence: Synthetic oligonucleotide
  Target: ATXN1; (+) strand; PAM type: YTN; PAM sequence: TTC
ttaaggcttttggagctcca

SEQ ID NO: 292282 - DNA, 20 bp, Artificial Sequence
  Description of Artificial Sequence: Synthetic oligonucleotide
  Target: ATXN1; (+) strand; PAM type: YTN; PAM sequence: CTT
aaggcttttggagctccaag

SEQ ID NO: 292283 - DNA, 20 bp, Artificial Sequence
  Description of Artificial Sequence: Synthetic oligonucleotide
  Target: ATXN1; (+) strand; PAM type: YTN; PAM sequence: TTA
aggcttttggagctccaagg

SEQ ID NO: 292284 - DNA, 20 bp, Artificial Sequence
  Description of Artificial Sequence: Synthetic oligonucleotide
  Target: ATXN1; (+) strand; PAM type: YTN; PAM sequence: CTT
ttggagctccaaggggccag

SEQ ID NO: 292285 - DNA, 20 bp, Artificial Sequence
  Description of Artificial Sequence: Synthetic oligonucleotide
  Target: ATXN1; (+) strand; PAM type: YTN; PAM sequence: TTT
tggagctccaaggggccagg

SEQ ID NO: 292286 - DNA, 20 bp, Artificial Sequence
  Description of Artificial Sequence: Synthetic oligonucleotide
  Target: ATXN1; (+) strand; PAM type: YTN; PAM sequence: TTT
ggagctccaaggggccaggg

SEQ ID NO: 292287 - DNA, 20 bp, Artificial Sequence
  Description of Artificial Sequence: Synthetic oligonucleotide
  Target: ATXN1; (+) strand; PAM type: YTN; PAM sequence: TTG
gagctccaaggggccaggga

SEQ ID NO: 292288 - DNA, 20 bp, Artificial Sequence
  Description of Artificial Sequence: Synthetic oligonucleotide
  Target: ATXN1; (+) strand; PAM type: YTN; PAM sequence: CTC
caaggggccagggaagtgca

SEQ ID NO: 292289 - DNA, 20 bp, Artificial Sequence
  Description of Artificial Sequence: Synthetic oligonucleotide
  Target: ATXN1; (+) strand; PAM type: YTN; PAM sequence: CTT
caaccagcagcagccattgt

SEQ ID NO: 292290 - DNA, 20 bp, Artificial Sequence
  Description of Artificial Sequence: Synthetic oligonucleotide
  Target: ATXN1; (+) strand; PAM type: YTN; PAM sequence: TTC
aaccagcagcagccattgtt

SEQ ID NO: 292291 - DNA, 20 bp, Artificial Sequence
  Description of Artificial Sequence: Synthetic oligonucleotide
  Target: ATXN1; (+) strand; PAM type: YTN; PAM sequence: TTG
ttctaacagaaatctgaaaa

SEQ ID NO: 292292 - DNA, 20 bp, Artificial Sequence
  Description of Artificial Sequence: Synthetic oligonucleotide
  Target: ATXN1; (+) strand; PAM type: YTN; PAM sequence: TTC
taacagaaatctgaaaataa

SEQ ID NO: 292293 - DNA, 20 bp, Artificial Sequence
  Description of Artificial Sequence: Synthetic oligonucleotide
  Target: ATXN1; (+) strand; PAM type: YTN; PAM sequence: CTA
acagaaatctgaaaataaca

SEQ ID NO: 292294 - DNA, 20 bp, Artificial Sequence
  Description of Artificial Sequence: Synthetic oligonucleotide
  Target: ATXN1; (+) strand; PAM type: YTN; PAM sequence: CTG
aaaataacacattcactctg

SEQ ID NO: 292295 - DNA, 20 bp, Artificial Sequence
  Description of Artificial Sequence: Synthetic oligonucleotide
  Target: ATXN1; (+) strand; PAM type: YTN; PAM sequence: TTC
actctgacatgccaactcac

SEQ ID NO: 292296 - DNA, 20 bp, Artificial Sequence
  Description of Artificial Sequence: Synthetic oligonucleotide
  Target: ATXN1; (+) strand; PAM type: YTN; PAM sequence: CTC
tgacatgccaactcactact

SEQ ID NO: 292297 - DNA, 20 bp, Artificial Sequence
  Description of Artificial Sequence: Synthetic oligonucleotide
  Target: ATXN1; (+) strand; PAM type: YTN; PAM sequence: CTG
acatgccaactcactacttt

SEQ ID NO: 292298 - DNA, 20 bp, Artificial Sequence
  Description of Artificial Sequence: Synthetic oligonucleotide
  Target: ATXN1; (+) strand; PAM type: YTN; PAM sequence: CTC
actacttttaattgtggctc

SEQ ID NO: 292299 - DNA, 20 bp, Artificial Sequence
  Description of Artificial Sequence: Synthetic oligonucleotide
  Target: ATXN1; (+) strand; PAM type: YTN; PAM sequence: CTA
cttttaattgtggctcatta

SEQ ID NO: 292300 - DNA, 20 bp, Artificial Sequence
  Description of Artificial Sequence: Synthetic oligonucleotide
  Target: ATXN1; (+) strand; PAM type: YTN; PAM sequence: CTT
ttaattgtggctcattaaag

SEQ ID NO: 292301 - DNA, 20 bp, Artificial Sequence
  Description of Artificial Sequence: Synthetic oligonucleotide
  Target: ATXN1; (+) strand; PAM type: YTN; PAM sequence: TTT
taattgtggctcattaaaga

SEQ ID NO: 292302 - DNA, 20 bp, Artificial Sequence
  Description of Artificial Sequence: Synthetic oligonucleotide
  Target: ATXN1; (+) strand; PAM type: YTN; PAM sequence: TTT
aattgtggctcattaaagat

SEQ ID NO: 292303 - DNA, 20 bp, Artificial Sequence
  Description of Artificial Sequence: Synthetic oligonucleotide
  Target: ATXN1; (+) strand; PAM type: YTN; PAM sequence: TTA
attgtggctcattaaagatg

SEQ ID NO: 292304 - DNA, 20 bp, Artificial Sequence
  Description of Artificial Sequence: Synthetic oligonucleotide
  Target: ATXN1; (+) strand; PAM type: YTN; PAM sequence: TTG
tggctcattaaagatgtaaa

SEQ ID NO: 292305 - DNA, 20 bp, Artificial Sequence
  Description of Artificial Sequence: Synthetic oligonucleotide
  Target: ATXN1; (+) strand; PAM type: YTN; PAM sequence: CTC
attaaagatgtaaatagaag

SEQ ID NO: 292306 - DNA, 20 bp, Artificial Sequence
  Description of Artificial Sequence: Synthetic oligonucleotide
  Target: ATXN1; (+) strand; PAM type: YTN; PAM sequence: TTA
aagatgtaaatagaagaatt

SEQ ID NO: 292307 - DNA, 20 bp, Artificial Sequence
  Description of Artificial Sequence: Synthetic oligonucleotide
  Target: ATXN1; (+) strand; PAM type: YTN; PAM sequence: TTA
tgttcacctctactacaatt

SEQ ID NO: 292308 - DNA, 20 bp, Artificial Sequence
  Description of Artificial Sequence: Synthetic oligonucleotide
  Target: ATXN1; (+) strand; PAM type: YTN; PAM sequence: TTC
acctctactacaatttcatt

SEQ ID NO: 292309 - DNA, 20 bp, Artificial Sequence
  Description of Artificial Sequence: Synthetic oligonucleotide
  Target: ATXN1; (+) strand; PAM type: YTN; PAM sequence: CTC
tactacaatttcattgctgc

SEQ ID NO: 292310 - DNA, 20 bp, Artificial Sequence
  Description of Artificial Sequence: Synthetic oligonucleotide
  Target: ATXN1; (+) strand; PAM type: YTN; PAM sequence: CTA
ctacaatttcattgctgcag

SEQ ID NO: 292311 - DNA, 20 bp, Artificial Sequence
  Description of Artificial Sequence: Synthetic oligonucleotide
  Target: ATXN1; (+) strand; PAM type: YTN; PAM sequence: CTA
caatttcattgctgcagtaa

SEQ ID NO: 292312 - DNA, 20 bp, Artificial Sequence
  Description of Artificial Sequence: Synthetic oligonucleotide
  Target: ATXN1; (+) strand; PAM type: YTN; PAM sequence: TTT
cattgctgcagtaaaattac

SEQ ID NO: 292313 - DNA, 20 bp, Artificial Sequence
  Description of Artificial Sequence: Synthetic oligonucleotide
  Target: ATXN1; (+) strand; PAM type: YTN; PAM sequence: TTC
attgctgcagtaaaattaca

SEQ ID NO: 292314 - DNA, 20 bp, Artificial Sequence
  Description of Artificial Sequence: Synthetic oligonucleotide
  Target: ATXN1; (+) strand; PAM type: YTN; PAM sequence: TTG
ctgcagtaaaattacaatgt

SEQ ID NO: 292315 - DNA, 20 bp, Artificial Sequence
  Description of Artificial Sequence: Synthetic oligonucleotide
  Target: ATXN1; (+) strand; PAM type: YTN; PAM sequence: CTG
cagtaaaattacaatgtttc

SEQ ID NO: 292316 - DNA, 20 bp, Artificial Sequence
  Description of Artificial Sequence: Synthetic oligonucleotide
  Target: ATXN1; (+) strand; PAM type: YTN; PAM sequence: TTA
caatgtttccttctatgcag

SEQ ID NO: 292317 - DNA, 20 bp, Artificial Sequence
  Description of Artificial Sequence: Synthetic oligonucleotide
  Target: ATXN1; (+) strand; PAM type: YTN; PAM sequence: TTT
ccttctatgcagaaagaaat

SEQ ID NO: 292318 - DNA, 20 bp, Artificial Sequence
  Description of Artificial Sequence: Synthetic oligonucleotide
  Target: ATXN1; (+) strand; PAM type: YTN; PAM sequence: TTC
cttctatgcagaaagaaata

SEQ ID NO: 292319 - DNA, 20 bp, Artificial Sequence
  Description of Artificial Sequence: Synthetic oligonucleotide
  Target: ATXN1; (+) strand; PAM type: YTN; PAM sequence: CTT
ctatgcagaaagaaatactt

SEQ ID NO: 292320 - DNA, 20 bp, Artificial Sequence
  Description of Artificial Sequence: Synthetic oligonucleotide
  Target: ATXN1; (+) strand; PAM type: YTN; PAM sequence: TTC
tatgcagaaagaaatacttc

SEQ ID NO: 292321 - DNA, 20 bp, Artificial Sequence
  Description of Artificial Sequence: Synthetic oligonucleotide
  Target: ATXN1; (+) strand; PAM type: YTN; PAM sequence: CTA
tgcagaaagaaatacttctt

SEQ ID NO: 292322 - DNA, 20 bp, Artificial Sequence
  Description of Artificial Sequence: Synthetic oligonucleotide
  Target: ATXN1; (+) strand; PAM type: YTN; PAM sequence: CTT
cttctctgagtaatagcacc

SEQ ID NO: 292323 - DNA, 20 bp, Artificial Sequence
  Description of Artificial Sequence: Synthetic oligonucleotide
  Target: ATXN1; (+) strand; PAM type: YTN; PAM sequence: TTC
ttctctgagtaatagcacca

SEQ ID NO: 292324 - DNA, 20 bp, Artificial Sequence
  Description of Artificial Sequence: Synthetic oligonucleotide
  Target: ATXN1; (+) strand; PAM type: YTN; PAM sequence: CTT
ctctgagtaatagcaccaga

SEQ ID NO: 292325 - DNA, 20 bp, Artificial Sequence
  Description of Artificial Sequence: Synthetic oligonucleotide
  Target: ATXN1; (+) strand; PAM type: YTN; PAM sequence: TTC
tctgagtaatagcaccagaa

SEQ ID NO: 292326 - DNA, 20 bp, Artificial Sequence
  Description of Artificial Sequence: Synthetic oligonucleotide
  Target: ATXN1; (+) strand; PAM type: YTN; PAM sequence: CTC
tgagtaatagcaccagaagt

SEQ ID NO: 292327 - DNA, 20 bp, Artificial Sequence
  Description of Artificial Sequence: Synthetic oligonucleotide
  Target: ATXN1; (+) strand; PAM type: YTN; PAM sequence: CTG
agtaatagcaccagaagtgg

SEQ ID NO: 292328 - DNA, 20 bp, Artificial Sequence
  Description of Artificial Sequence: Synthetic oligonucleotide
  Target: ATXN1; (+) strand; PAM type: YTN; PAM sequence: CTA
tgattcaccaattctccaac

SEQ ID NO: 292329 - DNA, 20 bp, Artificial Sequence
  Description of Artificial Sequence: Synthetic oligonucleotide
  Target: ATXN1; (+) strand; PAM type: YTN; PAM sequence: TTC
accaattctccaacagtagg

SEQ ID NO: 292330 - DNA, 20 bp, Artificial Sequence
  Description of Artificial Sequence: Synthetic oligonucleotide
  Target: ATXN1; (+) strand; PAM type: YTN; PAM sequence: TTC
tccaacagtaggcatcacat

SEQ ID NO: 292331 - DNA, 20 bp, Artificial Sequence
  Description of Artificial Sequence: Synthetic oligonucleotide
  Target: ATXN1; (+) strand; PAM type: YTN; PAM sequence: CTC
caacagtaggcatcacatgt

SEQ ID NO: 292332 - DNA, 20 bp, Artificial Sequence
  Description of Artificial Sequence: Synthetic oligonucleotide
  Target: ATXN1; (+) strand; PAM type: YTN; PAM sequence: CTG
cctgttgttggacagaggca

SEQ ID NO: 292333 - DNA, 20 bp, Artificial Sequence
  Description of Artificial Sequence: Synthetic oligonucleotide
  Target: ATXN1; (+) strand; PAM type: YTN; PAM sequence: CTG
ttgttggacagaggcagatg

SEQ ID NO: 292334 - DNA, 20 bp, Artificial Sequence
  Description of Artificial Sequence: Synthetic oligonucleotide
  Target: ATXN1; (+) strand; PAM type: YTN; PAM sequence: TTG
ttggacagaggcagatggac

SEQ ID NO: 292335 - DNA, 20 bp, Artificial Sequence
  Description of Artificial Sequence: Synthetic oligonucleotide
  Target: ATXN1; (+) strand; PAM type: YTN; PAM sequence: TTG
gacagaggcagatggacaga

SEQ ID NO: 292336 - DNA, 20 bp, Artificial Sequence
  Description of Artificial Sequence: Synthetic oligonucleotide
  Target: ATXN1; (+) strand; PAM type: YTN; PAM sequence: TTA
tttttttttaatgaaaagaa

SEQ ID NO: 292337 - DNA, 20 bp, Artificial Sequence
  Description of Artificial Sequence: Synthetic oligonucleotide
  Target: ATXN1; (+) strand; PAM type: YTN; PAM sequence: TTT
ttttttaatgaaaagaaagg

SEQ ID NO: 292338 - DNA, 20 bp, Artificial Sequence
  Description of Artificial Sequence: Synthetic oligonucleotide
  Target: ATXN1; (+) strand; PAM type: YTN; PAM sequence: TTT
tttttaatgaaaagaaagga

SEQ ID NO: 292339 - DNA, 20 bp, Artificial Sequence
  Description of Artificial Sequence: Synthetic oligonucleotide
  Target: ATXN1; (+) strand; PAM type: YTN; PAM sequence: TTT
ttttaatgaaaagaaaggac

SEQ ID NO: 292340 - DNA, 20 bp, Artificial Sequence
  Description of Artificial Sequence: Synthetic oligonucleotide
  Target: ATXN1; (+) strand; PAM type: YTN; PAM sequence: TTT
tttaatgaaaagaaaggaca

SEQ ID NO: 292341 - DNA, 20 bp, Artificial Sequence
  Description of Artificial Sequence: Synthetic oligonucleotide
  Target: ATXN1; (+) strand; PAM type: YTN; PAM sequence: TTT
ttaatgaaaagaaaggacac

SEQ ID NO: 292342 - DNA, 20 bp, Artificial Sequence
  Description of Artificial Sequence: Synthetic oligonucleotide
  Target: ATXN1; (+) strand; PAM type: YTN; PAM sequence: TTT
taatgaaaagaaaggacaca

SEQ ID NO: 292343 - DNA, 20 bp, Artificial Sequence
  Description of Artificial Sequence: Synthetic oligonucleotide
  Target: ATXN1; (+) strand; PAM type: YTN; PAM sequence: TTT
aatgaaaagaaaggacacat

SEQ ID NO: 292344 - DNA, 20 bp, Artificial Sequence
  Description of Artificial Sequence: Synthetic oligonucleotide
  Target: ATXN1; (+) strand; PAM type: YTN; PAM sequence: TTA
atgaaaagaaaggacacatc

SEQ ID NO: 292345 - DNA, 20 bp, Artificial Sequence
  Description of Artificial Sequence: Synthetic oligonucleotide
  Target: ATXN1; (+) strand; PAM type: YTN; PAM sequence: TTG
aaagatgcaacaggcgcatc

SEQ ID NO: 292346 - DNA, 20 bp, Artificial Sequence
  Description of Artificial Sequence: Synthetic oligonucleotide
  Target: ATXN1; (+) strand; PAM type: YTN; PAM sequence: CTC
attttattgcatttcacttt

SEQ ID NO: 292347 - DNA, 20 bp, Artificial Sequence
  Description of Artificial Sequence: Synthetic oligonucleotide
  Target: ATXN1; (+) strand; PAM type: YTN; PAM sequence: TTT
tattgcatttcactttgttg

SEQ ID NO: 292348 - DNA, 20 bp, Artificial Sequence
  Description of Artificial Sequence: Synthetic oligonucleotide
  Target: ATXN1; (+) strand; PAM type: YTN; PAM sequence: TTT
attgcatttcactttgttgt

SEQ ID NO: 292349 - DNA, 20 bp, Artificial Sequence
  Description of Artificial Sequence: Synthetic oligonucleotide
  Target: ATXN1; (+) strand; PAM type: YTN; PAM sequence: TTA
ttgcatttcactttgttgtc

SEQ ID NO: 292350 - DNA, 20 bp, Artificial Sequence
  Description of Artificial Sequence: Synthetic oligonucleotide
  Target: ATXN1; (+) strand; PAM type: YTN; PAM sequence: TTG
catttcactttgttgtcctt

SEQ ID NO: 292351 - DNA, 20 bp, Artificial Sequence
  Description of Artificial Sequence: Synthetic oligonucleotide
  Target: ATXN1; (+) strand; PAM type: YTN; PAM sequence: TTT
cactttgttgtcctttgcag

SEQ ID NO: 292352 - DNA, 20 bp, Artificial Sequence
  Description of Artificial Sequence: Synthetic oligonucleotide
  Target: ATXN1; (+) strand; PAM type: YTN; PAM sequence: TTC
actttgttgtcctttgcaga

SEQ ID NO: 292353 - DNA, 20 bp, Artificial Sequence
  Description of Artificial Sequence: Synthetic oligonucleotide
  Target: ATXN1; (+) strand; PAM type: YTN; PAM sequence: CTT
tgttgtcctttgcagatact

SEQ ID NO: 292354 - DNA, 20 bp, Artificial Sequence
  Description of Artificial Sequence: Synthetic oligonucleotide
  Target: ATXN1; (+) strand; PAM type: YTN; PAM sequence: TTT
gttgtcctttgcagatactg

SEQ ID NO: 292355 - DNA, 20 bp, Artificial Sequence
  Description of Artificial Sequence: Synthetic oligonucleotide
  Target: ATXN1; (+) strand; PAM type: YTN; PAM sequence: TTG
ttgtcctttgcagatactgc

SEQ ID NO: 292356 - DNA, 20 bp, Artificial Sequence
  Description of Artificial Sequence: Synthetic oligonucleotide
  Target: ATXN1; (+) strand; PAM type: YTN; PAM sequence: TTG
tcctttgcagatactgcatt

SEQ ID NO: 292357 - DNA, 20 bp, Artificial Sequence
  Description of Artificial Sequence: Synthetic oligonucleotide
  Target: ATXN1; (+) strand; PAM type: YTN; PAM sequence: CTT
tgcagatactgcattttttt

SEQ ID NO: 292358 - DNA, 20 bp, Artificial Sequence
  Description of Artificial Sequence: Synthetic oligonucleotide
  Target: ATXN1; (+) strand; PAM type: YTN; PAM sequence: TTT
gcagatactgcatttttttt

SEQ ID NO: 292359 - DNA, 20 bp, Artificial Sequence
  Description of Artificial Sequence: Synthetic oligonucleotide
  Target: ATXN1; (+) strand; PAM type: YTN; PAM sequence: TTG
cagatactgcattttttttt

SEQ ID NO: 292360 - DNA, 20 bp, Artificial Sequence
  Description of Artificial Sequence: Synthetic oligonucleotide
  Target: ATXN1; (+) strand; PAM type: YTN; PAM sequence: CTG
catttttttttcaaattgaa

SEQ ID NO: 292361 - DNA, 20 bp, Artificial Sequence
  Description of Artificial Sequence: Synthetic oligonucleotide
  Target: ATXN1; (+) strand; PAM type: YTN; PAM sequence: TTT
ttttttcaaattgaagttct

SEQ ID NO: 292362 - DNA, 20 bp, Artificial Sequence
  Description of Artificial Sequence: Synthetic oligonucleotide
  Target: ATXN1; (+) strand; PAM type: YTN; PAM sequence: TTT
tttttcaaattgaagttctg

SEQ ID NO: 292363 - DNA, 20 bp, Artificial Sequence
  Description of Artificial Sequence: Synthetic oligonucleotide
  Target: ATXN1; (+) strand; PAM type: YTN; PAM sequence: TTT
ttttcaaattgaagttctgt

SEQ ID NO: 292364 - DNA, 20 bp, Artificial Sequence
  Description of Artificial Sequence: Synthetic oligonucleotide
  Target: ATXN1; (+) strand; PAM type: YTN; PAM sequence: TTT
tttcaaattgaagttctgtg

SEQ ID NO: 292365 - DNA, 20 bp, Artificial Sequence
  Description of Artificial Sequence: Synthetic oligonucleotide
  Target: ATXN1; (+) strand; PAM type: YTN; PAM sequence: TTT
ttcaaattgaagttctgtgg

SEQ ID NO: 292366 - DNA, 20 bp, Artificial Sequence
  Description of Artificial Sequence: Synthetic oligonucleotide
  Target: ATXN1; (+) strand; PAM type: YTN; PAM sequence: TTT
tcaaattgaagttctgtggc

SEQ ID NO: 292367 - DNA, 20 bp, Artificial Sequence
  Description of Artificial Sequence: Synthetic oligonucleotide
  Target: ATXN1; (+) strand; PAM type: YTN; PAM sequence: TTT
caaattgaagttctgtggca

SEQ ID NO: 292368 - DNA, 20 bp, Artificial Sequence
  Description of Artificial Sequence: Synthetic oligonucleotide
  Target: ATXN1; (+) strand; PAM type: YTN; PAM sequence: TTC
aaattgaagttctgtggcaa

SEQ ID NO: 292369 - DNA, 20 bp, Artificial Sequence
  Description of Artificial Sequence: Synthetic oligonucleotide
  Target: ATXN1; (+) strand; PAM type: YTN; PAM sequence: TTG
aagttctgtggcaaccccgt

SEQ ID NO: 292370 - DNA, 20 bp, Artificial Sequence
  Description of Artificial Sequence: Synthetic oligonucleotide
  Target: ATXN1; (+) strand; PAM type: YTN; PAM sequence: TTC
tgtggcaaccccgtgtcaag

SEQ ID NO: 292371 - DNA, 20 bp, Artificial Sequence
  Description of Artificial Sequence: Synthetic oligonucleotide
  Target: ATXN1; (+) strand; PAM type: YTN; PAM sequence: CTG
tggcaaccccgtgtcaagca

SEQ ID NO: 292372 - DNA, 20 bp, Artificial Sequence
  Description of Artificial Sequence: Synthetic oligonucleotide
  Target: ATXN1; (+) strand; PAM type: YTN; PAM sequence: CTC
caccagcatcacctctccaa

SEQ ID NO: 292373 - DNA, 20 bp, Artificial Sequence
  Description of Artificial Sequence: Synthetic oligonucleotide
  Target: ATXN1; (+) strand; PAM type: YTN; PAM sequence: CTC
tccaacagcatgtgctcatg

SEQ ID NO: 292374 - DNA, 20 bp, Artificial Sequence
  Description of Artificial Sequence: Synthetic oligonucleotide
  Target: ATXN1; (+) strand; PAM type: YTN; PAM sequence: CTC
caacagcatgtgctcatgtt

SEQ ID NO: 292375 - DNA, 20 bp, Artificial Sequence
  Description of Artificial Sequence: Synthetic oligonucleotide
  Target: ATXN1; (+) strand; PAM type: YTN; PAM sequence: CTC
atgttgagcctctgccacat

SEQ ID NO: 292376 - DNA, 20 bp, Artificial Sequence
  Description of Artificial Sequence: Synthetic oligonucleotide
  Target: ATXN1; (+) strand; PAM type: YTN; PAM sequence: TTG
agcctctgccacatttcggt

SEQ ID NO: 292377 - DNA, 20 bp, Artificial Sequence
  Description of Artificial Sequence: Synthetic oligonucleotide
  Target: ATXN1; (+) strand; PAM type: YTN; PAM sequence: CTC
tgccacatttcggtaataca

SEQ ID NO: 292378 - DNA, 20 bp, Artificial Sequence
  Description of Artificial Sequence: Synthetic oligonucleotide
  Target: ATXN1; (+) strand; PAM type: YTN; PAM sequence: CTG
ccacatttcggtaatacagt

SEQ ID NO: 292379 - DNA, 20 bp, Artificial Sequence
  Description of Artificial Sequence: Synthetic oligonucleotide
  Target: ATXN1; (+) strand; PAM type: YTN; PAM sequence: TTT
cggtaatacagtatttcaaa

SEQ ID NO: 292380 - DNA, 20 bp, Artificial Sequence
  Description of Artificial Sequence: Synthetic oligonucleotide
  Target: ATXN1; (+) strand; PAM type: YTN; PAM sequence: TTC
ggtaatacagtatttcaaac

SEQ ID NO: 292381 - DNA, 20 bp, Artificial Sequence
  Description of Artificial Sequence: Synthetic oligonucleotide
  Target: ATXN1; (+) strand; PAM type: YTN; PAM sequence: TTT
caaacttttgcgctgttata

SEQ ID NO: 292382 - DNA, 20 bp, Artificial Sequence
  Description of Artificial Sequence: Synthetic oligonucleotide
  Target: ATXN1; (+) strand; PAM type: YTN; PAM sequence: TTC
aaacttttgcgctgttatat

SEQ ID NO: 292383 - DNA, 20 bp, Artificial Sequence
  Description of Artificial Sequence: Synthetic oligonucleotide
  Target: ATXN1; (+) strand; PAM type: YTN; PAM sequence: CTT
ttgcgctgttatatctgtta

SEQ ID NO: 292384 - DNA, 20 bp, Artificial Sequence
  Description of Artificial Sequence: Synthetic oligonucleotide
  Target: ATXN1; (+) strand; PAM type: YTN; PAM sequence: TTT
tgcgctgttatatctgttat

SEQ ID NO: 292385 - DNA, 20 bp, Artificial Sequence
  Description of Artificial Sequence: Synthetic oligonucleotide
  Target: ATXN1; (+) strand; PAM type: YTN; PAM sequence: TTT
gcgctgttatatctgttatg

SEQ ID NO: 292386 - DNA, 20 bp, Artificial Sequence
  Description of Artificial Sequence: Synthetic oligonucleotide
  Target: ATXN1; (+) strand; PAM type: YTN; PAM sequence: TTG
cgctgttatatctgttatgg

SEQ ID NO: 292387 - DNA, 20 bp, Artificial Sequence
  Description of Artificial Sequence: Synthetic oligonucleotide
  Target: ATXN1; (+) strand; PAM type: YTN; PAM sequence: CTG
ttatatctgttatggtgatc

SEQ ID NO: 292388 - DNA, 20 bp, Artificial Sequence
  Description of Artificial Sequence: Synthetic oligonucleotide
  Target: ATXN1; (+) strand; PAM type: YTN; PAM sequence: TTA
tatctgttatggtgatctga

SEQ ID NO: 292389 - DNA, 20 bp, Artificial Sequence
  Description of Artificial Sequence: Synthetic oligonucleotide
  Target: ATXN1; (+) strand; PAM type: YTN; PAM sequence: CTG
ttatggtgatctgagatcag

SEQ ID NO: 292390 - DNA, 20 bp, Artificial Sequence
  Description of Artificial Sequence: Synthetic oligonucleotide
  Target: ATXN1; (+) strand; PAM type: YTN; PAM sequence: TTA
tggtgatctgagatcagtgc

SEQ ID NO: 292391 - DNA, 20 bp, Artificial Sequence
  Description of Artificial Sequence: Synthetic oligonucleotide
  Target: ATXN1; (+) strand; PAM type: YTN; PAM sequence: CTG
agatcagtgctctttgacgt

SEQ ID NO: 292392 - DNA, 20 bp, Artificial Sequence
  Description of Artificial Sequence: Synthetic oligonucleotide
  Target: ATXN1; (+) strand; PAM type: YTN; PAM sequence: CTC
tttgacgttactattataat

SEQ ID NO: 292393 - DNA, 20 bp, Artificial Sequence
  Description of Artificial Sequence: Synthetic oligonucleotide
  Target: ATXN1; (+) strand; PAM type: YTN; PAM sequence: CTT
tgacgttactattataattg

SEQ ID NO: 292394 - DNA, 20 bp, Artificial Sequence
  Description of Artificial Sequence: Synthetic oligonucleotide
  Target: ATXN1; (+) strand; PAM type: YTN; PAM sequence: TTT
gacgttactattataattgt

SEQ ID NO: 292395 - DNA, 20 bp, Artificial Sequence
  Description of Artificial Sequence: Synthetic oligonucleotide
  Target: ATXN1; (+) strand; PAM type: YTN; PAM sequence: TTG
acgttactattataattgtt

SEQ ID NO: 292396 - DNA, 20 bp, Artificial Sequence
  Description of Artificial Sequence: Synthetic oligonucleotide
  Target: ATXN1; (+) strand; PAM type: YTN; PAM sequence: TTA
ctattataattgttttgttc

SEQ ID NO: 292397 - DNA, 20 bp, Artificial Sequence
  Description of Artificial Sequence: Synthetic oligonucleotide
  Target: ATXN1; (+) strand; PAM type: YTN; PAM sequence: CTA
ttataattgttttgttcacc

SEQ ID NO: 292398 - DNA, 20 bp, Artificial Sequence
  Description of Artificial Sequence: Synthetic oligonucleotide
  Target: ATXN1; (+) strand; PAM type: YTN; PAM sequence: TTA
taattgttttgttcaccatg

SEQ ID NO: 292399 - DNA, 20 bp, Artificial Sequence
  Description of Artificial Sequence: Synthetic oligonucleotide
  Target: ATXN1; (+) strand; PAM type: YTN; PAM sequence: TTG
ttttgttcaccatgaaccac

SEQ ID NO: 292400 - DNA, 20 bp, Artificial Sequence
  Description of Artificial Sequence: Synthetic oligonucleotide
  Target: ATXN1; (+) strand; PAM type: YTN; PAM sequence: TTT
tgttcaccatgaaccacaca

SEQ ID NO: 292401 - DNA, 20 bp, Artificial Sequence
  Description of Artificial Sequence: Synthetic oligonucleotide
  Target: ATXN1; (+) strand; PAM type: YTN; PAM sequence: TTT
gttcaccatgaaccacacac

SEQ ID NO: 292402 - DNA, 20 bp, Artificial Sequence
  Description of Artificial Sequence: Synthetic oligonucleotide
  Target: ATXN1; (+) strand; PAM type: YTN; PAM sequence: TTG
ttcaccatgaaccacacacc

SEQ ID NO: 292403 - DNA, 20 bp, Artificial Sequence
  Description of Artificial Sequence: Synthetic oligonucleotide
  Target: ATXN1; (+) strand; PAM type: YTN; PAM sequence: TTC
accatgaaccacacacccca

SEQ ID NO: 292404 - DNA, 20 bp, Artificial Sequence
  Description of Artificial Sequence: Synthetic oligonucleotide
  Target: ATXN1; (+) strand; PAM type: YTN; PAM sequence: CTT
aatcagtaaatgtcatgtgt

SEQ ID NO: 292405 - DNA, 20 bp, Artificial Sequence
  Description of Artificial Sequence: Synthetic oligonucleotide
  Target: ATXN1; (+) strand; PAM type: YTN; PAM sequence: TTA
atcagtaaatgtcatgtgtg

SEQ ID NO: 292406 - DNA, 20 bp, Artificial Sequence
  Description of Artificial Sequence: Synthetic oligonucleotide
  Target: ATXN1; (+) strand; PAM type: YTN; PAM sequence: TTC
tgactgctacaaagactggc

SEQ ID NO: 292407 - DNA, 20 bp, Artificial Sequence
  Description of Artificial Sequence: Synthetic oligonucleotide
  Target: ATXN1; (+) strand; PAM type: YTN; PAM sequence: CTG
actgctacaaagactggctg

SEQ ID NO: 292408 - DNA, 20 bp, Artificial Sequence
  Description of Artificial Sequence: Synthetic oligonucleotide
  Target: ATXN1; (+) strand; PAM type: YTN; PAM sequence: CTG
ctacaaagactggctgttct

SEQ ID NO: 292409 - DNA, 20 bp, Artificial Sequence
  Description of Artificial Sequence: Synthetic oligonucleotide
  Target: ATXN1; (+) strand; PAM type: YTN; PAM sequence: CTA
caaagactggctgttctctc

SEQ ID NO: 292410 - DNA, 20 bp, Artificial Sequence
  Description of Artificial Sequence: Synthetic oligonucleotide
  Target: ATXN1; (+) strand; PAM type: YTN; PAM sequence: CTG
gctgttctctctccctcctc

SEQ ID NO: 292411 - DNA, 20 bp, Artificial Sequence
  Description of Artificial Sequence: Synthetic oligonucleotide
  Target: ATXN1; (+) strand; PAM type: YTN; PAM sequence: CTG
ttctctctccctcctctcgg

SEQ ID NO: 292412 - DNA, 20 bp, Artificial Sequence
  Description of Artificial Sequence: Synthetic oligonucleotide
  Target: ATXN1; (+) strand; PAM type: YTN; PAM sequence: TTC
tctctccctcctctcgggcc

SEQ ID NO: 292413 - DNA, 20 bp, Artificial Sequence
  Description of Artificial Sequence: Synthetic oligonucleotide
  Target: ATXN1; (+) strand; PAM type: YTN; PAM sequence: CTC
tctccctcctctcgggcctc

SEQ ID NO: 292414 - DNA, 20 bp, Artificial Sequence
  Description of Artificial Sequence: Synthetic oligonucleotide
  Target: ATXN1; (+) strand; PAM type: YTN; PAM sequence: CTC
tccctcctctcgggcctcct

SEQ ID NO: 292415 - DNA, 20 bp, Artificial Sequence
  Description of Artificial Sequence: Synthetic oligonucleotide
  Target: ATXN1; (+) strand; PAM type: YTN; PAM sequence: CTC
cctcctctcgggcctccttg

SEQ ID NO: 292416 - DNA, 20 bp, Artificial Sequence
  Description of Artificial Sequence: Synthetic oligonucleotide
  Target: ATXN1; (+) strand; PAM type: YTN; PAM sequence: CTC
ctctcgggcctccttgtttc

SEQ ID NO: 292417 - DNA, 20 bp, Artificial Sequence
  Description of Artificial Sequence: Synthetic oligonucleotide
  Target: ATXN1; (+) strand; PAM type: YTN; PAM sequence: CTC
tcgggcctccttgtttcctc

SEQ ID NO: 292418 - DNA, 20 bp, Artificial Sequence
  Description of Artificial Sequence: Synthetic oligonucleotide
  Target: ATXN1; (+) strand; PAM type: YTN; PAM sequence: CTC
gggcctccttgtttcctcag

SEQ ID NO: 292419 - DNA, 20 bp, Artificial Sequence
  Description of Artificial Sequence: Synthetic oligonucleotide
  Target: ATXN1; (+) strand; PAM type: YTN; PAM sequence: CTC
cttgtttcctcagacacaag

SEQ ID NO: 292420 - DNA, 20 bp, Artificial Sequence
  Description of Artificial Sequence: Synthetic oligonucleotide
  Target: ATXN1; (+) strand; PAM type: YTN; PAM sequence: CTT
gtttcctcagacacaagaat

SEQ ID NO: 292421 - DNA, 20 bp, Artificial Sequence
  Description of Artificial Sequence: Synthetic oligonucleotide
  Target: ATXN1; (+) strand; PAM type: YTN; PAM sequence: TTG
tttcctcagacacaagaata

SEQ ID NO: 292422 - DNA, 20 bp, Artificial Sequence
  Description of Artificial Sequence: Synthetic oligonucleotide
  Target: ATXN1; (+) strand; PAM type: YTN; PAM sequence: TTT
cctcagacacaagaatattg

SEQ ID NO: 292423 - DNA, 20 bp, Artificial Sequence
  Description of Artificial Sequence: Synthetic oligonucleotide
  Target: ATXN1; (+) strand; PAM type: YTN; PAM sequence: TTC
ctcagacacaagaatattga

SEQ ID NO: 292424 - DNA, 20 bp, Artificial Sequence
  Description of Artificial Sequence: Synthetic oligonucleotide
  Target: ATXN1; (+) strand; PAM type: YTN; PAM sequence: CTC
agacacaagaatattgaagt

SEQ ID NO: 292425 - DNA, 20 bp, Artificial Sequence
  Description of Artificial Sequence: Synthetic oligonucleotide
  Target: ATXN1; (+) strand; PAM type: YTN; PAM sequence: TTG
aagttggccaggcacggggg

SEQ ID NO: 292426 - DNA, 20 bp, Artificial Sequence
  Description of Artificial Sequence: Synthetic oligonucleotide
  Target: ATXN1; (+) strand; PAM type: YTN; PAM sequence: TTG
gccaggcacgggggctcacg

SEQ ID NO: 292427 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 292428 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 292429 - DNA, 20 bp, Artificial Sequence
  Description of Artificial Sequence: Synthetic oligonucleotide
  Target: ATXN1; (+) strand; PAM type: YTN; PAM sequence: CTT
tgggaggccaaggtgggcag

SEQ ID NO: 292430 - DNA, 20 bp, Artificial Sequence
  Description of Artificial Sequence: Synthetic oligonucleotide
  Target: ATXN1; (+) strand; PAM type: YTN; PAM sequence: TTT
gggaggccaaggtgggcaga

SEQ ID NO: 292431 - DNA, 20 bp, Artificial Sequence
  Description of Artificial Sequence: Synthetic oligonucleotide
  Target: ATXN1; (+) strand; PAM type: YTN; PAM sequence: TTG
ggaggccaaggtgggcagat

SEQ ID NO: 292432 - DNA, 20 bp, Artificial Sequence
  Description of Artificial Sequence: Synthetic oligonucleotide
  Target: ATXN1; (+) strand; PAM type: YTN; PAM sequence: TTC
aggagatcaagaccatcctg

SEQ ID NO: 292433 - DNA, 20 bp, Artificial Sequence
  Description of Artificial Sequence: Synthetic oligonucleotide
  Target: ATXN1; (+) strand; PAM type: YTN; PAM sequence: CTG
gctaacatggtgaaactcaa

SEQ ID NO: 292434 - DNA, 20 bp, Artificial Sequence
  Description of Artificial Sequence: Synthetic oligonucleotide
  Target: ATXN1; (+) strand; PAM type: YTN; PAM sequence: CTA
acatggtgaaactcaatctc

SEQ ID NO: 292435 - DNA, 20 bp, Artificial Sequence
  Description of Artificial Sequence: Synthetic oligonucleotide
  Target: ATXN1; (+) strand; PAM type: YTN; PAM sequence: CTC
aatctctactaaaaatacaa

SEQ ID NO: 292436 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaagtt

SEQ ID NO: 292437 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaagttag

SEQ ID NO: 292438 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaagttagccg

SEQ ID NO: 292439 - DNA, 20 bp, Artificial Sequence
  Description of Artificial Sequence: Synthetic oligonucleotide
  Target: ATXN1; (+) strand; PAM type: YTN; PAM sequence: TTA
gccggacgtagtggcgggtg

SEQ ID NO: 292440 - DNA, 20 bp, Artificial Sequence
  Description of Artificial Sequence: Synthetic oligonucleotide
  Target: ATXN1; (+) strand; PAM type: YTN; PAM sequence: CTG
tagtctcagctattcgggag

SEQ ID NO: 292441 - DNA, 20 bp, Artificial Sequence
  Description of Artificial Sequence: Synthetic oligonucleotide
  Target: ATXN1; (+) strand; PAM type: YTN; PAM sequence: CTC
agctattcgggaggctgagg

SEQ ID NO: 292442 - DNA, 20 bp, Artificial Sequence
  Description of Artificial Sequence: Synthetic oligonucleotide
  Target: ATXN1; (+) strand; PAM type: YTN; PAM sequence: CTA
ttcgggaggctgaggcagga

SEQ ID NO: 292443 - DNA, 20 bp, Artificial Sequence
  Description of Artificial Sequence: Synthetic oligonucleotide
  Target: ATXN1; (+) strand; PAM type: YTN; PAM sequence: TTC
gggaggctgaggcaggagaa

SEQ ID NO: 292444 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatggcgtgaa

SEQ ID NO: 292445 - DNA, 20 bp, Artificial Sequence
  Description of Artificial Sequence: Synthetic oligonucleotide
  Target: ATXN1; (+) strand; PAM type: YTN; PAM sequence: CTT
gcagtaagcagagatcgtgc

SEQ ID NO: 292446 - DNA, 20 bp, Artificial Sequence
  Description of Artificial Sequence: Synthetic oligonucleotide
  Target: ATXN1; (+) strand; PAM type: YTN; PAM sequence: TTG
cagtaagcagagatcgtgcc

SEQ ID NO: 292447 - DNA, 20 bp, Artificial Sequence
  Description of Artificial Sequence: Synthetic oligonucleotide
  Target: ATXN1; (+) strand; PAM type: YTN; PAM sequence: CTG
cactcaagcctgggtgacag

SEQ ID NO: 292448 - DNA, 20 bp, Artificial Sequence
  Description of Artificial Sequence: Synthetic oligonucleotide
  Target: ATXN1; (+) strand; PAM type: YTN; PAM sequence: CTC
aagcctgggtgacagagcga

SEQ ID NO: 292449 - DNA, 20 bp, Artificial Sequence
  Description of Artificial Sequence: Synthetic oligonucleotide
  Target: ATXN1; (+) strand; PAM type: YTN; PAM sequence: CTG
ggtgacagagcgagactctg

SEQ ID NO: 292450 - DNA, 20 bp, Artificial Sequence
  Description of Artificial Sequence: Synthetic oligonucleotide
  Target: ATXN1; (+) strand; PAM type: YTN; PAM sequence: CTC
tgtctcaaaaaagaaaaaaa

SEQ ID NO: 292451 - DNA, 20 bp, Artificial Sequence
  Description of Artificial Sequence: Synthetic oligonucleotide
  Target: ATXN1; (+) strand; PAM type: YTN; PAM sequence: CTG
tctcaaaaaagaaaaaaaaa

SEQ ID NO: 292452 - DNA, 20 bp, Artificial Sequence
  Description of Artificial Sequence: Synthetic oligonucleotide
  Target: ATXN1; (+) strand; PAM type: YTN; PAM sequence: CTC
aaaaaagaaaaaaaaaaaag

SEQ ID NO: 292453 - DNA, 20 bp, Artificial Sequence
  Description of Artificial Sequence: Synthetic oligonucleotide
  Target: ATXN1; (+) strand; PAM type: YTN; PAM sequence: TTG
aaattaggccaattaataac

SEQ ID NO: 292454 - DNA, 20 bp, Artificial Sequence
  Description of Artificial Sequence: Synthetic oligonucleotide
  Target: ATXN1; (+) strand; PAM type: YTN; PAM sequence: TTA
ggccaattaataaccctaaa

SEQ ID NO: 292455 - DNA, 20 bp, Artificial Sequence
  Description of Artificial Sequence: Synthetic oligonucleotide
  Target: ATXN1; (+) strand; PAM type: YTN; PAM sequence: TTA
ataaccctaaaatagccgct

SEQ ID NO: 292456 - DNA, 20 bp, Artificial Sequence
  Description of Artificial Sequence: Synthetic oligonucleotide
  Target: ATXN1; (+) strand; PAM type: YTN; PAM sequence: CTA
aaatagccgctaagcattca

SEQ ID NO: 292457 - DNA, 20 bp, Artificial Sequence
  Description of Artificial Sequence: Synthetic oligonucleotide
  Target: ATXN1; (+) strand; PAM type: YTN; PAM sequence: CTA
agcattcaagtgaaaggaag

SEQ ID NO: 292458 - DNA, 20 bp, Artificial Sequence
  Description of Artificial Sequence: Synthetic oligonucleotide
  Target: ATXN1; (+) strand; PAM type: YTN; PAM sequence: TTC
aagtgaaaggaagagtgagt

SEQ ID NO: 292459 - DNA, 20 bp, Artificial Sequence
  Description of Artificial Sequence: Synthetic oligonucleotide
  Target: ATXN1; (+) strand; PAM type: YTN; PAM sequence: CTC
tcaatttaaataagaaaact

SEQ ID NO: 292460 - DNA, 20 bp, Artificial Sequence
  Description of Artificial Sequence: Synthetic oligonucleotide
  Target: ATXN1; (+) strand; PAM type: YTN; PAM sequence: CTC
aatttaaataagaaaactag

SEQ ID NO: 292461 - DNA, 20 bp, Artificial Sequence
  Description of Artificial Sequence: Synthetic oligonucleotide
  Target: ATXN1; (+) strand; PAM type: YTN; PAM sequence: TTT
aaataagaaaactagaaatg

SEQ ID NO: 292462 - DNA, 20 bp, Artificial Sequence
  Description of Artificial Sequence: Synthetic oligonucleotide
  Target: ATXN1; (+) strand; PAM type: YTN; PAM sequence: TTA
aataagaaaactagaaatga

SEQ ID NO: 292463 - DNA, 20 bp, Artificial Sequence
  Description of Artificial Sequence: Synthetic oligonucleotide
  Target: ATXN1; (+) strand; PAM type: YTN; PAM sequence: CTA
gaaatgattaagcttagcga

SEQ ID NO: 292464 - DNA, 20 bp, Artificial Sequence
  Description of Artificial Sequence: Synthetic oligonucleotide
  Target: ATXN1; (+) strand; PAM type: YTN; PAM sequence: TTA
agcttagcgaggaaggcatg

SEQ ID NO: 292465 - DNA, 20 bp, Artificial Sequence
  Description of Artificial Sequence: Synthetic oligonucleotide
  Target: ATXN1; (+) strand; PAM type: YTN; PAM sequence: CTT
agcgaggaaggcatgttgaa

SEQ ID NO: 292466 - DNA, 20 bp, Artificial Sequence
  Description of Artificial Sequence: Synthetic oligonucleotide
  Target: ATXN1; (+) strand; PAM type: YTN; PAM sequence: TTA
gcgaggaaggcatgttgaaa

SEQ ID NO: 292467 - DNA, 20 bp, Artificial Sequence
  Description of Artificial Sequence: Synthetic oligonucleotide
  Target: ATXN1; (+) strand; PAM type: YTN; PAM sequence: TTG
aaagctgacatatgtcaaaa

SEQ ID NO: 292468 - DNA, 20 bp, Artificial Sequence
  Description of Artificial Sequence: Synthetic oligonucleotide
  Target: ATXN1; (+) strand; PAM type: YTN; PAM sequence: CTG
acatatgtcaaaagccaggc

SEQ ID NO: 292469 - DNA, 20 bp, Artificial Sequence
  Description of Artificial Sequence: Synthetic oligonucleotide
  Target: ATXN1; (+) strand; PAM type: YTN; PAM sequence: CTT
cttgtgactgaagggttagc

SEQ ID NO: 292470 - DNA, 20 bp, Artificial Sequence
  Description of Artificial Sequence: Synthetic oligonucleotide
  Target: ATXN1; (+) strand; PAM type: YTN; PAM sequence: TTC
ttgtgactgaagggttagcc

SEQ ID NO: 292471 - DNA, 20 bp, Artificial Sequence
  Description of Artificial Sequence: Synthetic oligonucleotide
  Target: ATXN1; (+) strand; PAM type: YTN; PAM sequence: CTT
gtgactgaagggttagccaa

SEQ ID NO: 292472 - DNA, 20 bp, Artificial Sequence
  Description of Artificial Sequence: Synthetic oligonucleotide
  Target: ATXN1; (+) strand; PAM type: YTN; PAM sequence: TTG
tgactgaagggttagccaag

SEQ ID NO: 292473 - DNA, 20 bp, Artificial Sequence
  Description of Artificial Sequence: Synthetic oligonucleotide
  Target: ATXN1; (+) strand; PAM type: YTN; PAM sequence: CTG
aagggttagccaagctgtga

SEQ ID NO: 292474 - DNA, 20 bp, Artificial Sequence
  Description of Artificial Sequence: Synthetic oligonucleotide
  Target: ATXN1; (+) strand; PAM type: YTN; PAM sequence: TTA
gccaagctgtgaatgctaag

SEQ ID NO: 292475 - DNA, 20 bp, Artificial Sequence
  Description of Artificial Sequence: Synthetic oligonucleotide
  Target: ATXN1; (+) strand; PAM type: YTN; PAM sequence: CTG
tgaatgctaaggaaaagttc

SEQ ID NO: 292476 - DNA, 20 bp, Artificial Sequence
  Description of Artificial Sequence: Synthetic oligonucleotide
  Target: ATXN1; (+) strand; PAM type: YTN; PAM sequence: CTA
aggaaaagttcttgaagaaa

SEQ ID NO: 292477 - DNA, 20 bp, Artificial Sequence
  Description of Artificial Sequence: Synthetic oligonucleotide
  Target: ATXN1; (+) strand; PAM type: YTN; PAM sequence: TTC
ttgaagaaaattaaaagtgc

SEQ ID NO: 292478 - DNA, 20 bp, Artificial Sequence
  Description of Artificial Sequence: Synthetic oligonucleotide
  Target: ATXN1; (+) strand; PAM type: YTN; PAM sequence: CTT
gaagaaaattaaaagtgcta

SEQ ID NO: 292479 - DNA, 20 bp, Artificial Sequence
  Description of Artificial Sequence: Synthetic oligonucleotide
  Target: ATXN1; (+) strand; PAM type: YTN; PAM sequence: TTG
aagaaaattaaaagtgctac

SEQ ID NO: 292480 - DNA, 20 bp, Artificial Sequence
  Description of Artificial Sequence: Synthetic oligonucleotide
  Target: ATXN1; (+) strand; PAM type: YTN; PAM sequence: TTA
aaagtgctactccagtgaac

SEQ ID NO: 292481 - DNA, 20 bp, Artificial Sequence
  Description of Artificial Sequence: Synthetic oligonucleotide
  Target: ATXN1; (+) strand; PAM type: YTN; PAM sequence: CTA
ctccagtgaactcatcaatg

SEQ ID NO: 292482 - DNA, 20 bp, Artificial Sequence
  Description of Artificial Sequence: Synthetic oligonucleotide
  Target: ATXN1; (+) strand; PAM type: YTN; PAM sequence: CTC
cagtgaactcatcaatggta

SEQ ID NO: 292483 - DNA, 20 bp, Artificial Sequence
  Description of Artificial Sequence: Synthetic oligonucleotide
  Target: ATXN1; (+) strand; PAM type: YTN; PAM sequence: CTC
atcaatggtaagaaagtgaa

SEQ ID NO: 292484 - DNA, 20 bp, Artificial Sequence
  Description of Artificial Sequence: Synthetic oligonucleotide
  Target: ATXN1; (+) strand; PAM type: YTN; PAM sequence: CTT
gttgctgatatggacaaagt

SEQ ID NO: 292485 - DNA, 20 bp, Artificial Sequence
  Description of Artificial Sequence: Synthetic oligonucleotide
  Target: ATXN1; (+) strand; PAM type: YTN; PAM sequence: TTG
ttgctgatatggacaaagtt

SEQ ID NO: 292486 - DNA, 20 bp, Artificial Sequence
  Description of Artificial Sequence: Synthetic oligonucleotide
  Target: ATXN1; (+) strand; PAM type: YTN; PAM sequence: TTG
ctgatatggacaaagttaga

SEQ ID NO: 292487 - DNA, 20 bp, Artificial Sequence
  Description of Artificial Sequence: Synthetic oligonucleotide
  Target: ATXN1; (+) strand; PAM type: YTN; PAM sequence: CTG
atatggacaaagttagagtg

SEQ ID NO: 292488 - DNA, 20 bp, Artificial Sequence
  Description of Artificial Sequence: Synthetic oligonucleotide
  Target: ATXN1; (+) strand; PAM type: YTN; PAM sequence: TTA
gagtggtctgaatagaaaag

SEQ ID NO: 292489 - DNA, 20 bp, Artificial Sequence
  Description of Artificial Sequence: Synthetic oligonucleotide
  Target: ATXN1; (+) strand; PAM type: YTN; PAM sequence: CTG
aatagaaaagcaaaccagcc

SEQ ID NO: 292490 - DNA, 20 bp, Artificial Sequence
  Description of Artificial Sequence: Synthetic oligonucleotide
  Target: ATXN1; (+) strand; PAM type: YTN; PAM sequence: TTC
ccttaagccaaagcctaatc

SEQ ID NO: 292491 - DNA, 20 bp, Artificial Sequence
  Description of Artificial Sequence: Synthetic oligonucleotide
  Target: ATXN1; (+) strand; PAM type: YTN; PAM sequence: CTT
aagccaaagcctaatccaga

SEQ ID NO: 292492 - DNA, 20 bp, Artificial Sequence
  Description of Artificial Sequence: Synthetic oligonucleotide
  Target: ATXN1; (+) strand; PAM type: YTN; PAM sequence: TTA
agccaaagcctaatccagat

SEQ ID NO: 292493 - DNA, 20 bp, Artificial Sequence
  Description of Artificial Sequence: Synthetic oligonucleotide
  Target: ATXN1; (+) strand; PAM type: YTN; PAM sequence: CTA
atccagatcaaggccctaac

SEQ ID NO: 292494 - DNA, 20 bp, Artificial Sequence
  Description of Artificial Sequence: Synthetic oligonucleotide
  Target: ATXN1; (+) strand; PAM type: YTN; PAM sequence: CTA
actctcttcacttctatgaa

SEQ ID NO: 292495 - DNA, 20 bp, Artificial Sequence
  Description of Artificial Sequence: Synthetic oligonucleotide
  Target: ATXN1; (+) strand; PAM type: YTN; PAM sequence: CTC
tcttcacttctatgaaggct

SEQ ID NO: 292496 - DNA, 20 bp, Artificial Sequence
  Description of Artificial Sequence: Synthetic oligonucleotide
  Target: ATXN1; (+) strand; PAM type: YTN; PAM sequence: CTC
ttcacttctatgaaggctga

SEQ ID NO: 292497 - DNA, 20 bp, Artificial Sequence
  Description of Artificial Sequence: Synthetic oligonucleotide
  Target: ATXN1; (+) strand; PAM type: YTN; PAM sequence: CTT
cacttctatgaaggctgaga

SEQ ID NO: 292498 - DNA, 20 bp, Artificial Sequence
  Description of Artificial Sequence: Synthetic oligonucleotide
  Target: ATXN1; (+) strand; PAM type: YTN; PAM sequence: TTC
acttctatgaaggctgagag

SEQ ID NO: 292499 - DNA, 20 bp, Artificial Sequence
  Description of Artificial Sequence: Synthetic oligonucleotide
  Target: ATXN1; (+) strand; PAM type: YTN; PAM sequence: CTT
ctatgaaggctgagagaggt

SEQ ID NO: 292500 - DNA, 20 bp, Artificial Sequence
  Description of Artificial Sequence: Synthetic oligonucleotide
  Target: ATXN1; (+) strand; PAM type: YTN; PAM sequence: TTC
tatgaaggctgagagaggtg

SEQ ID NO: 292501 - DNA, 20 bp, Artificial Sequence
  Description of Artificial Sequence: Synthetic oligonucleotide
  Target: ATXN1; (+) strand; PAM type: YTN; PAM sequence: CTA
tgaaggctgagagaggtgag

SEQ ID NO: 292502 - DNA, 20 bp, Artificial Sequence
  Description of Artificial Sequence: Synthetic oligonucleotide
  Target: ATXN1; (+) strand; PAM type: YTN; PAM sequence: CTG
agagaggtgaggaacttgga

SEQ ID NO: 292503 - DNA, 20 bp, Artificial Sequence
  Description of Artificial Sequence: Synthetic oligonucleotide
  Target: ATXN1; (+) strand; PAM type: YTN; PAM sequence: CTT
ggagaagaaaagtttgaagc

SEQ ID NO: 292504 - DNA, 20 bp, Artificial Sequence
  Description of Artificial Sequence: Synthetic oligonucleotide
  Target: ATXN1; (+) strand; PAM type: YTN; PAM sequence: TTG
gagaagaaaagtttgaagct

SEQ ID NO: 292505 - DNA, 20 bp, Artificial Sequence
  Description of Artificial Sequence: Synthetic oligonucleotide
  Target: ATXN1; (+) strand; PAM type: YTN; PAM sequence: TTT
gaagctagcagaagttggtt

SEQ ID NO: 292506 - DNA, 20 bp, Artificial Sequence
  Description of Artificial Sequence: Synthetic oligonucleotide
  Target: ATXN1; (+) strand; PAM type: YTN; PAM sequence: TTG
aagctagcagaagttggttc

SEQ ID NO: 292507 - DNA, 20 bp, Artificial Sequence
  Description of Artificial Sequence: Synthetic oligonucleotide
  Target: ATXN1; (+) strand; PAM type: YTN; PAM sequence: CTA
gcagaagttggttcgtgaga

SEQ ID NO: 292508 - DNA, 20 bp, Artificial Sequence
  Description of Artificial Sequence: Synthetic oligonucleotide
  Target: ATXN1; (+) strand; PAM type: YTN; PAM sequence: TTG
gttcgtgagatttaaggaaa

SEQ ID NO: 292509 - DNA, 20 bp, Artificial Sequence
  Description of Artificial Sequence: Synthetic oligonucleotide
  Target: ATXN1; (+) strand; PAM type: YTN; PAM sequence: TTC
gtgagatttaaggaaagaaa

SEQ ID NO: 292510 - DNA, 20 bp, Artificial Sequence
  Description of Artificial Sequence: Synthetic oligonucleotide
  Target: ATXN1; (+) strand; PAM type: YTN; PAM sequence: TTT
aaggaaagaaatcttctcca

SEQ ID NO: 292511 - DNA, 20 bp, Artificial Sequence
  Description of Artificial Sequence: Synthetic oligonucleotide
  Target: ATXN1; (+) strand; PAM type: YTN; PAM sequence: TTA
aggaaagaaatcttctccaa

SEQ ID NO: 292512 - DNA, 20 bp, Artificial Sequence
  Description of Artificial Sequence: Synthetic oligonucleotide
  Target: ATXN1; (+) strand; PAM type: YTN; PAM sequence: CTT
ctccaaatgctgatgtagaa

SEQ ID NO: 292513 - DNA, 20 bp, Artificial Sequence
  Description of Artificial Sequence: Synthetic oligonucleotide
  Target: ATXN1; (+) strand; PAM type: YTN; PAM sequence: TTC
tccaaatgctgatgtagaag

SEQ ID NO: 292514 - DNA, 20 bp, Artificial Sequence
  Description of Artificial Sequence: Synthetic oligonucleotide
  Target: ATXN1; (+) strand; PAM type: YTN; PAM sequence: CTC
caaatgctgatgtagaagct

SEQ ID NO: 292515 - DNA, 20 bp, Artificial Sequence
  Description of Artificial Sequence: Synthetic oligonucleotide
  Target: ATXN1; (+) strand; PAM type: YTN; PAM sequence: CTG
atgtagaagctgcagcaggt

SEQ ID NO: 292516 - DNA, 20 bp, Artificial Sequence
  Description of Artificial Sequence: Synthetic oligonucleotide
  Target: ATXN1; (+) strand; PAM type: YTN; PAM sequence: CTG
cagcaggttatccagaaaat

SEQ ID NO: 292517 - DNA, 20 bp, Artificial Sequence
  Description of Artificial Sequence: Synthetic oligonucleotide
  Target: ATXN1; (+) strand; PAM type: YTN; PAM sequence: TTA
tccagaaaatttaactaaga

SEQ ID NO: 292518 - DNA, 20 bp, Artificial Sequence
  Description of Artificial Sequence: Synthetic oligonucleotide
  Target: ATXN1; (+) strand; PAM type: YTN; PAM sequence: TTT
aactaagatcattgatgaag

SEQ ID NO: 292519 - DNA, 20 bp, Artificial Sequence
  Description of Artificial Sequence: Synthetic oligonucleotide
  Target: ATXN1; (+) strand; PAM type: YTN; PAM sequence: TTA
actaagatcattgatgaagg

SEQ ID NO: 292520 - DNA, 20 bp, Artificial Sequence
  Description of Artificial Sequence: Synthetic oligonucleotide
  Target: ATXN1; (+) strand; PAM type: YTN; PAM sequence: CTA
agatcattgatgaaggtgac

SEQ ID NO: 292521 - DNA, 20 bp, Artificial Sequence
  Description of Artificial Sequence: Synthetic oligonucleotide
  Target: ATXN1; (+) strand; PAM type: YTN; PAM sequence: TTG
atgaaggtgactacagattt

SEQ ID NO: 292522 - DNA, 20 bp, Artificial Sequence
  Description of Artificial Sequence: Synthetic oligonucleotide
  Target: ATXN1; (+) strand; PAM type: YTN; PAM sequence: CTA
cagatttttcaacgtaggca

SEQ ID NO: 292523 - DNA, 20 bp, Artificial Sequence
  Description of Artificial Sequence: Synthetic oligonucleotide
  Target: ATXN1; (+) strand; PAM type: YTN; PAM sequence: TTT
ttcaacgtaggcaaagcagc

SEQ ID NO: 292524 - DNA, 20 bp, Artificial Sequence
  Description of Artificial Sequence: Synthetic oligonucleotide
  Target: ATXN1; (+) strand; PAM type: YTN; PAM sequence: TTT
tcaacgtaggcaaagcagcc

SEQ ID NO: 292525 - DNA, 20 bp, Artificial Sequence
  Description of Artificial Sequence: Synthetic oligonucleotide
  Target: ATXN1; (+) strand; PAM type: YTN; PAM sequence: TTT
caacgtaggcaaagcagcct

SEQ ID NO: 292526 - DNA, 20 bp, Artificial Sequence
  Description of Artificial Sequence: Synthetic oligonucleotide
  Target: ATXN1; (+) strand; PAM type: YTN; PAM sequence: TTC
aacgtaggcaaagcagcctt

SEQ ID NO: 292527 - DNA, 20 bp, Artificial Sequence
  Description of Artificial Sequence: Synthetic oligonucleotide
  Target: ATXN1; (+) strand; PAM type: YTN; PAM sequence: CTT
ctattggaagaaaatgccat

SEQ ID NO: 292528 - DNA, 20 bp, Artificial Sequence
  Description of Artificial Sequence: Synthetic oligonucleotide
  Target: ATXN1; (+) strand; PAM type: YTN; PAM sequence: TTC
tattggaagaaaatgccatt

SEQ ID NO: 292529 - DNA, 20 bp, Artificial Sequence
  Description of Artificial Sequence: Synthetic oligonucleotide
  Target: ATXN1; (+) strand; PAM type: YTN; PAM sequence: CTA
ttggaagaaaatgccattta

SEQ ID NO: 292530 - DNA, 20 bp, Artificial Sequence
  Description of Artificial Sequence: Synthetic oligonucleotide
  Target: ATXN1; (+) strand; PAM type: YTN; PAM sequence: TTG
gaagaaaatgccatttaaga

SEQ ID NO: 292531 - DNA, 20 bp, Artificial Sequence
  Description of Artificial Sequence: Synthetic oligonucleotide
  Target: ATXN1; (+) strand; PAM type: YTN; PAM sequence: TTT
aagactttcatagctagaga

SEQ ID NO: 292532 - DNA, 20 bp, Artificial Sequence
  Description of Artificial Sequence: Synthetic oligonucleotide
  Target: ATXN1; (+) strand; PAM type: YTN; PAM sequence: TTA
agactttcatagctagagag

SEQ ID NO: 292533 - DNA, 20 bp, Artificial Sequence
  Description of Artificial Sequence: Synthetic oligonucleotide
  Target: ATXN1; (+) strand; PAM type: YTN; PAM sequence: CTT
tcatagctagagaggagaag

SEQ ID NO: 292534 - DNA, 20 bp, Artificial Sequence
  Description of Artificial Sequence: Synthetic oligonucleotide
  Target: ATXN1; (+) strand; PAM type: YTN; PAM sequence: TTT
catagctagagaggagaagt

SEQ ID NO: 292535 - DNA, 20 bp, Artificial Sequence
  Description of Artificial Sequence: Synthetic oligonucleotide
  Target: ATXN1; (+) strand; PAM type: YTN; PAM sequence: TTC
atagctagagaggagaagtc

SEQ ID NO: 292536 - DNA, 20 bp, Artificial Sequence
  Description of Artificial Sequence: Synthetic oligonucleotide
  Target: ATXN1; (+) strand; PAM type: YTN; PAM sequence: CTA
gagaggagaagtcaatgctt

SEQ ID NO: 292537 - DNA, 20 bp, Artificial Sequence
  Description of Artificial Sequence: Synthetic oligonucleotide
  Target: ATXN1; (+) strand; PAM type: YTN; PAM sequence: CTT
gactacaaagcttcaaagga

SEQ ID NO: 292538 - DNA, 20 bp, Artificial Sequence
  Description of Artificial Sequence: Synthetic oligonucleotide
  Target: ATXN1; (+) strand; PAM type: YTN; PAM sequence: TTG
actacaaagcttcaaaggag

SEQ ID NO: 292539 - DNA, 20 bp, Artificial Sequence
  Description of Artificial Sequence: Synthetic oligonucleotide
  Target: ATXN1; (+) strand; PAM type: YTN; PAM sequence: CTA
caaagcttcaaaggagaggc

SEQ ID NO: 292540 - DNA, 20 bp, Artificial Sequence
  Description of Artificial Sequence: Synthetic oligonucleotide
  Target: ATXN1; (+) strand; PAM type: YTN; PAM sequence: CTT
caaaggagaggctgactctc

SEQ ID NO: 292541 - DNA, 20 bp, Artificial Sequence
  Description of Artificial Sequence: Synthetic oligonucleotide
  Target: ATXN1; (+) strand; PAM type: YTN; PAM sequence: TTC
aaaggagaggctgactctct

SEQ ID NO: 292542 - DNA, 20 bp, Artificial Sequence
  Description of Artificial Sequence: Synthetic oligonucleotide
  Target: ATXN1; (+) strand; PAM type: YTN; PAM sequence: CTG
actctcttgttacgggcaaa

SEQ ID NO: 292543 - DNA, 20 bp, Artificial Sequence
  Description of Artificial Sequence: Synthetic oligonucleotide
  Target: ATXN1; (+) strand; PAM type: YTN; PAM sequence: CTC
tcttgttacgggcaaatgca

SEQ ID NO: 292544 - DNA, 20 bp, Artificial Sequence
  Description of Artificial Sequence: Synthetic oligonucleotide
  Target: ATXN1; (+) strand; PAM type: YTN; PAM sequence: CTC
ttgttacgggcaaatgcagc

SEQ ID NO: 292545 - DNA, 20 bp, Artificial Sequence
  Description of Artificial Sequence: Synthetic oligonucleotide
  Target: ATXN1; (+) strand; PAM type: YTN; PAM sequence: CTT
gttacgggcaaatgcagcta

SEQ ID NO: 292546 - DNA, 20 bp, Artificial Sequence
  Description of Artificial Sequence: Synthetic oligonucleotide
  Target: ATXN1; (+) strand; PAM type: YTN; PAM sequence: TTG
ttacgggcaaatgcagctag

SEQ ID NO: 292547 - DNA, 20 bp, Artificial Sequence
  Description of Artificial Sequence: Synthetic oligonucleotide
  Target: ATXN1; (+) strand; PAM type: YTN; PAM sequence: TTA
cgggcaaatgcagctagtga

SEQ ID NO: 292548 - DNA, 20 bp, Artificial Sequence
  Description of Artificial Sequence: Synthetic oligonucleotide
  Target: ATXN1; (+) strand; PAM type: YTN; PAM sequence: CTA
gtgactttagttgaagccaa

SEQ ID NO: 292549 - DNA, 20 bp, Artificial Sequence
  Description of Artificial Sequence: Synthetic oligonucleotide
  Target: ATXN1; (+) strand; PAM type: YTN; PAM sequence: CTT
tagttgaagccaatgctcat

SEQ ID NO: 292550 - DNA, 20 bp, Artificial Sequence
  Description of Artificial Sequence: Synthetic oligonucleotide
  Target: ATXN1; (+) strand; PAM type: YTN; PAM sequence: TTT
agttgaagccaatgctcatt

SEQ ID NO: 292551 - DNA, 20 bp, Artificial Sequence
  Description of Artificial Sequence: Synthetic oligonucleotide
  Target: ATXN1; (+) strand; PAM type: YTN; PAM sequence: TTA
gttgaagccaatgctcattt

SEQ ID NO: 292552 - DNA, 20 bp, Artificial Sequence
  Description of Artificial Sequence: Synthetic oligonucleotide
  Target: ATXN1; (+) strand; PAM type: YTN; PAM sequence: TTG
aagccaatgctcatttacca

SEQ ID NO: 292553 - DNA, 20 bp, Artificial Sequence
  Description of Artificial Sequence: Synthetic oligonucleotide
  Target: ATXN1; (+) strand; PAM type: YTN; PAM sequence: CTC
atttaccattccaaaaatcc

SEQ ID NO: 292554 - DNA, 20 bp, Artificial Sequence
  Description of Artificial Sequence: Synthetic oligonucleotide
  Target: ATXN1; (+) strand; PAM type: YTN; PAM sequence: TTT
accattccaaaaatcctaga

SEQ ID NO: 292555 - DNA, 20 bp, Artificial Sequence
  Description of Artificial Sequence: Synthetic oligonucleotide
  Target: ATXN1; (+) strand; PAM type: YTN; PAM sequence: TTA
ccattccaaaaatcctagag

SEQ ID NO: 292556 - DNA, 20 bp, Artificial Sequence
  Description of Artificial Sequence: Synthetic oligonucleotide
  Target: ATXN1; (+) strand; PAM type: YTN; PAM sequence: TTC
caaaaatcctagagccctaa

SEQ ID NO: 292557 - DNA, 20 bp, Artificial Sequence
  Description of Artificial Sequence: Synthetic oligonucleotide
  Target: ATXN1; (+) strand; PAM type: YTN; PAM sequence: CTA
gagccctaataattatgctg

SEQ ID NO: 292558 - DNA, 20 bp, Artificial Sequence
  Description of Artificial Sequence: Synthetic oligonucleotide
  Target: ATXN1; (+) strand; PAM type: YTN; PAM sequence: CTA
ataattatgctgaatctact

SEQ ID NO: 292559 - DNA, 20 bp, Artificial Sequence
  Description of Artificial Sequence: Synthetic oligonucleotide
  Target: ATXN1; (+) strand; PAM type: YTN; PAM sequence: TTA
tgctgaatctactctgccag

SEQ ID NO: 292560 - DNA, 20 bp, Artificial Sequence
  Description of Artificial Sequence: Synthetic oligonucleotide
  Target: ATXN1; (+) strand; PAM type: YTN; PAM sequence: CTG
aatctactctgccagtgcta

SEQ ID NO: 292561 - DNA, 20 bp, Artificial Sequence
  Description of Artificial Sequence: Synthetic oligonucleotide
  Target: ATXN1; (+) strand; PAM type: YTN; PAM sequence: CTA
ctctgccagtgctatagaaa

SEQ ID NO: 292562 - DNA, 20 bp, Artificial Sequence
  Description of Artificial Sequence: Synthetic oligonucleotide
  Target: ATXN1; (+) strand; PAM type: YTN; PAM sequence: CTC
tgccagtgctatagaaatgg

SEQ ID NO: 292563 - DNA, 20 bp, Artificial Sequence
  Description of Artificial Sequence: Synthetic oligonucleotide
  Target: ATXN1; (+) strand; PAM type: YTN; PAM sequence: CTG
ccagtgctatagaaatggaa

SEQ ID NO: 292564 - DNA, 20 bp, Artificial Sequence
  Description of Artificial Sequence: Synthetic oligonucleotide
  Target: ATXN1; (+) strand; PAM type: YTN; PAM sequence: CTA
tagaaatggaacaacaaagc

SEQ ID NO: 292565 - DNA, 20 bp, Artificial Sequence
  Description of Artificial Sequence: Synthetic oligonucleotide
  Target: ATXN1; (+) strand; PAM type: YTN; PAM sequence: CTG
gatgaaagcacattgggtta

SEQ ID NO: 292566 - DNA, 20 bp, Artificial Sequence
  Description of Artificial Sequence: Synthetic oligonucleotide
  Target: ATXN1; (+) strand; PAM type: YTN; PAM sequence: TTG
ggttactaaatactttaagc

SEQ ID NO: 292567 - DNA, 20 bp, Artificial Sequence
  Description of Artificial Sequence: Synthetic oligonucleotide
  Target: ATXN1; (+) strand; PAM type: YTN; PAM sequence: TTA
ctaaatactttaagcccact

SEQ ID NO: 292568 - DNA, 20 bp, Artificial Sequence
  Description of Artificial Sequence: Synthetic oligonucleotide
  Target: ATXN1; (+) strand; PAM type: YTN; PAM sequence: CTA
aatactttaagcccactgtt

SEQ ID NO: 292569 - DNA, 20 bp, Artificial Sequence
  Description of Artificial Sequence: Synthetic oligonucleotide
  Target: ATXN1; (+) strand; PAM type: YTN; PAM sequence: CTT
taagcccactgttgagactt

SEQ ID NO: 292570 - DNA, 20 bp, Artificial Sequence
  Description of Artificial Sequence: Synthetic oligonucleotide
  Target: ATXN1; (+) strand; PAM type: YTN; PAM sequence: TTT
aagcccactgttgagactta

SEQ ID NO: 292571 - DNA, 20 bp, Artificial Sequence
  Description of Artificial Sequence: Synthetic oligonucleotide
  Target: ATXN1; (+) strand; PAM type: YTN; PAM sequence: TTA
agcccactgttgagacttaa

SEQ ID NO: 292572 - DNA, 20 bp, Artificial Sequence
  Description of Artificial Sequence: Synthetic oligonucleotide
  Target: ATXN1; (+) strand; PAM type: YTN; PAM sequence: CTG
ttgagacttaattgctcaga

SEQ ID NO: 292573 - DNA, 20 bp, Artificial Sequence
  Description of Artificial Sequence: Synthetic oligonucleotide
  Target: ATXN1; (+) strand; PAM type: YTN; PAM sequence: TTG
agacttaattgctcagaaaa

SEQ ID NO: 292574 - DNA, 20 bp, Artificial Sequence
  Description of Artificial Sequence: Synthetic oligonucleotide
  Target: ATXN1; (+) strand; PAM type: YTN; PAM sequence: CTT
aattgctcagaaaaagattc

SEQ ID NO: 292575 - DNA, 20 bp, Artificial Sequence
  Description of Artificial Sequence: Synthetic oligonucleotide
  Target: ATXN1; (+) strand; PAM type: YTN; PAM sequence: TTA
attgctcagaaaaagattcc

SEQ ID NO: 292576 - DNA, 20 bp, Artificial Sequence
  Description of Artificial Sequence: Synthetic oligonucleotide
  Target: ATXN1; (+) strand; PAM type: YTN; PAM sequence: TTG
ctcagaaaaagattcctttc

SEQ ID NO: 292577 - DNA, 20 bp, Artificial Sequence
  Description of Artificial Sequence: Synthetic oligonucleotide
  Target: ATXN1; (+) strand; PAM type: YTN; PAM sequence: CTC
agaaaaagattcctttcaaa

SEQ ID NO: 292578 - DNA, 20 bp, Artificial Sequence
  Description of Artificial Sequence: Synthetic oligonucleotide
  Target: ATXN1; (+) strand; PAM type: YTN; PAM sequence: TTC
ctttcaaaatattactgctt

SEQ ID NO: 292579 - DNA, 20 bp, Artificial Sequence
  Description of Artificial Sequence: Synthetic oligonucleotide
  Target: ATXN1; (+) strand; PAM type: YTN; PAM sequence: CTT
tcaaaatattactgcttatt

SEQ ID NO: 292580 - DNA, 20 bp, Artificial Sequence
  Description of Artificial Sequence: Synthetic oligonucleotide
  Target: ATXN1; (+) strand; PAM type: YTN; PAM sequence: TTT
caaaatattactgcttattg

SEQ ID NO: 292581 - DNA, 20 bp, Artificial Sequence
  Description of Artificial Sequence: Synthetic oligonucleotide
  Target: ATXN1; (+) strand; PAM type: YTN; PAM sequence: TTC
aaaatattactgcttattga

SEQ ID NO: 292582 - DNA, 20 bp, Artificial Sequence
  Description of Artificial Sequence: Synthetic oligonucleotide
  Target: ATXN1; (+) strand; PAM type: YTN; PAM sequence: TTA
ctgcttattgacaatgcact

SEQ ID NO: 292583 - DNA, 20 bp, Artificial Sequence
  Description of Artificial Sequence: Synthetic oligonucleotide
  Target: ATXN1; (+) strand; PAM type: YTN; PAM sequence: CTG
cttattgacaatgcacttcg

SEQ ID NO: 292584 - DNA, 20 bp, Artificial Sequence
  Description of Artificial Sequence: Synthetic oligonucleotide
  Target: ATXN1; (+) strand; PAM type: YTN; PAM sequence: CTT
attgacaatgcacttcgtca

SEQ ID NO: 292585 - DNA, 20 bp, Artificial Sequence
  Description of Artificial Sequence: Synthetic oligonucleotide
  Target: ATXN1; (+) strand; PAM type: YTN; PAM sequence: TTA
ttgacaatgcacttcgtcac

SEQ ID NO: 292586 - DNA, 20 bp, Artificial Sequence
  Description of Artificial Sequence: Synthetic oligonucleotide
  Target: ATXN1; (+) strand; PAM type: YTN; PAM sequence: TTG
acaatgcacttcgtcactca

SEQ ID NO: 292587 - DNA, 20 bp, Artificial Sequence
  Description of Artificial Sequence: Synthetic oligonucleotide
  Target: ATXN1; (+) strand; PAM type: YTN; PAM sequence: CTT
cgtcactcatctaagagctc

SEQ ID NO: 292588 - DNA, 20 bp, Artificial Sequence
  Description of Artificial Sequence: Synthetic oligonucleotide
  Target: ATXN1; (+) strand; PAM type: YTN; PAM sequence: TTC
gtcactcatctaagagctct

SEQ ID NO: 292589 - DNA, 20 bp, Artificial Sequence
  Description of Artificial Sequence: Synthetic oligonucleotide
  Target: ATXN1; (+) strand; PAM type: YTN; PAM sequence: CTC
atctaagagctctgatggaa

SEQ ID NO: 292590 - DNA, 20 bp, Artificial Sequence
  Description of Artificial Sequence: Synthetic oligonucleotide
  Target: ATXN1; (+) strand; PAM type: YTN; PAM sequence: CTA
agagctctgatggaaatata

SEQ ID NO: 292591 - DNA, 20 bp, Artificial Sequence
  Description of Artificial Sequence: Synthetic oligonucleotide
  Target: ATXN1; (+) strand; PAM type: YTN; PAM sequence: CTC
tgatggaaatatacaaggag

SEQ ID NO: 292592 - DNA, 20 bp, Artificial Sequence
  Description of Artificial Sequence: Synthetic oligonucleotide
  Target: ATXN1; (+) strand; PAM type: YTN; PAM sequence: CTG
atggaaatatacaaggagat

SEQ ID NO: 292593 - DNA, 20 bp, Artificial Sequence
  Description of Artificial Sequence: Synthetic oligonucleotide
  Target: ATXN1; (+) strand; PAM type: YTN; PAM sequence: TTC
atgtcgttttcacgcctgct

SEQ ID NO: 292594 - DNA, 20 bp, Artificial Sequence
  Description of Artificial Sequence: Synthetic oligonucleotide
  Target: ATXN1; (+) strand; PAM type: YTN; PAM sequence: TTT
tcacgcctgctaacacaaca

SEQ ID NO: 292595 - DNA, 20 bp, Artificial Sequence
  Description of Artificial Sequence: Synthetic oligonucleotide
  Target: ATXN1; (+) strand; PAM type: YTN; PAM sequence: TTT
cacgcctgctaacacaacac

SEQ ID NO: 292596 - DNA, 20 bp, Artificial Sequence
  Description of Artificial Sequence: Synthetic oligonucleotide
  Target: ATXN1; (+) strand; PAM type: YTN; PAM sequence: TTC
acgcctgctaacacaacacc

SEQ ID NO: 292597 - DNA, 20 bp, Artificial Sequence
  Description of Artificial Sequence: Synthetic oligonucleotide
  Target: ATXN1; (+) strand; PAM type: YTN; PAM sequence: CTG
ctaacacaacacccattctg

SEQ ID NO: 292598 - DNA, 20 bp, Artificial Sequence
  Description of Artificial Sequence: Synthetic oligonucleotide
  Target: ATXN1; (+) strand; PAM type: YTN; PAM sequence: CTA
acacaacacccattctgcaa

SEQ ID NO: 292599 - DNA, 20 bp, Artificial Sequence
  Description of Artificial Sequence: Synthetic oligonucleotide
  Target: ATXN1; (+) strand; PAM type: YTN; PAM sequence: TTC
tgcaacccatggatcaagga

SEQ ID NO: 292600 - DNA, 20 bp, Artificial Sequence
  Description of Artificial Sequence: Synthetic oligonucleotide
  Target: ATXN1; (+) strand; PAM type: YTN; PAM sequence: CTG
caacccatggatcaaggagt

SEQ ID NO: 292601 - DNA, 20 bp, Artificial Sequence
  Description of Artificial Sequence: Synthetic oligonucleotide
  Target: ATXN1; (+) strand; PAM type: YTN; PAM sequence: TTT
ttattttcaagtcttcttat

SEQ ID NO: 292602 - DNA, 20 bp, Artificial Sequence
  Description of Artificial Sequence: Synthetic oligonucleotide
  Target: ATXN1; (+) strand; PAM type: YTN; PAM sequence: TTT
tattttcaagtcttcttatt

SEQ ID NO: 292603 - DNA, 20 bp, Artificial Sequence
  Description of Artificial Sequence: Synthetic oligonucleotide
  Target: ATXN1; (+) strand; PAM type: YTN; PAM sequence: TTT
attttcaagtcttcttattt

SEQ ID NO: 292604 - DNA, 20 bp, Artificial Sequence
  Description of Artificial Sequence: Synthetic oligonucleotide
  Target: ATXN1; (+) strand; PAM type: YTN; PAM sequence: TTA
ttttcaagtcttcttattta

SEQ ID NO: 292605 - DNA, 20 bp, Artificial Sequence
  Description of Artificial Sequence: Synthetic oligonucleotide
  Target: ATXN1; (+) strand; PAM type: YTN; PAM sequence: TTT
tcaagtcttcttatttaaga

SEQ ID NO: 292606 - DNA, 20 bp, Artificial Sequence
  Description of Artificial Sequence: Synthetic oligonucleotide
  Target: ATXN1; (+) strand; PAM type: YTN; PAM sequence: TTT
caagtcttcttatttaagaa

SEQ ID NO: 292607 - DNA, 20 bp, Artificial Sequence
  Description of Artificial Sequence: Synthetic oligonucleotide
  Target: ATXN1; (+) strand; PAM type: YTN; PAM sequence: TTC
aagtcttcttatttaagaaa

SEQ ID NO: 292608 - DNA, 20 bp, Artificial Sequence
  Description of Artificial Sequence: Synthetic oligonucleotide
  Target: ATXN1; (+) strand; PAM type: YTN; PAM sequence: CTT
cttatttaagaaatacattc

SEQ ID NO: 292609 - DNA, 20 bp, Artificial Sequence
  Description of Artificial Sequence: Synthetic oligonucleotide
  Target: ATXN1; (+) strand; PAM type: YTN; PAM sequence: TTC
ttatttaagaaatacattct

SEQ ID NO: 292610 - DNA, 20 bp, Artificial Sequence
  Description of Artificial Sequence: Synthetic oligonucleotide
  Target: ATXN1; (+) strand; PAM type: YTN; PAM sequence: CTT
atttaagaaatacattctgt

SEQ ID NO: 292611 - DNA, 20 bp, Artificial Sequence
  Description of Artificial Sequence: Synthetic oligonucleotide
  Target: ATXN1; (+) strand; PAM type: YTN; PAM sequence: TTA
tttaagaaatacattctgta

SEQ ID NO: 292612 - DNA, 20 bp, Artificial Sequence
  Description of Artificial Sequence: Synthetic oligonucleotide
  Target: ATXN1; (+) strand; PAM type: YTN; PAM sequence: TTT
aagaaatacattctgtaagg

SEQ ID NO: 292613 - DNA, 20 bp, Artificial Sequence
  Description of Artificial Sequence: Synthetic oligonucleotide
  Target: ATXN1; (+) strand; PAM type: YTN; PAM sequence: TTA
agaaatacattctgtaaggc

SEQ ID NO: 292614 - DNA, 20 bp, Artificial Sequence
  Description of Artificial Sequence: Synthetic oligonucleotide
  Target: ATXN1; (+) strand; PAM type: YTN; PAM sequence: TTC
tgtaaggctatcattgccac

SEQ ID NO: 292615 - DNA, 20 bp, Artificial Sequence
  Description of Artificial Sequence: Synthetic oligonucleotide
  Target: ATXN1; (+) strand; PAM type: YTN; PAM sequence: CTG
taaggctatcattgccacag

SEQ ID NO: 292616 - DNA, 20 bp, Artificial Sequence
  Description of Artificial Sequence: Synthetic oligonucleotide
  Target: ATXN1; (+) strand; PAM type: YTN; PAM sequence: CTA
tcattgccacagaaagtaat

SEQ ID NO: 292617 - DNA, 20 bp, Artificial Sequence
  Description of Artificial Sequence: Synthetic oligonucleotide
  Target: ATXN1; (+) strand; PAM type: YTN; PAM sequence: TTG
ccacagaaagtaattcctct

SEQ ID NO: 292618 - DNA, 20 bp, Artificial Sequence
  Description of Artificial Sequence: Synthetic oligonucleotide
  Target: ATXN1; (+) strand; PAM type: YTN; PAM sequence: TTC
ctctgatggatctgggaaaa

SEQ ID NO: 292619 - DNA, 20 bp, Artificial Sequence
  Description of Artificial Sequence: Synthetic oligonucleotide
  Target: ATXN1; (+) strand; PAM type: YTN; PAM sequence: CTC
tgatggatctgggaaaagta

SEQ ID NO: 292620 - DNA, 20 bp, Artificial Sequence
  Description of Artificial Sequence: Synthetic oligonucleotide
  Target: ATXN1; (+) strand; PAM type: YTN; PAM sequence: CTG
atggatctgggaaaagtaaa

SEQ ID NO: 292621 - DNA, 20 bp, Artificial Sequence
  Description of Artificial Sequence: Synthetic oligonucleotide
  Target: ATXN1; (+) strand; PAM type: YTN; PAM sequence: CTG
ggaaaagtaaattgaaaacc

SEQ ID NO: 292622 - DNA, 20 bp, Artificial Sequence
  Description of Artificial Sequence: Synthetic oligonucleotide
  Target: ATXN1; (+) strand; PAM type: YTN; PAM sequence: TTG
aaaacctcctggaaaggatt

SEQ ID NO: 292623 - DNA, 20 bp, Artificial Sequence
  Description of Artificial Sequence: Synthetic oligonucleotide
  Target: ATXN1; (+) strand; PAM type: YTN; PAM sequence: CTC
ctggaaaggattcaccattg

SEQ ID NO: 292624 - DNA, 20 bp, Artificial Sequence
  Description of Artificial Sequence: Synthetic oligonucleotide
  Target: ATXN1; (+) strand; PAM type: YTN; PAM sequence: CTG
gaaaggattcaccattgtag

SEQ ID NO: 292625 - DNA, 20 bp, Artificial Sequence
  Description of Artificial Sequence: Synthetic oligonucleotide
  Target: ATXN1; (+) strand; PAM type: YTN; PAM sequence: TTC
accattgtagatgtcattaa

SEQ ID NO: 292626 - DNA, 20 bp, Artificial Sequence
  Description of Artificial Sequence: Synthetic oligonucleotide
  Target: ATXN1; (+) strand; PAM type: YTN; PAM sequence: TTG
tagatgtcattaagaacatt

SEQ ID NO: 292627 - DNA, 20 bp, Artificial Sequence
  Description of Artificial Sequence: Synthetic oligonucleotide
  Target: ATXN1; (+) strand; PAM type: YTN; PAM sequence: TTA
agaacatttgattcatggga

SEQ ID NO: 292628 - DNA, 20 bp, Artificial Sequence
  Description of Artificial Sequence: Synthetic oligonucleotide
  Target: ATXN1; (+) strand; PAM type: YTN; PAM sequence: TTT
gattcatgggaagaggtcaa

SEQ ID NO: 292629 - DNA, 20 bp, Artificial Sequence
  Description of Artificial Sequence: Synthetic oligonucleotide
  Target: ATXN1; (+) strand; PAM type: YTN; PAM sequence: TTG
attcatgggaagaggtcaaa

SEQ ID NO: 292630 - DNA, 20 bp, Artificial Sequence
  Description of Artificial Sequence: Synthetic oligonucleotide
  Target: ATXN1; (+) strand; PAM type: YTN; PAM sequence: TTC
atgggaagaggtcaaaatat

SEQ ID NO: 292631 - DNA, 20 bp, Artificial Sequence
  Description of Artificial Sequence: Synthetic oligonucleotide
  Target: ATXN1; (+) strand; PAM type: YTN; PAM sequence: TTT
ggaagaagttgattccaacc

SEQ ID NO: 292632 - DNA, 20 bp, Artificial Sequence
  Description of Artificial Sequence: Synthetic oligonucleotide
  Target: ATXN1; (+) strand; PAM type: YTN; PAM sequence: TTG
gaagaagttgattccaaccc

SEQ ID NO: 292633 - DNA, 20 bp, Artificial Sequence
  Description of Artificial Sequence: Synthetic oligonucleotide
  Target: ATXN1; (+) strand; PAM type: YTN; PAM sequence: TTG
attccaacccccatggatga

SEQ ID NO: 292634 - DNA, 20 bp, Artificial Sequence
  Description of Artificial Sequence: Synthetic oligonucleotide
  Target: ATXN1; (+) strand; PAM type: YTN; PAM sequence: TTC
caacccccatggatgacttg

SEQ ID NO: 292635 - DNA, 20 bp, Artificial Sequence
  Description of Artificial Sequence: Synthetic oligonucleotide
  Target: ATXN1; (+) strand; PAM type: YTN; PAM sequence: CTT
gagggtttcaagacttcggt

SEQ ID NO: 292636 - DNA, 20 bp, Artificial Sequence
  Description of Artificial Sequence: Synthetic oligonucleotide
  Target: ATXN1; (+) strand; PAM type: YTN; PAM sequence: TTG
agggtttcaagacttcggtg

SEQ ID NO: 292637 - DNA, 20 bp, Artificial Sequence
  Description of Artificial Sequence: Synthetic oligonucleotide
  Target: ATXN1; (+) strand; PAM type: YTN; PAM sequence: TTT
caagacttcggtggaggaag

SEQ ID NO: 292638 - DNA, 20 bp, Artificial Sequence
  Description of Artificial Sequence: Synthetic oligonucleotide
  Target: ATXN1; (+) strand; PAM type: YTN; PAM sequence: TTC
aagacttcggtggaggaagg

SEQ ID NO: 292639 - DNA, 20 bp, Artificial Sequence
  Description of Artificial Sequence: Synthetic oligonucleotide
  Target: ATXN1; (+) strand; PAM type: YTN; PAM sequence: CTT
cggtggaggaaggaactgca

SEQ ID NO: 292640 - DNA, 20 bp, Artificial Sequence
  Description of Artificial Sequence: Synthetic oligonucleotide
  Target: ATXN1; (+) strand; PAM type: YTN; PAM sequence: TTC
ggtggaggaaggaactgcag

SEQ ID NO: 292641 - DNA, 20 bp, Artificial Sequence
  Description of Artificial Sequence: Synthetic oligonucleotide
  Target: ATXN1; (+) strand; PAM type: YTN; PAM sequence: CTG
cagatgaggtggaaacagca

SEQ ID NO: 292642 - DNA, 20 bp, Artificial Sequence
  Description of Artificial Sequence: Synthetic oligonucleotide
  Target: ATXN1; (+) strand; PAM type: YTN; PAM sequence: TTA
gaaatggagcctgaaaatgt

SEQ ID NO: 292643 - DNA, 20 bp, Artificial Sequence
  Description of Artificial Sequence: Synthetic oligonucleotide
  Target: ATXN1; (+) strand; PAM type: YTN; PAM sequence: CTG
aaaatgtgactgaattgatt

SEQ ID NO: 292644 - DNA, 20 bp, Artificial Sequence
  Description of Artificial Sequence: Synthetic oligonucleotide
  Target: ATXN1; (+) strand; PAM type: YTN; PAM sequence: CTG
aattgattgctgcaatctca

SEQ ID NO: 292645 - DNA, 20 bp, Artificial Sequence
  Description of Artificial Sequence: Synthetic oligonucleotide
  Target: ATXN1; (+) strand; PAM type: YTN; PAM sequence: TTG
attgctgcaatctcatgatc

SEQ ID NO: 292646 - DNA, 20 bp, Artificial Sequence
  Description of Artificial Sequence: Synthetic oligonucleotide
  Target: ATXN1; (+) strand; PAM type: YTN; PAM sequence: TTG
ctgcaatctcatgatcaaac

SEQ ID NO: 292647 - DNA, 20 bp, Artificial Sequence
  Description of Artificial Sequence: Synthetic oligonucleotide
  Target: ATXN1; (+) strand; PAM type: YTN; PAM sequence: CTG
caatctcatgatcaaacttc

SEQ ID NO: 292648 - DNA, 20 bp, Artificial Sequence
  Description of Artificial Sequence: Synthetic oligonucleotide
  Target: ATXN1; (+) strand; PAM type: YTN; PAM sequence: CTC
atgatcaaacttcagcagat

SEQ ID NO: 292649 - DNA, 20 bp, Artificial Sequence
  Description of Artificial Sequence: Synthetic oligonucleotide
  Target: ATXN1; (+) strand; PAM type: YTN; PAM sequence: CTT
cagcagatgaggagttgcct

SEQ ID NO: 292650 - DNA, 20 bp, Artificial Sequence
  Description of Artificial Sequence: Synthetic oligonucleotide
  Target: ATXN1; (+) strand; PAM type: YTN; PAM sequence: TTC
agcagatgaggagttgcctc

SEQ ID NO: 292651 - DNA, 20 bp, Artificial Sequence
  Description of Artificial Sequence: Synthetic oligonucleotide
  Target: ATXN1; (+) strand; PAM type: YTN; PAM sequence: TTG
cctctatggaggagcaaaga

SEQ ID NO: 292652 - DNA, 20 bp, Artificial Sequence
  Description of Artificial Sequence: Synthetic oligonucleotide
  Target: ATXN1; (+) strand; PAM type: YTN; PAM sequence: CTC
tatggaggagcaaagaaagt

SEQ ID NO: 292653 - DNA, 20 bp, Artificial Sequence
  Description of Artificial Sequence: Synthetic oligonucleotide
  Target: ATXN1; (+) strand; PAM type: YTN; PAM sequence: CTA
tggaggagcaaagaaagtgg

SEQ ID NO: 292654 - DNA, 20 bp, Artificial Sequence
  Description of Artificial Sequence: Synthetic oligonucleotide
  Target: ATXN1; (+) strand; PAM type: YTN; PAM sequence: TTT
catggccgggcacagtggct

SEQ ID NO: 292655 - DNA, 20 bp, Artificial Sequence
  Description of Artificial Sequence: Synthetic oligonucleotide
  Target: ATXN1; (+) strand; PAM type: YTN; PAM sequence: TTC
atggccgggcacagtggctc

SEQ ID NO: 292656 - DNA, 20 bp, Artificial Sequence
  Description of Artificial Sequence: Synthetic oligonucleotide
  Target: ATXN1; (+) strand; PAM type: YTN; PAM sequence: CTC
acgcttgtaatctcagcact

SEQ ID NO: 292657 - DNA, 20 bp, Artificial Sequence
  Description of Artificial Sequence: Synthetic oligonucleotide
  Target: ATXN1; (+) strand; PAM type: YTN; PAM sequence: CTT
gtaatctcagcactttggga

SEQ ID NO: 292658 - DNA, 20 bp, Artificial Sequence
  Description of Artificial Sequence: Synthetic oligonucleotide
  Target: ATXN1; (+) strand; PAM type: YTN; PAM sequence: TTG
taatctcagcactttgggag

SEQ ID NO: 292659 - DNA, 20 bp, Artificial Sequence
  Description of Artificial Sequence: Synthetic oligonucleotide
  Target: ATXN1; (+) strand; PAM type: YTN; PAM sequence: CTC
agcactttgggaggccgagg

SEQ ID NO: 292660 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggcagggga

SEQ ID NO: 292661 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggcaggggaa

SEQ ID NO: 292662 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggcaggggaat

SEQ ID NO: 292663 - DNA, 20 bp, Artificial Sequence
  Description of Artificial Sequence: Synthetic oligonucleotide
  Target: ATXN1; (+) strand; PAM type: YTN; PAM sequence: CTG
gctaacacagctaacattgt

SEQ ID NO: 292664 - DNA, 20 bp, Artificial Sequence
  Description of Artificial Sequence: Synthetic oligonucleotide
  Target: ATXN1; (+) strand; PAM type: YTN; PAM sequence: CTA
acacagctaacattgtgaaa

SEQ ID NO: 292665 - DNA, 20 bp, Artificial Sequence
  Description of Artificial Sequence: Synthetic oligonucleotide
  Target: ATXN1; (+) strand; PAM type: YTN; PAM sequence: CTA
acattgtgaaacccatctct

SEQ ID NO: 292666 - DNA, 20 bp, Artificial Sequence
  Description of Artificial Sequence: Synthetic oligonucleotide
  Target: ATXN1; (+) strand; PAM type: YTN; PAM sequence: TTG
tgaaacccatctctactaaa

SEQ ID NO: 292667 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaaatt

SEQ ID NO: 292668 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaaattag

SEQ ID NO: 292669 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaaattagccc

SEQ ID NO: 292670 - DNA, 20 bp, Artificial Sequence
  Description of Artificial Sequence: Synthetic oligonucleotide
  Target: ATXN1; (+) strand; PAM type: YTN; PAM sequence: TTA
gcccagcgtggtggtgcgca

SEQ ID NO: 292671 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctactcaggag

SEQ ID NO: 292672 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggctgaggcagga

SEQ ID NO: 292673 - DNA, 20 bp, Artificial Sequence
  Description of Artificial Sequence: Synthetic oligonucleotide
  Target: ATXN1; (+) strand; PAM type: YTN; PAM sequence: CTC
aggaggctgaggcaggagaa

SEQ ID NO: 292674 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaattgtttgaa

SEQ ID NO: 292675 - DNA, 20 bp, Artificial Sequence
  Description of Artificial Sequence: Synthetic oligonucleotide
  Target: ATXN1; (+) strand; PAM type: YTN; PAM sequence: TTG
tttgaacctgggaggtggag

SEQ ID NO: 292676 - DNA, 20 bp, Artificial Sequence
  Description of Artificial Sequence: Synthetic oligonucleotide
  Target: ATXN1; (+) strand; PAM type: YTN; PAM sequence: TTT
gaacctgggaggtggaggtt

SEQ ID NO: 292677 - DNA, 20 bp, Artificial Sequence
  Description of Artificial Sequence: Synthetic oligonucleotide
  Target: ATXN1; (+) strand; PAM type: YTN; PAM sequence: TTG
aacctgggaggtggaggttg

SEQ ID NO: 292678 - DNA, 20 bp, Artificial Sequence
  Description of Artificial Sequence: Synthetic oligonucleotide
  Target: ATXN1; (+) strand; PAM type: YTN; PAM sequence: CTG
ggaggtggaggttgcagtga

SEQ ID NO: 292679 - DNA, 20 bp, Artificial Sequence
  Description of Artificial Sequence: Synthetic oligonucleotide
  Target: ATXN1; (+) strand; PAM type: YTN; PAM sequence: TTG
cagtgagccgagatcgcgcc

SEQ ID NO: 292680 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggtgacag

SEQ ID NO: 292681 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgacagaacga

SEQ ID NO: 292682 - DNA, 20 bp, Artificial Sequence
  Description of Artificial Sequence: Synthetic oligonucleotide
  Target: ATXN1; (+) strand; PAM type: YTN; PAM sequence: CTG
ggtgacagaacgagactccg

SEQ ID NO: 292683 - DNA, 20 bp, Artificial Sequence
  Description of Artificial Sequence: Synthetic oligonucleotide
  Target: ATXN1; (+) strand; PAM type: YTN; PAM sequence: CTC
cgtctcaaaacaaacaaaca

SEQ ID NO: 292684 - DNA, 20 bp, Artificial Sequence
  Description of Artificial Sequence: Synthetic oligonucleotide
  Target: ATXN1; (+) strand; PAM type: YTN; PAM sequence: CTC
aaaacaaacaaacaaacaaa

SEQ ID NO: 292685 - DNA, 20 bp, Artificial Sequence
  Description of Artificial Sequence: Synthetic oligonucleotide
  Target: ATXN1; (+) strand; PAM type: YTN; PAM sequence: TTT
catgagatgtaatctactcc

SEQ ID NO: 292686 - DNA, 20 bp, Artificial Sequence
  Description of Artificial Sequence: Synthetic oligonucleotide
  Target: ATXN1; (+) strand; PAM type: YTN; PAM sequence: TTC
atgagatgtaatctactcct

SEQ ID NO: 292687 - DNA, 20 bp, Artificial Sequence
  Description of Artificial Sequence: Synthetic oligonucleotide
  Target: ATXN1; (+) strand; PAM type: YTN; PAM sequence: CTA
ctcctgatgaagatactgtg

SEQ ID NO: 292688 - DNA, 20 bp, Artificial Sequence
  Description of Artificial Sequence: Synthetic oligonucleotide
  Target: ATXN1; (+) strand; PAM type: YTN; PAM sequence: CTC
ctgatgaagatactgtgaac

SEQ ID NO: 292689 - DNA, 20 bp, Artificial Sequence
  Description of Artificial Sequence: Synthetic oligonucleotide
  Target: ATXN1; (+) strand; PAM type: YTN; PAM sequence: CTG
atgaagatactgtgaacact

SEQ ID NO: 292690 - DNA, 20 bp, Artificial Sequence
  Description of Artificial Sequence: Synthetic oligonucleotide
  Target: ATXN1; (+) strand; PAM type: YTN; PAM sequence: CTG
tgaacactgttaaaatgaca

SEQ ID NO: 292691 - DNA, 20 bp, Artificial Sequence
  Description of Artificial Sequence: Synthetic oligonucleotide
  Target: ATXN1; (+) strand; PAM type: YTN; PAM sequence: CTG
ttaaaatgacaacaaaggat

SEQ ID NO: 292692 - DNA, 20 bp, Artificial Sequence
  Description of Artificial Sequence: Synthetic oligonucleotide
  Target: ATXN1; (+) strand; PAM type: YTN; PAM sequence: TTA
aaatgacaacaaaggatttg

SEQ ID NO: 292693 - DNA, 20 bp, Artificial Sequence
  Description of Artificial Sequence: Synthetic oligonucleotide
  Target: ATXN1; (+) strand; PAM type: YTN; PAM sequence: TTT
gaaatattacataaacttaa

SEQ ID NO: 292694 - DNA, 20 bp, Artificial Sequence
  Description of Artificial Sequence: Synthetic oligonucleotide
  Target: ATXN1; (+) strand; PAM type: YTN; PAM sequence: TTG
aaatattacataaacttaat

SEQ ID NO: 292695 - DNA, 20 bp, Artificial Sequence
  Description of Artificial Sequence: Synthetic oligonucleotide
  Target: ATXN1; (+) strand; PAM type: YTN; PAM sequence: TTA
cataaacttaattgatgcag

SEQ ID NO: 292696 - DNA, 20 bp, Artificial Sequence
  Description of Artificial Sequence: Synthetic oligonucleotide
  Target: ATXN1; (+) strand; PAM type: YTN; PAM sequence: CTT
aattgatgcagtgacaggtt

SEQ ID NO: 292697 - DNA, 20 bp, Artificial Sequence
  Description of Artificial Sequence: Synthetic oligonucleotide
  Target: ATXN1; (+) strand; PAM type: YTN; PAM sequence: TTA
attgatgcagtgacaggttt

SEQ ID NO: 292698 - DNA, 20 bp, Artificial Sequence
  Description of Artificial Sequence: Synthetic oligonucleotide
  Target: ATXN1; (+) strand; PAM type: YTN; PAM sequence: TTG
atgcagtgacaggtttgaga

SEQ ID NO: 292699 - DNA, 20 bp, Artificial Sequence
  Description of Artificial Sequence: Synthetic oligonucleotide
  Target: ATXN1; (+) strand; PAM type: YTN; PAM sequence: TTT
gagaggactgactctaactt

SEQ ID NO: 292700 - DNA, 20 bp, Artificial Sequence
  Description of Artificial Sequence: Synthetic oligonucleotide
  Target: ATXN1; (+) strand; PAM type: YTN; PAM sequence: TTG
agaggactgactctaacttt

SEQ ID NO: 292701 - DNA, 20 bp, Artificial Sequence
  Description of Artificial Sequence: Synthetic oligonucleotide
  Target: ATXN1; (+) strand; PAM type: YTN; PAM sequence: CTG
actctaactttgaaagttct

SEQ ID NO: 292702 - DNA, 20 bp, Artificial Sequence
  Description of Artificial Sequence: Synthetic oligonucleotide
  Target: ATXN1; (+) strand; PAM type: YTN; PAM sequence: CTC
taactttgaaagttctacta

SEQ ID NO: 292703 - DNA, 20 bp, Artificial Sequence
  Description of Artificial Sequence: Synthetic oligonucleotide
  Target: ATXN1; (+) strand; PAM type: YTN; PAM sequence: CTA
actttgaaagttctactatg

SEQ ID NO: 292704 - DNA, 20 bp, Artificial Sequence
  Description of Artificial Sequence: Synthetic oligonucleotide
  Target: ATXN1; (+) strand; PAM type: YTN; PAM sequence: CTT
tgaaagttctactatgggta

SEQ ID NO: 292705 - DNA, 20 bp, Artificial Sequence
  Description of Artificial Sequence: Synthetic oligonucleotide
  Target: ATXN1; (+) strand; PAM type: YTN; PAM sequence: TTT
gaaagttctactatgggtaa

SEQ ID NO: 292706 - DNA, 20 bp, Artificial Sequence
  Description of Artificial Sequence: Synthetic oligonucleotide
  Target: ATXN1; (+) strand; PAM type: YTN; PAM sequence: TTG
aaagttctactatgggtaaa

SEQ ID NO: 292707 - DNA, 20 bp, Artificial Sequence
  Description of Artificial Sequence: Synthetic oligonucleotide
  Target: ATXN1; (+) strand; PAM type: YTN; PAM sequence: TTC
tactatgggtaaaatgctct

SEQ ID NO: 292708 - DNA, 20 bp, Artificial Sequence
  Description of Artificial Sequence: Synthetic oligonucleotide
  Target: ATXN1; (+) strand; PAM type: YTN; PAM sequence: CTA
ctatgggtaaaatgctctca

SEQ ID NO: 292709 - DNA, 20 bp, Artificial Sequence
  Description of Artificial Sequence: Synthetic oligonucleotide
  Target: ATXN1; (+) strand; PAM type: YTN; PAM sequence: CTA
tgggtaaaatgctctcaaac

SEQ ID NO: 292710 - DNA, 20 bp, Artificial Sequence
  Description of Artificial Sequence: Synthetic oligonucleotide
  Target: ATXN1; (+) strand; PAM type: YTN; PAM sequence: CTC
tcaaacaatggtgcatacta

SEQ ID NO: 292711 - DNA, 20 bp, Artificial Sequence
  Description of Artificial Sequence: Synthetic oligonucleotide
  Target: ATXN1; (+) strand; PAM type: YTN; PAM sequence: CTC
aaacaatggtgcatactaca

SEQ ID NO: 292712 - DNA, 20 bp, Artificial Sequence
  Description of Artificial Sequence: Synthetic oligonucleotide
  Target: ATXN1; (+) strand; PAM type: YTN; PAM sequence: CTA
cagagaaatctttcatgaaa

SEQ ID NO: 292713 - DNA, 20 bp, Artificial Sequence
  Description of Artificial Sequence: Synthetic oligonucleotide
  Target: ATXN1; (+) strand; PAM type: YTN; PAM sequence: CTT
tcatgaaaggaagagtcaat

SEQ ID NO: 292714 - DNA, 20 bp, Artificial Sequence
  Description of Artificial Sequence: Synthetic oligonucleotide
  Target: ATXN1; (+) strand; PAM type: YTN; PAM sequence: TTT
catgaaaggaagagtcaata

SEQ ID NO: 292715 - DNA, 20 bp, Artificial Sequence
  Description of Artificial Sequence: Synthetic oligonucleotide
  Target: ATXN1; (+) strand; PAM type: YTN; PAM sequence: TTC
atgaaaggaagagtcaataa

SEQ ID NO: 292716 - DNA, 20 bp, Artificial Sequence
  Description of Artificial Sequence: Synthetic oligonucleotide
  Target: ATXN1; (+) strand; PAM type: YTN; PAM sequence: TTG
ttgtctaattttaagaaatt

SEQ ID NO: 292717 - DNA, 20 bp, Artificial Sequence
  Description of Artificial Sequence: Synthetic oligonucleotide
  Target: ATXN1; (+) strand; PAM type: YTN; PAM sequence: TTG
tctaattttaagaaattgcc

SEQ ID NO: 292718 - DNA, 20 bp, Artificial Sequence
  Description of Artificial Sequence: Synthetic oligonucleotide
  Target: ATXN1; (+) strand; PAM type: YTN; PAM sequence: CTA
attttaagaaattgccaccg

SEQ ID NO: 292719 - DNA, 20 bp, Artificial Sequence
  Description of Artificial Sequence: Synthetic oligonucleotide
  Target: ATXN1; (+) strand; PAM type: YTN; PAM sequence: TTT
taagaaattgccaccgccac

SEQ ID NO: 292720 - DNA, 20 bp, Artificial Sequence
  Description of Artificial Sequence: Synthetic oligonucleotide
  Target: ATXN1; (+) strand; PAM type: YTN; PAM sequence: TTT
aagaaattgccaccgccacc

SEQ ID NO: 292721 - DNA, 20 bp, Artificial Sequence
  Description of Artificial Sequence: Synthetic oligonucleotide
  Target: ATXN1; (+) strand; PAM type: YTN; PAM sequence: TTA
agaaattgccaccgccaccc

SEQ ID NO: 292722 - DNA, 20 bp, Artificial Sequence
  Description of Artificial Sequence: Synthetic oligonucleotide
  Target: ATXN1; (+) strand; PAM type: YTN; PAM sequence: TTG
ccaccgccaccccagctttc

SEQ ID NO: 292723 - DNA, 20 bp, Artificial Sequence
  Description of Artificial Sequence: Synthetic oligonucleotide
  Target: ATXN1; (+) strand; PAM type: YTN; PAM sequence: CTT
tcagcaaccacctccctaaa

SEQ ID NO: 292724 - DNA, 20 bp, Artificial Sequence
  Description of Artificial Sequence: Synthetic oligonucleotide
  Target: ATXN1; (+) strand; PAM type: YTN; PAM sequence: TTT
cagcaaccacctccctaaat

SEQ ID NO: 292725 - DNA, 20 bp, Artificial Sequence
  Description of Artificial Sequence: Synthetic oligonucleotide
  Target: ATXN1; (+) strand; PAM type: YTN; PAM sequence: TTC
agcaaccacctccctaaatc

SEQ ID NO: 292726 - DNA, 20 bp, Artificial Sequence
  Description of Artificial Sequence: Synthetic oligonucleotide
  Target: ATXN1; (+) strand; PAM type: YTN; PAM sequence: CTC
cctaaatcagtcagcagcca

SEQ ID NO: 292727 - DNA, 20 bp, Artificial Sequence
  Description of Artificial Sequence: Synthetic oligonucleotide
  Target: ATXN1; (+) strand; PAM type: YTN; PAM sequence: CTA
aatcagtcagcagccatcaa

SEQ ID NO: 292728 - DNA, 20 bp, Artificial Sequence
  Description of Artificial Sequence: Synthetic oligonucleotide
  Target: ATXN1; (+) strand; PAM type: YTN; PAM sequence: CTT
taccaacaaaacgattatgg

SEQ ID NO: 292729 - DNA, 20 bp, Artificial Sequence
  Description of Artificial Sequence: Synthetic oligonucleotide
  Target: ATXN1; (+) strand; PAM type: YTN; PAM sequence: TTT
accaacaaaacgattatggt

SEQ ID NO: 292730 - DNA, 20 bp, Artificial Sequence
  Description of Artificial Sequence: Synthetic oligonucleotide
  Target: ATXN1; (+) strand; PAM type: YTN; PAM sequence: TTA
ccaacaaaacgattatggtt

SEQ ID NO: 292731 - DNA, 20 bp, Artificial Sequence
  Description of Artificial Sequence: Synthetic oligonucleotide
  Target: ATXN1; (+) strand; PAM type: YTN; PAM sequence: TTA
tggttcaatgaagatgatcg

SEQ ID NO: 292732 - DNA, 20 bp, Artificial Sequence
  Description of Artificial Sequence: Synthetic oligonucleotide
  Target: ATXN1; (+) strand; PAM type: YTN; PAM sequence: TTC
aatgaagatgatcgttaaca

SEQ ID NO: 292733 - DNA, 20 bp, Artificial Sequence
  Description of Artificial Sequence: Synthetic oligonucleotide
  Target: ATXN1; (+) strand; PAM type: YTN; PAM sequence: TTA
acagtttttagcaataaagc

SEQ ID NO: 292734 - DNA, 20 bp, Artificial Sequence
  Description of Artificial Sequence: Synthetic oligonucleotide
  Target: ATXN1; (+) strand; PAM type: YTN; PAM sequence: TTT
ttagcaataaagcattttaa

SEQ ID NO: 292735 - DNA, 20 bp, Artificial Sequence
  Description of Artificial Sequence: Synthetic oligonucleotide
  Target: ATXN1; (+) strand; PAM type: YTN; PAM sequence: TTT
tagcaataaagcattttaaa

SEQ ID NO: 292736 - DNA, 20 bp, Artificial Sequence
  Description of Artificial Sequence: Synthetic oligonucleotide
  Target: ATXN1; (+) strand; PAM type: YTN; PAM sequence: TTT
agcaataaagcattttaaaa

SEQ ID NO: 292737 - DNA, 20 bp, Artificial Sequence
  Description of Artificial Sequence: Synthetic oligonucleotide
  Target: ATXN1; (+) strand; PAM type: YTN; PAM sequence: TTA
gcaataaagcattttaaaat

SEQ ID NO: 292738 - DNA, 20 bp, Artificial Sequence
  Description of Artificial Sequence: Synthetic oligonucleotide
  Target: ATXN1; (+) strand; PAM type: YTN; PAM sequence: TTT
taaaattaaggtatgtactt

SEQ ID NO: 292739 - DNA, 20 bp, Artificial Sequence
  Description of Artificial Sequence: Synthetic oligonucleotide
  Target: ATXN1; (+) strand; PAM type: YTN; PAM sequence: TTT
aaaattaaggtatgtacttt

SEQ ID NO: 292740 - DNA, 20 bp, Artificial Sequence
  Description of Artificial Sequence: Synthetic oligonucleotide
  Target: ATXN1; (+) strand; PAM type: YTN; PAM sequence: TTA
aaattaaggtatgtactttt

SEQ ID NO: 292741 - DNA, 20 bp, Artificial Sequence
  Description of Artificial Sequence: Synthetic oligonucleotide
  Target: ATXN1; (+) strand; PAM type: YTN; PAM sequence: TTA
aggtatgtacttttgtttag

SEQ ID NO: 292742 - DNA, 20 bp, Artificial Sequence
  Description of Artificial Sequence: Synthetic oligonucleotide
  Target: ATXN1; (+) strand; PAM type: YTN; PAM sequence: CTT
ttgtttagacaaaatgttat

SEQ ID NO: 292743 - DNA, 20 bp, Artificial Sequence
  Description of Artificial Sequence: Synthetic oligonucleotide
  Target: ATXN1; (+) strand; PAM type: YTN; PAM sequence: TTT
tgtttagacaaaatgttatt

SEQ ID NO: 292744 - DNA, 20 bp, Artificial Sequence
  Description of Artificial Sequence: Synthetic oligonucleotide
  Target: ATXN1; (+) strand; PAM type: YTN; PAM sequence: TTT
gtttagacaaaatgttattg

SEQ ID NO: 292745 - DNA, 20 bp, Artificial Sequence
  Description of Artificial Sequence: Synthetic oligonucleotide
  Target: ATXN1; (+) strand; PAM type: YTN; PAM sequence: TTG
tttagacaaaatgttattgg

SEQ ID NO: 292746 - DNA, 20 bp, Artificial Sequence
  Description of Artificial Sequence: Synthetic oligonucleotide
  Target: ATXN1; (+) strand; PAM type: YTN; PAM sequence: TTT
agacaaaatgttattggata

SEQ ID NO: 292747 - DNA, 20 bp, Artificial Sequence
  Description of Artificial Sequence: Synthetic oligonucleotide
  Target: ATXN1; (+) strand; PAM type: YTN; PAM sequence: TTA
gacaaaatgttattggataa

SEQ ID NO: 292748 - DNA, 20 bp, Artificial Sequence
  Description of Artificial Sequence: Synthetic oligonucleotide
  Target: ATXN1; (+) strand; PAM type: YTN; PAM sequence: TTA
ttggataattaatagactat

SEQ ID NO: 292749 - DNA, 20 bp, Artificial Sequence
  Description of Artificial Sequence: Synthetic oligonucleotide
  Target: ATXN1; (+) strand; PAM type: YTN; PAM sequence: TTG
gataattaatagactatagt

SEQ ID NO: 292750 - DNA, 20 bp, Artificial Sequence
  Description of Artificial Sequence: Synthetic oligonucleotide
  Target: ATXN1; (+) strand; PAM type: YTN; PAM sequence: TTA
atagactatagtatggtgta

SEQ ID NO: 292751 - DNA, 20 bp, Artificial Sequence
  Description of Artificial Sequence: Synthetic oligonucleotide
  Target: ATXN1; (+) strand; PAM type: YTN; PAM sequence: CTA
tagtatggtgtaaacataac

SEQ ID NO: 292752 - DNA, 20 bp, Artificial Sequence
  Description of Artificial Sequence: Synthetic oligonucleotide
  Target: ATXN1; (+) strand; PAM type: YTN; PAM sequence: CTT
atatgcactggaaaaccaaa

SEQ ID NO: 292753 - DNA, 20 bp, Artificial Sequence
  Description of Artificial Sequence: Synthetic oligonucleotide
  Target: ATXN1; (+) strand; PAM type: YTN; PAM sequence: TTA
tatgcactggaaaaccaaaa

SEQ ID NO: 292754 - DNA, 20 bp, Artificial Sequence
  Description of Artificial Sequence: Synthetic oligonucleotide
  Target: ATXN1; (+) strand; PAM type: YTN; PAM sequence: CTG
gaaaaccaaaaaatttgtgt

SEQ ID NO: 292755 - DNA, 20 bp, Artificial Sequence
  Description of Artificial Sequence: Synthetic oligonucleotide
  Target: ATXN1; (+) strand; PAM type: YTN; PAM sequence: TTT
gtgtgatttgctgtattgca

SEQ ID NO: 292756 - DNA, 20 bp, Artificial Sequence
  Description of Artificial Sequence: Synthetic oligonucleotide
  Target: ATXN1; (+) strand; PAM type: YTN; PAM sequence: TTG
tgtgatttgctgtattgcaa

SEQ ID NO: 292757 - DNA, 20 bp, Artificial Sequence
  Description of Artificial Sequence: Synthetic oligonucleotide
  Target: ATXN1; (+) strand; PAM type: YTN; PAM sequence: TTT
gctgtattgcaatacttgct

SEQ ID NO: 292758 - DNA, 20 bp, Artificial Sequence
  Description of Artificial Sequence: Synthetic oligonucleotide
  Target: ATXN1; (+) strand; PAM type: YTN; PAM sequence: TTG
ctgtattgcaatacttgctt

SEQ ID NO: 292759 - DNA, 20 bp, Artificial Sequence
  Description of Artificial Sequence: Synthetic oligonucleotide
  Target: ATXN1; (+) strand; PAM type: YTN; PAM sequence: CTG
tattgcaatacttgctttac

SEQ ID NO: 292760 - DNA, 20 bp, Artificial Sequence
  Description of Artificial Sequence: Synthetic oligonucleotide
  Target: ATXN1; (+) strand; PAM type: YTN; PAM sequence: TTG
caatacttgctttactgctg

SEQ ID NO: 292761 - DNA, 20 bp, Artificial Sequence
  Description of Artificial Sequence: Synthetic oligonucleotide
  Target: ATXN1; (+) strand; PAM type: YTN; PAM sequence: CTT
gctttactgctgtggtctat

SEQ ID NO: 292762 - DNA, 20 bp, Artificial Sequence
  Description of Artificial Sequence: Synthetic oligonucleotide
  Target: ATXN1; (+) strand; PAM type: YTN; PAM sequence: TTG
ctttactgctgtggtctata

SEQ ID NO: 292763 - DNA, 20 bp, Artificial Sequence
  Description of Artificial Sequence: Synthetic oligonucleotide
  Target: ATXN1; (+) strand; PAM type: YTN; PAM sequence: CTT
tactgctgtggtctataagt

SEQ ID NO: 292764 - DNA, 20 bp, Artificial Sequence
  Description of Artificial Sequence: Synthetic oligonucleotide
  Target: ATXN1; (+) strand; PAM type: YTN; PAM sequence: TTT
actgctgtggtctataagtg

SEQ ID NO: 292765 - DNA, 20 bp, Artificial Sequence
  Description of Artificial Sequence: Synthetic oligonucleotide
  Target: ATXN1; (+) strand; PAM type: YTN; PAM sequence: TTA
ctgctgtggtctataagtga

SEQ ID NO: 292766 - DNA, 20 bp, Artificial Sequence
  Description of Artificial Sequence: Synthetic oligonucleotide
  Target: ATXN1; (+) strand; PAM type: YTN; PAM sequence: CTG
ctgtggtctataagtgaacc

SEQ ID NO: 292767 - DNA, 20 bp, Artificial Sequence
  Description of Artificial Sequence: Synthetic oligonucleotide
  Target: ATXN1; (+) strand; PAM type: YTN; PAM sequence: CTG
tggtctataagtgaacccaa

SEQ ID NO: 292768 - DNA, 20 bp, Artificial Sequence
  Description of Artificial Sequence: Synthetic oligonucleotide
  Target: ATXN1; (+) strand; PAM type: YTN; PAM sequence: CTA
taagtgaacccaaaatatct

SEQ ID NO: 292769 - DNA, 20 bp, Artificial Sequence
  Description of Artificial Sequence: Synthetic oligonucleotide
  Target: ATXN1; (+) strand; PAM type: YTN; PAM sequence: CTC
tgagtgtccaggcacagtgg

SEQ ID NO: 292770 - DNA, 20 bp, Artificial Sequence
  Description of Artificial Sequence: Synthetic oligonucleotide
  Target: ATXN1; (+) strand; PAM type: YTN; PAM sequence: CTG
agtgtccaggcacagtggct

SEQ ID NO: 292771 - DNA, 20 bp, Artificial Sequence
  Description of Artificial Sequence: Synthetic oligonucleotide
  Target: ATXN1; (+) strand; PAM type: YTN; PAM sequence: CTC
atgcctgtaatcccagcact

SEQ ID NO: 292772 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 292773 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgaggtgggtgg

SEQ ID NO: 292774 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaggtgggtgga

SEQ ID NO: 292775 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggtgggtggat

SEQ ID NO: 292776 - DNA, 20 bp, Artificial Sequence
  Description of Artificial Sequence: Synthetic oligonucleotide
  Target: ATXN1; (+) strand; PAM type: YTN; PAM sequence: CTG
aggtgggtggatcacctggg

SEQ ID NO: 292777 - DNA, 20 bp, Artificial Sequence
  Description of Artificial Sequence: Synthetic oligonucleotide
  Target: ATXN1; (+) strand; PAM type: YTN; PAM sequence: CTG
gggtcaggagttcgagacca

SEQ ID NO: 292778 - DNA, 20 bp, Artificial Sequence
  Description of Artificial Sequence: Synthetic oligonucleotide
  Target: ATXN1; (+) strand; PAM type: YTN; PAM sequence: TTC
gagaccagcctcaccaatat

SEQ ID NO: 292779 - DNA, 20 bp, Artificial Sequence
  Description of Artificial Sequence: Synthetic oligonucleotide
  Target: ATXN1; (+) strand; PAM type: YTN; PAM sequence: CTC
accaatatggtgaaacccca

SEQ ID NO: 292780 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 292781 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 292782 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagctgg

SEQ ID NO: 292783 - DNA, 20 bp, Artificial Sequence
  Description of Artificial Sequence: Synthetic oligonucleotide
  Target: ATXN1; (+) strand; PAM type: YTN; PAM sequence: TTA
gctgggcatggtggcaggca

SEQ ID NO: 292784 - DNA, 20 bp, Artificial Sequence
  Description of Artificial Sequence: Synthetic oligonucleotide
  Target: ATXN1; (+) strand; PAM type: YTN; PAM sequence: CTG
ggcatggtggcaggcaccta

SEQ ID NO: 292785 - DNA, 20 bp, Artificial Sequence
  Description of Artificial Sequence: Synthetic oligonucleotide
  Target: ATXN1; (+) strand; PAM type: YTN; PAM sequence: CTA
tagtcccagctacttgggag

SEQ ID NO: 292786 - DNA, 20 bp, Artificial Sequence
  Description of Artificial Sequence: Synthetic oligonucleotide
  Target: ATXN1; (+) strand; PAM type: YTN; PAM sequence: CTA
cttgggaggcttgaacccag

SEQ ID NO: 292787 - DNA, 20 bp, Artificial Sequence
  Description of Artificial Sequence: Synthetic oligonucleotide
  Target: ATXN1; (+) strand; PAM type: YTN; PAM sequence: CTT
gggaggcttgaacccaggag

SEQ ID NO: 292788 - DNA, 20 bp, Artificial Sequence
  Description of Artificial Sequence: Synthetic oligonucleotide
  Target: ATXN1; (+) strand; PAM type: YTN; PAM sequence: TTG
ggaggcttgaacccaggagg

SEQ ID NO: 292789 - DNA, 20 bp, Artificial Sequence
  Description of Artificial Sequence: Synthetic oligonucleotide
  Target: ATXN1; (+) strand; PAM type: YTN; PAM sequence: CTT
gaacccaggaggcggagctt

SEQ ID NO: 292790 - DNA, 20 bp, Artificial Sequence
  Description of Artificial Sequence: Synthetic oligonucleotide
  Target: ATXN1; (+) strand; PAM type: YTN; PAM sequence: TTG
aacccaggaggcggagcttg

SEQ ID NO: 292791 - DNA, 20 bp, Artificial Sequence
  Description of Artificial Sequence: Synthetic oligonucleotide
  Target: ATXN1; (+) strand; PAM type: YTN; PAM sequence: CTT
gcagtgagcagagatcgtgc

SEQ ID NO: 292792 - DNA, 20 bp, Artificial Sequence
  Description of Artificial Sequence: Synthetic oligonucleotide
  Target: ATXN1; (+) strand; PAM type: YTN; PAM sequence: TTG
cagtgagcagagatcgtgcc

SEQ ID NO: 292793 - DNA, 20 bp, Artificial Sequence
  Description of Artificial Sequence: Synthetic oligonucleotide
  Target: ATXN1; (+) strand; PAM type: YTN; PAM sequence: CTG
cactccagcctggcaacaaa

SEQ ID NO: 292794 - DNA, 20 bp, Artificial Sequence
  Description of Artificial Sequence: Synthetic oligonucleotide
  Target: ATXN1; (+) strand; PAM type: YTN; PAM sequence: CTC
cagcctggcaacaaagcaag

SEQ ID NO: 292795 - DNA, 20 bp, Artificial Sequence
  Description of Artificial Sequence: Synthetic oligonucleotide
  Target: ATXN1; (+) strand; PAM type: YTN; PAM sequence: CTG
gcaacaaagcaagactccca

SEQ ID NO: 292796 - DNA, 20 bp, Artificial Sequence
  Description of Artificial Sequence: Synthetic oligonucleotide
  Target: ATXN1; (+) strand; PAM type: YTN; PAM sequence: CTC
ccaactcaaaaaaaaaaaaa

SEQ ID NO: 292797 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaaagaca

SEQ ID NO: 292798 - DNA, 20 bp, Artificial Sequence
  Description of Artificial Sequence: Synthetic oligonucleotide
  Target: ATXN1; (+) strand; PAM type: YTN; PAM sequence: CTC
tgagctatgcctgtgtctaa

SEQ ID NO: 292799 - DNA, 20 bp, Artificial Sequence
  Description of Artificial Sequence: Synthetic oligonucleotide
  Target: ATXN1; (+) strand; PAM type: YTN; PAM sequence: CTG
agctatgcctgtgtctaaaa

SEQ ID NO: 292800 - DNA, 20 bp, Artificial Sequence
  Description of Artificial Sequence: Synthetic oligonucleotide
  Target: ATXN1; (+) strand; PAM type: YTN; PAM sequence: CTA
tgcctgtgtctaaaaaattc

SEQ ID NO: 292801 - DNA, 20 bp, Artificial Sequence
  Description of Artificial Sequence: Synthetic oligonucleotide
  Target: ATXN1; (+) strand; PAM type: YTN; PAM sequence: CTG
tgtctaaaaaattctgaact

SEQ ID NO: 292802 - DNA, 20 bp, Artificial Sequence
  Description of Artificial Sequence: Synthetic oligonucleotide
  Target: ATXN1; (+) strand; PAM type: YTN; PAM sequence: CTA
aaaaattctgaactcttcct

SEQ ID NO: 292803 - DNA, 20 bp, Artificial Sequence
  Description of Artificial Sequence: Synthetic oligonucleotide
  Target: ATXN1; (+) strand; PAM type: YTN; PAM sequence: TTC
tgaactcttcctaacaggca

SEQ ID NO: 292804 - DNA, 20 bp, Artificial Sequence
  Description of Artificial Sequence: Synthetic oligonucleotide
  Target: ATXN1; (+) strand; PAM type: YTN; PAM sequence: CTG
aactcttcctaacaggcact

SEQ ID NO: 292805 - DNA, 20 bp, Artificial Sequence
  Description of Artificial Sequence: Synthetic oligonucleotide
  Target: ATXN1; (+) strand; PAM type: YTN; PAM sequence: CTC
ttcctaacaggcactacaga

SEQ ID NO: 292806 - DNA, 20 bp, Artificial Sequence
  Description of Artificial Sequence: Synthetic oligonucleotide
  Target: ATXN1; (+) strand; PAM type: YTN; PAM sequence: CTT
cctaacaggcactacagaaa

SEQ ID NO: 292807 - DNA, 20 bp, Artificial Sequence
  Description of Artificial Sequence: Synthetic oligonucleotide
  Target: ATXN1; (+) strand; PAM type: YTN; PAM sequence: TTC
ctaacaggcactacagaaat

SEQ ID NO: 292808 - DNA, 20 bp, Artificial Sequence
  Description of Artificial Sequence: Synthetic oligonucleotide
  Target: ATXN1; (+) strand; PAM type: YTN; PAM sequence: CTA
acaggcactacagaaatgta

SEQ ID NO: 292809 - DNA, 20 bp, Artificial Sequence
  Description of Artificial Sequence: Synthetic oligonucleotide
  Target: ATXN1; (+) strand; PAM type: YTN; PAM sequence: CTA
cagaaatgtaagcctggcca

SEQ ID NO: 292810 - DNA, 20 bp, Artificial Sequence
  Description of Artificial Sequence: Synthetic oligonucleotide
  Target: ATXN1; (+) strand; PAM type: YTN; PAM sequence: CTG
gccagctgcggtggctcacg

SEQ ID NO: 292811 - DNA, 20 bp, Artificial Sequence
  Description of Artificial Sequence: Synthetic oligonucleotide
  Target: ATXN1; (+) strand; PAM type: YTN; PAM sequence: CTG
cggtggctcacgcctgtaat

SEQ ID NO: 292812 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaattccagcact

SEQ ID NO: 292813 - DNA, 20 bp, Artificial Sequence
  Description of Artificial Sequence: Synthetic oligonucleotide
  Target: ATXN1; (+) strand; PAM type: YTN; PAM sequence: CTG
taattccagcactttgagag

SEQ ID NO: 292814 - DNA, 20 bp, Artificial Sequence
  Description of Artificial Sequence: Synthetic oligonucleotide
  Target: ATXN1; (+) strand; PAM type: YTN; PAM sequence: TTC
cagcactttgagaggccaag

SEQ ID NO: 292815 - DNA, 20 bp, Artificial Sequence
  Description of Artificial Sequence: Synthetic oligonucleotide
  Target: ATXN1; (+) strand; PAM type: YTN; PAM sequence: CTT
tgagaggccaagacgggtag

SEQ ID NO: 292816 - DNA, 20 bp, Artificial Sequence
  Description of Artificial Sequence: Synthetic oligonucleotide
  Target: ATXN1; (+) strand; PAM type: YTN; PAM sequence: TTT
gagaggccaagacgggtaga

SEQ ID NO: 292817 - DNA, 20 bp, Artificial Sequence
  Description of Artificial Sequence: Synthetic oligonucleotide
  Target: ATXN1; (+) strand; PAM type: YTN; PAM sequence: TTG
agaggccaagacgggtagac

SEQ ID NO: 292818 - DNA, 20 bp, Artificial Sequence
  Description of Artificial Sequence: Synthetic oligonucleotide
  Target: ATXN1; (+) strand; PAM type: YTN; PAM sequence: CTG
cttgagcccaggagtttaag

SEQ ID NO: 292819 - DNA, 20 bp, Artificial Sequence
  Description of Artificial Sequence: Synthetic oligonucleotide
  Target: ATXN1; (+) strand; PAM type: YTN; PAM sequence: CTT
gagcccaggagtttaagaca

SEQ ID NO: 292820 - DNA, 20 bp, Artificial Sequence
  Description of Artificial Sequence: Synthetic oligonucleotide
  Target: ATXN1; (+) strand; PAM type: YTN; PAM sequence: TTG
agcccaggagtttaagacaa

SEQ ID NO: 292821 - DNA, 20 bp, Artificial Sequence
  Description of Artificial Sequence: Synthetic oligonucleotide
  Target: ATXN1; (+) strand; PAM type: YTN; PAM sequence: TTT
aagacaagcctgggcaacat

SEQ ID NO: 292822 - DNA, 20 bp, Artificial Sequence
  Description of Artificial Sequence: Synthetic oligonucleotide
  Target: ATXN1; (+) strand; PAM type: YTN; PAM sequence: TTA
agacaagcctgggcaacatg

SEQ ID NO: 292823 - DNA, 20 bp, Artificial Sequence
  Description of Artificial Sequence: Synthetic oligonucleotide
  Target: ATXN1; (+) strand; PAM type: YTN; PAM sequence: CTG
ggcaacatgatgaaacctcg

SEQ ID NO: 292824 - DNA, 20 bp, Artificial Sequence
  Description of Artificial Sequence: Synthetic oligonucleotide
  Target: ATXN1; (+) strand; PAM type: YTN; PAM sequence: CTC
gtctctacaaaaaatacaaa

SEQ ID NO: 292825 - DNA, 20 bp, Artificial Sequence
  Description of Artificial Sequence: Synthetic oligonucleotide
  Target: ATXN1; (+) strand; PAM type: YTN; PAM sequence: CTC
tacaaaaaatacaaaaatta

SEQ ID NO: 292826 - DNA, 20 bp, Artificial Sequence
  Description of Artificial Sequence: Synthetic oligonucleotide
  Target: ATXN1; (+) strand; PAM type: YTN; PAM sequence: CTA
caaaaaatacaaaaattagc

SEQ ID NO: 292827 - DNA, 20 bp, Artificial Sequence
  Description of Artificial Sequence: Synthetic oligonucleotide
  Target: ATXN1; (+) strand; PAM type: YTN; PAM sequence: TTA
gccaggtgttgtcgtgcaca

SEQ ID NO: 292828 - DNA, 20 bp, Artificial Sequence
  Description of Artificial Sequence: Synthetic oligonucleotide
  Target: ATXN1; (+) strand; PAM type: YTN; PAM sequence: TTG
tcgtgcacacatgtaatctc

SEQ ID NO: 292829 - DNA, 20 bp, Artificial Sequence
  Description of Artificial Sequence: Synthetic oligonucleotide
  Target: ATXN1; (+) strand; PAM type: YTN; PAM sequence: CTC
agctacttgggaggctgagg

SEQ ID NO: 292830 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgaggcagga

SEQ ID NO: 292831 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggcaggaaga

SEQ ID NO: 292832 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggaagat

SEQ ID NO: 292833 - DNA, 20 bp, Artificial Sequence
  Description of Artificial Sequence: Synthetic oligonucleotide
  Target: ATXN1; (+) strand; PAM type: YTN; PAM sequence: CTG
aggcaggaagatcacttgag

SEQ ID NO: 292834 - DNA, 20 bp, Artificial Sequence
  Description of Artificial Sequence: Synthetic oligonucleotide
  Target: ATXN1; (+) strand; PAM type: YTN; PAM sequence: CTT
gaggcccggaggtcgaggct

SEQ ID NO: 292835 - DNA, 20 bp, Artificial Sequence
  Description of Artificial Sequence: Synthetic oligonucleotide
  Target: ATXN1; (+) strand; PAM type: YTN; PAM sequence: TTG
aggcccggaggtcgaggctg

SEQ ID NO: 292836 - DNA, 20 bp, Artificial Sequence
  Description of Artificial Sequence: Synthetic oligonucleotide
  Target: ATXN1; (+) strand; PAM type: YTN; PAM sequence: CTG
cagtgagctgagattgcacc

SEQ ID NO: 292837 - DNA, 20 bp, Artificial Sequence
  Description of Artificial Sequence: Synthetic oligonucleotide
  Target: ATXN1; (+) strand; PAM type: YTN; PAM sequence: CTG
agattgcaccactgcactcc

SEQ ID NO: 292838 - DNA, 20 bp, Artificial Sequence
  Description of Artificial Sequence: Synthetic oligonucleotide
  Target: ATXN1; (+) strand; PAM type: YTN; PAM sequence: TTG
caccactgcactccagcctg

SEQ ID NO: 292839 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggagacaa

SEQ ID NO: 292840 - DNA, 20 bp, Artificial Sequence
  Description of Artificial Sequence: Synthetic oligonucleotide
  Target: ATXN1; (+) strand; PAM type: YTN; PAM sequence: CTC
cagcctgggagacaagagtg

SEQ ID NO: 292841 - DNA, 20 bp, Artificial Sequence
  Description of Artificial Sequence: Synthetic oligonucleotide
  Target: ATXN1; (+) strand; PAM type: YTN; PAM sequence: CTG
ggagacaagagtgagaccct

SEQ ID NO: 292842 - DNA, 20 bp, Artificial Sequence
  Description of Artificial Sequence: Synthetic oligonucleotide
  Target: ATXN1; (+) strand; PAM type: YTN; PAM sequence: CTG
ccaaaaaaaaaaaaaaaaaa

SEQ ID NO: 292843 - DNA, 20 bp, Artificial Sequence
  Description of Artificial Sequence: Synthetic oligonucleotide
  Target: ATXN1; (+) strand; PAM type: YTN; PAM sequence: CTA
tgagcctgcttgcagaaatt

SEQ ID NO: 292844 - DNA, 20 bp, Artificial Sequence
  Description of Artificial Sequence: Synthetic oligonucleotide
  Target: ATXN1; (+) strand; PAM type: YTN; PAM sequence: CTG
cttgcagaaattctgagaag

SEQ ID NO: 292845 - DNA, 20 bp, Artificial Sequence
  Description of Artificial Sequence: Synthetic oligonucleotide
  Target: ATXN1; (+) strand; PAM type: YTN; PAM sequence: CTT
gcagaaattctgagaagaat

SEQ ID NO: 292846 - DNA, 20 bp, Artificial Sequence
  Description of Artificial Sequence: Synthetic oligonucleotide
  Target: ATXN1; (+) strand; PAM type: YTN; PAM sequence: TTG
cagaaattctgagaagaatt

SEQ ID NO: 292847 - DNA, 20 bp, Artificial Sequence
  Description of Artificial Sequence: Synthetic oligonucleotide
  Target: ATXN1; (+) strand; PAM type: YTN; PAM sequence: TTC
tgagaagaattcgggccaaa

SEQ ID NO: 292848 - DNA, 20 bp, Artificial Sequence
  Description of Artificial Sequence: Synthetic oligonucleotide
  Target: ATXN1; (+) strand; PAM type: YTN; PAM sequence: CTG
agaagaattcgggccaaata

SEQ ID NO: 292849 - DNA, 20 bp, Artificial Sequence
  Description of Artificial Sequence: Synthetic oligonucleotide
  Target: ATXN1; (+) strand; PAM type: YTN; PAM sequence: TTC
gggccaaataggagttaaaa

SEQ ID NO: 292850 - DNA, 20 bp, Artificial Sequence
  Description of Artificial Sequence: Synthetic oligonucleotide
  Target: ATXN1; (+) strand; PAM type: YTN; PAM sequence: TTA
aaataaagtgaggggaaatc

SEQ ID NO: 292851 - DNA, 20 bp, Artificial Sequence
  Description of Artificial Sequence: Synthetic oligonucleotide
  Target: ATXN1; (+) strand; PAM type: YTN; PAM sequence: CTC
caaagaggcacatgaaacta

SEQ ID NO: 292852 - DNA, 20 bp, Artificial Sequence
  Description of Artificial Sequence: Synthetic oligonucleotide
  Target: ATXN1; (+) strand; PAM type: YTN; PAM sequence: CTA
tgtctcagaaagagttcgat

SEQ ID NO: 292853 - DNA, 20 bp, Artificial Sequence
  Description of Artificial Sequence: Synthetic oligonucleotide
  Target: ATXN1; (+) strand; PAM type: YTN; PAM sequence: CTC
agaaagagttcgatcgtttg

SEQ ID NO: 292854 - DNA, 20 bp, Artificial Sequence
  Description of Artificial Sequence: Synthetic oligonucleotide
  Target: ATXN1; (+) strand; PAM type: YTN; PAM sequence: TTC
gatcgtttgtttgataaatg

SEQ ID NO: 292855 - DNA, 20 bp, Artificial Sequence
  Description of Artificial Sequence: Synthetic oligonucleotide
  Target: ATXN1; (+) strand; PAM type: YTN; PAM sequence: TTT
gtttgataaatgttattctc

SEQ ID NO: 292856 - DNA, 20 bp, Artificial Sequence
  Description of Artificial Sequence: Synthetic oligonucleotide
  Target: ATXN1; (+) strand; PAM type: YTN; PAM sequence: TTG
tttgataaatgttattctct

SEQ ID NO: 292857 - DNA, 20 bp, Artificial Sequence
  Description of Artificial Sequence: Synthetic oligonucleotide
  Target: ATXN1; (+) strand; PAM type: YTN; PAM sequence: TTT
gataaatgttattctcttca

SEQ ID NO: 292858 - DNA, 20 bp, Artificial Sequence
  Description of Artificial Sequence: Synthetic oligonucleotide
  Target: ATXN1; (+) strand; PAM type: YTN; PAM sequence: TTG
ataaatgttattctcttcag

SEQ ID NO: 292859 - DNA, 20 bp, Artificial Sequence
  Description of Artificial Sequence: Synthetic oligonucleotide
  Target: ATXN1; (+) strand; PAM type: YTN; PAM sequence: TTA
ttctcttcagttattaagaa

SEQ ID NO: 292860 - DNA, 20 bp, Artificial Sequence
  Description of Artificial Sequence: Synthetic oligonucleotide
  Target: ATXN1; (+) strand; PAM type: YTN; PAM sequence: TTC
tcttcagttattaagaagaa

SEQ ID NO: 292861 - DNA, 20 bp, Artificial Sequence
  Description of Artificial Sequence: Synthetic oligonucleotide
  Target: ATXN1; (+) strand; PAM type: YTN; PAM sequence: CTC
ttcagttattaagaagaaaa

SEQ ID NO: 292862 - DNA, 20 bp, Artificial Sequence
  Description of Artificial Sequence: Synthetic oligonucleotide
  Target: ATXN1; (+) strand; PAM type: YTN; PAM sequence: CTT
cagttattaagaagaaaaaa

SEQ ID NO: 292863 - DNA, 20 bp, Artificial Sequence
  Description of Artificial Sequence: Synthetic oligonucleotide
  Target: ATXN1; (+) strand; PAM type: YTN; PAM sequence: TTC
agttattaagaagaaaaaaa

SEQ ID NO: 292864 - DNA, 20 bp, Artificial Sequence
  Description of Artificial Sequence: Synthetic oligonucleotide
  Target: ATXN1; (+) strand; PAM type: YTN; PAM sequence: TTA
ttaagaagaaaaaaaaatct

SEQ ID NO: 292865 - DNA, 20 bp, Artificial Sequence
  Description of Artificial Sequence: Synthetic oligonucleotide
  Target: ATXN1; (+) strand; PAM type: YTN; PAM sequence: TTA
agaagaaaaaaaaatctgta

SEQ ID NO: 292866 - DNA, 20 bp, Artificial Sequence
  Description of Artificial Sequence: Synthetic oligonucleotide
  Target: ATXN1; (+) strand; PAM type: YTN; PAM sequence: CTG
tatcttctctatgcccatat

SEQ ID NO: 292867 - DNA, 20 bp, Artificial Sequence
  Description of Artificial Sequence: Synthetic oligonucleotide
  Target: ATXN1; (+) strand; PAM type: YTN; PAM sequence: CTT
ctctatgcccatattccaat

SEQ ID NO: 292868 - DNA, 20 bp, Artificial Sequence
  Description of Artificial Sequence: Synthetic oligonucleotide
  Target: ATXN1; (+) strand; PAM type: YTN; PAM sequence: TTC
tctatgcccatattccaata

SEQ ID NO: 292869 - DNA, 20 bp, Artificial Sequence
  Description of Artificial Sequence: Synthetic oligonucleotide
  Target: ATXN1; (+) strand; PAM type: YTN; PAM sequence: CTC
tatgcccatattccaataca

SEQ ID NO: 292870 - DNA, 20 bp, Artificial Sequence
  Description of Artificial Sequence: Synthetic oligonucleotide
  Target: ATXN1; (+) strand; PAM type: YTN; PAM sequence: CTA
tgcccatattccaatacaac

SEQ ID NO: 292871 - DNA, 20 bp, Artificial Sequence
  Description of Artificial Sequence: Synthetic oligonucleotide
  Target: ATXN1; (+) strand; PAM type: YTN; PAM sequence: TTC
caatacaacccagtttctga

SEQ ID NO: 292872 - DNA, 20 bp, Artificial Sequence
  Description of Artificial Sequence: Synthetic oligonucleotide
  Target: ATXN1; (+) strand; PAM type: YTN; PAM sequence: TTT
ctgaaattagaatgagaact

SEQ ID NO: 292873 - DNA, 20 bp, Artificial Sequence
  Description of Artificial Sequence: Synthetic oligonucleotide
  Target: ATXN1; (+) strand; PAM type: YTN; PAM sequence: TTC
tgaaattagaatgagaactt

SEQ ID NO: 292874 - DNA, 20 bp, Artificial Sequence
  Description of Artificial Sequence: Synthetic oligonucleotide
  Target: ATXN1; (+) strand; PAM type: YTN; PAM sequence: CTG
aaattagaatgagaacttat

SEQ ID NO: 292875 - DNA, 20 bp, Artificial Sequence
  Description of Artificial Sequence: Synthetic oligonucleotide
  Target: ATXN1; (+) strand; PAM type: YTN; PAM sequence: TTA
gaatgagaacttattgataa

SEQ ID NO: 292876 - DNA, 20 bp, Artificial Sequence
  Description of Artificial Sequence: Synthetic oligonucleotide
  Target: ATXN1; (+) strand; PAM type: YTN; PAM sequence: CTT
attgataattactgacataa

SEQ ID NO: 292877 - DNA, 20 bp, Artificial Sequence
  Description of Artificial Sequence: Synthetic oligonucleotide
  Target: ATXN1; (+) strand; PAM type: YTN; PAM sequence: TTA
ttgataattactgacataat

SEQ ID NO: 292878 - DNA, 20 bp, Artificial Sequence
  Description of Artificial Sequence: Synthetic oligonucleotide
  Target: ATXN1; (+) strand; PAM type: YTN; PAM sequence: TTG
ataattactgacataataaa

SEQ ID NO: 292879 - DNA, 20 bp, Artificial Sequence
  Description of Artificial Sequence: Synthetic oligonucleotide
  Target: ATXN1; (+) strand; PAM type: YTN; PAM sequence: TTA
ctgacataataaagtattga

SEQ ID NO: 292880 - DNA, 20 bp, Artificial Sequence
  Description of Artificial Sequence: Synthetic oligonucleotide
  Target: ATXN1; (+) strand; PAM type: YTN; PAM sequence: CTG
acataataaagtattgataa

SEQ ID NO: 292881 - DNA, 20 bp, Artificial Sequence
  Description of Artificial Sequence: Synthetic oligonucleotide
  Target: ATXN1; (+) strand; PAM type: YTN; PAM sequence: TTG
ataacaaatactttggaaaa

SEQ ID NO: 292882 - DNA, 20 bp, Artificial Sequence
  Description of Artificial Sequence: Synthetic oligonucleotide
  Target: ATXN1; (+) strand; PAM type: YTN; PAM sequence: CTT
tggaaaagaacagtatattt

SEQ ID NO: 292883 - DNA, 20 bp, Artificial Sequence
  Description of Artificial Sequence: Synthetic oligonucleotide
  Target: ATXN1; (+) strand; PAM type: YTN; PAM sequence: TTT
ggaaaagaacagtatatttg

SEQ ID NO: 292884 - DNA, 20 bp, Artificial Sequence
  Description of Artificial Sequence: Synthetic oligonucleotide
  Target: ATXN1; (+) strand; PAM type: YTN; PAM sequence: TTG
gaaaagaacagtatatttga

SEQ ID NO: 292885 - DNA, 20 bp, Artificial Sequence
  Description of Artificial Sequence: Synthetic oligonucleotide
  Target: ATXN1; (+) strand; PAM type: YTN; PAM sequence: TTT
gaaacactgttattaaaaat

SEQ ID NO: 292886 - DNA, 20 bp, Artificial Sequence
  Description of Artificial Sequence: Synthetic oligonucleotide
  Target: ATXN1; (+) strand; PAM type: YTN; PAM sequence: TTG
aaacactgttattaaaaatt

SEQ ID NO: 292887 - DNA, 20 bp, Artificial Sequence
  Description of Artificial Sequence: Synthetic oligonucleotide
  Target: ATXN1; (+) strand; PAM type: YTN; PAM sequence: CTG
ttattaaaaattaaattatg

SEQ ID NO: 292888 - DNA, 20 bp, Artificial Sequence
  Description of Artificial Sequence: Synthetic oligonucleotide
  Target: ATXN1; (+) strand; PAM type: YTN; PAM sequence: TTA
ttaaaaattaaattatgggc

SEQ ID NO: 292889 - DNA, 20 bp, Artificial Sequence
  Description of Artificial Sequence: Synthetic oligonucleotide
  Target: ATXN1; (+) strand; PAM type: YTN; PAM sequence: TTA
aaaattaaattatgggccag

SEQ ID NO: 292890 - DNA, 20 bp, Artificial Sequence
  Description of Artificial Sequence: Synthetic oligonucleotide
  Target: ATXN1; (+) strand; PAM type: YTN; PAM sequence: TTA
aattatgggccagacataaa

SEQ ID NO: 292891 - DNA, 20 bp, Artificial Sequence
  Description of Artificial Sequence: Synthetic oligonucleotide
  Target: ATXN1; (+) strand; PAM type: YTN; PAM sequence: TTA
tgggccagacataaaaggac

SEQ ID NO: 292892 - DNA, 20 bp, Artificial Sequence
  Description of Artificial Sequence: Synthetic oligonucleotide
  Target: ATXN1; (+) strand; PAM type: YTN; PAM sequence: TTG
tatgattccatgtggtccct

SEQ ID NO: 292893 - DNA, 20 bp, Artificial Sequence
  Description of Artificial Sequence: Synthetic oligonucleotide
  Target: ATXN1; (+) strand; PAM type: YTN; PAM sequence: TTC
catgtggtccctaaaataag

SEQ ID NO: 292894 - DNA, 20 bp, Artificial Sequence
  Description of Artificial Sequence: Synthetic oligonucleotide
  Target: ATXN1; (+) strand; PAM type: YTN; PAM sequence: CTA
aaataagaaacttcatagag

SEQ ID NO: 292895 - DNA, 20 bp, Artificial Sequence
  Description of Artificial Sequence: Synthetic oligonucleotide
  Target: ATXN1; (+) strand; PAM type: YTN; PAM sequence: CTT
catagagacacagtgtacaa

SEQ ID NO: 292896 - DNA, 20 bp, Artificial Sequence
  Description of Artificial Sequence: Synthetic oligonucleotide
  Target: ATXN1; (+) strand; PAM type: YTN; PAM sequence: TTC
atagagacacagtgtacaat

SEQ ID NO: 292897 - DNA, 20 bp, Artificial Sequence
  Description of Artificial Sequence: Synthetic oligonucleotide
  Target: ATXN1; (+) strand; PAM type: YTN; PAM sequence: TTA
ccaggggctgggaggagaga

SEQ ID NO: 292898 - DNA, 20 bp, Artificial Sequence
  Description of Artificial Sequence: Synthetic oligonucleotide
  Target: ATXN1; (+) strand; PAM type: YTN; PAM sequence: CTG
ggaggagagaatggagtgtt

SEQ ID NO: 292899 - DNA, 20 bp, Artificial Sequence
  Description of Artificial Sequence: Synthetic oligonucleotide
  Target: ATXN1; (+) strand; PAM type: YTN; PAM sequence: TTA
ttgtctaatgaatgcagagc

SEQ ID NO: 292900 - DNA, 20 bp, Artificial Sequence
  Description of Artificial Sequence: Synthetic oligonucleotide
  Target: ATXN1; (+) strand; PAM type: YTN; PAM sequence: TTG
tctaatgaatgcagagcttc

SEQ ID NO: 292901 - DNA, 20 bp, Artificial Sequence
  Description of Artificial Sequence: Synthetic oligonucleotide
  Target: ATXN1; (+) strand; PAM type: YTN; PAM sequence: CTA
atgaatgcagagcttctgtt

SEQ ID NO: 292902 - DNA, 20 bp, Artificial Sequence
  Description of Artificial Sequence: Synthetic oligonucleotide
  Target: ATXN1; (+) strand; PAM type: YTN; PAM sequence: CTT
ctgttcgggatgatgaaaaa

SEQ ID NO: 292903 - DNA, 20 bp, Artificial Sequence
  Description of Artificial Sequence: Synthetic oligonucleotide
  Target: ATXN1; (+) strand; PAM type: YTN; PAM sequence: TTC
tgttcgggatgatgaaaaag

SEQ ID NO: 292904 - DNA, 20 bp, Artificial Sequence
  Description of Artificial Sequence: Synthetic oligonucleotide
  Target: ATXN1; (+) strand; PAM type: YTN; PAM sequence: CTG
ttcgggatgatgaaaaagtt

SEQ ID NO: 292905 - DNA, 20 bp, Artificial Sequence
  Description of Artificial Sequence: Synthetic oligonucleotide
  Target: ATXN1; (+) strand; PAM type: YTN; PAM sequence: TTC
gggatgatgaaaaagttctg

SEQ ID NO: 292906 - DNA, 20 bp, Artificial Sequence
  Description of Artificial Sequence: Synthetic oligonucleotide
  Target: ATXN1; (+) strand; PAM type: YTN; PAM sequence: TTC
tggaaatggatagtggagat

SEQ ID NO: 292907 - DNA, 20 bp, Artificial Sequence
  Description of Artificial Sequence: Synthetic oligonucleotide
  Target: ATXN1; (+) strand; PAM type: YTN; PAM sequence: CTG
gaaatggatagtggagatga

SEQ ID NO: 292908 - DNA, 20 bp, Artificial Sequence
  Description of Artificial Sequence: Synthetic oligonucleotide
  Target: ATXN1; (+) strand; PAM type: YTN; PAM sequence: TTG
cactacactggaaatgtaca

SEQ ID NO: 292909 - DNA, 20 bp, Artificial Sequence
  Description of Artificial Sequence: Synthetic oligonucleotide
  Target: ATXN1; (+) strand; PAM type: YTN; PAM sequence: CTA
cactggaaatgtacataatg

SEQ ID NO: 292910 - DNA, 20 bp, Artificial Sequence
  Description of Artificial Sequence: Synthetic oligonucleotide
  Target: ATXN1; (+) strand; PAM type: YTN; PAM sequence: CTG
gaaatgtacataatgccact

SEQ ID NO: 292911 - DNA, 20 bp, Artificial Sequence
  Description of Artificial Sequence: Synthetic oligonucleotide
  Target: ATXN1; (+) strand; PAM type: YTN; PAM sequence: CTG
aattgtacacttaaaaatgg

SEQ ID NO: 292912 - DNA, 20 bp, Artificial Sequence
  Description of Artificial Sequence: Synthetic oligonucleotide
  Target: ATXN1; (+) strand; PAM type: YTN; PAM sequence: TTG
tacacttaaaaatggttaaa

SEQ ID NO: 292913 - DNA, 20 bp, Artificial Sequence
  Description of Artificial Sequence: Synthetic oligonucleotide
  Target: ATXN1; (+) strand; PAM type: YTN; PAM sequence: CTT
aaaaatggttaaactgggcc

SEQ ID NO: 292914 - DNA, 20 bp, Artificial Sequence
  Description of Artificial Sequence: Synthetic oligonucleotide
  Target: ATXN1; (+) strand; PAM type: YTN; PAM sequence: TTA
aaaatggttaaactgggcca

SEQ ID NO: 292915 - DNA, 20 bp, Artificial Sequence
  Description of Artificial Sequence: Synthetic oligonucleotide
  Target: ATXN1; (+) strand; PAM type: YTN; PAM sequence: TTA
aactgggccaggtgtggtgg

SEQ ID NO: 292916 - DNA, 20 bp, Artificial Sequence
  Description of Artificial Sequence: Synthetic oligonucleotide
  Target: ATXN1; (+) strand; PAM type: YTN; PAM sequence: CTG
ggccaggtgtggtggctcac

SEQ ID NO: 292917 - DNA, 20 bp, Artificial Sequence
  Description of Artificial Sequence: Synthetic oligonucleotide
  Target: ATXN1; (+) strand; PAM type: YTN; PAM sequence: CTC
acgccccagcactttgggag

SEQ ID NO: 292918 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgaggcgggcag

SEQ ID NO: 292919 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaggcgggcaga

SEQ ID NO: 292920 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcgggcagat

SEQ ID NO: 292921 - DNA, 20 bp, Artificial Sequence
  Description of Artificial Sequence: Synthetic oligonucleotide
  Target: ATXN1; (+) strand; PAM type: YTN; PAM sequence: CTG
aggcgggcagatcacgaggt

SEQ ID NO: 292922 - DNA, 20 bp, Artificial Sequence
  Description of Artificial Sequence: Synthetic oligonucleotide
  Target: ATXN1; (+) strand; PAM type: YTN; PAM sequence: CTG
gccaacatggtgaaacccca

SEQ ID NO: 292923 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaattc

SEQ ID NO: 292924 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattccc

SEQ ID NO: 292925 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattccctgg

SEQ ID NO: 292926 - DNA, 20 bp, Artificial Sequence
  Description of Artificial Sequence: Synthetic oligonucleotide
  Target: ATXN1; (+) strand; PAM type: YTN; PAM sequence: TTC
cctgggcgtggcggcatgcg

SEQ ID NO: 292927 - DNA, 20 bp, Artificial Sequence
  Description of Artificial Sequence: Synthetic oligonucleotide
  Target: ATXN1; (+) strand; PAM type: YTN; PAM sequence: CTG
ggcgtggcggcatgcgcctg

SEQ ID NO: 292928 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctactcgggag

SEQ ID NO: 292929 - DNA, 20 bp, Artificial Sequence
  Description of Artificial Sequence: Synthetic oligonucleotide
  Target: ATXN1; (+) strand; PAM type: YTN; PAM sequence: CTA
ctcgggaggccgaggcagga

SEQ ID NO: 292930 - DNA, 20 bp, Artificial Sequence
  Description of Artificial Sequence: Synthetic oligonucleotide
  Target: ATXN1; (+) strand; PAM type: YTN; PAM sequence: CTC
gggaggccgaggcaggagaa

SEQ ID NO: 292931 - DNA, 20 bp, Artificial Sequence
  Description of Artificial Sequence: Synthetic oligonucleotide
  Target: ATXN1; (+) strand; PAM type: YTN; PAM sequence: TTG
cttgaacccaggaggcggag

SEQ ID NO: 292932 - DNA, 20 bp, Artificial Sequence
  Description of Artificial Sequence: Synthetic oligonucleotide
  Target: ATXN1; (+) strand; PAM type: YTN; PAM sequence: CTT
gaacccaggaggcggaggct

SEQ ID NO: 292933 - DNA, 20 bp, Artificial Sequence
  Description of Artificial Sequence: Synthetic oligonucleotide
  Target: ATXN1; (+) strand; PAM type: YTN; PAM sequence: TTG
aacccaggaggcggaggctg

SEQ ID NO: 292934 - DNA, 20 bp, Artificial Sequence
  Description of Artificial Sequence: Synthetic oligonucleotide
  Target: ATXN1; (+) strand; PAM type: YTN; PAM sequence: CTG
cagtgagctgagatcatgcc

SEQ ID NO: 292935 - DNA, 20 bp, Artificial Sequence
  Description of Artificial Sequence: Synthetic oligonucleotide
  Target: ATXN1; (+) strand; PAM type: YTN; PAM sequence: CTG
agatcatgccactgcactcc

SEQ ID NO: 292936 - DNA, 20 bp, Artificial Sequence
  Description of Artificial Sequence: Synthetic oligonucleotide
  Target: ATXN1; (+) strand; PAM type: YTN; PAM sequence: CTG
cactccagcctggcgacaga

SEQ ID NO: 292937 - DNA, 20 bp, Artificial Sequence
  Description of Artificial Sequence: Synthetic oligonucleotide
  Target: ATXN1; (+) strand; PAM type: YTN; PAM sequence: CTC
cagcctggcgacagagcaag

SEQ ID NO: 292938 - DNA, 20 bp, Artificial Sequence
  Description of Artificial Sequence: Synthetic oligonucleotide
  Target: ATXN1; (+) strand; PAM type: YTN; PAM sequence: CTG
gcgacagagcaagactccgt

SEQ ID NO: 292939 - DNA, 20 bp, Artificial Sequence
  Description of Artificial Sequence: Synthetic oligonucleotide
  Target: ATXN1; (+) strand; PAM type: YTN; PAM sequence: CTC
cgtttcaaaaaaaaaaaaaa

SEQ ID NO: 292940 - DNA, 20 bp, Artificial Sequence
  Description of Artificial Sequence: Synthetic oligonucleotide
  Target: ATXN1; (+) strand; PAM type: YTN; PAM sequence: TTT
caaaaaaaaaaaaaaaaagg

SEQ ID NO: 292941 - DNA, 20 bp, Artificial Sequence
  Description of Artificial Sequence: Synthetic oligonucleotide
  Target: ATXN1; (+) strand; PAM type: YTN; PAM sequence: TTC
aaaaaaaaaaaaaaaaaggt

SEQ ID NO: 292942 - DNA, 20 bp, Artificial Sequence
  Description of Artificial Sequence: Synthetic oligonucleotide
  Target: ATXN1; (+) strand; PAM type: YTN; PAM sequence: TTA
aaatggtaaatttatggtaa

SEQ ID NO: 292943 - DNA, 20 bp, Artificial Sequence
  Description of Artificial Sequence: Synthetic oligonucleotide
  Target: ATXN1; (+) strand; PAM type: YTN; PAM sequence: TTT
atggtaaattttatggtgtg

SEQ ID NO: 292944 - DNA, 20 bp, Artificial Sequence
  Description of Artificial Sequence: Synthetic oligonucleotide
  Target: ATXN1; (+) strand; PAM type: YTN; PAM sequence: TTA
tggtaaattttatggtgtgt

SEQ ID NO: 292945 - DNA, 20 bp, Artificial Sequence
  Description of Artificial Sequence: Synthetic oligonucleotide
  Target: ATXN1; (+) strand; PAM type: YTN; PAM sequence: TTT
tatggtgtgtgtgtgtgtgt

SEQ ID NO: 292946 - DNA, 20 bp, Artificial Sequence
  Description of Artificial Sequence: Synthetic oligonucleotide
  Target: ATXN1; (+) strand; PAM type: YTN; PAM sequence: TTT
atggtgtgtgtgtgtgtgtg

SEQ ID NO: 292947 - DNA, 20 bp, Artificial Sequence
  Description of Artificial Sequence: Synthetic oligonucleotide
  Target: ATXN1; (+) strand; PAM type: YTN; PAM sequence: TTA
tggtgtgtgtgtgtgtgtgt

SEQ ID NO: 292948 - DNA, 20 bp, Artificial Sequence
  Description of Artificial Sequence: Synthetic oligonucleotide
  Target: ATXN1; (+) strand; PAM type: YTN; PAM sequence: CTA
tatatttatatatattttaa

SEQ ID NO: 292949 - DNA, 20 bp, Artificial Sequence
  Description of Artificial Sequence: Synthetic oligonucleotide
  Target: ATXN1; (+) strand; PAM type: YTN; PAM sequence: TTT
atatatattttaaaaatcaa

SEQ ID NO: 292950 - DNA, 20 bp, Artificial Sequence
  Description of Artificial Sequence: Synthetic oligonucleotide
  Target: ATXN1; (+) strand; PAM type: YTN; PAM sequence: TTA
tatatattttaaaaatcaaa

SEQ ID NO: 292951 - DNA, 20 bp, Artificial Sequence
  Description of Artificial Sequence: Synthetic oligonucleotide
  Target: ATXN1; (+) strand; PAM type: YTN; PAM sequence: TTT
taaaaatcaaattaaggaca

SEQ ID NO: 292952 - DNA, 20 bp, Artificial Sequence
  Description of Artificial Sequence: Synthetic oligonucleotide
  Target: ATXN1; (+) strand; PAM type: YTN; PAM sequence: TTT
aaaaatcaaattaaggacac

SEQ ID NO: 292953 - DNA, 20 bp, Artificial Sequence
  Description of Artificial Sequence: Synthetic oligonucleotide
  Target: ATXN1; (+) strand; PAM type: YTN; PAM sequence: TTA
aaaatcaaattaaggacact

SEQ ID NO: 292954 - DNA, 20 bp, Artificial Sequence
  Description of Artificial Sequence: Synthetic oligonucleotide
  Target: ATXN1; (+) strand; PAM type: YTN; PAM sequence: TTA
aggacactttcagagtaggg

SEQ ID NO: 292955 - DNA, 20 bp, Artificial Sequence
  Description of Artificial Sequence: Synthetic oligonucleotide
  Target: ATXN1; (+) strand; PAM type: YTN; PAM sequence: CTT
tcagagtagggtatctgatg

SEQ ID NO: 292956 - DNA, 20 bp, Artificial Sequence
  Description of Artificial Sequence: Synthetic oligonucleotide
  Target: ATXN1; (+) strand; PAM type: YTN; PAM sequence: TTT
cagagtagggtatctgatgg

SEQ ID NO: 292957 - DNA, 20 bp, Artificial Sequence
  Description of Artificial Sequence: Synthetic oligonucleotide
  Target: ATXN1; (+) strand; PAM type: YTN; PAM sequence: TTC
agagtagggtatctgatgga

SEQ ID NO: 292958 - DNA, 20 bp, Artificial Sequence
  Description of Artificial Sequence: Synthetic oligonucleotide
  Target: ATXN1; (+) strand; PAM type: YTN; PAM sequence: CTG
atggatagcctggtccctga

SEQ ID NO: 292959 - DNA, 20 bp, Artificial Sequence
  Description of Artificial Sequence: Synthetic oligonucleotide
  Target: ATXN1; (+) strand; PAM type: YTN; PAM sequence: CTG
gtccctgagacacagcgtgc

SEQ ID NO: 292960 - DNA, 20 bp, Artificial Sequence
  Description of Artificial Sequence: Synthetic oligonucleotide
  Target: ATXN1; (+) strand; PAM type: YTN; PAM sequence: CTG
agacacagcgtgctgctcta

SEQ ID NO: 292961 - DNA, 20 bp, Artificial Sequence
  Description of Artificial Sequence: Synthetic oligonucleotide
  Target: ATXN1; (+) strand; PAM type: YTN; PAM sequence: CTG
ctctatgctggctctccaaa

SEQ ID NO: 292962 - DNA, 20 bp, Artificial Sequence
  Description of Artificial Sequence: Synthetic oligonucleotide
  Target: ATXN1; (+) strand; PAM type: YTN; PAM sequence: CTC
tatgctggctctccaaagtg

SEQ ID NO: 292963 - DNA, 20 bp, Artificial Sequence
  Description of Artificial Sequence: Synthetic oligonucleotide
  Target: ATXN1; (+) strand; PAM type: YTN; PAM sequence: CTA
tgctggctctccaaagtggg

SEQ ID NO: 292964 - DNA, 20 bp, Artificial Sequence
  Description of Artificial Sequence: Synthetic oligonucleotide
  Target: ATXN1; (+) strand; PAM type: YTN; PAM sequence: CTG
gctctccaaagtgggtgaga

SEQ ID NO: 292965 - DNA, 20 bp, Artificial Sequence
  Description of Artificial Sequence: Synthetic oligonucleotide
  Target: ATXN1; (+) strand; PAM type: YTN; PAM sequence: CTC
tccaaagtgggtgagagtgg

SEQ ID NO: 292966 - DNA, 20 bp, Artificial Sequence
  Description of Artificial Sequence: Synthetic oligonucleotide
  Target: ATXN1; (+) strand; PAM type: YTN; PAM sequence: CTC
caaagtgggtgagagtggtg

SEQ ID NO: 292967 - DNA, 20 bp, Artificial Sequence
  Description of Artificial Sequence: Synthetic oligonucleotide
  Target: ATXN1; (+) strand; PAM type: YTN; PAM sequence: CTG
acgtggccactcaccaggaa

SEQ ID NO: 292968 - DNA, 20 bp, Artificial Sequence
  Description of Artificial Sequence: Synthetic oligonucleotide
  Target: ATXN1; (+) strand; PAM type: YTN; PAM sequence: CTC
accaggaaagtagaggtcac

SEQ ID NO: 292969 - DNA, 20 bp, Artificial Sequence
  Description of Artificial Sequence: Synthetic oligonucleotide
  Target: ATXN1; (+) strand; PAM type: YTN; PAM sequence: TTT
tcgcaaagtgagcacagctg

SEQ ID NO: 292970 - DNA, 20 bp, Artificial Sequence
  Description of Artificial Sequence: Synthetic oligonucleotide
  Target: ATXN1; (+) strand; PAM type: YTN; PAM sequence: TTT
cgcaaagtgagcacagctgc

SEQ ID NO: 292971 - DNA, 20 bp, Artificial Sequence
  Description of Artificial Sequence: Synthetic oligonucleotide
  Target: ATXN1; (+) strand; PAM type: YTN; PAM sequence: TTC
gcaaagtgagcacagctgca

SEQ ID NO: 292972 - DNA, 20 bp, Artificial Sequence
  Description of Artificial Sequence: Synthetic oligonucleotide
  Target: ATXN1; (+) strand; PAM type: YTN; PAM sequence: CTG
caggtgagcaaagcctctga

SEQ ID NO: 292973 - DNA, 20 bp, Artificial Sequence
  Description of Artificial Sequence: Synthetic oligonucleotide
  Target: ATXN1; (+) strand; PAM type: YTN; PAM sequence: CTC
tgaaaatcagcactagcatg

SEQ ID NO: 292974 - DNA, 20 bp, Artificial Sequence
  Description of Artificial Sequence: Synthetic oligonucleotide
  Target: ATXN1; (+) strand; PAM type: YTN; PAM sequence: CTG
aaaatcagcactagcatgga

SEQ ID NO: 292975 - DNA, 20 bp, Artificial Sequence
  Description of Artificial Sequence: Synthetic oligonucleotide
  Target: ATXN1; (+) strand; PAM type: YTN; PAM sequence: CTA
gcatggatgccaaatattta

SEQ ID NO: 292976 - DNA, 20 bp, Artificial Sequence
  Description of Artificial Sequence: Synthetic oligonucleotide
  Target: ATXN1; (+) strand; PAM type: YTN; PAM sequence: TTT
acgcttcctgatttaaatgc

SEQ ID NO: 292977 - DNA, 20 bp, Artificial Sequence
  Description of Artificial Sequence: Synthetic oligonucleotide
  Target: ATXN1; (+) strand; PAM type: YTN; PAM sequence: TTA
cgcttcctgatttaaatgca

SEQ ID NO: 292978 - DNA, 20 bp, Artificial Sequence
  Description of Artificial Sequence: Synthetic oligonucleotide
  Target: ATXN1; (+) strand; PAM type: YTN; PAM sequence: CTT
cctgatttaaatgcatcaag

SEQ ID NO: 292979 - DNA, 20 bp, Artificial Sequence
  Description of Artificial Sequence: Synthetic oligonucleotide
  Target: ATXN1; (+) strand; PAM type: YTN; PAM sequence: TTC
ctgatttaaatgcatcaagc

SEQ ID NO: 292980 - DNA, 20 bp, Artificial Sequence
  Description of Artificial Sequence: Synthetic oligonucleotide
  Target: ATXN1; (+) strand; PAM type: YTN; PAM sequence: CTG
atttaaatgcatcaagcaga

SEQ ID NO: 292981 - DNA, 20 bp, Artificial Sequence
  Description of Artificial Sequence: Synthetic oligonucleotide
  Target: ATXN1; (+) strand; PAM type: YTN; PAM sequence: TTT
aaatgcatcaagcagacttg

SEQ ID NO: 292982 - DNA, 20 bp, Artificial Sequence
  Description of Artificial Sequence: Synthetic oligonucleotide
  Target: ATXN1; (+) strand; PAM type: YTN; PAM sequence: TTA
aatgcatcaagcagacttga

SEQ ID NO: 292983 - DNA, 20 bp, Artificial Sequence
  Description of Artificial Sequence: Synthetic oligonucleotide
  Target: ATXN1; (+) strand; PAM type: YTN; PAM sequence: CTT
gatatttttgagactcttaa

SEQ ID NO: 292984 - DNA, 20 bp, Artificial Sequence
  Description of Artificial Sequence: Synthetic oligonucleotide
  Target: ATXN1; (+) strand; PAM type: YTN; PAM sequence: TTG
atatttttgagactcttaac

SEQ ID NO: 292985 - DNA, 20 bp, Artificial Sequence
  Description of Artificial Sequence: Synthetic oligonucleotide
  Target: ATXN1; (+) strand; PAM type: YTN; PAM sequence: TTT
ttgagactcttaacggtaga

SEQ ID NO: 292986 - DNA, 20 bp, Artificial Sequence
  Description of Artificial Sequence: Synthetic oligonucleotide
  Target: ATXN1; (+) strand; PAM type: YTN; PAM sequence: TTT
tgagactcttaacggtagat

SEQ ID NO: 292987 - DNA, 20 bp, Artificial Sequence
  Description of Artificial Sequence: Synthetic oligonucleotide
  Target: ATXN1; (+) strand; PAM type: YTN; PAM sequence: TTT
gagactcttaacggtagatc

SEQ ID NO: 292988 - DNA, 20 bp, Artificial Sequence
  Description of Artificial Sequence: Synthetic oligonucleotide
  Target: ATXN1; (+) strand; PAM type: YTN; PAM sequence: TTG
agactcttaacggtagatca

SEQ ID NO: 292989 - DNA, 20 bp, Artificial Sequence
  Description of Artificial Sequence: Synthetic oligonucleotide
  Target: ATXN1; (+) strand; PAM type: YTN; PAM sequence: CTC
ttaacggtagatcatttttg

SEQ ID NO: 292990 - DNA, 20 bp, Artificial Sequence
  Description of Artificial Sequence: Synthetic oligonucleotide
  Target: ATXN1; (+) strand; PAM type: YTN; PAM sequence: CTT
aacggtagatcatttttgta

SEQ ID NO: 292991 - DNA, 20 bp, Artificial Sequence
  Description of Artificial Sequence: Synthetic oligonucleotide
  Target: ATXN1; (+) strand; PAM type: YTN; PAM sequence: TTA
acggtagatcatttttgtag

SEQ ID NO: 292992 - DNA, 20 bp, Artificial Sequence
  Description of Artificial Sequence: Synthetic oligonucleotide
  Target: ATXN1; (+) strand; PAM type: YTN; PAM sequence: TTT
ttgtagagcagataaccact

SEQ ID NO: 292993 - DNA, 20 bp, Artificial Sequence
  Description of Artificial Sequence: Synthetic oligonucleotide
  Target: ATXN1; (+) strand; PAM type: YTN; PAM sequence: TTT
tgtagagcagataaccactc

SEQ ID NO: 292994 - DNA, 20 bp, Artificial Sequence
  Description of Artificial Sequence: Synthetic oligonucleotide
  Target: ATXN1; (+) strand; PAM type: YTN; PAM sequence: TTT
gtagagcagataaccactcc

SEQ ID NO: 292995 - DNA, 20 bp, Artificial Sequence
  Description of Artificial Sequence: Synthetic oligonucleotide
  Target: ATXN1; (+) strand; PAM type: YTN; PAM sequence: TTG
tagagcagataaccactcca

SEQ ID NO: 292996 - DNA, 20 bp, Artificial Sequence
  Description of Artificial Sequence: Synthetic oligonucleotide
  Target: ATXN1; (+) strand; PAM type: YTN; PAM sequence: CTC
caaaactgttcaagctaata

SEQ ID NO: 292997 - DNA, 20 bp, Artificial Sequence
  Description of Artificial Sequence: Synthetic oligonucleotide
  Target: ATXN1; (+) strand; PAM type: YTN; PAM sequence: CTG
ttcaagctaataaatacaga

SEQ ID NO: 292998 - DNA, 20 bp, Artificial Sequence
  Description of Artificial Sequence: Synthetic oligonucleotide
  Target: ATXN1; (+) strand; PAM type: YTN; PAM sequence: TTC
aagctaataaatacagattt

SEQ ID NO: 292999 - DNA, 20 bp, Artificial Sequence
  Description of Artificial Sequence: Synthetic oligonucleotide
  Target: ATXN1; (+) strand; PAM type: YTN; PAM sequence: CTA
ataaatacagatttgggcca

SEQ ID NO: 293000 - DNA, 20 bp, Artificial Sequence
  Description of Artificial Sequence: Synthetic oligonucleotide
  Target: ATXN1; (+) strand; PAM type: YTN; PAM sequence: TTT
gggccaaatttacataatat

SEQ ID NO: 293001 - DNA, 20 bp, Artificial Sequence
  Description of Artificial Sequence: Synthetic oligonucleotide
  Target: ATXN1; (+) strand; PAM type: YTN; PAM sequence: TTG
ggccaaatttacataatatg

SEQ ID NO: 293002 - DNA, 20 bp, Artificial Sequence
  Description of Artificial Sequence: Synthetic oligonucleotide
  Target: ATXN1; (+) strand; PAM type: YTN; PAM sequence: TTT
acataatatgtgcttgtagg

SEQ ID NO: 293003 - DNA, 20 bp, Artificial Sequence
  Description of Artificial Sequence: Synthetic oligonucleotide
  Target: ATXN1; (+) strand; PAM type: YTN; PAM sequence: TTA
cataatatgtgcttgtaggt

SEQ ID NO: 293004 - DNA, 20 bp, Artificial Sequence
  Description of Artificial Sequence: Synthetic oligonucleotide
  Target: ATXN1; (+) strand; PAM type: YTN; PAM sequence: CTT
gtaggttcactggccatgac

SEQ ID NO: 293005 - DNA, 20 bp, Artificial Sequence
  Description of Artificial Sequence: Synthetic oligonucleotide
  Target: ATXN1; (+) strand; PAM type: YTN; PAM sequence: TTG
taggttcactggccatgacc

SEQ ID NO: 293006 - DNA, 20 bp, Artificial Sequence
  Description of Artificial Sequence: Synthetic oligonucleotide
  Target: ATXN1; (+) strand; PAM type: YTN; PAM sequence: TTC
actggccatgacctttgata

SEQ ID NO: 293007 - DNA, 20 bp, Artificial Sequence
  Description of Artificial Sequence: Synthetic oligonucleotide
  Target: ATXN1; (+) strand; PAM type: YTN; PAM sequence: CTG
gccatgacctttgatagctg

SEQ ID NO: 293008 - DNA, 20 bp, Artificial Sequence
  Description of Artificial Sequence: Synthetic oligonucleotide
  Target: ATXN1; (+) strand; PAM type: YTN; PAM sequence: CTT
tgatagctgaaattgaactt

SEQ ID NO: 293009 - DNA, 20 bp, Artificial Sequence
  Description of Artificial Sequence: Synthetic oligonucleotide
  Target: ATXN1; (+) strand; PAM type: YTN; PAM sequence: TTT
gatagctgaaattgaacttt

SEQ ID NO: 293010 - DNA, 20 bp, Artificial Sequence
  Description of Artificial Sequence: Synthetic oligonucleotide
  Target: ATXN1; (+) strand; PAM type: YTN; PAM sequence: TTG
atagctgaaattgaactttc

SEQ ID NO: 293011 - DNA, 20 bp, Artificial Sequence
  Description of Artificial Sequence: Synthetic oligonucleotide
  Target: ATXN1; (+) strand; PAM type: YTN; PAM sequence: CTG
aaattgaactttcccctttc

SEQ ID NO: 293012 - DNA, 20 bp, Artificial Sequence
  Description of Artificial Sequence: Synthetic oligonucleotide
  Target: ATXN1; (+) strand; PAM type: YTN; PAM sequence: TTG
aactttcccctttcactaaa

SEQ ID NO: 293013 - DNA, 20 bp, Artificial Sequence
  Description of Artificial Sequence: Synthetic oligonucleotide
  Target: ATXN1; (+) strand; PAM type: YTN; PAM sequence: CTT
tcccctttcactaaatgtca

SEQ ID NO: 293014 - DNA, 20 bp, Artificial Sequence
  Description of Artificial Sequence: Synthetic oligonucleotide
  Target: ATXN1; (+) strand; PAM type: YTN; PAM sequence: TTT
cccctttcactaaatgtcat

SEQ ID NO: 293015 - DNA, 20 bp, Artificial Sequence
  Description of Artificial Sequence: Synthetic oligonucleotide
  Target: ATXN1; (+) strand; PAM type: YTN; PAM sequence: TTC
ccctttcactaaatgtcatt

SEQ ID NO: 293016 - DNA, 20 bp, Artificial Sequence
  Description of Artificial Sequence: Synthetic oligonucleotide
  Target: ATXN1; (+) strand; PAM type: YTN; PAM sequence: CTT
tcactaaatgtcattccaaa

SEQ ID NO: 293017 - DNA, 20 bp, Artificial Sequence
  Description of Artificial Sequence: Synthetic oligonucleotide
  Target: ATXN1; (+) strand; PAM type: YTN; PAM sequence: TTT
cactaaatgtcattccaaat

SEQ ID NO: 293018 - DNA, 20 bp, Artificial Sequence
  Description of Artificial Sequence: Synthetic oligonucleotide
  Target: ATXN1; (+) strand; PAM type: YTN; PAM sequence: TTC
actaaatgtcattccaaatt

SEQ ID NO: 293019 - DNA, 20 bp, Artificial Sequence
  Description of Artificial Sequence: Synthetic oligonucleotide
  Target: ATXN1; (+) strand; PAM type: YTN; PAM sequence: CTA
aatgtcattccaaattccag

SEQ ID NO: 293020 - DNA, 20 bp, Artificial Sequence
  Description of Artificial Sequence: Synthetic oligonucleotide
  Target: ATXN1; (+) strand; PAM type: YTN; PAM sequence: TTC
caaattccaggctgtctttg

SEQ ID NO: 293021 - DNA, 20 bp, Artificial Sequence
  Description of Artificial Sequence: Synthetic oligonucleotide
  Target: ATXN1; (+) strand; PAM type: YTN; PAM sequence: TTC
caggctgtctttggaagcaa

SEQ ID NO: 293022 - DNA, 20 bp, Artificial Sequence
  Description of Artificial Sequence: Synthetic oligonucleotide
  Target: ATXN1; (+) strand; PAM type: YTN; PAM sequence: CTG
tctttggaagcaaacactgc

SEQ ID NO: 293023 - DNA, 20 bp, Artificial Sequence
  Description of Artificial Sequence: Synthetic oligonucleotide
  Target: ATXN1; (+) strand; PAM type: YTN; PAM sequence: CTT
tggaagcaaacactgcattg

SEQ ID NO: 293024 - DNA, 20 bp, Artificial Sequence
  Description of Artificial Sequence: Synthetic oligonucleotide
  Target: ATXN1; (+) strand; PAM type: YTN; PAM sequence: TTT
ggaagcaaacactgcattgc

SEQ ID NO: 293025 - DNA, 20 bp, Artificial Sequence
  Description of Artificial Sequence: Synthetic oligonucleotide
  Target: ATXN1; (+) strand; PAM type: YTN; PAM sequence: TTG
gaagcaaacactgcattgcc

SEQ ID NO: 293026 - DNA, 20 bp, Artificial Sequence
  Description of Artificial Sequence: Synthetic oligonucleotide
  Target: ATXN1; (+) strand; PAM type: YTN; PAM sequence: CTG
cattgcctgttgccatgtgt

SEQ ID NO: 293027 - DNA, 20 bp, Artificial Sequence
  Description of Artificial Sequence: Synthetic oligonucleotide
  Target: ATXN1; (+) strand; PAM type: YTN; PAM sequence: TTG
cctgttgccatgtgtctttt

SEQ ID NO: 293028 - DNA, 20 bp, Artificial Sequence
  Description of Artificial Sequence: Synthetic oligonucleotide
  Target: ATXN1; (+) strand; PAM type: YTN; PAM sequence: CTG
ttgccatgtgtcttttagat

SEQ ID NO: 293029 - DNA, 20 bp, Artificial Sequence
  Description of Artificial Sequence: Synthetic oligonucleotide
  Target: ATXN1; (+) strand; PAM type: YTN; PAM sequence: TTG
ccatgtgtcttttagataat

SEQ ID NO: 293030 - DNA, 20 bp, Artificial Sequence
  Description of Artificial Sequence: Synthetic oligonucleotide
  Target: ATXN1; (+) strand; PAM type: YTN; PAM sequence: CTT
ttagataataaacgtgggtt

SEQ ID NO: 293031 - DNA, 20 bp, Artificial Sequence
  Description of Artificial Sequence: Synthetic oligonucleotide
  Target: ATXN1; (+) strand; PAM type: YTN; PAM sequence: TTT
tagataataaacgtgggttc

SEQ ID NO: 293032 - DNA, 20 bp, Artificial Sequence
  Description of Artificial Sequence: Synthetic oligonucleotide
  Target: ATXN1; (+) strand; PAM type: YTN; PAM sequence: TTT
agataataaacgtgggttcc

SEQ ID NO: 293033 - DNA, 20 bp, Artificial Sequence
  Description of Artificial Sequence: Synthetic oligonucleotide
  Target: ATXN1; (+) strand; PAM type: YTN; PAM sequence: TTA
gataataaacgtgggttcca

SEQ ID NO: 293034 - DNA, 20 bp, Artificial Sequence
  Description of Artificial Sequence: Synthetic oligonucleotide
  Target: ATXN1; (+) strand; PAM type: YTN; PAM sequence: TTC
caccagatggaagaagcaaa

SEQ ID NO: 293035 - DNA, 20 bp, Artificial Sequence
  Description of Artificial Sequence: Synthetic oligonucleotide
  Target: ATXN1; (+) strand; PAM type: YTN; PAM sequence: CTT
gccccaaatatctagggttc

SEQ ID NO: 293036 - DNA, 20 bp, Artificial Sequence
  Description of Artificial Sequence: Synthetic oligonucleotide
  Target: ATXN1; (+) strand; PAM type: YTN; PAM sequence: TTG
ccccaaatatctagggttcc

SEQ ID NO: 293037 - DNA, 20 bp, Artificial Sequence
  Description of Artificial Sequence: Synthetic oligonucleotide
  Target: ATXN1; (+) strand; PAM type: YTN; PAM sequence: CTA
gggttcctgctaggtactca

SEQ ID NO: 293038 - DNA, 20 bp, Artificial Sequence
  Description of Artificial Sequence: Synthetic oligonucleotide
  Target: ATXN1; (+) strand; PAM type: YTN; PAM sequence: TTC
ctgctaggtactcacgccca

SEQ ID NO: 293039 - DNA, 20 bp, Artificial Sequence
  Description of Artificial Sequence: Synthetic oligonucleotide
  Target: ATXN1; (+) strand; PAM type: YTN; PAM sequence: CTG
ctaggtactcacgcccaaac

SEQ ID NO: 293040 - DNA, 20 bp, Artificial Sequence
  Description of Artificial Sequence: Synthetic oligonucleotide
  Target: ATXN1; (+) strand; PAM type: YTN; PAM sequence: CTA
ggtactcacgcccaaactgc

SEQ ID NO: 293041 - DNA, 20 bp, Artificial Sequence
  Description of Artificial Sequence: Synthetic oligonucleotide
  Target: ATXN1; (+) strand; PAM type: YTN; PAM sequence: CTC
acgcccaaactgcatctact

SEQ ID NO: 293042 - DNA, 20 bp, Artificial Sequence
  Description of Artificial Sequence: Synthetic oligonucleotide
  Target: ATXN1; (+) strand; PAM type: YTN; PAM sequence: CTG
catctactgtgaagagttag

SEQ ID NO: 293043 - DNA, 20 bp, Artificial Sequence
  Description of Artificial Sequence: Synthetic oligonucleotide
  Target: ATXN1; (+) strand; PAM type: YTN; PAM sequence: CTA
ctgtgaagagttagttgact

SEQ ID NO: 293044 - DNA, 20 bp, Artificial Sequence
  Description of Artificial Sequence: Synthetic oligonucleotide
  Target: ATXN1; (+) strand; PAM type: YTN; PAM sequence: CTG
tgaagagttagttgactttg

SEQ ID NO: 293045 - DNA, 20 bp, Artificial Sequence
  Description of Artificial Sequence: Synthetic oligonucleotide
  Target: ATXN1; (+) strand; PAM type: YTN; PAM sequence: TTA
gttgactttgcattctgacc

SEQ ID NO: 293046 - DNA, 20 bp, Artificial Sequence
  Description of Artificial Sequence: Synthetic oligonucleotide
  Target: ATXN1; (+) strand; PAM type: YTN; PAM sequence: TTG
actttgcattctgacccaat

SEQ ID NO: 293047 - DNA, 20 bp, Artificial Sequence
  Description of Artificial Sequence: Synthetic oligonucleotide
  Target: ATXN1; (+) strand; PAM type: YTN; PAM sequence: CTT
tgcattctgacccaatgcag

SEQ ID NO: 293048 - DNA, 20 bp, Artificial Sequence
  Description of Artificial Sequence: Synthetic oligonucleotide
  Target: ATXN1; (+) strand; PAM type: YTN; PAM sequence: TTT
gcattctgacccaatgcagg

SEQ ID NO: 293049 - DNA, 20 bp, Artificial Sequence
  Description of Artificial Sequence: Synthetic oligonucleotide
  Target: ATXN1; (+) strand; PAM type: YTN; PAM sequence: TTG
cattctgacccaatgcagga

SEQ ID NO: 293050 - DNA, 20 bp, Artificial Sequence
  Description of Artificial Sequence: Synthetic oligonucleotide
  Target: ATXN1; (+) strand; PAM type: YTN; PAM sequence: TTC
tgacccaatgcaggatgctg

SEQ ID NO: 293051 - DNA, 20 bp, Artificial Sequence
  Description of Artificial Sequence: Synthetic oligonucleotide
  Target: ATXN1; (+) strand; PAM type: YTN; PAM sequence: CTG
acccaatgcaggatgctggg

SEQ ID NO: 293052 - DNA, 20 bp, Artificial Sequence
  Description of Artificial Sequence: Synthetic oligonucleotide
  Target: ATXN1; (+) strand; PAM type: YTN; PAM sequence: CTG
ggctcctacaagtggtttgt

SEQ ID NO: 293053 - DNA, 20 bp, Artificial Sequence
  Description of Artificial Sequence: Synthetic oligonucleotide
  Target: ATXN1; (+) strand; PAM type: YTN; PAM sequence: CTC
ctacaagtggtttgtctgat

SEQ ID NO: 293054 - DNA, 20 bp, Artificial Sequence
  Description of Artificial Sequence: Synthetic oligonucleotide
  Target: ATXN1; (+) strand; PAM type: YTN; PAM sequence: CTA
caagtggtttgtctgatggg

SEQ ID NO: 293055 - DNA, 20 bp, Artificial Sequence
  Description of Artificial Sequence: Synthetic oligonucleotide
  Target: ATXN1; (+) strand; PAM type: YTN; PAM sequence: TTT
gtctgatgggctcccagaga

SEQ ID NO: 293056 - DNA, 20 bp, Artificial Sequence
  Description of Artificial Sequence: Synthetic oligonucleotide
  Target: ATXN1; (+) strand; PAM type: YTN; PAM sequence: TTG
tctgatgggctcccagagat

SEQ ID NO: 293057 - DNA, 20 bp, Artificial Sequence
  Description of Artificial Sequence: Synthetic oligonucleotide
  Target: ATXN1; (+) strand; PAM type: YTN; PAM sequence: CTG
atgggctcccagagatggcc

SEQ ID NO: 293058 - DNA, 20 bp, Artificial Sequence
  Description of Artificial Sequence: Synthetic oligonucleotide
  Target: ATXN1; (+) strand; PAM type: YTN; PAM sequence: CTC
ccagagatggccagctgcca

SEQ ID NO: 293059 - DNA, 20 bp, Artificial Sequence
  Description of Artificial Sequence: Synthetic oligonucleotide
  Target: ATXN1; (+) strand; PAM type: YTN; PAM sequence: CTG
ccagcagcatcatttagaag

SEQ ID NO: 293060 - DNA, 20 bp, Artificial Sequence
  Description of Artificial Sequence: Synthetic oligonucleotide
  Target: ATXN1; (+) strand; PAM type: YTN; PAM sequence: TTT
agaagaattctggtcctgag

SEQ ID NO: 293061 - DNA, 20 bp, Artificial Sequence
  Description of Artificial Sequence: Synthetic oligonucleotide
  Target: ATXN1; (+) strand; PAM type: YTN; PAM sequence: TTA
gaagaattctggtcctgagg

SEQ ID NO: 293062 - DNA, 20 bp, Artificial Sequence
  Description of Artificial Sequence: Synthetic oligonucleotide
  Target: ATXN1; (+) strand; PAM type: YTN; PAM sequence: TTC
tggtcctgaggacagattat

SEQ ID NO: 293063 - DNA, 20 bp, Artificial Sequence
  Description of Artificial Sequence: Synthetic oligonucleotide
  Target: ATXN1; (+) strand; PAM type: YTN; PAM sequence: CTG
gtcctgaggacagattattg

SEQ ID NO: 293064 - DNA, 20 bp, Artificial Sequence
  Description of Artificial Sequence: Synthetic oligonucleotide
  Target: ATXN1; (+) strand; PAM type: YTN; PAM sequence: CTG
aggacagattattgaaaata

SEQ ID NO: 293065 - DNA, 20 bp, Artificial Sequence
  Description of Artificial Sequence: Synthetic oligonucleotide
  Target: ATXN1; (+) strand; PAM type: YTN; PAM sequence: TTA
ttgaaaataatctatttcca

SEQ ID NO: 293066 - DNA, 20 bp, Artificial Sequence
  Description of Artificial Sequence: Synthetic oligonucleotide
  Target: ATXN1; (+) strand; PAM type: YTN; PAM sequence: TTG
aaaataatctatttccattt

SEQ ID NO: 293067 - DNA, 20 bp, Artificial Sequence
  Description of Artificial Sequence: Synthetic oligonucleotide
  Target: ATXN1; (+) strand; PAM type: YTN; PAM sequence: CTA
tttccatttaacctctgcaa

SEQ ID NO: 293068 - DNA, 20 bp, Artificial Sequence
  Description of Artificial Sequence: Synthetic oligonucleotide
  Target: ATXN1; (+) strand; PAM type: YTN; PAM sequence: TTT
ccatttaacctctgcaaagt

SEQ ID NO: 293069 - DNA, 20 bp, Artificial Sequence
  Description of Artificial Sequence: Synthetic oligonucleotide
  Target: ATXN1; (+) strand; PAM type: YTN; PAM sequence: TTC
catttaacctctgcaaagta

SEQ ID NO: 293070 - DNA, 20 bp, Artificial Sequence
  Description of Artificial Sequence: Synthetic oligonucleotide
  Target: ATXN1; (+) strand; PAM type: YTN; PAM sequence: TTT
aacctctgcaaagtagactg

SEQ ID NO: 293071 - DNA, 20 bp, Artificial Sequence
  Description of Artificial Sequence: Synthetic oligonucleotide
  Target: ATXN1; (+) strand; PAM type: YTN; PAM sequence: TTA
acctctgcaaagtagactgg

SEQ ID NO: 293072 - DNA, 20 bp, Artificial Sequence
  Description of Artificial Sequence: Synthetic oligonucleotide
  Target: ATXN1; (+) strand; PAM type: YTN; PAM sequence: CTC
tgcaaagtagactgggtcct

SEQ ID NO: 293073 - DNA, 20 bp, Artificial Sequence
  Description of Artificial Sequence: Synthetic oligonucleotide
  Target: ATXN1; (+) strand; PAM type: YTN; PAM sequence: CTG
caaagtagactgggtccttg

SEQ ID NO: 293074 - DNA, 20 bp, Artificial Sequence
  Description of Artificial Sequence: Synthetic oligonucleotide
  Target: ATXN1; (+) strand; PAM type: YTN; PAM sequence: CTG
ggtccttgtggggctttcgt

SEQ ID NO: 293075 - DNA, 20 bp, Artificial Sequence
  Description of Artificial Sequence: Synthetic oligonucleotide
  Target: ATXN1; (+) strand; PAM type: YTN; PAM sequence: CTT
gtggggctttcgtttcctta

SEQ ID NO: 293076 - DNA, 20 bp, Artificial Sequence
  Description of Artificial Sequence: Synthetic oligonucleotide
  Target: ATXN1; (+) strand; PAM type: YTN; PAM sequence: TTG
tggggctttcgtttccttaa

SEQ ID NO: 293077 - DNA, 20 bp, Artificial Sequence
  Description of Artificial Sequence: Synthetic oligonucleotide
  Target: ATXN1; (+) strand; PAM type: YTN; PAM sequence: CTT
tcgtttccttaaaagcaact

SEQ ID NO: 293078 - DNA, 20 bp, Artificial Sequence
  Description of Artificial Sequence: Synthetic oligonucleotide
  Target: ATXN1; (+) strand; PAM type: YTN; PAM sequence: TTT
cgtttccttaaaagcaactg

SEQ ID NO: 293079 - DNA, 20 bp, Artificial Sequence
  Description of Artificial Sequence: Synthetic oligonucleotide
  Target: ATXN1; (+) strand; PAM type: YTN; PAM sequence: TTC
gtttccttaaaagcaactgt

SEQ ID NO: 293080 - DNA, 20 bp, Artificial Sequence
  Description of Artificial Sequence: Synthetic oligonucleotide
  Target: ATXN1; (+) strand; PAM type: YTN; PAM sequence: TTT
ccttaaaagcaactgtgtac

SEQ ID NO: 293081 - DNA, 20 bp, Artificial Sequence
  Description of Artificial Sequence: Synthetic oligonucleotide
  Target: ATXN1; (+) strand; PAM type: YTN; PAM sequence: TTC
cttaaaagcaactgtgtact

SEQ ID NO: 293082 - DNA, 20 bp, Artificial Sequence
  Description of Artificial Sequence: Synthetic oligonucleotide
  Target: ATXN1; (+) strand; PAM type: YTN; PAM sequence: CTT
aaaagcaactgtgtacttgc

SEQ ID NO: 293083 - DNA, 20 bp, Artificial Sequence
  Description of Artificial Sequence: Synthetic oligonucleotide
  Target: ATXN1; (+) strand; PAM type: YTN; PAM sequence: TTA
aaagcaactgtgtacttgct

SEQ ID NO: 293084 - DNA, 20 bp, Artificial Sequence
  Description of Artificial Sequence: Synthetic oligonucleotide
  Target: ATXN1; (+) strand; PAM type: YTN; PAM sequence: CTG
tgtacttgcttagcaacgtg

SEQ ID NO: 293085 - DNA, 20 bp, Artificial Sequence
  Description of Artificial Sequence: Synthetic oligonucleotide
  Target: ATXN1; (+) strand; PAM type: YTN; PAM sequence: CTT
gcttagcaacgtggacttaa

SEQ ID NO: 293086 - DNA, 20 bp, Artificial Sequence
  Description of Artificial Sequence: Synthetic oligonucleotide
  Target: ATXN1; (+) strand; PAM type: YTN; PAM sequence: TTG
cttagcaacgtggacttaaa

SEQ ID NO: 293087 - DNA, 20 bp, Artificial Sequence
  Description of Artificial Sequence: Synthetic oligonucleotide
  Target: ATXN1; (+) strand; PAM type: YTN; PAM sequence: CTT
agcaacgtggacttaaacca

SEQ ID NO: 293088 - DNA, 20 bp, Artificial Sequence
  Description of Artificial Sequence: Synthetic oligonucleotide
  Target: ATXN1; (+) strand; PAM type: YTN; PAM sequence: TTA
gcaacgtggacttaaaccag

SEQ ID NO: 293089 - DNA, 20 bp, Artificial Sequence
  Description of Artificial Sequence: Synthetic oligonucleotide
  Target: ATXN1; (+) strand; PAM type: YTN; PAM sequence: CTT
aaaccagtggaagaaatact

SEQ ID NO: 293090 - DNA, 20 bp, Artificial Sequence
  Description of Artificial Sequence: Synthetic oligonucleotide
  Target: ATXN1; (+) strand; PAM type: YTN; PAM sequence: TTA
aaccagtggaagaaatactt

SEQ ID NO: 293091 - DNA, 20 bp, Artificial Sequence
  Description of Artificial Sequence: Synthetic oligonucleotide
  Target: ATXN1; (+) strand; PAM type: YTN; PAM sequence: CTT
agtggagactggaaaacagc

SEQ ID NO: 293092 - DNA, 20 bp, Artificial Sequence
  Description of Artificial Sequence: Synthetic oligonucleotide
  Target: ATXN1; (+) strand; PAM type: YTN; PAM sequence: TTA
gtggagactggaaaacagca

SEQ ID NO: 293093 - DNA, 20 bp, Artificial Sequence
  Description of Artificial Sequence: Synthetic oligonucleotide
  Target: ATXN1; (+) strand; PAM type: YTN; PAM sequence: CTG
gaaaacagcaataaaagaga

SEQ ID NO: 293094 - DNA, 20 bp, Artificial Sequence
  Description of Artificial Sequence: Synthetic oligonucleotide
  Target: ATXN1; (+) strand; PAM type: YTN; PAM sequence: TTC
aatagagggaggggtggtgg

SEQ ID NO: 293095 - DNA, 20 bp, Artificial Sequence
  Description of Artificial Sequence: Synthetic oligonucleotide
  Target: ATXN1; (+) strand; PAM type: YTN; PAM sequence: CTA
cagaccaagggtgagggagc

SEQ ID NO: 293096 - DNA, 20 bp, Artificial Sequence
  Description of Artificial Sequence: Synthetic oligonucleotide
  Target: ATXN1; (+) strand; PAM type: YTN; PAM sequence: TTG
aatcccagctttaccatctc

SEQ ID NO: 293097 - DNA, 20 bp, Artificial Sequence
  Description of Artificial Sequence: Synthetic oligonucleotide
  Target: ATXN1; (+) strand; PAM type: YTN; PAM sequence: CTT
taccatctccaagcagcatt

SEQ ID NO: 293098 - DNA, 20 bp, Artificial Sequence
  Description of Artificial Sequence: Synthetic oligonucleotide
  Target: ATXN1; (+) strand; PAM type: YTN; PAM sequence: TTT
accatctccaagcagcatta

SEQ ID NO: 293099 - DNA, 20 bp, Artificial Sequence
  Description of Artificial Sequence: Synthetic oligonucleotide
  Target: ATXN1; (+) strand; PAM type: YTN; PAM sequence: TTA
ccatctccaagcagcattac

SEQ ID NO: 293100 - DNA, 20 bp, Artificial Sequence
  Description of Artificial Sequence: Synthetic oligonucleotide
  Target: ATXN1; (+) strand; PAM type: YTN; PAM sequence: CTC
caagcagcattactttcttc

SEQ ID NO: 293101 - DNA, 20 bp, Artificial Sequence
  Description of Artificial Sequence: Synthetic oligonucleotide
  Target: ATXN1; (+) strand; PAM type: YTN; PAM sequence: TTA
ctttcttcagtcccagtgac

SEQ ID NO: 293102 - DNA, 20 bp, Artificial Sequence
  Description of Artificial Sequence: Synthetic oligonucleotide
  Target: ATXN1; (+) strand; PAM type: YTN; PAM sequence: CTT
tcttcagtcccagtgacctc

SEQ ID NO: 293103 - DNA, 20 bp, Artificial Sequence
  Description of Artificial Sequence: Synthetic oligonucleotide
  Target: ATXN1; (+) strand; PAM type: YTN; PAM sequence: TTT
cttcagtcccagtgacctca

SEQ ID NO: 293104 - DNA, 20 bp, Artificial Sequence
  Description of Artificial Sequence: Synthetic oligonucleotide
  Target: ATXN1; (+) strand; PAM type: YTN; PAM sequence: TTC
ttcagtcccagtgacctcat

SEQ ID NO: 293105 - DNA, 20 bp, Artificial Sequence
  Description of Artificial Sequence: Synthetic oligonucleotide
  Target: ATXN1; (+) strand; PAM type: YTN; PAM sequence: CTT
cagtcccagtgacctcatcc

SEQ ID NO: 293106 - DNA, 20 bp, Artificial Sequence
  Description of Artificial Sequence: Synthetic oligonucleotide
  Target: ATXN1; (+) strand; PAM type: YTN; PAM sequence: TTC
agtcccagtgacctcatcca

SEQ ID NO: 293107 - DNA, 20 bp, Artificial Sequence
  Description of Artificial Sequence: Synthetic oligonucleotide
  Target: ATXN1; (+) strand; PAM type: YTN; PAM sequence: CTC
atccattataatattaataa

SEQ ID NO: 293108 - DNA, 20 bp, Artificial Sequence
  Description of Artificial Sequence: Synthetic oligonucleotide
  Target: ATXN1; (+) strand; PAM type: YTN; PAM sequence: TTA
taatattaataacatataat

SEQ ID NO: 293109 - DNA, 20 bp, Artificial Sequence
  Description of Artificial Sequence: Synthetic oligonucleotide
  Target: ATXN1; (+) strand; PAM type: YTN; PAM sequence: TTA
ataacatataattgaaatgc

SEQ ID NO: 293110 - DNA, 20 bp, Artificial Sequence
  Description of Artificial Sequence: Synthetic oligonucleotide
  Target: ATXN1; (+) strand; PAM type: YTN; PAM sequence: TTG
aaatgcaaaaattacactct

SEQ ID NO: 293111 - DNA, 20 bp, Artificial Sequence
  Description of Artificial Sequence: Synthetic oligonucleotide
  Target: ATXN1; (+) strand; PAM type: YTN; PAM sequence: TTA
cactctctacctttaagatt

SEQ ID NO: 293112 - DNA, 20 bp, Artificial Sequence
  Description of Artificial Sequence: Synthetic oligonucleotide
  Target: ATXN1; (+) strand; PAM type: YTN; PAM sequence: CTC
tctacctttaagatttccta

SEQ ID NO: 293113 - DNA, 20 bp, Artificial Sequence
  Description of Artificial Sequence: Synthetic oligonucleotide
  Target: ATXN1; (+) strand; PAM type: YTN; PAM sequence: CTC
tacctttaagatttcctatg

SEQ ID NO: 293114 - DNA, 20 bp, Artificial Sequence
  Description of Artificial Sequence: Synthetic oligonucleotide
  Target: ATXN1; (+) strand; PAM type: YTN; PAM sequence: CTA
cctttaagatttcctatggg

SEQ ID NO: 293115 - DNA, 20 bp, Artificial Sequence
  Description of Artificial Sequence: Synthetic oligonucleotide
  Target: ATXN1; (+) strand; PAM type: YTN; PAM sequence: CTT
taagatttcctatggggatc

SEQ ID NO: 293116 - DNA, 20 bp, Artificial Sequence
  Description of Artificial Sequence: Synthetic oligonucleotide
  Target: ATXN1; (+) strand; PAM type: YTN; PAM sequence: TTT
aagatttcctatggggatca

SEQ ID NO: 293117 - DNA, 20 bp, Artificial Sequence
  Description of Artificial Sequence: Synthetic oligonucleotide
  Target: ATXN1; (+) strand; PAM type: YTN; PAM sequence: TTA
agatttcctatggggatcaa

SEQ ID NO: 293118 - DNA, 20 bp, Artificial Sequence
  Description of Artificial Sequence: Synthetic oligonucleotide
  Target: ATXN1; (+) strand; PAM type: YTN; PAM sequence: TTT
cctatggggatcaaatgaga

SEQ ID NO: 293119 - DNA, 20 bp, Artificial Sequence
  Description of Artificial Sequence: Synthetic oligonucleotide
  Target: ATXN1; (+) strand; PAM type: YTN; PAM sequence: TTC
ctatggggatcaaatgagat

SEQ ID NO: 293120 - DNA, 20 bp, Artificial Sequence
  Description of Artificial Sequence: Synthetic oligonucleotide
  Target: ATXN1; (+) strand; PAM type: YTN; PAM sequence: CTA
tggggatcaaatgagatgaa

SEQ ID NO: 293121 - DNA, 20 bp, Artificial Sequence
  Description of Artificial Sequence: Synthetic oligonucleotide
  Target: ATXN1; (+) strand; PAM type: YTN; PAM sequence: TTG
ctcagtaacttaaccagttt

SEQ ID NO: 293122 - DNA, 20 bp, Artificial Sequence
  Description of Artificial Sequence: Synthetic oligonucleotide
  Target: ATXN1; (+) strand; PAM type: YTN; PAM sequence: CTC
agtaacttaaccagtttatt

SEQ ID NO: 293123 - DNA, 20 bp, Artificial Sequence
  Description of Artificial Sequence: Synthetic oligonucleotide
  Target: ATXN1; (+) strand; PAM type: YTN; PAM sequence: CTT
aaccagtttatttcttcttt

SEQ ID NO: 293124 - DNA, 20 bp, Artificial Sequence
  Description of Artificial Sequence: Synthetic oligonucleotide
  Target: ATXN1; (+) strand; PAM type: YTN; PAM sequence: TTA
accagtttatttcttcttta

SEQ ID NO: 293125 - DNA, 20 bp, Artificial Sequence
  Description of Artificial Sequence: Synthetic oligonucleotide
  Target: ATXN1; (+) strand; PAM type: YTN; PAM sequence: TTT
atttcttctttaaaaaggaa

SEQ ID NO: 293126 - DNA, 20 bp, Artificial Sequence
  Description of Artificial Sequence: Synthetic oligonucleotide
  Target: ATXN1; (+) strand; PAM type: YTN; PAM sequence: TTA
tttcttctttaaaaaggaaa

SEQ ID NO: 293127 - DNA, 20 bp, Artificial Sequence
  Description of Artificial Sequence: Synthetic oligonucleotide
  Target: ATXN1; (+) strand; PAM type: YTN; PAM sequence: TTT
cttctttaaaaaggaaattg

SEQ ID NO: 293128 - DNA, 20 bp, Artificial Sequence
  Description of Artificial Sequence: Synthetic oligonucleotide
  Target: ATXN1; (+) strand; PAM type: YTN; PAM sequence: TTC
ttctttaaaaaggaaattgt

SEQ ID NO: 293129 - DNA, 20 bp, Artificial Sequence
  Description of Artificial Sequence: Synthetic oligonucleotide
  Target: ATXN1; (+) strand; PAM type: YTN; PAM sequence: CTT
ctttaaaaaggaaattgtac

SEQ ID NO: 293130 - DNA, 20 bp, Artificial Sequence
  Description of Artificial Sequence: Synthetic oligonucleotide
  Target: ATXN1; (+) strand; PAM type: YTN; PAM sequence: TTC
tttaaaaaggaaattgtaca

SEQ ID NO: 293131 - DNA, 20 bp, Artificial Sequence
  Description of Artificial Sequence: Synthetic oligonucleotide
  Target: ATXN1; (+) strand; PAM type: YTN; PAM sequence: CTT
taaaaaggaaattgtacaaa

SEQ ID NO: 293132 - DNA, 20 bp, Artificial Sequence
  Description of Artificial Sequence: Synthetic oligonucleotide
  Target: ATXN1; (+) strand; PAM type: YTN; PAM sequence: TTT
aaaaaggaaattgtacaaaa

SEQ ID NO: 293133 - DNA, 20 bp, Artificial Sequence
  Description of Artificial Sequence: Synthetic oligonucleotide
  Target: ATXN1; (+) strand; PAM type: YTN; PAM sequence: TTA
aaaaggaaattgtacaaaac

SEQ ID NO: 293134 - DNA, 20 bp, Artificial Sequence
  Description of Artificial Sequence: Synthetic oligonucleotide
  Target: ATXN1; (+) strand; PAM type: YTN; PAM sequence: TTG
tacaaaacatgtttccagag

SEQ ID NO: 293135 - DNA, 20 bp, Artificial Sequence
  Description of Artificial Sequence: Synthetic oligonucleotide
  Target: ATXN1; (+) strand; PAM type: YTN; PAM sequence: TTT
ccagagttttgttaaggaag

SEQ ID NO: 293136 - DNA, 20 bp, Artificial Sequence
  Description of Artificial Sequence: Synthetic oligonucleotide
  Target: ATXN1; (+) strand; PAM type: YTN; PAM sequence: TTC
cagagttttgttaaggaagc

SEQ ID NO: 293137 - DNA, 20 bp, Artificial Sequence
  Description of Artificial Sequence: Synthetic oligonucleotide
  Target: ATXN1; (+) strand; PAM type: YTN; PAM sequence: TTT
tgttaaggaagctttgaaaa

SEQ ID NO: 293138 - DNA, 20 bp, Artificial Sequence
  Description of Artificial Sequence: Synthetic oligonucleotide
  Target: ATXN1; (+) strand; PAM type: YTN; PAM sequence: TTT
gttaaggaagctttgaaaac

SEQ ID NO: 293139 - DNA, 20 bp, Artificial Sequence
  Description of Artificial Sequence: Synthetic oligonucleotide
  Target: ATXN1; (+) strand; PAM type: YTN; PAM sequence: TTG
ttaaggaagctttgaaaaca

SEQ ID NO: 293140 - DNA, 20 bp, Artificial Sequence
  Description of Artificial Sequence: Synthetic oligonucleotide
  Target: ATXN1; (+) strand; PAM type: YTN; PAM sequence: TTA
aggaagctttgaaaacagac

SEQ ID NO: 293141 - DNA, 20 bp, Artificial Sequence
  Description of Artificial Sequence: Synthetic oligonucleotide
  Target: ATXN1; (+) strand; PAM type: YTN; PAM sequence: CTT
tgaaaacagactccaccagt

SEQ ID NO: 293142 - DNA, 20 bp, Artificial Sequence
  Description of Artificial Sequence: Synthetic oligonucleotide
  Target: ATXN1; (+) strand; PAM type: YTN; PAM sequence: TTT
gaaaacagactccaccagta

SEQ ID NO: 293143 - DNA, 20 bp, Artificial Sequence
  Description of Artificial Sequence: Synthetic oligonucleotide
  Target: ATXN1; (+) strand; PAM type: YTN; PAM sequence: TTG
aaaacagactccaccagtat

SEQ ID NO: 293144 - DNA, 20 bp, Artificial Sequence
  Description of Artificial Sequence: Synthetic oligonucleotide
  Target: ATXN1; (+) strand; PAM type: YTN; PAM sequence: CTC
caccagtatttatggagtat

SEQ ID NO: 293145 - DNA, 20 bp, Artificial Sequence
  Description of Artificial Sequence: Synthetic oligonucleotide
  Target: ATXN1; (+) strand; PAM type: YTN; PAM sequence: TTT
atggagtattcaccatactg

SEQ ID NO: 293146 - DNA, 20 bp, Artificial Sequence
  Description of Artificial Sequence: Synthetic oligonucleotide
  Target: ATXN1; (+) strand; PAM type: YTN; PAM sequence: TTA
tggagtattcaccatactga

SEQ ID NO: 293147 - DNA, 20 bp, Artificial Sequence
  Description of Artificial Sequence: Synthetic oligonucleotide
  Target: ATXN1; (+) strand; PAM type: YTN; PAM sequence: TTC
accatactgacagtctaata

SEQ ID NO: 293148 - DNA, 20 bp, Artificial Sequence
  Description of Artificial Sequence: Synthetic oligonucleotide
  Target: ATXN1; (+) strand; PAM type: YTN; PAM sequence: CTG
acagtctaataccactcctc

SEQ ID NO: 293149 - DNA, 20 bp, Artificial Sequence
  Description of Artificial Sequence: Synthetic oligonucleotide
  Target: ATXN1; (+) strand; PAM type: YTN; PAM sequence: CTA
ataccactcctctggggagc

SEQ ID NO: 293150 - DNA, 20 bp, Artificial Sequence
  Description of Artificial Sequence: Synthetic oligonucleotide
  Target: ATXN1; (+) strand; PAM type: YTN; PAM sequence: CTC
ctctggggagcccaggatgg

SEQ ID NO: 293151 - DNA, 20 bp, Artificial Sequence
  Description of Artificial Sequence: Synthetic oligonucleotide
  Target: ATXN1; (+) strand; PAM type: YTN; PAM sequence: CTC
tggggagcccaggatggtgc

SEQ ID NO: 293152 - DNA, 20 bp, Artificial Sequence
  Description of Artificial Sequence: Synthetic oligonucleotide
  Target: ATXN1; (+) strand; PAM type: YTN; PAM sequence: CTG
gggagcccaggatggtgcaa

SEQ ID NO: 293153 - DNA, 20 bp, Artificial Sequence
  Description of Artificial Sequence: Synthetic oligonucleotide
  Target: ATXN1; (+) strand; PAM type: YTN; PAM sequence: CTC
caaggctatgtgtggtggca

SEQ ID NO: 293154 - DNA, 20 bp, Artificial Sequence
  Description of Artificial Sequence: Synthetic oligonucleotide
  Target: ATXN1; (+) strand; PAM type: YTN; PAM sequence: CTA
tgtgtggtggcacatgccca

SEQ ID NO: 293155 - DNA, 20 bp, Artificial Sequence
  Description of Artificial Sequence: Synthetic oligonucleotide
  Target: ATXN1; (+) strand; PAM type: YTN; PAM sequence: CTC
tgagaggccaaagcaggaga

SEQ ID NO: 293156 - DNA, 20 bp, Artificial Sequence
  Description of Artificial Sequence: Synthetic oligonucleotide
  Target: ATXN1; (+) strand; PAM type: YTN; PAM sequence: CTG
agaggccaaagcaggagaat

SEQ ID NO: 293157 - DNA, 20 bp, Artificial Sequence
  Description of Artificial Sequence: Synthetic oligonucleotide
  Target: ATXN1; (+) strand; PAM type: YTN; PAM sequence: TTG
ctggaacacagggctccaga

SEQ ID NO: 293158 - DNA, 20 bp, Artificial Sequence
  Description of Artificial Sequence: Synthetic oligonucleotide
  Target: ATXN1; (+) strand; PAM type: YTN; PAM sequence: CTG
gaacacagggctccagaaca

SEQ ID NO: 293159 - DNA, 20 bp, Artificial Sequence
  Description of Artificial Sequence: Synthetic oligonucleotide
  Target: ATXN1; (+) strand; PAM type: YTN; PAM sequence: CTC
cagaacagcctgggtaacat

SEQ ID NO: 293160 - DNA, 20 bp, Artificial Sequence
  Description of Artificial Sequence: Synthetic oligonucleotide
  Target: ATXN1; (+) strand; PAM type: YTN; PAM sequence: CTG
ggtaacatagcaagaatcca

SEQ ID NO: 293161 - DNA, 20 bp, Artificial Sequence
  Description of Artificial Sequence: Synthetic oligonucleotide
  Target: ATXN1; (+) strand; PAM type: YTN; PAM sequence: CTC
tacaaaaaaaaaattaaaaa

SEQ ID NO: 293162 - DNA, 20 bp, Artificial Sequence
  Description of Artificial Sequence: Synthetic oligonucleotide
  Target: ATXN1; (+) strand; PAM type: YTN; PAM sequence: CTA
caaaaaaaaaattaaaaatg

SEQ ID NO: 293163 - DNA, 20 bp, Artificial Sequence
  Description of Artificial Sequence: Synthetic oligonucleotide
  Target: ATXN1; (+) strand; PAM type: YTN; PAM sequence: TTA
aaaatgagccaggtgtggtg

SEQ ID NO: 293164 - DNA, 20 bp, Artificial Sequence
  Description of Artificial Sequence: Synthetic oligonucleotide
  Target: ATXN1; (+) strand; PAM type: YTN; PAM sequence: CTC
taattccagagctctgggaa

SEQ ID NO: 293165 - DNA, 20 bp, Artificial Sequence
  Description of Artificial Sequence: Synthetic oligonucleotide
  Target: ATXN1; (+) strand; PAM type: YTN; PAM sequence: CTA
attccagagctctgggaagt

SEQ ID NO: 293166 - DNA, 20 bp, Artificial Sequence
  Description of Artificial Sequence: Synthetic oligonucleotide
  Target: ATXN1; (+) strand; PAM type: YTN; PAM sequence: TTC
cagagctctgggaagttggg

SEQ ID NO: 293167 - DNA, 20 bp, Artificial Sequence
  Description of Artificial Sequence: Synthetic oligonucleotide
  Target: ATXN1; (+) strand; PAM type: YTN; PAM sequence: CTC
tgggaagttggggtgggagg

SEQ ID NO: 293168 - DNA, 20 bp, Artificial Sequence
  Description of Artificial Sequence: Synthetic oligonucleotide
  Target: ATXN1; (+) strand; PAM type: YTN; PAM sequence: CTG
ggaagttggggtgggaggat

SEQ ID NO: 293169 - DNA, 20 bp, Artificial Sequence
  Description of Artificial Sequence: Synthetic oligonucleotide
  Target: ATXN1; (+) strand; PAM type: YTN; PAM sequence: TTG
gggtgggaggatcacctggg

SEQ ID NO: 293170 - DNA, 20 bp, Artificial Sequence
  Description of Artificial Sequence: Synthetic oligonucleotide
  Target: ATXN1; (+) strand; PAM type: YTN; PAM sequence: CTG
ggctcaggaggtcaaggatg

SEQ ID NO: 293171 - DNA, 20 bp, Artificial Sequence
  Description of Artificial Sequence: Synthetic oligonucleotide
  Target: ATXN1; (+) strand; PAM type: YTN; PAM sequence: CTC
aggaggtcaaggatgcagtg

SEQ ID NO: 293172 - DNA, 20 bp, Artificial Sequence
  Description of Artificial Sequence: Synthetic oligonucleotide
  Target: ATXN1; (+) strand; PAM type: YTN; PAM sequence: CTA
tgatgataccactgtactca

SEQ ID NO: 293173 - DNA, 20 bp, Artificial Sequence
  Description of Artificial Sequence: Synthetic oligonucleotide
  Target: ATXN1; (+) strand; PAM type: YTN; PAM sequence: CTG
tactcagcctgggtgacaga

SEQ ID NO: 293174 - DNA, 20 bp, Artificial Sequence
  Description of Artificial Sequence: Synthetic oligonucleotide
  Target: ATXN1; (+) strand; PAM type: YTN; PAM sequence: CTC
agcctgggtgacagagcaag

SEQ ID NO: 293175 - DNA, 20 bp, Artificial Sequence
  Description of Artificial Sequence: Synthetic oligonucleotide
  Target: ATXN1; (+) strand; PAM type: YTN; PAM sequence: CTG
ggtgacagagcaagactctg

SEQ ID NO: 293176 - DNA, 20 bp, Artificial Sequence
  Description of Artificial Sequence: Synthetic oligonucleotide
  Target: ATXN1; (+) strand; PAM type: YTN; PAM sequence: CTC
tgtctcttaaacaaaacaaa

SEQ ID NO: 293177 - DNA, 20 bp, Artificial Sequence
  Description of Artificial Sequence: Synthetic oligonucleotide
  Target: ATXN1; (+) strand; PAM type: YTN; PAM sequence: CTG
tctcttaaacaaaacaaaag

SEQ ID NO: 293178 - DNA, 20 bp, Artificial Sequence
  Description of Artificial Sequence: Synthetic oligonucleotide
  Target: ATXN1; (+) strand; PAM type: YTN; PAM sequence: CTC
ttaaacaaaacaaaagacgt

SEQ ID NO: 293179 - DNA, 20 bp, Artificial Sequence
  Description of Artificial Sequence: Synthetic oligonucleotide
  Target: ATXN1; (+) strand; PAM type: YTN; PAM sequence: CTT
aaacaaaacaaaagacgtgt

SEQ ID NO: 293180 - DNA, 20 bp, Artificial Sequence
  Description of Artificial Sequence: Synthetic oligonucleotide
  Target: ATXN1; (+) strand; PAM type: YTN; PAM sequence: TTA
aacaaaacaaaagacgtgtc

SEQ ID NO: 293181 - DNA, 20 bp, Artificial Sequence
  Description of Artificial Sequence: Synthetic oligonucleotide
  Target: ATXN1; (+) strand; PAM type: YTN; PAM sequence: CTA
ccactccagggaagtgaaaa

SEQ ID NO: 293182 - DNA, 20 bp, Artificial Sequence
  Description of Artificial Sequence: Synthetic oligonucleotide
  Target: ATXN1; (+) strand; PAM type: YTN; PAM sequence: CTC
cagggaagtgaaaaagcaga

SEQ ID NO: 293183 - DNA, 20 bp, Artificial Sequence
  Description of Artificial Sequence: Synthetic oligonucleotide
  Target: ATXN1; (+) strand; PAM type: YTN; PAM sequence: TTC
ctgctaagagtgatcatgac

SEQ ID NO: 293184 - DNA, 20 bp, Artificial Sequence
  Description of Artificial Sequence: Synthetic oligonucleotide
  Target: ATXN1; (+) strand; PAM type: YTN; PAM sequence: CTG
ctaagagtgatcatgaccct

SEQ ID NO: 293185 - DNA, 20 bp, Artificial Sequence
  Description of Artificial Sequence: Synthetic oligonucleotide
  Target: ATXN1; (+) strand; PAM type: YTN; PAM sequence: CTA
agagtgatcatgaccctctc

SEQ ID NO: 293186 - DNA, 20 bp, Artificial Sequence
  Description of Artificial Sequence: Synthetic oligonucleotide
  Target: ATXN1; (+) strand; PAM type: YTN; PAM sequence: CTC
tcctattcaacaaccttcag

SEQ ID NO: 293187 - DNA, 20 bp, Artificial Sequence
  Description of Artificial Sequence: Synthetic oligonucleotide
  Target: ATXN1; (+) strand; PAM type: YTN; PAM sequence: CTC
ctattcaacaaccttcagtg

SEQ ID NO: 293188 - DNA, 20 bp, Artificial Sequence
  Description of Artificial Sequence: Synthetic oligonucleotide
  Target: ATXN1; (+) strand; PAM type: YTN; PAM sequence: CTA
ttcaacaaccttcagtggct

SEQ ID NO: 293189 - DNA, 20 bp, Artificial Sequence
  Description of Artificial Sequence: Synthetic oligonucleotide
  Target: ATXN1; (+) strand; PAM type: YTN; PAM sequence: TTC
aacaaccttcagtggctctc

SEQ ID NO: 293190 - DNA, 20 bp, Artificial Sequence
  Description of Artificial Sequence: Synthetic oligonucleotide
  Target: ATXN1; (+) strand; PAM type: YTN; PAM sequence: CTT
cagtggctctccgccactta

SEQ ID NO: 293191 - DNA, 20 bp, Artificial Sequence
  Description of Artificial Sequence: Synthetic oligonucleotide
  Target: ATXN1; (+) strand; PAM type: YTN; PAM sequence: TTC
agtggctctccgccacttaa

SEQ ID NO: 293192 - DNA, 20 bp, Artificial Sequence
  Description of Artificial Sequence: Synthetic oligonucleotide
  Target: ATXN1; (+) strand; PAM type: YTN; PAM sequence: CTC
tccgccacttaagaaaaaat

SEQ ID NO: 293193 - DNA, 20 bp, Artificial Sequence
  Description of Artificial Sequence: Synthetic oligonucleotide
  Target: ATXN1; (+) strand; PAM type: YTN; PAM sequence: CTC
cgccacttaagaaaaaatgg

SEQ ID NO: 293194 - DNA, 20 bp, Artificial Sequence
  Description of Artificial Sequence: Synthetic oligonucleotide
  Target: ATXN1; (+) strand; PAM type: YTN; PAM sequence: CTT
aagaaaaaatggaattaatc

SEQ ID NO: 293195 - DNA, 20 bp, Artificial Sequence
  Description of Artificial Sequence: Synthetic oligonucleotide
  Target: ATXN1; (+) strand; PAM type: YTN; PAM sequence: TTA
agaaaaaatggaattaatcc

SEQ ID NO: 293196 - DNA, 20 bp, Artificial Sequence
  Description of Artificial Sequence: Synthetic oligonucleotide
  Target: ATXN1; (+) strand; PAM type: YTN; PAM sequence: TTA
atcccattttctcatctgta

SEQ ID NO: 293197 - DNA, 20 bp, Artificial Sequence
  Description of Artificial Sequence: Synthetic oligonucleotide
  Target: ATXN1; (+) strand; PAM type: YTN; PAM sequence: TTT
tctcatctgtaaaatgtgga

SEQ ID NO: 293198 - DNA, 20 bp, Artificial Sequence
  Description of Artificial Sequence: Synthetic oligonucleotide
  Target: ATXN1; (+) strand; PAM type: YTN; PAM sequence: TTT
ctcatctgtaaaatgtggat

SEQ ID NO: 293199 - DNA, 20 bp, Artificial Sequence
  Description of Artificial Sequence: Synthetic oligonucleotide
  Target: ATXN1; (+) strand; PAM type: YTN; PAM sequence: TTC
tcatctgtaaaatgtggata

SEQ ID NO: 293200 - DNA, 20 bp, Artificial Sequence
  Description of Artificial Sequence: Synthetic oligonucleotide
  Target: ATXN1; (+) strand; PAM type: YTN; PAM sequence: CTC
atctgtaaaatgtggatagc

SEQ ID NO: 293201 - DNA, 20 bp, Artificial Sequence
  Description of Artificial Sequence: Synthetic oligonucleotide
  Target: ATXN1; (+) strand; PAM type: YTN; PAM sequence: CTG
taaaatgtggatagctatgt

SEQ ID NO: 293202 - DNA, 20 bp, Artificial Sequence
  Description of Artificial Sequence: Synthetic oligonucleotide
  Target: ATXN1; (+) strand; PAM type: YTN; PAM sequence: CTA
tgttgaagggagttgtaatc

SEQ ID NO: 293203 - DNA, 20 bp, Artificial Sequence
  Description of Artificial Sequence: Synthetic oligonucleotide
  Target: ATXN1; (+) strand; PAM type: YTN; PAM sequence: TTG
aagggagttgtaatcagagc

SEQ ID NO: 293204 - DNA, 20 bp, Artificial Sequence
  Description of Artificial Sequence: Synthetic oligonucleotide
  Target: ATXN1; (+) strand; PAM type: YTN; PAM sequence: TTG
taatcagagctaatttatgt

SEQ ID NO: 293205 - DNA, 20 bp, Artificial Sequence
  Description of Artificial Sequence: Synthetic oligonucleotide
  Target: ATXN1; (+) strand; PAM type: YTN; PAM sequence: CTA
atttatgtaaagccccaacc

SEQ ID NO: 293206 - DNA, 20 bp, Artificial Sequence
  Description of Artificial Sequence: Synthetic oligonucleotide
  Target: ATXN1; (+) strand; PAM type: YTN; PAM sequence: TTT
atgtaaagccccaaccacag

SEQ ID NO: 293207 - DNA, 20 bp, Artificial Sequence
  Description of Artificial Sequence: Synthetic oligonucleotide
  Target: ATXN1; (+) strand; PAM type: YTN; PAM sequence: TTA
tgtaaagccccaaccacaga

SEQ ID NO: 293208 - DNA, 20 bp, Artificial Sequence
  Description of Artificial Sequence: Synthetic oligonucleotide
  Target: ATXN1; (+) strand; PAM type: YTN; PAM sequence: CTG
atatatggcaccactcagtg

SEQ ID NO: 293209 - DNA, 20 bp, Artificial Sequence
  Description of Artificial Sequence: Synthetic oligonucleotide
  Target: ATXN1; (+) strand; PAM type: YTN; PAM sequence: CTC
agtgaatagttcacactcac

SEQ ID NO: 293210 - DNA, 20 bp, Artificial Sequence
  Description of Artificial Sequence: Synthetic oligonucleotide
  Target: ATXN1; (+) strand; PAM type: YTN; PAM sequence: TTC
acactcaccgttatcatcat

SEQ ID NO: 293211 - DNA, 20 bp, Artificial Sequence
  Description of Artificial Sequence: Synthetic oligonucleotide
  Target: ATXN1; (+) strand; PAM type: YTN; PAM sequence: CTC
accgttatcatcattatcat

SEQ ID NO: 293212 - DNA, 20 bp, Artificial Sequence
  Description of Artificial Sequence: Synthetic oligonucleotide
  Target: ATXN1; (+) strand; PAM type: YTN; PAM sequence: TTA
tcatcattatcattaaatca

SEQ ID NO: 293213 - DNA, 20 bp, Artificial Sequence
  Description of Artificial Sequence: Synthetic oligonucleotide
  Target: ATXN1; (+) strand; PAM type: YTN; PAM sequence: TTA
tcattaaatcagactatctt

SEQ ID NO: 293214 - DNA, 20 bp, Artificial Sequence
  Description of Artificial Sequence: Synthetic oligonucleotide
  Target: ATXN1; (+) strand; PAM type: YTN; PAM sequence: TTA
aatcagactatcttcctccc

SEQ ID NO: 293215 - DNA, 20 bp, Artificial Sequence
  Description of Artificial Sequence: Synthetic oligonucleotide
  Target: ATXN1; (+) strand; PAM type: YTN; PAM sequence: CTA
tcttcctcccagtctcccac

SEQ ID NO: 293216 - DNA, 20 bp, Artificial Sequence
  Description of Artificial Sequence: Synthetic oligonucleotide
  Target: ATXN1; (+) strand; PAM type: YTN; PAM sequence: CTT
cctcccagtctcccactgtt

SEQ ID NO: 293217 - DNA, 20 bp, Artificial Sequence
  Description of Artificial Sequence: Synthetic oligonucleotide
  Target: ATXN1; (+) strand; PAM type: YTN; PAM sequence: TTC
ctcccagtctcccactgttc

SEQ ID NO: 293218 - DNA, 20 bp, Artificial Sequence
  Description of Artificial Sequence: Synthetic oligonucleotide
  Target: ATXN1; (+) strand; PAM type: YTN; PAM sequence: CTC
ccagtctcccactgttccac

SEQ ID NO: 293219 - DNA, 20 bp, Artificial Sequence
  Description of Artificial Sequence: Synthetic oligonucleotide
  Target: ATXN1; (+) strand; PAM type: YTN; PAM sequence: CTC
ccactgttccacctcacaca

SEQ ID NO: 293220 - DNA, 20 bp, Artificial Sequence
  Description of Artificial Sequence: Synthetic oligonucleotide
  Target: ATXN1; (+) strand; PAM type: YTN; PAM sequence: CTG
ttccacctcacacaccttaa

SEQ ID NO: 293221 - DNA, 20 bp, Artificial Sequence
  Description of Artificial Sequence: Synthetic oligonucleotide
  Target: ATXN1; (+) strand; PAM type: YTN; PAM sequence: TTC
cacctcacacaccttaaccc

SEQ ID NO: 293222 - DNA, 20 bp, Artificial Sequence
  Description of Artificial Sequence: Synthetic oligonucleotide
  Target: ATXN1; (+) strand; PAM type: YTN; PAM sequence: CTC
acacaccttaaccctgggct

SEQ ID NO: 293223 - DNA, 20 bp, Artificial Sequence
  Description of Artificial Sequence: Synthetic oligonucleotide
  Target: ATXN1; (+) strand; PAM type: YTN; PAM sequence: CTT
aaccctgggctcaaactggt

SEQ ID NO: 293224 - DNA, 20 bp, Artificial Sequence
  Description of Artificial Sequence: Synthetic oligonucleotide
  Target: ATXN1; (+) strand; PAM type: YTN; PAM sequence: TTA
accctgggctcaaactggtc

SEQ ID NO: 293225 - DNA, 20 bp, Artificial Sequence
  Description of Artificial Sequence: Synthetic oligonucleotide
  Target: ATXN1; (+) strand; PAM type: YTN; PAM sequence: CTG
ggctcaaactggtccacagc

SEQ ID NO: 293226 - DNA, 20 bp, Artificial Sequence
  Description of Artificial Sequence: Synthetic oligonucleotide
  Target: ATXN1; (+) strand; PAM type: YTN; PAM sequence: CTC
aaactggtccacagctttcc

SEQ ID NO: 293227 - DNA, 20 bp, Artificial Sequence
  Description of Artificial Sequence: Synthetic oligonucleotide
  Target: ATXN1; (+) strand; PAM type: YTN; PAM sequence: CTG
gtccacagctttcctcaaat

SEQ ID NO: 293228 - DNA, 20 bp, Artificial Sequence
  Description of Artificial Sequence: Synthetic oligonucleotide
  Target: ATXN1; (+) strand; PAM type: YTN; PAM sequence: CTT
tcctcaaatatgctctgctc

SEQ ID NO: 293229 - DNA, 20 bp, Artificial Sequence
  Description of Artificial Sequence: Synthetic oligonucleotide
  Target: ATXN1; (+) strand; PAM type: YTN; PAM sequence: TTT
cctcaaatatgctctgctct

SEQ ID NO: 293230 - DNA, 20 bp, Artificial Sequence
  Description of Artificial Sequence: Synthetic oligonucleotide
  Target: ATXN1; (+) strand; PAM type: YTN; PAM sequence: TTC
ctcaaatatgctctgctctg

SEQ ID NO: 293231 - DNA, 20 bp, Artificial Sequence
  Description of Artificial Sequence: Synthetic oligonucleotide
  Target: ATXN1; (+) strand; PAM type: YTN; PAM sequence: CTC
aaatatgctctgctctgcac

SEQ ID NO: 293232 - DNA, 20 bp, Artificial Sequence
  Description of Artificial Sequence: Synthetic oligonucleotide
  Target: ATXN1; (+) strand; PAM type: YTN; PAM sequence: CTC
tgctctgcactctcccttct

SEQ ID NO: 293233 - DNA, 20 bp, Artificial Sequence
  Description of Artificial Sequence: Synthetic oligonucleotide
  Target: ATXN1; (+) strand; PAM type: YTN; PAM sequence: CTG
ctctgcactctcccttctcc

SEQ ID NO: 293234 - DNA, 20 bp, Artificial Sequence
  Description of Artificial Sequence: Synthetic oligonucleotide
  Target: ATXN1; (+) strand; PAM type: YTN; PAM sequence: CTC
tgcactctcccttctccaca

SEQ ID NO: 293235 - DNA, 20 bp, Artificial Sequence
  Description of Artificial Sequence: Synthetic oligonucleotide
  Target: ATXN1; (+) strand; PAM type: YTN; PAM sequence: CTG
cactctcccttctccacacc

SEQ ID NO: 293236 - DNA, 20 bp, Artificial Sequence
  Description of Artificial Sequence: Synthetic oligonucleotide
  Target: ATXN1; (+) strand; PAM type: YTN; PAM sequence: CTC
tcccttctccacacctttgg

SEQ ID NO: 293237 - DNA, 20 bp, Artificial Sequence
  Description of Artificial Sequence: Synthetic oligonucleotide
  Target: ATXN1; (+) strand; PAM type: YTN; PAM sequence: CTC
ccttctccacacctttgggc

SEQ ID NO: 293238 - DNA, 20 bp, Artificial Sequence
  Description of Artificial Sequence: Synthetic oligonucleotide
  Target: ATXN1; (+) strand; PAM type: YTN; PAM sequence: CTT
ctccacacctttgggcacac

SEQ ID NO: 293239 - DNA, 20 bp, Artificial Sequence
  Description of Artificial Sequence: Synthetic oligonucleotide
  Target: ATXN1; (+) strand; PAM type: YTN; PAM sequence: TTC
tccacacctttgggcacacg

SEQ ID NO: 293240 - DNA, 20 bp, Artificial Sequence
  Description of Artificial Sequence: Synthetic oligonucleotide
  Target: ATXN1; (+) strand; PAM type: YTN; PAM sequence: CTC
cacacctttgggcacacgcc

SEQ ID NO: 293241 - DNA, 20 bp, Artificial Sequence
  Description of Artificial Sequence: Synthetic oligonucleotide
  Target: ATXN1; (+) strand; PAM type: YTN; PAM sequence: CTT
tgggcacacgccctcccgtg

SEQ ID NO: 293242 - DNA, 20 bp, Artificial Sequence
  Description of Artificial Sequence: Synthetic oligonucleotide
  Target: ATXN1; (+) strand; PAM type: YTN; PAM sequence: TTT
gggcacacgccctcccgtgt

SEQ ID NO: 293243 - DNA, 20 bp, Artificial Sequence
  Description of Artificial Sequence: Synthetic oligonucleotide
  Target: ATXN1; (+) strand; PAM type: YTN; PAM sequence: TTG
ggcacacgccctcccgtgtg

SEQ ID NO: 293244 - DNA, 20 bp, Artificial Sequence
  Description of Artificial Sequence: Synthetic oligonucleotide
  Target: ATXN1; (+) strand; PAM type: YTN; PAM sequence: CTC
ccgtgtggaatgccttgctc

SEQ ID NO: 293245 - DNA, 20 bp, Artificial Sequence
  Description of Artificial Sequence: Synthetic oligonucleotide
  Target: ATXN1; (+) strand; PAM type: YTN; PAM sequence: CTT
gctcccagctctgtcaggtg

SEQ ID NO: 293246 - DNA, 20 bp, Artificial Sequence
  Description of Artificial Sequence: Synthetic oligonucleotide
  Target: ATXN1; (+) strand; PAM type: YTN; PAM sequence: TTG
ctcccagctctgtcaggtgg

SEQ ID NO: 293247 - DNA, 20 bp, Artificial Sequence
  Description of Artificial Sequence: Synthetic oligonucleotide
  Target: ATXN1; (+) strand; PAM type: YTN; PAM sequence: CTC
ccagctctgtcaggtggaat

SEQ ID NO: 293248 - DNA, 20 bp, Artificial Sequence
  Description of Artificial Sequence: Synthetic oligonucleotide
  Target: ATXN1; (+) strand; PAM type: YTN; PAM sequence: CTC
tgtcaggtggaatcctagcc

SEQ ID NO: 293249 - DNA, 20 bp, Artificial Sequence
  Description of Artificial Sequence: Synthetic oligonucleotide
  Target: ATXN1; (+) strand; PAM type: YTN; PAM sequence: CTG
tcaggtggaatcctagccat

SEQ ID NO: 293250 - DNA, 20 bp, Artificial Sequence
  Description of Artificial Sequence: Synthetic oligonucleotide
  Target: ATXN1; (+) strand; PAM type: YTN; PAM sequence: CTA
gccattcttccaagtcagct

SEQ ID NO: 293251 - DNA, 20 bp, Artificial Sequence
  Description of Artificial Sequence: Synthetic oligonucleotide
  Target: ATXN1; (+) strand; PAM type: YTN; PAM sequence: TTC
ttccaagtcagctctgatgc

SEQ ID NO: 293252 - DNA, 20 bp, Artificial Sequence
  Description of Artificial Sequence: Synthetic oligonucleotide
  Target: ATXN1; (+) strand; PAM type: YTN; PAM sequence: CTT
ccaagtcagctctgatgctt

SEQ ID NO: 293253 - DNA, 20 bp, Artificial Sequence
  Description of Artificial Sequence: Synthetic oligonucleotide
  Target: ATXN1; (+) strand; PAM type: YTN; PAM sequence: TTC
caagtcagctctgatgcttc

SEQ ID NO: 293254 - DNA, 20 bp, Artificial Sequence
  Description of Artificial Sequence: Synthetic oligonucleotide
  Target: ATXN1; (+) strand; PAM type: YTN; PAM sequence: CTC
tgatgcttcctccaagtcct

SEQ ID NO: 293255 - DNA, 20 bp, Artificial Sequence
  Description of Artificial Sequence: Synthetic oligonucleotide
  Target: ATXN1; (+) strand; PAM type: YTN; PAM sequence: CTG
atgcttcctccaagtcctca

SEQ ID NO: 293256 - DNA, 20 bp, Artificial Sequence
  Description of Artificial Sequence: Synthetic oligonucleotide
  Target: ATXN1; (+) strand; PAM type: YTN; PAM sequence: CTT
cctccaagtcctcaccactc

SEQ ID NO: 293257 - DNA, 20 bp, Artificial Sequence
  Description of Artificial Sequence: Synthetic oligonucleotide
  Target: ATXN1; (+) strand; PAM type: YTN; PAM sequence: TTC
ctccaagtcctcaccactcc

SEQ ID NO: 293258 - DNA, 20 bp, Artificial Sequence
  Description of Artificial Sequence: Synthetic oligonucleotide
  Target: ATXN1; (+) strand; PAM type: YTN; PAM sequence: CTC
caagtcctcaccactcccaa

SEQ ID NO: 293259 - DNA, 20 bp, Artificial Sequence
  Description of Artificial Sequence: Synthetic oligonucleotide
  Target: ATXN1; (+) strand; PAM type: YTN; PAM sequence: CTC
accactcccaaatcagacta

SEQ ID NO: 293260 - DNA, 20 bp, Artificial Sequence
  Description of Artificial Sequence: Synthetic oligonucleotide
  Target: ATXN1; (+) strand; PAM type: YTN; PAM sequence: CTC
ccaaatcagactaaatatcc

SEQ ID NO: 293261 - DNA, 20 bp, Artificial Sequence
  Description of Artificial Sequence: Synthetic oligonucleotide
  Target: ATXN1; (+) strand; PAM type: YTN; PAM sequence: CTA
aatatcccactcctttgtgt

SEQ ID NO: 293262 - DNA, 20 bp, Artificial Sequence
  Description of Artificial Sequence: Synthetic oligonucleotide
  Target: ATXN1; (+) strand; PAM type: YTN; PAM sequence: CTC
ctttgtgttcccacagcatt

SEQ ID NO: 293263 - DNA, 20 bp, Artificial Sequence
  Description of Artificial Sequence: Synthetic oligonucleotide
  Target: ATXN1; (+) strand; PAM type: YTN; PAM sequence: CTT
tgtgttcccacagcattgct

SEQ ID NO: 293264 - DNA, 20 bp, Artificial Sequence
  Description of Artificial Sequence: Synthetic oligonucleotide
  Target: ATXN1; (+) strand; PAM type: YTN; PAM sequence: TTT
gtgttcccacagcattgctt

SEQ ID NO: 293265 - DNA, 20 bp, Artificial Sequence
  Description of Artificial Sequence: Synthetic oligonucleotide
  Target: ATXN1; (+) strand; PAM type: YTN; PAM sequence: TTG
tgttcccacagcattgcttc

SEQ ID NO: 293266 - DNA, 20 bp, Artificial Sequence
  Description of Artificial Sequence: Synthetic oligonucleotide
  Target: ATXN1; (+) strand; PAM type: YTN; PAM sequence: TTC
ccacagcattgcttcgcctt

SEQ ID NO: 293267 - DNA, 20 bp, Artificial Sequence
  Description of Artificial Sequence: Synthetic oligonucleotide
  Target: ATXN1; (+) strand; PAM type: YTN; PAM sequence: TTG
cttcgccttccctagctggg

SEQ ID NO: 293268 - DNA, 20 bp, Artificial Sequence
  Description of Artificial Sequence: Synthetic oligonucleotide
  Target: ATXN1; (+) strand; PAM type: YTN; PAM sequence: CTT
cgccttccctagctgggttc

SEQ ID NO: 293269 - DNA, 20 bp, Artificial Sequence
  Description of Artificial Sequence: Synthetic oligonucleotide
  Target: ATXN1; (+) strand; PAM type: YTN; PAM sequence: TTC
gccttccctagctgggttca

SEQ ID NO: 293270 - DNA, 20 bp, Artificial Sequence
  Description of Artificial Sequence: Synthetic oligonucleotide
  Target: ATXN1; (+) strand; PAM type: YTN; PAM sequence: CTT
ccctagctgggttcacctac

SEQ ID NO: 293271 - DNA, 20 bp, Artificial Sequence
  Description of Artificial Sequence: Synthetic oligonucleotide
  Target: ATXN1; (+) strand; PAM type: YTN; PAM sequence: TTC
cctagctgggttcacctaca

SEQ ID NO: 293272 - DNA, 20 bp, Artificial Sequence
  Description of Artificial Sequence: Synthetic oligonucleotide
  Target: ATXN1; (+) strand; PAM type: YTN; PAM sequence: CTA
gctgggttcacctacatgtt

SEQ ID NO: 293273 - DNA, 20 bp, Artificial Sequence
  Description of Artificial Sequence: Synthetic oligonucleotide
  Target: ATXN1; (+) strand; PAM type: YTN; PAM sequence: CTG
ggttcacctacatgtttccc

SEQ ID NO: 293274 - DNA, 20 bp, Artificial Sequence
  Description of Artificial Sequence: Synthetic oligonucleotide
  Target: ATXN1; (+) strand; PAM type: YTN; PAM sequence: TTC
acctacatgtttcccctaac

SEQ ID NO: 293275 - DNA, 20 bp, Artificial Sequence
  Description of Artificial Sequence: Synthetic oligonucleotide
  Target: ATXN1; (+) strand; PAM type: YTN; PAM sequence: CTA
catgtttcccctaacagtgt

SEQ ID NO: 293276 - DNA, 20 bp, Artificial Sequence
  Description of Artificial Sequence: Synthetic oligonucleotide
  Target: ATXN1; (+) strand; PAM type: YTN; PAM sequence: TTT
cccctaacagtgtaaattcc

SEQ ID NO: 293277 - DNA, 20 bp, Artificial Sequence
  Description of Artificial Sequence: Synthetic oligonucleotide
  Target: ATXN1; (+) strand; PAM type: YTN; PAM sequence: TTC
ccctaacagtgtaaattcct

SEQ ID NO: 293278 - DNA, 20 bp, Artificial Sequence
  Description of Artificial Sequence: Synthetic oligonucleotide
  Target: ATXN1; (+) strand; PAM type: YTN; PAM sequence: CTA
acagtgtaaattcctaaacc

SEQ ID NO: 293279 - DNA, 20 bp, Artificial Sequence
  Description of Artificial Sequence: Synthetic oligonucleotide
  Target: ATXN1; (+) strand; PAM type: YTN; PAM sequence: TTC
ctaaaccaagtttgtaggaa

SEQ ID NO: 293280 - DNA, 20 bp, Artificial Sequence
  Description of Artificial Sequence: Synthetic oligonucleotide
  Target: ATXN1; (+) strand; PAM type: YTN; PAM sequence: CTA
aaccaagtttgtaggaaggc

SEQ ID NO: 293281 - DNA, 20 bp, Artificial Sequence
  Description of Artificial Sequence: Synthetic oligonucleotide
  Target: ATXN1; (+) strand; PAM type: YTN; PAM sequence: TTT
gtaggaaggcatgaagaata

SEQ ID NO: 293282 - DNA, 20 bp, Artificial Sequence
  Description of Artificial Sequence: Synthetic oligonucleotide
  Target: ATXN1; (+) strand; PAM type: YTN; PAM sequence: TTG
taggaaggcatgaagaataa

SEQ ID NO: 293283 - DNA, 20 bp, Artificial Sequence
  Description of Artificial Sequence: Synthetic oligonucleotide
  Target: ATXN1; (+) strand; PAM type: YTN; PAM sequence: CTG
gaaaaattttaccacaaact

SEQ ID NO: 293284 - DNA, 20 bp, Artificial Sequence
  Description of Artificial Sequence: Synthetic oligonucleotide
  Target: ATXN1; (+) strand; PAM type: YTN; PAM sequence: TTT
taccacaaactgagtaacta

SEQ ID NO: 293285 - DNA, 20 bp, Artificial Sequence
  Description of Artificial Sequence: Synthetic oligonucleotide
  Target: ATXN1; (+) strand; PAM type: YTN; PAM sequence: TTT
accacaaactgagtaactaa

SEQ ID NO: 293286 - DNA, 20 bp, Artificial Sequence
  Description of Artificial Sequence: Synthetic oligonucleotide
  Target: ATXN1; (+) strand; PAM type: YTN; PAM sequence: TTA
ccacaaactgagtaactaac

SEQ ID NO: 293287 - DNA, 20 bp, Artificial Sequence
  Description of Artificial Sequence: Synthetic oligonucleotide
  Target: ATXN1; (+) strand; PAM type: YTN; PAM sequence: CTG
agtaactaacgaaattccat

SEQ ID NO: 293288 - DNA, 20 bp, Artificial Sequence
  Description of Artificial Sequence: Synthetic oligonucleotide
  Target: ATXN1; (+) strand; PAM type: YTN; PAM sequence: CTA
acgaaattccatgaaagtgg

SEQ ID NO: 293289 - DNA, 20 bp, Artificial Sequence
  Description of Artificial Sequence: Synthetic oligonucleotide
  Target: ATXN1; (+) strand; PAM type: YTN; PAM sequence: TTC
catgaaagtggtatgataat

SEQ ID NO: 293290 - DNA, 20 bp, Artificial Sequence
  Description of Artificial Sequence: Synthetic oligonucleotide
  Target: ATXN1; (+) strand; PAM type: YTN; PAM sequence: CTA
ccattttttgaaagctttac

SEQ ID NO: 293291 - DNA, 20 bp, Artificial Sequence
  Description of Artificial Sequence: Synthetic oligonucleotide
  Target: ATXN1; (+) strand; PAM type: YTN; PAM sequence: TTT
tttgaaagctttacgtgcat

SEQ ID NO: 293292 - DNA, 20 bp, Artificial Sequence
  Description of Artificial Sequence: Synthetic oligonucleotide
  Target: ATXN1; (+) strand; PAM type: YTN; PAM sequence: TTT
ttgaaagctttacgtgcatc

SEQ ID NO: 293293 - DNA, 20 bp, Artificial Sequence
  Description of Artificial Sequence: Synthetic oligonucleotide
  Target: ATXN1; (+) strand; PAM type: YTN; PAM sequence: TTT
tgaaagctttacgtgcatca

SEQ ID NO: 293294 - DNA, 20 bp, Artificial Sequence
  Description of Artificial Sequence: Synthetic oligonucleotide
  Target: ATXN1; (+) strand; PAM type: YTN; PAM sequence: TTT
gaaagctttacgtgcatcaa

SEQ ID NO: 293295 - DNA, 20 bp, Artificial Sequence
  Description of Artificial Sequence: Synthetic oligonucleotide
  Target: ATXN1; (+) strand; PAM type: YTN; PAM sequence: TTG
aaagctttacgtgcatcaag

SEQ ID NO: 293296 - DNA, 20 bp, Artificial Sequence
  Description of Artificial Sequence: Synthetic oligonucleotide
  Target: ATXN1; (+) strand; PAM type: YTN; PAM sequence: CTT
tacgtgcatcaagactcatt

SEQ ID NO: 293297 - DNA, 20 bp, Artificial Sequence
  Description of Artificial Sequence: Synthetic oligonucleotide
  Target: ATXN1; (+) strand; PAM type: YTN; PAM sequence: TTT
acgtgcatcaagactcattt

SEQ ID NO: 293298 - DNA, 20 bp, Artificial Sequence
  Description of Artificial Sequence: Synthetic oligonucleotide
  Target: ATXN1; (+) strand; PAM type: YTN; PAM sequence: TTA
cgtgcatcaagactcattta

SEQ ID NO: 293299 - DNA, 20 bp, Artificial Sequence
  Description of Artificial Sequence: Synthetic oligonucleotide
  Target: ATXN1; (+) strand; PAM type: YTN; PAM sequence: CTC
atttaggtttttttgtttgt

SEQ ID NO: 293300 - DNA, 20 bp, Artificial Sequence
  Description of Artificial Sequence: Synthetic oligonucleotide
  Target: ATXN1; (+) strand; PAM type: YTN; PAM sequence: TTT
aggtttttttgtttgtttgt

SEQ ID NO: 293301 - DNA, 20 bp, Artificial Sequence
  Description of Artificial Sequence: Synthetic oligonucleotide
  Target: ATXN1; (+) strand; PAM type: YTN; PAM sequence: TTA
ggtttttttgtttgtttgtt

SEQ ID NO: 293302 - DNA, 20 bp, Artificial Sequence
  Description of Artificial Sequence: Synthetic oligonucleotide
  Target: ATXN1; (+) strand; PAM type: YTN; PAM sequence: TTT
ttttgtttgtttgtttgttt

SEQ ID NO: 293303 - DNA, 20 bp, Artificial Sequence
  Description of Artificial Sequence: Synthetic oligonucleotide
  Target: ATXN1; (+) strand; PAM type: YTN; PAM sequence: TTT
tttgtttgtttgtttgtttg

SEQ ID NO: 293304 - DNA, 20 bp, Artificial Sequence
  Description of Artificial Sequence: Synthetic oligonucleotide
  Target: ATXN1; (+) strand; PAM type: YTN; PAM sequence: TTT
ttgtttgtttgtttgtttgt

SEQ ID NO: 293305 - DNA, 20 bp, Artificial Sequence
  Description of Artificial Sequence: Synthetic oligonucleotide
  Target: ATXN1; (+) strand; PAM type: YTN; PAM sequence: TTT
tgtttgtttgtttgtttgtt

SEQ ID NO: 293306 - DNA, 20 bp, Artificial Sequence
  Description of Artificial Sequence: Synthetic oligonucleotide
  Target: ATXN1; (+) strand; PAM type: YTN; PAM sequence: TTT
gtttgtttgtttgtttgttt

SEQ ID NO: 293307 - DNA, 20 bp, Artificial Sequence
  Description of Artificial Sequence: Synthetic oligonucleotide
  Target: ATXN1; (+) strand; PAM type: YTN; PAM sequence: TTG
tttgtttgtttgtttgtttt

SEQ ID NO: 293308 - DNA, 20 bp, Artificial Sequence
  Description of Artificial Sequence: Synthetic oligonucleotide
  Target: ATXN1; (+) strand; PAM type: YTN; PAM sequence: TTT
gtttgtttgtttgttttgtt

SEQ ID NO: 293309 - DNA, 20 bp, Artificial Sequence
  Description of Artificial Sequence: Synthetic oligonucleotide
  Target: ATXN1; (+) strand; PAM type: YTN; PAM sequence: TTG
tttgtttgtttgttttgttt

SEQ ID NO: 293310 - DNA, 20 bp, Artificial Sequence
  Description of Artificial Sequence: Synthetic oligonucleotide
  Target: ATXN1; (+) strand; PAM type: YTN; PAM sequence: TTT
gtttgtttgttttgtttttt

SEQ ID NO: 293311 - DNA, 20 bp, Artificial Sequence
  Description of Artificial Sequence: Synthetic oligonucleotide
  Target: ATXN1; (+) strand; PAM type: YTN; PAM sequence: TTG
tttgtttgttttgttttttt

SEQ ID NO: 293312 - DNA, 20 bp, Artificial Sequence
  Description of Artificial Sequence: Synthetic oligonucleotide
  Target: ATXN1; (+) strand; PAM type: YTN; PAM sequence: TTT
gtttgttttgttttttttga

SEQ ID NO: 293313 - DNA, 20 bp, Artificial Sequence
  Description of Artificial Sequence: Synthetic oligonucleotide
  Target: ATXN1; (+) strand; PAM type: YTN; PAM sequence: TTG
tttgttttgttttttttgag

SEQ ID NO: 293314 - DNA, 20 bp, Artificial Sequence
  Description of Artificial Sequence: Synthetic oligonucleotide
  Target: ATXN1; (+) strand; PAM type: YTN; PAM sequence: TTT
gttttgttttttttgagaag

SEQ ID NO: 293315 - DNA, 20 bp, Artificial Sequence
  Description of Artificial Sequence: Synthetic oligonucleotide
  Target: ATXN1; (+) strand; PAM type: YTN; PAM sequence: TTG
ttttgttttttttgagaaga

SEQ ID NO: 293316 - DNA, 20 bp, Artificial Sequence
  Description of Artificial Sequence: Synthetic oligonucleotide
  Target: ATXN1; (+) strand; PAM type: YTN; PAM sequence: TTT
tgttttttttgagaagaagt

SEQ ID NO: 293317 - DNA, 20 bp, Artificial Sequence
  Description of Artificial Sequence: Synthetic oligonucleotide
  Target: ATXN1; (+) strand; PAM type: YTN; PAM sequence: TTT
gttttttttgagaagaagtc

SEQ ID NO: 293318 - DNA, 20 bp, Artificial Sequence
  Description of Artificial Sequence: Synthetic oligonucleotide
  Target: ATXN1; (+) strand; PAM type: YTN; PAM sequence: TTG
ttttttttgagaagaagtct

SEQ ID NO: 293319 - DNA, 20 bp, Artificial Sequence
  Description of Artificial Sequence: Synthetic oligonucleotide
  Target: ATXN1; (+) strand; PAM type: YTN; PAM sequence: TTT
tttttgagaagaagtctcgc

SEQ ID NO: 293320 - DNA, 20 bp, Artificial Sequence
  Description of Artificial Sequence: Synthetic oligonucleotide
  Target: ATXN1; (+) strand; PAM type: YTN; PAM sequence: TTT
ttttgagaagaagtctcgct

SEQ ID NO: 293321 - DNA, 20 bp, Artificial Sequence
  Description of Artificial Sequence: Synthetic oligonucleotide
  Target: ATXN1; (+) strand; PAM type: YTN; PAM sequence: TTT
tttgagaagaagtctcgctc

SEQ ID NO: 293322 - DNA, 20 bp, Artificial Sequence
  Description of Artificial Sequence: Synthetic oligonucleotide
  Target: ATXN1; (+) strand; PAM type: YTN; PAM sequence: TTT
ttgagaagaagtctcgctct

SEQ ID NO: 293323 - DNA, 20 bp, Artificial Sequence
  Description of Artificial Sequence: Synthetic oligonucleotide
  Target: ATXN1; (+) strand; PAM type: YTN; PAM sequence: TTT
tgagaagaagtctcgctctg

SEQ ID NO: 293324 - DNA, 20 bp, Artificial Sequence
  Description of Artificial Sequence: Synthetic oligonucleotide
  Target: ATXN1; (+) strand; PAM type: YTN; PAM sequence: TTT
gagaagaagtctcgctctgt

SEQ ID NO: 293325 - DNA, 20 bp, Artificial Sequence
  Description of Artificial Sequence: Synthetic oligonucleotide
  Target: ATXN1; (+) strand; PAM type: YTN; PAM sequence: TTG
agaagaagtctcgctctgtc

SEQ ID NO: 293326 - DNA, 20 bp, Artificial Sequence
  Description of Artificial Sequence: Synthetic oligonucleotide
  Target: ATXN1; (+) strand; PAM type: YTN; PAM sequence: CTC
gctctgtcacccaggctgga

SEQ ID NO: 293327 - DNA, 20 bp, Artificial Sequence
  Description of Artificial Sequence: Synthetic oligonucleotide
  Target: ATXN1; (+) strand; PAM type: YTN; PAM sequence: CTC
tgtcacccaggctggaatgc

SEQ ID NO: 293328 - DNA, 20 bp, Artificial Sequence
  Description of Artificial Sequence: Synthetic oligonucleotide
  Target: ATXN1; (+) strand; PAM type: YTN; PAM sequence: CTG
tcacccaggctggaatgcag

SEQ ID NO: 293329 - DNA, 20 bp, Artificial Sequence
  Description of Artificial Sequence: Synthetic oligonucleotide
  Target: ATXN1; (+) strand; PAM type: YTN; PAM sequence: CTG
gaatgcagtggcaccatctc

SEQ ID NO: 293330 - DNA, 20 bp, Artificial Sequence
  Description of Artificial Sequence: Synthetic oligonucleotide
  Target: ATXN1; (+) strand; PAM type: YTN; PAM sequence: CTC
ggctcactgcaacctccacc

SEQ ID NO: 293331 - DNA, 20 bp, Artificial Sequence
  Description of Artificial Sequence: Synthetic oligonucleotide
  Target: ATXN1; (+) strand; PAM type: YTN; PAM sequence: CTC
actgcaacctccacctccca

SEQ ID NO: 293332 - DNA, 20 bp, Artificial Sequence
  Description of Artificial Sequence: Synthetic oligonucleotide
  Target: ATXN1; (+) strand; PAM type: YTN; PAM sequence: CTG
caacctccacctcccaggtt

SEQ ID NO: 293333 - DNA, 20 bp, Artificial Sequence
  Description of Artificial Sequence: Synthetic oligonucleotide
  Target: ATXN1; (+) strand; PAM type: YTN; PAM sequence: CTC
cacctcccaggttcaagcaa

SEQ ID NO: 293334 - DNA, 20 bp, Artificial Sequence
  Description of Artificial Sequence: Synthetic oligonucleotide
  Target: ATXN1; (+) strand; PAM type: YTN; PAM sequence: CTC
ccaggttcaagcaattctcc

SEQ ID NO: 293335 - DNA, 20 bp, Artificial Sequence
  Description of Artificial Sequence: Synthetic oligonucleotide
  Target: ATXN1; (+) strand; PAM type: YTN; PAM sequence: TTC
aagcaattctcctgtctcag

SEQ ID NO: 293336 - DNA, 20 bp, Artificial Sequence
  Description of Artificial Sequence: Synthetic oligonucleotide
  Target: ATXN1; (+) strand; PAM type: YTN; PAM sequence: TTC
tcctgtctcagacgcccaag

SEQ ID NO: 293337 - DNA, 20 bp, Artificial Sequence
  Description of Artificial Sequence: Synthetic oligonucleotide
  Target: ATXN1; (+) strand; PAM type: YTN; PAM sequence: CTC
ctgtctcagacgcccaagta

SEQ ID NO: 293338 - DNA, 20 bp, Artificial Sequence
  Description of Artificial Sequence: Synthetic oligonucleotide
  Target: ATXN1; (+) strand; PAM type: YTN; PAM sequence: CTG
tctcagacgcccaagtagct

SEQ ID NO: 293339 - DNA, 20 bp, Artificial Sequence
  Description of Artificial Sequence: Synthetic oligonucleotide
  Target: ATXN1; (+) strand; PAM type: YTN; PAM sequence: CTC
agacgcccaagtagctggga

SEQ ID NO: 293340 - DNA, 20 bp, Artificial Sequence
  Description of Artificial Sequence: Synthetic oligonucleotide
  Target: ATXN1; (+) strand; PAM type: YTN; PAM sequence: CTG
ggactacaggcacctgccac

SEQ ID NO: 293341 - DNA, 20 bp, Artificial Sequence
  Description of Artificial Sequence: Synthetic oligonucleotide
  Target: ATXN1; (+) strand; PAM type: YTN; PAM sequence: CTA
caggcacctgccaccacgcc

SEQ ID NO: 293342 - DNA, 20 bp, Artificial Sequence
  Description of Artificial Sequence: Synthetic oligonucleotide
  Target: ATXN1; (+) strand; PAM type: YTN; PAM sequence: CTG
ccaccacgcccggctaattt

SEQ ID NO: 293343 - DNA, 20 bp, Artificial Sequence
  Description of Artificial Sequence: Synthetic oligonucleotide
  Target: ATXN1; (+) strand; PAM type: YTN; PAM sequence: CTA
atttttatatttttagtaga

SEQ ID NO: 293344 - DNA, 20 bp, Artificial Sequence
  Description of Artificial Sequence: Synthetic oligonucleotide
  Target: ATXN1; (+) strand; PAM type: YTN; PAM sequence: TTT
ttatatttttagtagagatg

SEQ ID NO: 293345 - DNA, 20 bp, Artificial Sequence
  Description of Artificial Sequence: Synthetic oligonucleotide
  Target: ATXN1; (+) strand; PAM type: YTN; PAM sequence: TTT
tatatttttagtagagatgg

SEQ ID NO: 293346 - DNA, 20 bp, Artificial Sequence
  Description of Artificial Sequence: Synthetic oligonucleotide
  Target: ATXN1; (+) strand; PAM type: YTN; PAM sequence: TTT
atatttttagtagagatggg

SEQ ID NO: 293347 - DNA, 20 bp, Artificial Sequence
  Description of Artificial Sequence: Synthetic oligonucleotide
  Target: ATXN1; (+) strand; PAM type: YTN; PAM sequence: TTA
tatttttagtagagatgggg

SEQ ID NO: 293348 - DNA, 20 bp, Artificial Sequence
  Description of Artificial Sequence: Synthetic oligonucleotide
  Target: ATXN1; (+) strand; PAM type: YTN; PAM sequence: TTT
ttagtagagatggggtttca

SEQ ID NO: 293349 - DNA, 20 bp, Artificial Sequence
  Description of Artificial Sequence: Synthetic oligonucleotide
  Target: ATXN1; (+) strand; PAM type: YTN; PAM sequence: TTT
tagtagagatggggtttcac

SEQ ID NO: 293350 - DNA, 20 bp, Artificial Sequence
  Description of Artificial Sequence: Synthetic oligonucleotide
  Target: ATXN1; (+) strand; PAM type: YTN; PAM sequence: TTT
agtagagatggggtttcacc

SEQ ID NO: 293351 - DNA, 20 bp, Artificial Sequence
  Description of Artificial Sequence: Synthetic oligonucleotide
  Target: ATXN1; (+) strand; PAM type: YTN; PAM sequence: TTA
gtagagatggggtttcacca

SEQ ID NO: 293352 - DNA, 20 bp, Artificial Sequence
  Description of Artificial Sequence: Synthetic oligonucleotide
  Target: ATXN1; (+) strand; PAM type: YTN; PAM sequence: TTT
caccatattggccagggtgg

SEQ ID NO: 293353 - DNA, 20 bp, Artificial Sequence
  Description of Artificial Sequence: Synthetic oligonucleotide
  Target: ATXN1; (+) strand; PAM type: YTN; PAM sequence: TTC
accatattggccagggtggt

SEQ ID NO: 293354 - DNA, 20 bp, Artificial Sequence
  Description of Artificial Sequence: Synthetic oligonucleotide
  Target: ATXN1; (+) strand; PAM type: YTN; PAM sequence: TTG
gccagggtggtcttaacccc

SEQ ID NO: 293355 - DNA, 20 bp, Artificial Sequence
  Description of Artificial Sequence: Synthetic oligonucleotide
  Target: ATXN1; (+) strand; PAM type: YTN; PAM sequence: CTT
aacccctgaccttgtgatcc

SEQ ID NO: 293356 - DNA, 20 bp, Artificial Sequence
  Description of Artificial Sequence: Synthetic oligonucleotide
  Target: ATXN1; (+) strand; PAM type: YTN; PAM sequence: TTA
acccctgaccttgtgatcca

SEQ ID NO: 293357 - DNA, 20 bp, Artificial Sequence
  Description of Artificial Sequence: Synthetic oligonucleotide
  Target: ATXN1; (+) strand; PAM type: YTN; PAM sequence: CTG
accttgtgatccacccacca

SEQ ID NO: 293358 - DNA, 20 bp, Artificial Sequence
  Description of Artificial Sequence: Synthetic oligonucleotide
  Target: ATXN1; (+) strand; PAM type: YTN; PAM sequence: CTT
gtgatccacccaccatggcc

SEQ ID NO: 293359 - DNA, 20 bp, Artificial Sequence
  Description of Artificial Sequence: Synthetic oligonucleotide
  Target: ATXN1; (+) strand; PAM type: YTN; PAM sequence: TTG
tgatccacccaccatggcct

SEQ ID NO: 293360 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattacag

SEQ ID NO: 293361 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcgtgagccac

SEQ ID NO: 293362 - DNA, 20 bp, Artificial Sequence
  Description of Artificial Sequence: Synthetic oligonucleotide
  Target: ATXN1; (+) strand; PAM type: YTN; PAM sequence: TTA
caggcgtgagccaccgtgcc

SEQ ID NO: 293363 - DNA, 20 bp, Artificial Sequence
  Description of Artificial Sequence: Synthetic oligonucleotide
  Target: ATXN1; (+) strand; PAM type: YTN; PAM sequence: CTG
gcctgttttatttttcttat

SEQ ID NO: 293364 - DNA, 20 bp, Artificial Sequence
  Description of Artificial Sequence: Synthetic oligonucleotide
  Target: ATXN1; (+) strand; PAM type: YTN; PAM sequence: CTG
ttttatttttcttatttcat

SEQ ID NO: 293365 - DNA, 20 bp, Artificial Sequence
  Description of Artificial Sequence: Synthetic oligonucleotide
  Target: ATXN1; (+) strand; PAM type: YTN; PAM sequence: TTT
tatttttcttatttcatgga

SEQ ID NO: 293366 - DNA, 20 bp, Artificial Sequence
  Description of Artificial Sequence: Synthetic oligonucleotide
  Target: ATXN1; (+) strand; PAM type: YTN; PAM sequence: TTT
atttttcttatttcatggat

SEQ ID NO: 293367 - DNA, 20 bp, Artificial Sequence
  Description of Artificial Sequence: Synthetic oligonucleotide
  Target: ATXN1; (+) strand; PAM type: YTN; PAM sequence: TTA
tttttcttatttcatggatt

SEQ ID NO: 293368 - DNA, 20 bp, Artificial Sequence
  Description of Artificial Sequence: Synthetic oligonucleotide
  Target: ATXN1; (+) strand; PAM type: YTN; PAM sequence: TTT
ttcttatttcatggattgat

SEQ ID NO: 293369 - DNA, 20 bp, Artificial Sequence
  Description of Artificial Sequence: Synthetic oligonucleotide
  Target: ATXN1; (+) strand; PAM type: YTN; PAM sequence: TTT
tcttatttcatggattgata

SEQ ID NO: 293370 - DNA, 20 bp, Artificial Sequence
  Description of Artificial Sequence: Synthetic oligonucleotide
  Target: ATXN1; (+) strand; PAM type: YTN; PAM sequence: TTT
cttatttcatggattgataa

SEQ ID NO: 293371 - DNA, 20 bp, Artificial Sequence
  Description of Artificial Sequence: Synthetic oligonucleotide
  Target: ATXN1; (+) strand; PAM type: YTN; PAM sequence: TTC
ttatttcatggattgataaa

SEQ ID NO: 293372 - DNA, 20 bp, Artificial Sequence
  Description of Artificial Sequence: Synthetic oligonucleotide
  Target: ATXN1; (+) strand; PAM type: YTN; PAM sequence: CTT
atttcatggattgataaact

SEQ ID NO: 293373 - DNA, 20 bp, Artificial Sequence
  Description of Artificial Sequence: Synthetic oligonucleotide
  Target: ATXN1; (+) strand; PAM type: YTN; PAM sequence: TTA
tttcatggattgataaactg

SEQ ID NO: 293374 - DNA, 20 bp, Artificial Sequence
  Description of Artificial Sequence: Synthetic oligonucleotide
  Target: ATXN1; (+) strand; PAM type: YTN; PAM sequence: TTT
catggattgataaactgaga

SEQ ID NO: 293375 - DNA, 20 bp, Artificial Sequence
  Description of Artificial Sequence: Synthetic oligonucleotide
  Target: ATXN1; (+) strand; PAM type: YTN; PAM sequence: TTC
atggattgataaactgagac

SEQ ID NO: 293376 - DNA, 20 bp, Artificial Sequence
  Description of Artificial Sequence: Synthetic oligonucleotide
  Target: ATXN1; (+) strand; PAM type: YTN; PAM sequence: TTG
ataaactgagacccaaagag

SEQ ID NO: 293377 - DNA, 20 bp, Artificial Sequence
  Description of Artificial Sequence: Synthetic oligonucleotide
  Target: ATXN1; (+) strand; PAM type: YTN; PAM sequence: CTG
agacccaaagagattaagtc

SEQ ID NO: 293378 - DNA, 20 bp, Artificial Sequence
  Description of Artificial Sequence: Synthetic oligonucleotide
  Target: ATXN1; (+) strand; PAM type: YTN; PAM sequence: TTA
agtcacttgctcaacattac

SEQ ID NO: 293379 - DNA, 20 bp, Artificial Sequence
  Description of Artificial Sequence: Synthetic oligonucleotide
  Target: ATXN1; (+) strand; PAM type: YTN; PAM sequence: CTT
gctcaacattacacagccat

SEQ ID NO: 293380 - DNA, 20 bp, Artificial Sequence
  Description of Artificial Sequence: Synthetic oligonucleotide
  Target: ATXN1; (+) strand; PAM type: YTN; PAM sequence: TTG
ctcaacattacacagccatt

SEQ ID NO: 293381 - DNA, 20 bp, Artificial Sequence
  Description of Artificial Sequence: Synthetic oligonucleotide
  Target: ATXN1; (+) strand; PAM type: YTN; PAM sequence: CTC
aacattacacagccattaag

SEQ ID NO: 293382 - DNA, 20 bp, Artificial Sequence
  Description of Artificial Sequence: Synthetic oligonucleotide
  Target: ATXN1; (+) strand; PAM type: YTN; PAM sequence: TTA
cacagccattaagtggaagt

SEQ ID NO: 293383 - DNA, 20 bp, Artificial Sequence
  Description of Artificial Sequence: Synthetic oligonucleotide
  Target: ATXN1; (+) strand; PAM type: YTN; PAM sequence: TTA
agtggaagttcggtattcaa

SEQ ID NO: 293384 - DNA, 20 bp, Artificial Sequence
  Description of Artificial Sequence: Synthetic oligonucleotide
  Target: ATXN1; (+) strand; PAM type: YTN; PAM sequence: TTC
ggtattcaaacccaggaagt

SEQ ID NO: 293385 - DNA, 20 bp, Artificial Sequence
  Description of Artificial Sequence: Synthetic oligonucleotide
  Target: ATXN1; (+) strand; PAM type: YTN; PAM sequence: TTC
aaacccaggaagtttgcctc

SEQ ID NO: 293386 - DNA, 20 bp, Artificial Sequence
  Description of Artificial Sequence: Synthetic oligonucleotide
  Target: ATXN1; (+) strand; PAM type: YTN; PAM sequence: TTT
gcctcaagaacctacacttt

SEQ ID NO: 293387 - DNA, 20 bp, Artificial Sequence
  Description of Artificial Sequence: Synthetic oligonucleotide
  Target: ATXN1; (+) strand; PAM type: YTN; PAM sequence: TTG
cctcaagaacctacactttt

SEQ ID NO: 293388 - DNA, 20 bp, Artificial Sequence
  Description of Artificial Sequence: Synthetic oligonucleotide
  Target: ATXN1; (+) strand; PAM type: YTN; PAM sequence: CTC
aagaacctacacttttcaac

SEQ ID NO: 293389 - DNA, 20 bp, Artificial Sequence
  Description of Artificial Sequence: Synthetic oligonucleotide
  Target: ATXN1; (+) strand; PAM type: YTN; PAM sequence: CTA
cacttttcaacacatcatac

SEQ ID NO: 293390 - DNA, 20 bp, Artificial Sequence
  Description of Artificial Sequence: Synthetic oligonucleotide
  Target: ATXN1; (+) strand; PAM type: YTN; PAM sequence: CTT
ttcaacacatcatactgttt

SEQ ID NO: 293391 - DNA, 20 bp, Artificial Sequence
  Description of Artificial Sequence: Synthetic oligonucleotide
  Target: ATXN1; (+) strand; PAM type: YTN; PAM sequence: TTT
tcaacacatcatactgtttc

SEQ ID NO: 293392 - DNA, 20 bp, Artificial Sequence
  Description of Artificial Sequence: Synthetic oligonucleotide
  Target: ATXN1; (+) strand; PAM type: YTN; PAM sequence: TTT
caacacatcatactgtttct

SEQ ID NO: 293393 - DNA, 20 bp, Artificial Sequence
  Description of Artificial Sequence: Synthetic oligonucleotide
  Target: ATXN1; (+) strand; PAM type: YTN; PAM sequence: TTC
aacacatcatactgtttctc

SEQ ID NO: 293394 - DNA, 20 bp, Artificial Sequence
  Description of Artificial Sequence: Synthetic oligonucleotide
  Target: ATXN1; (+) strand; PAM type: YTN; PAM sequence: CTG
tttctcagcagcattataac

SEQ ID NO: 293395 - DNA, 20 bp, Artificial Sequence
  Description of Artificial Sequence: Synthetic oligonucleotide
  Target: ATXN1; (+) strand; PAM type: YTN; PAM sequence: TTT
ctcagcagcattataactat

SEQ ID NO: 293396 - DNA, 20 bp, Artificial Sequence
  Description of Artificial Sequence: Synthetic oligonucleotide
  Target: ATXN1; (+) strand; PAM type: YTN; PAM sequence: TTC
tcagcagcattataactatt

SEQ ID NO: 293397 - DNA, 20 bp, Artificial Sequence
  Description of Artificial Sequence: Synthetic oligonucleotide
  Target: ATXN1; (+) strand; PAM type: YTN; PAM sequence: CTC
agcagcattataactattta

SEQ ID NO: 293398 - DNA, 20 bp, Artificial Sequence
  Description of Artificial Sequence: Synthetic oligonucleotide
  Target: ATXN1; (+) strand; PAM type: YTN; PAM sequence: TTA
taactatttattgtgaacta

SEQ ID NO: 293399 - DNA, 20 bp, Artificial Sequence
  Description of Artificial Sequence: Synthetic oligonucleotide
  Target: ATXN1; (+) strand; PAM type: YTN; PAM sequence: CTA
tttattgtgaactacctaag

SEQ ID NO: 293400 - DNA, 20 bp, Artificial Sequence
  Description of Artificial Sequence: Synthetic oligonucleotide
  Target: ATXN1; (+) strand; PAM type: YTN; PAM sequence: TTT
attgtgaactacctaagaaa

SEQ ID NO: 293401 - DNA, 20 bp, Artificial Sequence
  Description of Artificial Sequence: Synthetic oligonucleotide
  Target: ATXN1; (+) strand; PAM type: YTN; PAM sequence: TTA
ttgtgaactacctaagaaaa

SEQ ID NO: 293402 - DNA, 20 bp, Artificial Sequence
  Description of Artificial Sequence: Synthetic oligonucleotide
  Target: ATXN1; (+) strand; PAM type: YTN; PAM sequence: TTG
tgaactacctaagaaaacat

SEQ ID NO: 293403 - DNA, 20 bp, Artificial Sequence
  Description of Artificial Sequence: Synthetic oligonucleotide
  Target: ATXN1; (+) strand; PAM type: YTN; PAM sequence: CTA
cctaagaaaacatatggtgg

SEQ ID NO: 293404 - DNA, 20 bp, Artificial Sequence
  Description of Artificial Sequence: Synthetic oligonucleotide
  Target: ATXN1; (+) strand; PAM type: YTN; PAM sequence: CTA
agaaaacatatggtggctgt

SEQ ID NO: 293405 - DNA, 20 bp, Artificial Sequence
  Description of Artificial Sequence: Synthetic oligonucleotide
  Target: ATXN1; (+) strand; PAM type: YTN; PAM sequence: CTG
taatcagttgtctcagggct

SEQ ID NO: 293406 - DNA, 20 bp, Artificial Sequence
  Description of Artificial Sequence: Synthetic oligonucleotide
  Target: ATXN1; (+) strand; PAM type: YTN; PAM sequence: TTG
tctcagggctagattttaaa

SEQ ID NO: 293407 - DNA, 20 bp, Artificial Sequence
  Description of Artificial Sequence: Synthetic oligonucleotide
  Target: ATXN1; (+) strand; PAM type: YTN; PAM sequence: CTC
agggctagattttaaatctt

SEQ ID NO: 293408 - DNA, 20 bp, Artificial Sequence
  Description of Artificial Sequence: Synthetic oligonucleotide
  Target: ATXN1; (+) strand; PAM type: YTN; PAM sequence: CTA
gattttaaatctttgagatc

SEQ ID NO: 293409 - DNA, 20 bp, Artificial Sequence
  Description of Artificial Sequence: Synthetic oligonucleotide
  Target: ATXN1; (+) strand; PAM type: YTN; PAM sequence: TTT
taaatctttgagatctgggg

SEQ ID NO: 293410 - DNA, 20 bp, Artificial Sequence
  Description of Artificial Sequence: Synthetic oligonucleotide
  Target: ATXN1; (+) strand; PAM type: YTN; PAM sequence: TTT
aaatctttgagatctgggga

SEQ ID NO: 293411 - DNA, 20 bp, Artificial Sequence
  Description of Artificial Sequence: Synthetic oligonucleotide
  Target: ATXN1; (+) strand; PAM type: YTN; PAM sequence: TTA
aatctttgagatctggggat

SEQ ID NO: 293412 - DNA, 20 bp, Artificial Sequence
  Description of Artificial Sequence: Synthetic oligonucleotide
  Target: ATXN1; (+) strand; PAM type: YTN; PAM sequence: CTT
tgagatctggggattgaata

SEQ ID NO: 293413 - DNA, 20 bp, Artificial Sequence
  Description of Artificial Sequence: Synthetic oligonucleotide
  Target: ATXN1; (+) strand; PAM type: YTN; PAM sequence: TTT
gagatctggggattgaatat

SEQ ID NO: 293414 - DNA, 20 bp, Artificial Sequence
  Description of Artificial Sequence: Synthetic oligonucleotide
  Target: ATXN1; (+) strand; PAM type: YTN; PAM sequence: TTG
agatctggggattgaatata

SEQ ID NO: 293415 - DNA, 20 bp, Artificial Sequence
  Description of Artificial Sequence: Synthetic oligonucleotide
  Target: ATXN1; (+) strand; PAM type: YTN; PAM sequence: CTG
gggattgaatatacagcaca

SEQ ID NO: 293416 - DNA, 20 bp, Artificial Sequence
  Description of Artificial Sequence: Synthetic oligonucleotide
  Target: ATXN1; (+) strand; PAM type: YTN; PAM sequence: TTG
aatatacagcacagtgacta

SEQ ID NO: 293417 - DNA, 20 bp, Artificial Sequence
  Description of Artificial Sequence: Synthetic oligonucleotide
  Target: ATXN1; (+) strand; PAM type: YTN; PAM sequence: CTA
tggttaataatgatatttgt

SEQ ID NO: 293418 - DNA, 20 bp, Artificial Sequence
  Description of Artificial Sequence: Synthetic oligonucleotide
  Target: ATXN1; (+) strand; PAM type: YTN; PAM sequence: TTA
ataatgatatttgtacactt

SEQ ID NO: 293419 - DNA, 20 bp, Artificial Sequence
  Description of Artificial Sequence: Synthetic oligonucleotide
  Target: ATXN1; (+) strand; PAM type: YTN; PAM sequence: TTT
gtacacttgaaatttgctga

SEQ ID NO: 293420 - DNA, 20 bp, Artificial Sequence
  Description of Artificial Sequence: Synthetic oligonucleotide
  Target: ATXN1; (+) strand; PAM type: YTN; PAM sequence: TTG
tacacttgaaatttgctgag

SEQ ID NO: 293421 - DNA, 20 bp, Artificial Sequence
  Description of Artificial Sequence: Synthetic oligonucleotide
  Target: ATXN1; (+) strand; PAM type: YTN; PAM sequence: CTT
gaaatttgctgagacagtaa

SEQ ID NO: 293422 - DNA, 20 bp, Artificial Sequence
  Description of Artificial Sequence: Synthetic oligonucleotide
  Target: ATXN1; (+) strand; PAM type: YTN; PAM sequence: TTG
aaatttgctgagacagtaaa

SEQ ID NO: 293423 - DNA, 20 bp, Artificial Sequence
  Description of Artificial Sequence: Synthetic oligonucleotide
  Target: ATXN1; (+) strand; PAM type: YTN; PAM sequence: TTT
gctgagacagtaaatcttaa

SEQ ID NO: 293424 - DNA, 20 bp, Artificial Sequence
  Description of Artificial Sequence: Synthetic oligonucleotide
  Target: ATXN1; (+) strand; PAM type: YTN; PAM sequence: TTG
ctgagacagtaaatcttaaa

SEQ ID NO: 293425 - DNA, 20 bp, Artificial Sequence
  Description of Artificial Sequence: Synthetic oligonucleotide
  Target: ATXN1; (+) strand; PAM type: YTN; PAM sequence: CTG
agacagtaaatcttaaatgt

SEQ ID NO: 293426 - DNA, 20 bp, Artificial Sequence
  Description of Artificial Sequence: Synthetic oligonucleotide
  Target: ATXN1; (+) strand; PAM type: YTN; PAM sequence: CTT
aaatgttctcaccatgcaag

SEQ ID NO: 293427 - DNA, 20 bp, Artificial Sequence
  Description of Artificial Sequence: Synthetic oligonucleotide
  Target: ATXN1; (+) strand; PAM type: YTN; PAM sequence: TTA
aatgttctcaccatgcaaga

SEQ ID NO: 293428 - DNA, 20 bp, Artificial Sequence
  Description of Artificial Sequence: Synthetic oligonucleotide
  Target: ATXN1; (+) strand; PAM type: YTN; PAM sequence: TTC
tcaccatgcaagaaaaaata

SEQ ID NO: 293429 - DNA, 20 bp, Artificial Sequence
  Description of Artificial Sequence: Synthetic oligonucleotide
  Target: ATXN1; (+) strand; PAM type: YTN; PAM sequence: CTC
accatgcaagaaaaaataac

SEQ ID NO: 293430 - DNA, 20 bp, Artificial Sequence
  Description of Artificial Sequence: Synthetic oligonucleotide
  Target: ATXN1; (+) strand; PAM type: YTN; PAM sequence: CTA
tgtgaggtgatgaaagtgtt

SEQ ID NO: 293431 - DNA, 20 bp, Artificial Sequence
  Description of Artificial Sequence: Synthetic oligonucleotide
  Target: ATXN1; (+) strand; PAM type: YTN; PAM sequence: TTA
actaacttgatgataataaa

SEQ ID NO: 293432 - DNA, 20 bp, Artificial Sequence
  Description of Artificial Sequence: Synthetic oligonucleotide
  Target: ATXN1; (+) strand; PAM type: YTN; PAM sequence: CTA
acttgatgataataaacatt

SEQ ID NO: 293433 - DNA, 20 bp, Artificial Sequence
  Description of Artificial Sequence: Synthetic oligonucleotide
  Target: ATXN1; (+) strand; PAM type: YTN; PAM sequence: CTT
gatgataataaacatttcac

SEQ ID NO: 293434 - DNA, 20 bp, Artificial Sequence
  Description of Artificial Sequence: Synthetic oligonucleotide
  Target: ATXN1; (+) strand; PAM type: YTN; PAM sequence: TTG
atgataataaacatttcaca

SEQ ID NO: 293435 - DNA, 20 bp, Artificial Sequence
  Description of Artificial Sequence: Synthetic oligonucleotide
  Target: ATXN1; (+) strand; PAM type: YTN; PAM sequence: TTT
cacaatatatatgtatatca

SEQ ID NO: 293436 - DNA, 20 bp, Artificial Sequence
  Description of Artificial Sequence: Synthetic oligonucleotide
  Target: ATXN1; (+) strand; PAM type: YTN; PAM sequence: TTC
acaatatatatgtatatcaa

SEQ ID NO: 293437 - DNA, 20 bp, Artificial Sequence
  Description of Artificial Sequence: Synthetic oligonucleotide
  Target: ATXN1; (+) strand; PAM type: YTN; PAM sequence: TTG
tacacaaattttgtcaatca

SEQ ID NO: 293438 - DNA, 20 bp, Artificial Sequence
  Description of Artificial Sequence: Synthetic oligonucleotide
  Target: ATXN1; (+) strand; PAM type: YTN; PAM sequence: TTT
tgtcaatcataactcaataa

SEQ ID NO: 293439 - DNA, 20 bp, Artificial Sequence
  Description of Artificial Sequence: Synthetic oligonucleotide
  Target: ATXN1; (+) strand; PAM type: YTN; PAM sequence: TTT
gtcaatcataactcaataat

SEQ ID NO: 293440 - DNA, 20 bp, Artificial Sequence
  Description of Artificial Sequence: Synthetic oligonucleotide
  Target: ATXN1; (+) strand; PAM type: YTN; PAM sequence: TTG
tcaatcataactcaataatg

SEQ ID NO: 293441 - DNA, 20 bp, Artificial Sequence
  Description of Artificial Sequence: Synthetic oligonucleotide
  Target: ATXN1; (+) strand; PAM type: YTN; PAM sequence: CTC
aataatgctggaaaaataaa

SEQ ID NO: 293442 - DNA, 20 bp, Artificial Sequence
  Description of Artificial Sequence: Synthetic oligonucleotide
  Target: ATXN1; (+) strand; PAM type: YTN; PAM sequence: CTG
gaaaaataaaataaggccgg

SEQ ID NO: 293443 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 293444 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 293445 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgagacgggtgg

SEQ ID NO: 293446 - DNA, 20 bp, Artificial Sequence
  Description of Artificial Sequence: Synthetic oligonucleotide
  Target: ATXN1; (+) strand; PAM type: YTN; PAM sequence: TTT
gggaggctgagacgggtgga

SEQ ID NO: 293447 - DNA, 20 bp, Artificial Sequence
  Description of Artificial Sequence: Synthetic oligonucleotide
  Target: ATXN1; (+) strand; PAM type: YTN; PAM sequence: TTG
ggaggctgagacgggtggat

SEQ ID NO: 293448 - DNA, 20 bp, Artificial Sequence
  Description of Artificial Sequence: Synthetic oligonucleotide
  Target: ATXN1; (+) strand; PAM type: YTN; PAM sequence: CTG
agacgggtggatcatctgag

SEQ ID NO: 293449 - DNA, 20 bp, Artificial Sequence
  Description of Artificial Sequence: Synthetic oligonucleotide
  Target: ATXN1; (+) strand; PAM type: YTN; PAM sequence: CTG
aggtcaggagtttgaggcca

SEQ ID NO: 293450 - DNA, 20 bp, Artificial Sequence
  Description of Artificial Sequence: Synthetic oligonucleotide
  Target: ATXN1; (+) strand; PAM type: YTN; PAM sequence: TTT
gaggccatcctggccaatac

SEQ ID NO: 293451 - DNA, 20 bp, Artificial Sequence
  Description of Artificial Sequence: Synthetic oligonucleotide
  Target: ATXN1; (+) strand; PAM type: YTN; PAM sequence: TTG
aggccatcctggccaatacg

SEQ ID NO: 293452 - DNA, 20 bp, Artificial Sequence
  Description of Artificial Sequence: Synthetic oligonucleotide
  Target: ATXN1; (+) strand; PAM type: YTN; PAM sequence: CTG
gccaatacggtgagaccccc

SEQ ID NO: 293453 - DNA, 20 bp, Artificial Sequence
  Description of Artificial Sequence: Synthetic oligonucleotide
  Target: ATXN1; (+) strand; PAM type: YTN; PAM sequence: CTC
tctactaaaaatacaaaaat

SEQ ID NO: 293454 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 293455 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattatc

SEQ ID NO: 293456 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattatctgg

SEQ ID NO: 293457 - DNA, 20 bp, Artificial Sequence
  Description of Artificial Sequence: Synthetic oligonucleotide
  Target: ATXN1; (+) strand; PAM type: YTN; PAM sequence: TTA
tctgggtgtagtggcaggtg

SEQ ID NO: 293458 - DNA, 20 bp, Artificial Sequence
  Description of Artificial Sequence: Synthetic oligonucleotide
  Target: ATXN1; (+) strand; PAM type: YTN; PAM sequence: CTG
ggtgtagtggcaggtgcctg

SEQ ID NO: 293459 - DNA, 20 bp, Artificial Sequence
  Description of Artificial Sequence: Synthetic oligonucleotide
  Target: ATXN1; (+) strand; PAM type: YTN; PAM sequence: CTG
taatcccagctacttgggag

SEQ ID NO: 293460 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgaggcagaa

SEQ ID NO: 293461 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggcagaagat

SEQ ID NO: 293462 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcagaagatc

SEQ ID NO: 293463 - DNA, 20 bp, Artificial Sequence
  Description of Artificial Sequence: Synthetic oligonucleotide
  Target: ATXN1; (+) strand; PAM type: YTN; PAM sequence: CTG
aggcagaagatctcttgaac

SEQ ID NO: 293464 - DNA, 20 bp, Artificial Sequence
  Description of Artificial Sequence: Synthetic oligonucleotide
  Target: ATXN1; (+) strand; PAM type: YTN; PAM sequence: CTC
ttgaacccaggaggcggagg

SEQ ID NO: 293465 - DNA, 20 bp, Artificial Sequence
  Description of Artificial Sequence: Synthetic oligonucleotide
  Target: ATXN1; (+) strand; PAM type: YTN; PAM sequence: CTT
gaacccaggaggcggaggct

SEQ ID NO: 293466 - DNA, 20 bp, Artificial Sequence
  Description of Artificial Sequence: Synthetic oligonucleotide
  Target: ATXN1; (+) strand; PAM type: YTN; PAM sequence: TTG
aacccaggaggcggaggctg

SEQ ID NO: 293467 - DNA, 20 bp, Artificial Sequence
  Description of Artificial Sequence: Synthetic oligonucleotide
  Target: ATXN1; (+) strand; PAM type: YTN; PAM sequence: CTG
cagtgagccgaaattgcgct

SEQ ID NO: 293468 - DNA, 20 bp, Artificial Sequence
  Description of Artificial Sequence: Synthetic oligonucleotide
  Target: ATXN1; (+) strand; PAM type: YTN; PAM sequence: TTG
cgctattgcactccagcctg

SEQ ID NO: 293469 - DNA, 20 bp, Artificial Sequence
  Description of Artificial Sequence: Synthetic oligonucleotide
  Target: ATXN1; (+) strand; PAM type: YTN; PAM sequence: CTA
ttgcactccagcctgggcaa

SEQ ID NO: 293470 - DNA, 20 bp, Artificial Sequence
  Description of Artificial Sequence: Synthetic oligonucleotide
  Target: ATXN1; (+) strand; PAM type: YTN; PAM sequence: TTG
cactccagcctgggcaacaa

SEQ ID NO: 293471 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcaacaagaacg

SEQ ID NO: 293472 - DNA, 20 bp, Artificial Sequence
  Description of Artificial Sequence: Synthetic oligonucleotide
  Target: ATXN1; (+) strand; PAM type: YTN; PAM sequence: CTG
ggcaacaagaacgaaactcc

SEQ ID NO: 293473 - DNA, 20 bp, Artificial Sequence
  Description of Artificial Sequence: Synthetic oligonucleotide
  Target: ATXN1; (+) strand; PAM type: YTN; PAM sequence: CTC
catctcaaaaacaaaataaa

SEQ ID NO: 293474 - DNA, 20 bp, Artificial Sequence
  Description of Artificial Sequence: Synthetic oligonucleotide
  Target: ATXN1; (+) strand; PAM type: YTN; PAM sequence: CTC
aaaaacaaaataaaataaaa

SEQ ID NO: 293475 - DNA, 20 bp, Artificial Sequence
  Description of Artificial Sequence: Synthetic oligonucleotide
  Target: ATXN1; (+) strand; PAM type: YTN; PAM sequence: CTT
tgggatccatcaaggtactc

SEQ ID NO: 293476 - DNA, 20 bp, Artificial Sequence
  Description of Artificial Sequence: Synthetic oligonucleotide
  Target: ATXN1; (+) strand; PAM type: YTN; PAM sequence: TTT
gggatccatcaaggtactct

SEQ ID NO: 293477 - DNA, 20 bp, Artificial Sequence
  Description of Artificial Sequence: Synthetic oligonucleotide
  Target: ATXN1; (+) strand; PAM type: YTN; PAM sequence: TTG
ggatccatcaaggtactctg

SEQ ID NO: 293478 - DNA, 20 bp, Artificial Sequence
  Description of Artificial Sequence: Synthetic oligonucleotide
  Target: ATXN1; (+) strand; PAM type: YTN; PAM sequence: CTC
tggtctgtatgtagatcctt

SEQ ID NO: 293479 - DNA, 20 bp, Artificial Sequence
  Description of Artificial Sequence: Synthetic oligonucleotide
  Target: ATXN1; (+) strand; PAM type: YTN; PAM sequence: CTG
gtctgtatgtagatccttaa

SEQ ID NO: 293480 - DNA, 20 bp, Artificial Sequence
  Description of Artificial Sequence: Synthetic oligonucleotide
  Target: ATXN1; (+) strand; PAM type: YTN; PAM sequence: CTG
tatgtagatccttaagattt

SEQ ID NO: 293481 - DNA, 20 bp, Artificial Sequence
  Description of Artificial Sequence: Synthetic oligonucleotide
  Target: ATXN1; (+) strand; PAM type: YTN; PAM sequence: CTT
aagatttcaggactagttca

SEQ ID NO: 293482 - DNA, 20 bp, Artificial Sequence
  Description of Artificial Sequence: Synthetic oligonucleotide
  Target: ATXN1; (+) strand; PAM type: YTN; PAM sequence: TTA
agatttcaggactagttcac

SEQ ID NO: 293483 - DNA, 20 bp, Artificial Sequence
  Description of Artificial Sequence: Synthetic oligonucleotide
  Target: ATXN1; (+) strand; PAM type: YTN; PAM sequence: TTT
caggactagttcacttctct

SEQ ID NO: 293484 - DNA, 20 bp, Artificial Sequence
  Description of Artificial Sequence: Synthetic oligonucleotide
  Target: ATXN1; (+) strand; PAM type: YTN; PAM sequence: TTC
aggactagttcacttctctt

SEQ ID NO: 293485 - DNA, 20 bp, Artificial Sequence
  Description of Artificial Sequence: Synthetic oligonucleotide
  Target: ATXN1; (+) strand; PAM type: YTN; PAM sequence: CTA
gttcacttctcttttatatc

SEQ ID NO: 293486 - DNA, 20 bp, Artificial Sequence
  Description of Artificial Sequence: Synthetic oligonucleotide
  Target: ATXN1; (+) strand; PAM type: YTN; PAM sequence: TTC
acttctcttttatatccttc

SEQ ID NO: 293487 - DNA, 20 bp, Artificial Sequence
  Description of Artificial Sequence: Synthetic oligonucleotide
  Target: ATXN1; (+) strand; PAM type: YTN; PAM sequence: CTT
ctcttttatatccttcctca

SEQ ID NO: 293488 - DNA, 20 bp, Artificial Sequence
  Description of Artificial Sequence: Synthetic oligonucleotide
  Target: ATXN1; (+) strand; PAM type: YTN; PAM sequence: TTC
tcttttatatccttcctcat

SEQ ID NO: 293489 - DNA, 20 bp, Artificial Sequence
  Description of Artificial Sequence: Synthetic oligonucleotide
  Target: ATXN1; (+) strand; PAM type: YTN; PAM sequence: CTC
ttttatatccttcctcattg

SEQ ID NO: 293490 - DNA, 20 bp, Artificial Sequence
  Description of Artificial Sequence: Synthetic oligonucleotide
  Target: ATXN1; (+) strand; PAM type: YTN; PAM sequence: CTT
ttatatccttcctcattgaa

SEQ ID NO: 293491 - DNA, 20 bp, Artificial Sequence
  Description of Artificial Sequence: Synthetic oligonucleotide
  Target: ATXN1; (+) strand; PAM type: YTN; PAM sequence: TTT
tatatccttcctcattgaag

SEQ ID NO: 293492 - DNA, 20 bp, Artificial Sequence
  Description of Artificial Sequence: Synthetic oligonucleotide
  Target: ATXN1; (+) strand; PAM type: YTN; PAM sequence: TTT
atatccttcctcattgaagc

SEQ ID NO: 293493 - DNA, 20 bp, Artificial Sequence
  Description of Artificial Sequence: Synthetic oligonucleotide
  Target: ATXN1; (+) strand; PAM type: YTN; PAM sequence: TTA
tatccttcctcattgaagct

SEQ ID NO: 293494 - DNA, 20 bp, Artificial Sequence
  Description of Artificial Sequence: Synthetic oligonucleotide
  Target: ATXN1; (+) strand; PAM type: YTN; PAM sequence: CTT
cctcattgaagctactattg

SEQ ID NO: 293495 - DNA, 20 bp, Artificial Sequence
  Description of Artificial Sequence: Synthetic oligonucleotide
  Target: ATXN1; (+) strand; PAM type: YTN; PAM sequence: TTC
ctcattgaagctactattgc

SEQ ID NO: 293496 - DNA, 20 bp, Artificial Sequence
  Description of Artificial Sequence: Synthetic oligonucleotide
  Target: ATXN1; (+) strand; PAM type: YTN; PAM sequence: CTC
attgaagctactattgctta

SEQ ID NO: 293497 - DNA, 20 bp, Artificial Sequence
  Description of Artificial Sequence: Synthetic oligonucleotide
  Target: ATXN1; (+) strand; PAM type: YTN; PAM sequence: TTG
aagctactattgcttacaga

SEQ ID NO: 293498 - DNA, 20 bp, Artificial Sequence
  Description of Artificial Sequence: Synthetic oligonucleotide
  Target: ATXN1; (+) strand; PAM type: YTN; PAM sequence: CTA
ctattgcttacagacacttc

SEQ ID NO: 293499 - DNA, 20 bp, Artificial Sequence
  Description of Artificial Sequence: Synthetic oligonucleotide
  Target: ATXN1; (+) strand; PAM type: YTN; PAM sequence: CTA
ttgcttacagacacttcctt

SEQ ID NO: 293500 - DNA, 20 bp, Artificial Sequence
  Description of Artificial Sequence: Synthetic oligonucleotide
  Target: ATXN1; (+) strand; PAM type: YTN; PAM sequence: TTG
cttacagacacttcctttcc

SEQ ID NO: 293501 - DNA, 20 bp, Artificial Sequence
  Description of Artificial Sequence: Synthetic oligonucleotide
  Target: ATXN1; (+) strand; PAM type: YTN; PAM sequence: CTT
acagacacttcctttcctgc

SEQ ID NO: 293502 - DNA, 20 bp, Artificial Sequence
  Description of Artificial Sequence: Synthetic oligonucleotide
  Target: ATXN1; (+) strand; PAM type: YTN; PAM sequence: TTA
cagacacttcctttcctgct

SEQ ID NO: 293503 - DNA, 20 bp, Artificial Sequence
  Description of Artificial Sequence: Synthetic oligonucleotide
  Target: ATXN1; (+) strand; PAM type: YTN; PAM sequence: CTT
cctttcctgctacagccaac

SEQ ID NO: 293504 - DNA, 20 bp, Artificial Sequence
  Description of Artificial Sequence: Synthetic oligonucleotide
  Target: ATXN1; (+) strand; PAM type: YTN; PAM sequence: TTC
ctttcctgctacagccaaca

SEQ ID NO: 293505 - DNA, 20 bp, Artificial Sequence
  Description of Artificial Sequence: Synthetic oligonucleotide
  Target: ATXN1; (+) strand; PAM type: YTN; PAM sequence: CTT
tcctgctacagccaacacta

SEQ ID NO: 293506 - DNA, 20 bp, Artificial Sequence
  Description of Artificial Sequence: Synthetic oligonucleotide
  Target: ATXN1; (+) strand; PAM type: YTN; PAM sequence: TTT
cctgctacagccaacactag

SEQ ID NO: 293507 - DNA, 20 bp, Artificial Sequence
  Description of Artificial Sequence: Synthetic oligonucleotide
  Target: ATXN1; (+) strand; PAM type: YTN; PAM sequence: TTC
ctgctacagccaacactagg

SEQ ID NO: 293508 - DNA, 20 bp, Artificial Sequence
  Description of Artificial Sequence: Synthetic oligonucleotide
  Target: ATXN1; (+) strand; PAM type: YTN; PAM sequence: CTG
ctacagccaacactaggcaa

SEQ ID NO: 293509 - DNA, 20 bp, Artificial Sequence
  Description of Artificial Sequence: Synthetic oligonucleotide
  Target: ATXN1; (+) strand; PAM type: YTN; PAM sequence: CTA
cagccaacactaggcaacct

SEQ ID NO: 293510 - DNA, 20 bp, Artificial Sequence
  Description of Artificial Sequence: Synthetic oligonucleotide
  Target: ATXN1; (+) strand; PAM type: YTN; PAM sequence: CTA
ggcaaccttggagagggtac

SEQ ID NO: 293511 - DNA, 20 bp, Artificial Sequence
  Description of Artificial Sequence: Synthetic oligonucleotide
  Target: ATXN1; (+) strand; PAM type: YTN; PAM sequence: CTT
ggagagggtacagccacaat

SEQ ID NO: 293512 - DNA, 20 bp, Artificial Sequence
  Description of Artificial Sequence: Synthetic oligonucleotide
  Target: ATXN1; (+) strand; PAM type: YTN; PAM sequence: TTG
gagagggtacagccacaata

SEQ ID NO: 293513 - DNA, 20 bp, Artificial Sequence
  Description of Artificial Sequence: Synthetic oligonucleotide
  Target: ATXN1; (+) strand; PAM type: YTN; PAM sequence: CTG
cagagggcagttcaacataa

SEQ ID NO: 293514 - DNA, 20 bp, Artificial Sequence
  Description of Artificial Sequence: Synthetic oligonucleotide
  Target: ATXN1; (+) strand; PAM type: YTN; PAM sequence: TTC
aacataagcacctactatat

SEQ ID NO: 293515 - DNA, 20 bp, Artificial Sequence
  Description of Artificial Sequence: Synthetic oligonucleotide
  Target: ATXN1; (+) strand; PAM type: YTN; PAM sequence: CTA
ctatattgagaggcacctta

SEQ ID NO: 293516 - DNA, 20 bp, Artificial Sequence
  Description of Artificial Sequence: Synthetic oligonucleotide
  Target: ATXN1; (+) strand; PAM type: YTN; PAM sequence: CTA
tattgagaggcaccttaggt

SEQ ID NO: 293517 - DNA, 20 bp, Artificial Sequence
  Description of Artificial Sequence: Synthetic oligonucleotide
  Target: ATXN1; (+) strand; PAM type: YTN; PAM sequence: TTG
agaggcaccttaggttgtaa

SEQ ID NO: 293518 - DNA, 20 bp, Artificial Sequence
  Description of Artificial Sequence: Synthetic oligonucleotide
  Target: ATXN1; (+) strand; PAM type: YTN; PAM sequence: CTT
aggttgtaatgaaaagcgtc

SEQ ID NO: 293519 - DNA, 20 bp, Artificial Sequence
  Description of Artificial Sequence: Synthetic oligonucleotide
  Target: ATXN1; (+) strand; PAM type: YTN; PAM sequence: TTA
ggttgtaatgaaaagcgtca

SEQ ID NO: 293520 - DNA, 20 bp, Artificial Sequence
  Description of Artificial Sequence: Synthetic oligonucleotide
  Target: ATXN1; (+) strand; PAM type: YTN; PAM sequence: TTG
taatgaaaagcgtcatagtc

SEQ ID NO: 293521 - DNA, 20 bp, Artificial Sequence
  Description of Artificial Sequence: Synthetic oligonucleotide
  Target: ATXN1; (+) strand; PAM type: YTN; PAM sequence: CTA
attgccttcctgagtttttg

SEQ ID NO: 293522 - DNA, 20 bp, Artificial Sequence
  Description of Artificial Sequence: Synthetic oligonucleotide
  Target: ATXN1; (+) strand; PAM type: YTN; PAM sequence: TTG
ccttcctgagtttttgtcac

SEQ ID NO: 293523 - DNA, 20 bp, Artificial Sequence
  Description of Artificial Sequence: Synthetic oligonucleotide
  Target: ATXN1; (+) strand; PAM type: YTN; PAM sequence: CTT
cctgagtttttgtcactagg

SEQ ID NO: 293524 - DNA, 20 bp, Artificial Sequence
  Description of Artificial Sequence: Synthetic oligonucleotide
  Target: ATXN1; (+) strand; PAM type: YTN; PAM sequence: TTC
ctgagtttttgtcactaggt

SEQ ID NO: 293525 - DNA, 20 bp, Artificial Sequence
  Description of Artificial Sequence: Synthetic oligonucleotide
  Target: ATXN1; (+) strand; PAM type: YTN; PAM sequence: CTG
agtttttgtcactaggtact

SEQ ID NO: 293526 - DNA, 20 bp, Artificial Sequence
  Description of Artificial Sequence: Synthetic oligonucleotide
  Target: ATXN1; (+) strand; PAM type: YTN; PAM sequence: TTT
ttgtcactaggtacttagga

SEQ ID NO: 293527 - DNA, 20 bp, Artificial Sequence
  Description of Artificial Sequence: Synthetic oligonucleotide
  Target: ATXN1; (+) strand; PAM type: YTN; PAM sequence: TTT
tgtcactaggtacttaggat

SEQ ID NO: 293528 - DNA, 20 bp, Artificial Sequence
  Description of Artificial Sequence: Synthetic oligonucleotide
  Target: ATXN1; (+) strand; PAM type: YTN; PAM sequence: TTT
gtcactaggtacttaggatg

SEQ ID NO: 293529 - DNA, 20 bp, Artificial Sequence
  Description of Artificial Sequence: Synthetic oligonucleotide
  Target: ATXN1; (+) strand; PAM type: YTN; PAM sequence: TTG
tcactaggtacttaggatgc

SEQ ID NO: 293530 - DNA, 20 bp, Artificial Sequence
  Description of Artificial Sequence: Synthetic oligonucleotide
  Target: ATXN1; (+) strand; PAM type: YTN; PAM sequence: CTA
ggtacttaggatgcttctga

SEQ ID NO: 293531 - DNA, 20 bp, Artificial Sequence
  Description of Artificial Sequence: Synthetic oligonucleotide
  Target: ATXN1; (+) strand; PAM type: YTN; PAM sequence: CTT
aggatgcttctgagccctgg

SEQ ID NO: 293532 - DNA, 20 bp, Artificial Sequence
  Description of Artificial Sequence: Synthetic oligonucleotide
  Target: ATXN1; (+) strand; PAM type: YTN; PAM sequence: TTA
ggatgcttctgagccctggc

SEQ ID NO: 293533 - DNA, 20 bp, Artificial Sequence
  Description of Artificial Sequence: Synthetic oligonucleotide
  Target: ATXN1; (+) strand; PAM type: YTN; PAM sequence: CTT
ctgagccctggctctcatga

SEQ ID NO: 293534 - DNA, 20 bp, Artificial Sequence
  Description of Artificial Sequence: Synthetic oligonucleotide
  Target: ATXN1; (+) strand; PAM type: YTN; PAM sequence: TTC
tgagccctggctctcatgaa

SEQ ID NO: 293535 - DNA, 20 bp, Artificial Sequence
  Description of Artificial Sequence: Synthetic oligonucleotide
  Target: ATXN1; (+) strand; PAM type: YTN; PAM sequence: CTG
agccctggctctcatgaaag

SEQ ID NO: 293536 - DNA, 20 bp, Artificial Sequence
  Description of Artificial Sequence: Synthetic oligonucleotide
  Target: ATXN1; (+) strand; PAM type: YTN; PAM sequence: CTG
gctctcatgaaagtgcaaca

SEQ ID NO: 293537 - DNA, 20 bp, Artificial Sequence
  Description of Artificial Sequence: Synthetic oligonucleotide
  Target: ATXN1; (+) strand; PAM type: YTN; PAM sequence: CTC
tcatgaaagtgcaacaaaat

SEQ ID NO: 293538 - DNA, 20 bp, Artificial Sequence
  Description of Artificial Sequence: Synthetic oligonucleotide
  Target: ATXN1; (+) strand; PAM type: YTN; PAM sequence: CTC
atgaaagtgcaacaaaatat

SEQ ID NO: 293539 - DNA, 20 bp, Artificial Sequence
  Description of Artificial Sequence: Synthetic oligonucleotide
  Target: ATXN1; (+) strand; PAM type: YTN; PAM sequence: CTC
ctgatgaatgaactgtaaca

SEQ ID NO: 293540 - DNA, 20 bp, Artificial Sequence
  Description of Artificial Sequence: Synthetic oligonucleotide
  Target: ATXN1; (+) strand; PAM type: YTN; PAM sequence: CTG
atgaatgaactgtaacagtc

SEQ ID NO: 293541 - DNA, 20 bp, Artificial Sequence
  Description of Artificial Sequence: Synthetic oligonucleotide
  Target: ATXN1; (+) strand; PAM type: YTN; PAM sequence: CTG
taacagtcaccaaaaaagtt

SEQ ID NO: 293542 - DNA, 20 bp, Artificial Sequence
  Description of Artificial Sequence: Synthetic oligonucleotide
  Target: ATXN1; (+) strand; PAM type: YTN; PAM sequence: TTT
gcaaccccatggctagtgca

SEQ ID NO: 293543 - DNA, 20 bp, Artificial Sequence
  Description of Artificial Sequence: Synthetic oligonucleotide
  Target: ATXN1; (+) strand; PAM type: YTN; PAM sequence: TTG
caaccccatggctagtgcaa

SEQ ID NO: 293544 - DNA, 20 bp, Artificial Sequence
  Description of Artificial Sequence: Synthetic oligonucleotide
  Target: ATXN1; (+) strand; PAM type: YTN; PAM sequence: CTA
gtgcaacagaatagctaaag

SEQ ID NO: 293545 - DNA, 20 bp, Artificial Sequence
  Description of Artificial Sequence: Synthetic oligonucleotide
  Target: ATXN1; (+) strand; PAM type: YTN; PAM sequence: CTA
aagggaaactgggagtctgc

SEQ ID NO: 293546 - DNA, 20 bp, Artificial Sequence
  Description of Artificial Sequence: Synthetic oligonucleotide
  Target: ATXN1; (+) strand; PAM type: YTN; PAM sequence: CTG
ggagtctgcacattcacctt

SEQ ID NO: 293547 - DNA, 20 bp, Artificial Sequence
  Description of Artificial Sequence: Synthetic oligonucleotide
  Target: ATXN1; (+) strand; PAM type: YTN; PAM sequence: CTG
cacattcaccttagccatgg

SEQ ID NO: 293548 - DNA, 20 bp, Artificial Sequence
  Description of Artificial Sequence: Synthetic oligonucleotide
  Target: ATXN1; (+) strand; PAM type: YTN; PAM sequence: TTC
accttagccatggtatattt

SEQ ID NO: 293549 - DNA, 20 bp, Artificial Sequence
  Description of Artificial Sequence: Synthetic oligonucleotide
  Target: ATXN1; (+) strand; PAM type: YTN; PAM sequence: CTT
agccatggtatatttcatga

SEQ ID NO: 293550 - DNA, 20 bp, Artificial Sequence
  Description of Artificial Sequence: Synthetic oligonucleotide
  Target: ATXN1; (+) strand; PAM type: YTN; PAM sequence: TTA
gccatggtatatttcatgat

SEQ ID NO: 293551 - DNA, 20 bp, Artificial Sequence
  Description of Artificial Sequence: Synthetic oligonucleotide
  Target: ATXN1; (+) strand; PAM type: YTN; PAM sequence: TTT
catgatggatcttgtaaaca

SEQ ID NO: 293552 - DNA, 20 bp, Artificial Sequence
  Description of Artificial Sequence: Synthetic oligonucleotide
  Target: ATXN1; (+) strand; PAM type: YTN; PAM sequence: TTC
atgatggatcttgtaaacag

SEQ ID NO: 293553 - DNA, 20 bp, Artificial Sequence
  Description of Artificial Sequence: Synthetic oligonucleotide
  Target: ATXN1; (+) strand; PAM type: YTN; PAM sequence: CTT
gtaaacagctgaagggtcag

SEQ ID NO: 293554 - DNA, 20 bp, Artificial Sequence
  Description of Artificial Sequence: Synthetic oligonucleotide
  Target: ATXN1; (+) strand; PAM type: YTN; PAM sequence: TTG
taaacagctgaagggtcagg

SEQ ID NO: 293555 - DNA, 20 bp, Artificial Sequence
  Description of Artificial Sequence: Synthetic oligonucleotide
  Target: ATXN1; (+) strand; PAM type: YTN; PAM sequence: CTG
aagggtcaggtttttaaatg

SEQ ID NO: 293556 - DNA, 20 bp, Artificial Sequence
  Description of Artificial Sequence: Synthetic oligonucleotide
  Target: ATXN1; (+) strand; PAM type: YTN; PAM sequence: TTT
ttaaatgaatgcaaagatca

SEQ ID NO: 293557 - DNA, 20 bp, Artificial Sequence
  Description of Artificial Sequence: Synthetic oligonucleotide
  Target: ATXN1; (+) strand; PAM type: YTN; PAM sequence: TTT
taaatgaatgcaaagatcag

SEQ ID NO: 293558 - DNA, 20 bp, Artificial Sequence
  Description of Artificial Sequence: Synthetic oligonucleotide
  Target: ATXN1; (+) strand; PAM type: YTN; PAM sequence: TTT
aaatgaatgcaaagatcagg

SEQ ID NO: 293559 - DNA, 20 bp, Artificial Sequence
  Description of Artificial Sequence: Synthetic oligonucleotide
  Target: ATXN1; (+) strand; PAM type: YTN; PAM sequence: TTA
aatgaatgcaaagatcagga

SEQ ID NO: 293560 - DNA, 20 bp, Artificial Sequence
  Description of Artificial Sequence: Synthetic oligonucleotide
  Target: ATXN1; (+) strand; PAM type: YTN; PAM sequence: TTC
agctaaggttctttactctg

SEQ ID NO: 293561 - DNA, 20 bp, Artificial Sequence
  Description of Artificial Sequence: Synthetic oligonucleotide
  Target: ATXN1; (+) strand; PAM type: YTN; PAM sequence: CTA
aggttctttactctgcaaaa

SEQ ID NO: 293562 - DNA, 20 bp, Artificial Sequence
  Description of Artificial Sequence: Synthetic oligonucleotide
  Target: ATXN1; (+) strand; PAM type: YTN; PAM sequence: TTC
tttactctgcaaaacagaca

SEQ ID NO: 293563 - DNA, 20 bp, Artificial Sequence
  Description of Artificial Sequence: Synthetic oligonucleotide
  Target: ATXN1; (+) strand; PAM type: YTN; PAM sequence: CTT
tactctgcaaaacagacaag

SEQ ID NO: 293564 - DNA, 20 bp, Artificial Sequence
  Description of Artificial Sequence: Synthetic oligonucleotide
  Target: ATXN1; (+) strand; PAM type: YTN; PAM sequence: TTT
actctgcaaaacagacaagg

SEQ ID NO: 293565 - DNA, 20 bp, Artificial Sequence
  Description of Artificial Sequence: Synthetic oligonucleotide
  Target: ATXN1; (+) strand; PAM type: YTN; PAM sequence: TTA
ctctgcaaaacagacaagga

SEQ ID NO: 293566 - DNA, 20 bp, Artificial Sequence
  Description of Artificial Sequence: Synthetic oligonucleotide
  Target: ATXN1; (+) strand; PAM type: YTN; PAM sequence: CTC
tgcaaaacagacaaggatca

SEQ ID NO: 293567 - DNA, 20 bp, Artificial Sequence
  Description of Artificial Sequence: Synthetic oligonucleotide
  Target: ATXN1; (+) strand; PAM type: YTN; PAM sequence: CTG
caaaacagacaaggatcaac

SEQ ID NO: 293568 - DNA, 20 bp, Artificial Sequence
  Description of Artificial Sequence: Synthetic oligonucleotide
  Target: ATXN1; (+) strand; PAM type: YTN; PAM sequence: CTT
acatgaaatgctaaaaaatg

SEQ ID NO: 293569 - DNA, 20 bp, Artificial Sequence
  Description of Artificial Sequence: Synthetic oligonucleotide
  Target: ATXN1; (+) strand; PAM type: YTN; PAM sequence: TTA
catgaaatgctaaaaaatga

SEQ ID NO: 293570 - DNA, 20 bp, Artificial Sequence
  Description of Artificial Sequence: Synthetic oligonucleotide
  Target: ATXN1; (+) strand; PAM type: YTN; PAM sequence: CTA
aaaaatgatgtgggtattta

SEQ ID NO: 293571 - DNA, 20 bp, Artificial Sequence
  Description of Artificial Sequence: Synthetic oligonucleotide
  Target: ATXN1; (+) strand; PAM type: YTN; PAM sequence: TTT
aatgtttccaatcagtggtc

SEQ ID NO: 293572 - DNA, 20 bp, Artificial Sequence
  Description of Artificial Sequence: Synthetic oligonucleotide
  Target: ATXN1; (+) strand; PAM type: YTN; PAM sequence: TTA
atgtttccaatcagtggtca

SEQ ID NO: 293573 - DNA, 20 bp, Artificial Sequence
  Description of Artificial Sequence: Synthetic oligonucleotide
  Target: ATXN1; (+) strand; PAM type: YTN; PAM sequence: TTT
ccaatcagtggtcaatcaat

SEQ ID NO: 293574 - DNA, 20 bp, Artificial Sequence
  Description of Artificial Sequence: Synthetic oligonucleotide
  Target: ATXN1; (+) strand; PAM type: YTN; PAM sequence: TTC
caatcagtggtcaatcaata

SEQ ID NO: 293575 - DNA, 20 bp, Artificial Sequence
  Description of Artificial Sequence: Synthetic oligonucleotide
  Target: ATXN1; (+) strand; PAM type: YTN; PAM sequence: TTA
gtgactgactaatttcttaa

SEQ ID NO: 293576 - DNA, 20 bp, Artificial Sequence
  Description of Artificial Sequence: Synthetic oligonucleotide
  Target: ATXN1; (+) strand; PAM type: YTN; PAM sequence: CTG
actaatttcttaattagtta

SEQ ID NO: 293577 - DNA, 20 bp, Artificial Sequence
  Description of Artificial Sequence: Synthetic oligonucleotide
  Target: ATXN1; (+) strand; PAM type: YTN; PAM sequence: CTA
atttcttaattagttaatcc

SEQ ID NO: 293578 - DNA, 20 bp, Artificial Sequence
  Description of Artificial Sequence: Synthetic oligonucleotide
  Target: ATXN1; (+) strand; PAM type: YTN; PAM sequence: TTT
cttaattagttaatccagtg

SEQ ID NO: 293579 - DNA, 20 bp, Artificial Sequence
  Description of Artificial Sequence: Synthetic oligonucleotide
  Target: ATXN1; (+) strand; PAM type: YTN; PAM sequence: TTC
ttaattagttaatccagtga

SEQ ID NO: 293580 - DNA, 20 bp, Artificial Sequence
  Description of Artificial Sequence: Synthetic oligonucleotide
  Target: ATXN1; (+) strand; PAM type: YTN; PAM sequence: CTT
aattagttaatccagtgaca

SEQ ID NO: 293581 - DNA, 20 bp, Artificial Sequence
  Description of Artificial Sequence: Synthetic oligonucleotide
  Target: ATXN1; (+) strand; PAM type: YTN; PAM sequence: TTA
attagttaatccagtgacag

SEQ ID NO: 293582 - DNA, 20 bp, Artificial Sequence
  Description of Artificial Sequence: Synthetic oligonucleotide
  Target: ATXN1; (+) strand; PAM type: YTN; PAM sequence: TTA
gttaatccagtgacagttca

SEQ ID NO: 293583 - DNA, 20 bp, Artificial Sequence
  Description of Artificial Sequence: Synthetic oligonucleotide
  Target: ATXN1; (+) strand; PAM type: YTN; PAM sequence: TTA
atccagtgacagttcacctt

SEQ ID NO: 293584 - DNA, 20 bp, Artificial Sequence
  Description of Artificial Sequence: Synthetic oligonucleotide
  Target: ATXN1; (+) strand; PAM type: YTN; PAM sequence: TTC
accttttggcatgactttat

SEQ ID NO: 293585 - DNA, 20 bp, Artificial Sequence
  Description of Artificial Sequence: Synthetic oligonucleotide
  Target: ATXN1; (+) strand; PAM type: YTN; PAM sequence: CTT
ttggcatgactttataaaca

SEQ ID NO: 293586 - DNA, 20 bp, Artificial Sequence
  Description of Artificial Sequence: Synthetic oligonucleotide
  Target: ATXN1; (+) strand; PAM type: YTN; PAM sequence: TTT
tggcatgactttataaacaa

SEQ ID NO: 293587 - DNA, 20 bp, Artificial Sequence
  Description of Artificial Sequence: Synthetic oligonucleotide
  Target: ATXN1; (+) strand; PAM type: YTN; PAM sequence: TTT
ggcatgactttataaacaag

SEQ ID NO: 293588 - DNA, 20 bp, Artificial Sequence
  Description of Artificial Sequence: Synthetic oligonucleotide
  Target: ATXN1; (+) strand; PAM type: YTN; PAM sequence: TTG
gcatgactttataaacaaga

SEQ ID NO: 293589 - DNA, 20 bp, Artificial Sequence
  Description of Artificial Sequence: Synthetic oligonucleotide
  Target: ATXN1; (+) strand; PAM type: YTN; PAM sequence: CTT
tataaacaagaaaactgaag

SEQ ID NO: 293590 - DNA, 20 bp, Artificial Sequence
  Description of Artificial Sequence: Synthetic oligonucleotide
  Target: ATXN1; (+) strand; PAM type: YTN; PAM sequence: TTT
ataaacaagaaaactgaagg

SEQ ID NO: 293591 - DNA, 20 bp, Artificial Sequence
  Description of Artificial Sequence: Synthetic oligonucleotide
  Target: ATXN1; (+) strand; PAM type: YTN; PAM sequence: TTA
taaacaagaaaactgaaggc

SEQ ID NO: 293592 - DNA, 20 bp, Artificial Sequence
  Description of Artificial Sequence: Synthetic oligonucleotide
  Target: ATXN1; (+) strand; PAM type: YTN; PAM sequence: CTG
aaggctgggcaaggctatca

SEQ ID NO: 293593 - DNA, 20 bp, Artificial Sequence
  Description of Artificial Sequence: Synthetic oligonucleotide
  Target: ATXN1; (+) strand; PAM type: YTN; PAM sequence: CTG
ggcaaggctatcatgcaaaa

SEQ ID NO: 293594 - DNA, 20 bp, Artificial Sequence
  Description of Artificial Sequence: Synthetic oligonucleotide
  Target: ATXN1; (+) strand; PAM type: YTN; PAM sequence: CTA
tcatgcaaaaaaaatgacaa

SEQ ID NO: 293595 - DNA, 20 bp, Artificial Sequence
  Description of Artificial Sequence: Synthetic oligonucleotide
  Target: ATXN1; (+) strand; PAM type: YTN; PAM sequence: CTC
aaactgaaattccccattac

SEQ ID NO: 293596 - DNA, 20 bp, Artificial Sequence
  Description of Artificial Sequence: Synthetic oligonucleotide
  Target: ATXN1; (+) strand; PAM type: YTN; PAM sequence: CTG
aaattccccattacaactta

SEQ ID NO: 293597 - DNA, 20 bp, Artificial Sequence
  Description of Artificial Sequence: Synthetic oligonucleotide
  Target: ATXN1; (+) strand; PAM type: YTN; PAM sequence: TTC
cccattacaacttattgact

SEQ ID NO: 293598 - DNA, 20 bp, Artificial Sequence
  Description of Artificial Sequence: Synthetic oligonucleotide
  Target: ATXN1; (+) strand; PAM type: YTN; PAM sequence: TTA
caacttattgactctaaagc

SEQ ID NO: 293599 - DNA, 20 bp, Artificial Sequence
  Description of Artificial Sequence: Synthetic oligonucleotide
  Target: ATXN1; (+) strand; PAM type: YTN; PAM sequence: CTT
attgactctaaagcattaat

SEQ ID NO: 293600 - DNA, 20 bp, Artificial Sequence
  Description of Artificial Sequence: Synthetic oligonucleotide
  Target: ATXN1; (+) strand; PAM type: YTN; PAM sequence: TTA
ttgactctaaagcattaata

SEQ ID NO: 293601 - DNA, 20 bp, Artificial Sequence
  Description of Artificial Sequence: Synthetic oligonucleotide
  Target: ATXN1; (+) strand; PAM type: YTN; PAM sequence: TTG
actctaaagcattaatagga

SEQ ID NO: 293602 - DNA, 20 bp, Artificial Sequence
  Description of Artificial Sequence: Synthetic oligonucleotide
  Target: ATXN1; (+) strand; PAM type: YTN; PAM sequence: CTC
taaagcattaataggaaaaa

SEQ ID NO: 293603 - DNA, 20 bp, Artificial Sequence
  Description of Artificial Sequence: Synthetic oligonucleotide
  Target: ATXN1; (+) strand; PAM type: YTN; PAM sequence: CTA
aagcattaataggaaaaaac

SEQ ID NO: 293604 - DNA, 20 bp, Artificial Sequence
  Description of Artificial Sequence: Synthetic oligonucleotide
  Target: ATXN1; (+) strand; PAM type: YTN; PAM sequence: TTA
ataggaaaaaactctatttt

SEQ ID NO: 293605 - DNA, 20 bp, Artificial Sequence
  Description of Artificial Sequence: Synthetic oligonucleotide
  Target: ATXN1; (+) strand; PAM type: YTN; PAM sequence: CTC
tattttatatatgtatatac

SEQ ID NO: 293606 - DNA, 20 bp, Artificial Sequence
  Description of Artificial Sequence: Synthetic oligonucleotide
  Target: ATXN1; (+) strand; PAM type: YTN; PAM sequence: CTA
ttttatatatgtatatacac

SEQ ID NO: 293607 - DNA, 20 bp, Artificial Sequence
  Description of Artificial Sequence: Synthetic oligonucleotide
  Target: ATXN1; (+) strand; PAM type: YTN; PAM sequence: TTT
tatatatgtatatacacata

SEQ ID NO: 293608 - DNA, 20 bp, Artificial Sequence
  Description of Artificial Sequence: Synthetic oligonucleotide
  Target: ATXN1; (+) strand; PAM type: YTN; PAM sequence: TTT
atatatgtatatacacatat

SEQ ID NO: 293609 - DNA, 20 bp, Artificial Sequence
  Description of Artificial Sequence: Synthetic oligonucleotide
  Target: ATXN1; (+) strand; PAM type: YTN; PAM sequence: TTA
tatatgtatatacacatatg

SEQ ID NO: 293610 - DNA, 20 bp, Artificial Sequence
  Description of Artificial Sequence: Synthetic oligonucleotide
  Target: ATXN1; (+) strand; PAM type: YTN; PAM sequence: TTA
aataatcttccccgatatca

SEQ ID NO: 293611 - DNA, 20 bp, Artificial Sequence
  Description of Artificial Sequence: Synthetic oligonucleotide
  Target: ATXN1; (+) strand; PAM type: YTN; PAM sequence: CTT
ccccgatatcaaaatattat

SEQ ID NO: 293612 - DNA, 20 bp, Artificial Sequence
  Description of Artificial Sequence: Synthetic oligonucleotide
  Target: ATXN1; (+) strand; PAM type: YTN; PAM sequence: TTC
cccgatatcaaaatattatt

SEQ ID NO: 293613 - DNA, 20 bp, Artificial Sequence
  Description of Artificial Sequence: Synthetic oligonucleotide
  Target: ATXN1; (+) strand; PAM type: YTN; PAM sequence: TTA
ttttaaaagatgtgagcagc

SEQ ID NO: 293614 - DNA, 20 bp, Artificial Sequence
  Description of Artificial Sequence: Synthetic oligonucleotide
  Target: ATXN1; (+) strand; PAM type: YTN; PAM sequence: TTT
taaaagatgtgagcagcgtg

SEQ ID NO: 293615 - DNA, 20 bp, Artificial Sequence
  Description of Artificial Sequence: Synthetic oligonucleotide
  Target: ATXN1; (+) strand; PAM type: YTN; PAM sequence: TTT
aaaagatgtgagcagcgtgc

SEQ ID NO: 293616 - DNA, 20 bp, Artificial Sequence
  Description of Artificial Sequence: Synthetic oligonucleotide
  Target: ATXN1; (+) strand; PAM type: YTN; PAM sequence: TTA
aaagatgtgagcagcgtgcc

SEQ ID NO: 293617 - DNA, 20 bp, Artificial Sequence
  Description of Artificial Sequence: Synthetic oligonucleotide
  Target: ATXN1; (+) strand; PAM type: YTN; PAM sequence: CTC
acacactagccttcataaaa

SEQ ID NO: 293618 - DNA, 20 bp, Artificial Sequence
  Description of Artificial Sequence: Synthetic oligonucleotide
  Target: ATXN1; (+) strand; PAM type: YTN; PAM sequence: CTA
gccttcataaaattccattc

SEQ ID NO: 293619 - DNA, 20 bp, Artificial Sequence
  Description of Artificial Sequence: Synthetic oligonucleotide
  Target: ATXN1; (+) strand; PAM type: YTN; PAM sequence: CTT
cataaaattccattctgaat

SEQ ID NO: 293620 - DNA, 20 bp, Artificial Sequence
  Description of Artificial Sequence: Synthetic oligonucleotide
  Target: ATXN1; (+) strand; PAM type: YTN; PAM sequence: TTC
ataaaattccattctgaatt

SEQ ID NO: 293621 - DNA, 20 bp, Artificial Sequence
  Description of Artificial Sequence: Synthetic oligonucleotide
  Target: ATXN1; (+) strand; PAM type: YTN; PAM sequence: TTC
cattctgaattccttgtcac

SEQ ID NO: 293622 - DNA, 20 bp, Artificial Sequence
  Description of Artificial Sequence: Synthetic oligonucleotide
  Target: ATXN1; (+) strand; PAM type: YTN; PAM sequence: TTC
tgaattccttgtcacacgta

SEQ ID NO: 293623 - DNA, 20 bp, Artificial Sequence
  Description of Artificial Sequence: Synthetic oligonucleotide
  Target: ATXN1; (+) strand; PAM type: YTN; PAM sequence: CTG
aattccttgtcacacgtaca

SEQ ID NO: 293624 - DNA, 20 bp, Artificial Sequence
  Description of Artificial Sequence: Synthetic oligonucleotide
  Target: ATXN1; (+) strand; PAM type: YTN; PAM sequence: TTC
cttgtcacacgtacaaatga

SEQ ID NO: 293625 - DNA, 20 bp, Artificial Sequence
  Description of Artificial Sequence: Synthetic oligonucleotide
  Target: ATXN1; (+) strand; PAM type: YTN; PAM sequence: CTT
gtcacacgtacaaatgatga

SEQ ID NO: 293626 - DNA, 20 bp, Artificial Sequence
  Description of Artificial Sequence: Synthetic oligonucleotide
  Target: ATXN1; (+) strand; PAM type: YTN; PAM sequence: TTG
tcacacgtacaaatgatgat

SEQ ID NO: 293627 - DNA, 20 bp, Artificial Sequence
  Description of Artificial Sequence: Synthetic oligonucleotide
  Target: ATXN1; (+) strand; PAM type: YTN; PAM sequence: TTT
tctttttagtggtgtttttg

SEQ ID NO: 293628 - DNA, 20 bp, Artificial Sequence
  Description of Artificial Sequence: Synthetic oligonucleotide
  Target: ATXN1; (+) strand; PAM type: YTN; PAM sequence: TTT
ctttttagtggtgtttttga

SEQ ID NO: 293629 - DNA, 20 bp, Artificial Sequence
  Description of Artificial Sequence: Synthetic oligonucleotide
  Target: ATXN1; (+) strand; PAM type: YTN; PAM sequence: TTC
tttttagtggtgtttttgac

SEQ ID NO: 293630 - DNA, 20 bp, Artificial Sequence
  Description of Artificial Sequence: Synthetic oligonucleotide
  Target: ATXN1; (+) strand; PAM type: YTN; PAM sequence: CTT
tttagtggtgtttttgacat

SEQ ID NO: 293631 - DNA, 20 bp, Artificial Sequence
  Description of Artificial Sequence: Synthetic oligonucleotide
  Target: ATXN1; (+) strand; PAM type: YTN; PAM sequence: TTT
ttagtggtgtttttgacatg

SEQ ID NO: 293632 - DNA, 20 bp, Artificial Sequence
  Description of Artificial Sequence: Synthetic oligonucleotide
  Target: ATXN1; (+) strand; PAM type: YTN; PAM sequence: TTT
tagtggtgtttttgacatgt

SEQ ID NO: 293633 - DNA, 20 bp, Artificial Sequence
  Description of Artificial Sequence: Synthetic oligonucleotide
  Target: ATXN1; (+) strand; PAM type: YTN; PAM sequence: TTT
agtggtgtttttgacatgta

SEQ ID NO: 293634 - DNA, 20 bp, Artificial Sequence
  Description of Artificial Sequence: Synthetic oligonucleotide
  Target: ATXN1; (+) strand; PAM type: YTN; PAM sequence: TTA
gtggtgtttttgacatgtaa

SEQ ID NO: 293635 - DNA, 20 bp, Artificial Sequence
  Description of Artificial Sequence: Synthetic oligonucleotide
  Target: ATXN1; (+) strand; PAM type: YTN; PAM sequence: TTT
ttgacatgtaatattaaata

SEQ ID NO: 293636 - DNA, 20 bp, Artificial Sequence
  Description of Artificial Sequence: Synthetic oligonucleotide
  Target: ATXN1; (+) strand; PAM type: YTN; PAM sequence: TTT
tgacatgtaatattaaatag

SEQ ID NO: 293637 - DNA, 20 bp, Artificial Sequence
  Description of Artificial Sequence: Synthetic oligonucleotide
  Target: ATXN1; (+) strand; PAM type: YTN; PAM sequence: TTT
gacatgtaatattaaatagc

SEQ ID NO: 293638 - DNA, 20 bp, Artificial Sequence
  Description of Artificial Sequence: Synthetic oligonucleotide
  Target: ATXN1; (+) strand; PAM type: YTN; PAM sequence: TTG
acatgtaatattaaatagca

SEQ ID NO: 293639 - DNA, 20 bp, Artificial Sequence
  Description of Artificial Sequence: Synthetic oligonucleotide
  Target: ATXN1; (+) strand; PAM type: YTN; PAM sequence: TTA
aatagcatcctattccttcc

SEQ ID NO: 293640 - DNA, 20 bp, Artificial Sequence
  Description of Artificial Sequence: Synthetic oligonucleotide
  Target: ATXN1; (+) strand; PAM type: YTN; PAM sequence: CTA
ttccttcctttggaaagaac

SEQ ID NO: 293641 - DNA, 20 bp, Artificial Sequence
  Description of Artificial Sequence: Synthetic oligonucleotide
  Target: ATXN1; (+) strand; PAM type: YTN; PAM sequence: TTC
cttcctttggaaagaacttt

SEQ ID NO: 293642 - DNA, 20 bp, Artificial Sequence
  Description of Artificial Sequence: Synthetic oligonucleotide
  Target: ATXN1; (+) strand; PAM type: YTN; PAM sequence: CTT
cctttggaaagaacttttga

SEQ ID NO: 293643 - DNA, 20 bp, Artificial Sequence
  Description of Artificial Sequence: Synthetic oligonucleotide
  Target: ATXN1; (+) strand; PAM type: YTN; PAM sequence: TTC
ctttggaaagaacttttgag

SEQ ID NO: 293644 - DNA, 20 bp, Artificial Sequence
  Description of Artificial Sequence: Synthetic oligonucleotide
  Target: ATXN1; (+) strand; PAM type: YTN; PAM sequence: CTT
tggaaagaacttttgaggag

SEQ ID NO: 293645 - DNA, 20 bp, Artificial Sequence
  Description of Artificial Sequence: Synthetic oligonucleotide
  Target: ATXN1; (+) strand; PAM type: YTN; PAM sequence: TTT
ggaaagaacttttgaggagc

SEQ ID NO: 293646 - DNA, 20 bp, Artificial Sequence
  Description of Artificial Sequence: Synthetic oligonucleotide
  Target: ATXN1; (+) strand; PAM type: YTN; PAM sequence: TTG
gaaagaacttttgaggagcc

SEQ ID NO: 293647 - DNA, 20 bp, Artificial Sequence
  Description of Artificial Sequence: Synthetic oligonucleotide
  Target: ATXN1; (+) strand; PAM type: YTN; PAM sequence: CTT
ttgaggagccgaattaattt

SEQ ID NO: 293648 - DNA, 20 bp, Artificial Sequence
  Description of Artificial Sequence: Synthetic oligonucleotide
  Target: ATXN1; (+) strand; PAM type: YTN; PAM sequence: TTT
tgaggagccgaattaatttt

SEQ ID NO: 293649 - DNA, 20 bp, Artificial Sequence
  Description of Artificial Sequence: Synthetic oligonucleotide
  Target: ATXN1; (+) strand; PAM type: YTN; PAM sequence: TTT
gaggagccgaattaattttg

SEQ ID NO: 293650 - DNA, 20 bp, Artificial Sequence
  Description of Artificial Sequence: Synthetic oligonucleotide
  Target: ATXN1; (+) strand; PAM type: YTN; PAM sequence: TTG
aggagccgaattaattttgg

SEQ ID NO: 293651 - DNA, 20 bp, Artificial Sequence
  Description of Artificial Sequence: Synthetic oligonucleotide
  Target: ATXN1; (+) strand; PAM type: YTN; PAM sequence: TTA
attttggagatgacttttca

SEQ ID NO: 293652 - DNA, 20 bp, Artificial Sequence
  Description of Artificial Sequence: Synthetic oligonucleotide
  Target: ATXN1; (+) strand; PAM type: YTN; PAM sequence: TTT
tggagatgacttttcatttt

SEQ ID NO: 293653 - DNA, 20 bp, Artificial Sequence
  Description of Artificial Sequence: Synthetic oligonucleotide
  Target: ATXN1; (+) strand; PAM type: YTN; PAM sequence: TTT
ggagatgacttttcatttta

SEQ ID NO: 293654 - DNA, 20 bp, Artificial Sequence
  Description of Artificial Sequence: Synthetic oligonucleotide
  Target: ATXN1; (+) strand; PAM type: YTN; PAM sequence: TTG
gagatgacttttcattttat

SEQ ID NO: 293655 - DNA, 20 bp, Artificial Sequence
  Description of Artificial Sequence: Synthetic oligonucleotide
  Target: ATXN1; (+) strand; PAM type: YTN; PAM sequence: CTT
ttcattttatttaagccaag

SEQ ID NO: 293656 - DNA, 20 bp, Artificial Sequence
  Description of Artificial Sequence: Synthetic oligonucleotide
  Target: ATXN1; (+) strand; PAM type: YTN; PAM sequence: TTT
tcattttatttaagccaagt

SEQ ID NO: 293657 - DNA, 20 bp, Artificial Sequence
  Description of Artificial Sequence: Synthetic oligonucleotide
  Target: ATXN1; (+) strand; PAM type: YTN; PAM sequence: TTT
cattttatttaagccaagtt

SEQ ID NO: 293658 - DNA, 20 bp, Artificial Sequence
  Description of Artificial Sequence: Synthetic oligonucleotide
  Target: ATXN1; (+) strand; PAM type: YTN; PAM sequence: TTC
attttatttaagccaagtta

SEQ ID NO: 293659 - DNA, 20 bp, Artificial Sequence
  Description of Artificial Sequence: Synthetic oligonucleotide
  Target: ATXN1; (+) strand; PAM type: YTN; PAM sequence: TTT
tatttaagccaagttatttt

SEQ ID NO: 293660 - DNA, 20 bp, Artificial Sequence
  Description of Artificial Sequence: Synthetic oligonucleotide
  Target: ATXN1; (+) strand; PAM type: YTN; PAM sequence: TTT
atttaagccaagttattttt

SEQ ID NO: 293661 - DNA, 20 bp, Artificial Sequence
  Description of Artificial Sequence: Synthetic oligonucleotide
  Target: ATXN1; (+) strand; PAM type: YTN; PAM sequence: TTA
tttaagccaagttatttttt

SEQ ID NO: 293662 - DNA, 20 bp, Artificial Sequence
  Description of Artificial Sequence: Synthetic oligonucleotide
  Target: ATXN1; (+) strand; PAM type: YTN; PAM sequence: TTT
aagccaagttatttttttct

SEQ ID NO: 293663 - DNA, 20 bp, Artificial Sequence
  Description of Artificial Sequence: Synthetic oligonucleotide
  Target: ATXN1; (+) strand; PAM type: YTN; PAM sequence: TTA
agccaagttatttttttctc

SEQ ID NO: 293664 - DNA, 20 bp, Artificial Sequence
  Description of Artificial Sequence: Synthetic oligonucleotide
  Target: ATXN1; (+) strand; PAM type: YTN; PAM sequence: TTA
tttttttctcttttggtatt

SEQ ID NO: 293665 - DNA, 20 bp, Artificial Sequence
  Description of Artificial Sequence: Synthetic oligonucleotide
  Target: ATXN1; (+) strand; PAM type: YTN; PAM sequence: TTT
ttttctcttttggtatttta

SEQ ID NO: 293666 - DNA, 20 bp, Artificial Sequence
  Description of Artificial Sequence: Synthetic oligonucleotide
  Target: ATXN1; (+) strand; PAM type: YTN; PAM sequence: TTT
tttctcttttggtattttag

SEQ ID NO: 293667 - DNA, 20 bp, Artificial Sequence
  Description of Artificial Sequence: Synthetic oligonucleotide
  Target: ATXN1; (+) strand; PAM type: YTN; PAM sequence: TTT
ttctcttttggtattttagc

SEQ ID NO: 293668 - DNA, 20 bp, Artificial Sequence
  Description of Artificial Sequence: Synthetic oligonucleotide
  Target: ATXN1; (+) strand; PAM type: YTN; PAM sequence: TTT
tctcttttggtattttagcc

SEQ ID NO: 293669 - DNA, 20 bp, Artificial Sequence
  Description of Artificial Sequence: Synthetic oligonucleotide
  Target: ATXN1; (+) strand; PAM type: YTN; PAM sequence: TTT
ctcttttggtattttagcca

SEQ ID NO: 293670 - DNA, 20 bp, Artificial Sequence
  Description of Artificial Sequence: Synthetic oligonucleotide
  Target: ATXN1; (+) strand; PAM type: YTN; PAM sequence: TTC
tcttttggtattttagccaa

SEQ ID NO: 293671 - DNA, 20 bp, Artificial Sequence
  Description of Artificial Sequence: Synthetic oligonucleotide
  Target: ATXN1; (+) strand; PAM type: YTN; PAM sequence: CTC
ttttggtattttagccaaac

SEQ ID NO: 293672 - DNA, 20 bp, Artificial Sequence
  Description of Artificial Sequence: Synthetic oligonucleotide
  Target: ATXN1; (+) strand; PAM type: YTN; PAM sequence: CTT
ttggtattttagccaaacag

SEQ ID NO: 293673 - DNA, 20 bp, Artificial Sequence
  Description of Artificial Sequence: Synthetic oligonucleotide
  Target: ATXN1; (+) strand; PAM type: YTN; PAM sequence: TTT
tggtattttagccaaacaga

SEQ ID NO: 293674 - DNA, 20 bp, Artificial Sequence
  Description of Artificial Sequence: Synthetic oligonucleotide
  Target: ATXN1; (+) strand; PAM type: YTN; PAM sequence: TTT
ggtattttagccaaacagaa

SEQ ID NO: 293675 - DNA, 20 bp, Artificial Sequence
  Description of Artificial Sequence: Synthetic oligonucleotide
  Target: ATXN1; (+) strand; PAM type: YTN; PAM sequence: TTG
gtattttagccaaacagaat

SEQ ID NO: 293676 - DNA, 20 bp, Artificial Sequence
  Description of Artificial Sequence: Synthetic oligonucleotide
  Target: ATXN1; (+) strand; PAM type: YTN; PAM sequence: TTT
tagccaaacagaattcttag

SEQ ID NO: 293677 - DNA, 20 bp, Artificial Sequence
  Description of Artificial Sequence: Synthetic oligonucleotide
  Target: ATXN1; (+) strand; PAM type: YTN; PAM sequence: TTT
agccaaacagaattcttaga

SEQ ID NO: 293678 - DNA, 20 bp, Artificial Sequence
  Description of Artificial Sequence: Synthetic oligonucleotide
  Target: ATXN1; (+) strand; PAM type: YTN; PAM sequence: TTA
gccaaacagaattcttagaa

SEQ ID NO: 293679 - DNA, 20 bp, Artificial Sequence
  Description of Artificial Sequence: Synthetic oligonucleotide
  Target: ATXN1; (+) strand; PAM type: YTN; PAM sequence: TTC
ttagaaatgaaaaaaaaaat

SEQ ID NO: 293680 - DNA, 20 bp, Artificial Sequence
  Description of Artificial Sequence: Synthetic oligonucleotide
  Target: ATXN1; (+) strand; PAM type: YTN; PAM sequence: CTT
agaaatgaaaaaaaaaatag

SEQ ID NO: 293681 - DNA, 20 bp, Artificial Sequence
  Description of Artificial Sequence: Synthetic oligonucleotide
  Target: ATXN1; (+) strand; PAM type: YTN; PAM sequence: TTA
gaaatgaaaaaaaaaatagt

SEQ ID NO: 293682 - DNA, 20 bp, Artificial Sequence
  Description of Artificial Sequence: Synthetic oligonucleotide
  Target: ATXN1; (+) strand; PAM type: YTN; PAM sequence: TTC
ctagagcagagtagcctttc

SEQ ID NO: 293683 - DNA, 20 bp, Artificial Sequence
  Description of Artificial Sequence: Synthetic oligonucleotide
  Target: ATXN1; (+) strand; PAM type: YTN; PAM sequence: CTA
gagcagagtagcctttcaga

SEQ ID NO: 293684 - DNA, 20 bp, Artificial Sequence
  Description of Artificial Sequence: Synthetic oligonucleotide
  Target: ATXN1; (+) strand; PAM type: YTN; PAM sequence: CTT
tcagaattgaaaatgttaca

SEQ ID NO: 293685 - DNA, 20 bp, Artificial Sequence
  Description of Artificial Sequence: Synthetic oligonucleotide
  Target: ATXN1; (+) strand; PAM type: YTN; PAM sequence: TTT
cagaattgaaaatgttacat

SEQ ID NO: 293686 - DNA, 20 bp, Artificial Sequence
  Description of Artificial Sequence: Synthetic oligonucleotide
  Target: ATXN1; (+) strand; PAM type: YTN; PAM sequence: TTC
agaattgaaaatgttacatc

SEQ ID NO: 293687 - DNA, 20 bp, Artificial Sequence
  Description of Artificial Sequence: Synthetic oligonucleotide
  Target: ATXN1; (+) strand; PAM type: YTN; PAM sequence: TTG
aaaatgttacatcaaccctt

SEQ ID NO: 293688 - DNA, 20 bp, Artificial Sequence
  Description of Artificial Sequence: Synthetic oligonucleotide
  Target: ATXN1; (+) strand; PAM type: YTN; PAM sequence: TTA
catcaaccctttaatgttac

SEQ ID NO: 293689 - DNA, 20 bp, Artificial Sequence
  Description of Artificial Sequence: Synthetic oligonucleotide
  Target: ATXN1; (+) strand; PAM type: YTN; PAM sequence: CTT
taatgttacccagtcttttt

SEQ ID NO: 293690 - DNA, 20 bp, Artificial Sequence
  Description of Artificial Sequence: Synthetic oligonucleotide
  Target: ATXN1; (+) strand; PAM type: YTN; PAM sequence: TTT
aatgttacccagtcttttta

SEQ ID NO: 293691 - DNA, 20 bp, Artificial Sequence
  Description of Artificial Sequence: Synthetic oligonucleotide
  Target: ATXN1; (+) strand; PAM type: YTN; PAM sequence: TTA
atgttacccagtctttttaa

SEQ ID NO: 293692 - DNA, 20 bp, Artificial Sequence
  Description of Artificial Sequence: Synthetic oligonucleotide
  Target: ATXN1; (+) strand; PAM type: YTN; PAM sequence: TTA
cccagtctttttaaattccc

SEQ ID NO: 293693 - DNA, 20 bp, Artificial Sequence
  Description of Artificial Sequence: Synthetic oligonucleotide
  Target: ATXN1; (+) strand; PAM type: YTN; PAM sequence: CTT
tttaaattcccttaagaaaa

SEQ ID NO: 293694 - DNA, 20 bp, Artificial Sequence
  Description of Artificial Sequence: Synthetic oligonucleotide
  Target: ATXN1; (+) strand; PAM type: YTN; PAM sequence: TTT
ttaaattcccttaagaaaaa

SEQ ID NO: 293695 - DNA, 20 bp, Artificial Sequence
  Description of Artificial Sequence: Synthetic oligonucleotide
  Target: ATXN1; (+) strand; PAM type: YTN; PAM sequence: TTT
taaattcccttaagaaaaaa

SEQ ID NO: 293696 - DNA, 20 bp, Artificial Sequence
  Description of Artificial Sequence: Synthetic oligonucleotide
  Target: ATXN1; (+) strand; PAM type: YTN; PAM sequence: TTT
aaattcccttaagaaaaaaa

SEQ ID NO: 293697 - DNA, 20 bp, Artificial Sequence
  Description of Artificial Sequence: Synthetic oligonucleotide
  Target: ATXN1; (+) strand; PAM type: YTN; PAM sequence: TTA
aattcccttaagaaaaaaat

SEQ ID NO: 293698 - DNA, 20 bp, Artificial Sequence
  Description of Artificial Sequence: Synthetic oligonucleotide
  Target: ATXN1; (+) strand; PAM type: YTN; PAM sequence: TTC
ccttaagaaaaaaataccag

SEQ ID NO: 293699 - DNA, 20 bp, Artificial Sequence
  Description of Artificial Sequence: Synthetic oligonucleotide
  Target: ATXN1; (+) strand; PAM type: YTN; PAM sequence: CTT
aagaaaaaaataccagatat

SEQ ID NO: 293700 - DNA, 20 bp, Artificial Sequence
  Description of Artificial Sequence: Synthetic oligonucleotide
  Target: ATXN1; (+) strand; PAM type: YTN; PAM sequence: TTA
agaaaaaaataccagatatt

SEQ ID NO: 293701 - DNA, 20 bp, Artificial Sequence
  Description of Artificial Sequence: Synthetic oligonucleotide
  Target: ATXN1; (+) strand; PAM type: YTN; PAM sequence: TTC
acaaaatgtggccagaactg

SEQ ID NO: 293702 - DNA, 20 bp, Artificial Sequence
  Description of Artificial Sequence: Synthetic oligonucleotide
  Target: ATXN1; (+) strand; PAM type: YTN; PAM sequence: CTG
gatgtgtcatttatttggat

SEQ ID NO: 293703 - DNA, 20 bp, Artificial Sequence
  Description of Artificial Sequence: Synthetic oligonucleotide
  Target: ATXN1; (+) strand; PAM type: YTN; PAM sequence: TTT
atttggatttctgatttggc

SEQ ID NO: 293704 - DNA, 20 bp, Artificial Sequence
  Description of Artificial Sequence: Synthetic oligonucleotide
  Target: ATXN1; (+) strand; PAM type: YTN; PAM sequence: TTA
tttggatttctgatttggcc

SEQ ID NO: 293705 - DNA, 20 bp, Artificial Sequence
  Description of Artificial Sequence: Synthetic oligonucleotide
  Target: ATXN1; (+) strand; PAM type: YTN; PAM sequence: TTT
ggatttctgatttggccgac

SEQ ID NO: 293706 - DNA, 20 bp, Artificial Sequence
  Description of Artificial Sequence: Synthetic oligonucleotide
  Target: ATXN1; (+) strand; PAM type: YTN; PAM sequence: TTG
gatttctgatttggccgaca

SEQ ID NO: 293707 - DNA, 20 bp, Artificial Sequence
  Description of Artificial Sequence: Synthetic oligonucleotide
  Target: ATXN1; (+) strand; PAM type: YTN; PAM sequence: TTT
ctgatttggccgacatggtt

SEQ ID NO: 293708 - DNA, 20 bp, Artificial Sequence
  Description of Artificial Sequence: Synthetic oligonucleotide
  Target: ATXN1; (+) strand; PAM type: YTN; PAM sequence: TTC
tgatttggccgacatggtta

SEQ ID NO: 293709 - DNA, 20 bp, Artificial Sequence
  Description of Artificial Sequence: Synthetic oligonucleotide
  Target: ATXN1; (+) strand; PAM type: YTN; PAM sequence: CTG
atttggccgacatggttatg

SEQ ID NO: 293710 - DNA, 20 bp, Artificial Sequence
  Description of Artificial Sequence: Synthetic oligonucleotide
  Target: ATXN1; (+) strand; PAM type: YTN; PAM sequence: TTT
ggccgacatggttatgcatg

SEQ ID NO: 293711 - DNA, 20 bp, Artificial Sequence
  Description of Artificial Sequence: Synthetic oligonucleotide
  Target: ATXN1; (+) strand; PAM type: YTN; PAM sequence: TTG
gccgacatggttatgcatga

SEQ ID NO: 293712 - DNA, 20 bp, Artificial Sequence
  Description of Artificial Sequence: Synthetic oligonucleotide
  Target: ATXN1; (+) strand; PAM type: YTN; PAM sequence: TTA
tgcatgacataaaacagttt

SEQ ID NO: 293713 - DNA, 20 bp, Artificial Sequence
  Description of Artificial Sequence: Synthetic oligonucleotide
  Target: ATXN1; (+) strand; PAM type: YTN; PAM sequence: TTT
aaaaaaatggtttttagtaa

SEQ ID NO: 293714 - DNA, 20 bp, Artificial Sequence
  Description of Artificial Sequence: Synthetic oligonucleotide
  Target: ATXN1; (+) strand; PAM type: YTN; PAM sequence: TTA
aaaaaatggtttttagtaac

SEQ ID NO: 293715 - DNA, 20 bp, Artificial Sequence
  Description of Artificial Sequence: Synthetic oligonucleotide
  Target: ATXN1; (+) strand; PAM type: YTN; PAM sequence: TTT
ttagtaacttcataaatatg

SEQ ID NO: 293716 - DNA, 20 bp, Artificial Sequence
  Description of Artificial Sequence: Synthetic oligonucleotide
  Target: ATXN1; (+) strand; PAM type: YTN; PAM sequence: TTT
tagtaacttcataaatatgg

SEQ ID NO: 293717 - DNA, 20 bp, Artificial Sequence
  Description of Artificial Sequence: Synthetic oligonucleotide
  Target: ATXN1; (+) strand; PAM type: YTN; PAM sequence: TTT
agtaacttcataaatatggc

SEQ ID NO: 293718 - DNA, 20 bp, Artificial Sequence
  Description of Artificial Sequence: Synthetic oligonucleotide
  Target: ATXN1; (+) strand; PAM type: YTN; PAM sequence: TTA
gtaacttcataaatatggct

SEQ ID NO: 293719 - DNA, 20 bp, Artificial Sequence
  Description of Artificial Sequence: Synthetic oligonucleotide
  Target: ATXN1; (+) strand; PAM type: YTN; PAM sequence: CTT
cataaatatggcttacagtg

SEQ ID NO: 293720 - DNA, 20 bp, Artificial Sequence
  Description of Artificial Sequence: Synthetic oligonucleotide
  Target: ATXN1; (+) strand; PAM type: YTN; PAM sequence: TTC
ataaatatggcttacagtga

SEQ ID NO: 293721 - DNA, 20 bp, Artificial Sequence
  Description of Artificial Sequence: Synthetic oligonucleotide
  Target: ATXN1; (+) strand; PAM type: YTN; PAM sequence: CTT
acagtgaagctgaagcaatt

SEQ ID NO: 293722 - DNA, 20 bp, Artificial Sequence
  Description of Artificial Sequence: Synthetic oligonucleotide
  Target: ATXN1; (+) strand; PAM type: YTN; PAM sequence: TTA
cagtgaagctgaagcaattc

SEQ ID NO: 293723 - DNA, 20 bp, Artificial Sequence
  Description of Artificial Sequence: Synthetic oligonucleotide
  Target: ATXN1; (+) strand; PAM type: YTN; PAM sequence: CTG
aagcaattctatctgatgtt

SEQ ID NO: 293724 - DNA, 20 bp, Artificial Sequence
  Description of Artificial Sequence: Synthetic oligonucleotide
  Target: ATXN1; (+) strand; PAM type: YTN; PAM sequence: TTC
tatctgatgttagaattttc

SEQ ID NO: 293725 - DNA, 20 bp, Artificial Sequence
  Description of Artificial Sequence: Synthetic oligonucleotide
  Target: ATXN1; (+) strand; PAM type: YTN; PAM sequence: CTA
tctgatgttagaattttcta

SEQ ID NO: 293726 - DNA, 20 bp, Artificial Sequence
  Description of Artificial Sequence: Synthetic oligonucleotide
  Target: ATXN1; (+) strand; PAM type: YTN; PAM sequence: CTG
atgttagaattttctaatgc

SEQ ID NO: 293727 - DNA, 20 bp, Artificial Sequence
  Description of Artificial Sequence: Synthetic oligonucleotide
  Target: ATXN1; (+) strand; PAM type: YTN; PAM sequence: TTA
gaattttctaatgccaaaga

SEQ ID NO: 293728 - DNA, 20 bp, Artificial Sequence
  Description of Artificial Sequence: Synthetic oligonucleotide
  Target: ATXN1; (+) strand; PAM type: YTN; PAM sequence: TTT
tctaatgccaaagatatacg

SEQ ID NO: 293729 - DNA, 20 bp, Artificial Sequence
  Description of Artificial Sequence: Synthetic oligonucleotide
  Target: ATXN1; (+) strand; PAM type: YTN; PAM sequence: TTT
ctaatgccaaagatatacgc

SEQ ID NO: 293730 - DNA, 20 bp, Artificial Sequence
  Description of Artificial Sequence: Synthetic oligonucleotide
  Target: ATXN1; (+) strand; PAM type: YTN; PAM sequence: TTC
taatgccaaagatatacgcc

SEQ ID NO: 293731 - DNA, 20 bp, Artificial Sequence
  Description of Artificial Sequence: Synthetic oligonucleotide
  Target: ATXN1; (+) strand; PAM type: YTN; PAM sequence: CTA
atgccaaagatatacgccag

SEQ ID NO: 293732 - DNA, 20 bp, Artificial Sequence
  Description of Artificial Sequence: Synthetic oligonucleotide
  Target: ATXN1; (+) strand; PAM type: YTN; PAM sequence: TTT
agtttaaatgatgtgaggct

SEQ ID NO: 293733 - DNA, 20 bp, Artificial Sequence
  Description of Artificial Sequence: Synthetic oligonucleotide
  Target: ATXN1; (+) strand; PAM type: YTN; PAM sequence: TTA
gtttaaatgatgtgaggctg

SEQ ID NO: 293734 - DNA, 20 bp, Artificial Sequence
  Description of Artificial Sequence: Synthetic oligonucleotide
  Target: ATXN1; (+) strand; PAM type: YTN; PAM sequence: TTT
aaatgatgtgaggctgaatc

SEQ ID NO: 293735 - DNA, 20 bp, Artificial Sequence
  Description of Artificial Sequence: Synthetic oligonucleotide
  Target: ATXN1; (+) strand; PAM type: YTN; PAM sequence: TTA
aatgatgtgaggctgaatcc

SEQ ID NO: 293736 - DNA, 20 bp, Artificial Sequence
  Description of Artificial Sequence: Synthetic oligonucleotide
  Target: ATXN1; (+) strand; PAM type: YTN; PAM sequence: CTG
aatccaactattactgtaaa

SEQ ID NO: 293737 - DNA, 20 bp, Artificial Sequence
  Description of Artificial Sequence: Synthetic oligonucleotide
  Target: ATXN1; (+) strand; PAM type: YTN; PAM sequence: CTA
ttactgtaaaaactgtttaa

SEQ ID NO: 293738 - DNA, 20 bp, Artificial Sequence
  Description of Artificial Sequence: Synthetic oligonucleotide
  Target: ATXN1; (+) strand; PAM type: YTN; PAM sequence: TTA
ctgtaaaaactgtttaacca

SEQ ID NO: 293739 - DNA, 20 bp, Artificial Sequence
  Description of Artificial Sequence: Synthetic oligonucleotide
  Target: ATXN1; (+) strand; PAM type: YTN; PAM sequence: CTG
taaaaactgtttaaccaaaa

SEQ ID NO: 293740 - DNA, 20 bp, Artificial Sequence
  Description of Artificial Sequence: Synthetic oligonucleotide
  Target: ATXN1; (+) strand; PAM type: YTN; PAM sequence: CTG
tttaaccaaaaacatctatt

SEQ ID NO: 293741 - DNA, 20 bp, Artificial Sequence
  Description of Artificial Sequence: Synthetic oligonucleotide
  Target: ATXN1; (+) strand; PAM type: YTN; PAM sequence: TTT
aaccaaaaacatctattttt

SEQ ID NO: 293742 - DNA, 20 bp, Artificial Sequence
  Description of Artificial Sequence: Synthetic oligonucleotide
  Target: ATXN1; (+) strand; PAM type: YTN; PAM sequence: TTA
accaaaaacatctatttttg

SEQ ID NO: 293743 - DNA, 20 bp, Artificial Sequence
  Description of Artificial Sequence: Synthetic oligonucleotide
  Target: ATXN1; (+) strand; PAM type: YTN; PAM sequence: CTA
tttttgtaatttttatgaaa

SEQ ID NO: 293744 - DNA, 20 bp, Artificial Sequence
  Description of Artificial Sequence: Synthetic oligonucleotide
  Target: ATXN1; (+) strand; PAM type: YTN; PAM sequence: TTT
ttgtaatttttatgaaatag

SEQ ID NO: 293745 - DNA, 20 bp, Artificial Sequence
  Description of Artificial Sequence: Synthetic oligonucleotide
  Target: ATXN1; (+) strand; PAM type: YTN; PAM sequence: TTT
tgtaatttttatgaaatagt

SEQ ID NO: 293746 - DNA, 20 bp, Artificial Sequence
  Description of Artificial Sequence: Synthetic oligonucleotide
  Target: ATXN1; (+) strand; PAM type: YTN; PAM sequence: TTT
gtaatttttatgaaatagta

SEQ ID NO: 293747 - DNA, 20 bp, Artificial Sequence
  Description of Artificial Sequence: Synthetic oligonucleotide
  Target: ATXN1; (+) strand; PAM type: YTN; PAM sequence: TTG
taatttttatgaaatagtaa

SEQ ID NO: 293748 - DNA, 20 bp, Artificial Sequence
  Description of Artificial Sequence: Synthetic oligonucleotide
  Target: ATXN1; (+) strand; PAM type: YTN; PAM sequence: TTT
ttatgaaatagtaattagta

SEQ ID NO: 293749 - DNA, 20 bp, Artificial Sequence
  Description of Artificial Sequence: Synthetic oligonucleotide
  Target: ATXN1; (+) strand; PAM type: YTN; PAM sequence: TTT
tatgaaatagtaattagtac

SEQ ID NO: 293750 - DNA, 20 bp, Artificial Sequence
  Description of Artificial Sequence: Synthetic oligonucleotide
  Target: ATXN1; (+) strand; PAM type: YTN; PAM sequence: TTT
atgaaatagtaattagtact

SEQ ID NO: 293751 - DNA, 20 bp, Artificial Sequence
  Description of Artificial Sequence: Synthetic oligonucleotide
  Target: ATXN1; (+) strand; PAM type: YTN; PAM sequence: TTA
tgaaatagtaattagtacta

SEQ ID NO: 293752 - DNA, 20 bp, Artificial Sequence
  Description of Artificial Sequence: Synthetic oligonucleotide
  Target: ATXN1; (+) strand; PAM type: YTN; PAM sequence: TTA
gtactaagcttatccaaaaa

SEQ ID NO: 293753 - DNA, 20 bp, Artificial Sequence
  Description of Artificial Sequence: Synthetic oligonucleotide
  Target: ATXN1; (+) strand; PAM type: YTN; PAM sequence: CTA
agcttatccaaaaacatttt

SEQ ID NO: 293754 - DNA, 20 bp, Artificial Sequence
  Description of Artificial Sequence: Synthetic oligonucleotide
  Target: ATXN1; (+) strand; PAM type: YTN; PAM sequence: CTT
atccaaaaacatttttaata

SEQ ID NO: 293755 - DNA, 20 bp, Artificial Sequence
  Description of Artificial Sequence: Synthetic oligonucleotide
  Target: ATXN1; (+) strand; PAM type: YTN; PAM sequence: TTA
tccaaaaacatttttaatat

SEQ ID NO: 293756 - DNA, 20 bp, Artificial Sequence
  Description of Artificial Sequence: Synthetic oligonucleotide
  Target: ATXN1; (+) strand; PAM type: YTN; PAM sequence: TTT
ttaatatcttacctgaagga

SEQ ID NO: 293757 - DNA, 20 bp, Artificial Sequence
  Description of Artificial Sequence: Synthetic oligonucleotide
  Target: ATXN1; (+) strand; PAM type: YTN; PAM sequence: TTT
taatatcttacctgaaggat

SEQ ID NO: 293758 - DNA, 20 bp, Artificial Sequence
  Description of Artificial Sequence: Synthetic oligonucleotide
  Target: ATXN1; (+) strand; PAM type: YTN; PAM sequence: TTT
aatatcttacctgaaggatt

SEQ ID NO: 293759 - DNA, 20 bp, Artificial Sequence
  Description of Artificial Sequence: Synthetic oligonucleotide
  Target: ATXN1; (+) strand; PAM type: YTN; PAM sequence: TTA
atatcttacctgaaggatta

SEQ ID NO: 293760 - DNA, 20 bp, Artificial Sequence
  Description of Artificial Sequence: Synthetic oligonucleotide
  Target: ATXN1; (+) strand; PAM type: YTN; PAM sequence: CTT
acctgaaggattatttctgt

SEQ ID NO: 293761 - DNA, 20 bp, Artificial Sequence
  Description of Artificial Sequence: Synthetic oligonucleotide
  Target: ATXN1; (+) strand; PAM type: YTN; PAM sequence: TTA
cctgaaggattatttctgta

SEQ ID NO: 293762 - DNA, 20 bp, Artificial Sequence
  Description of Artificial Sequence: Synthetic oligonucleotide
  Target: ATXN1; (+) strand; PAM type: YTN; PAM sequence: CTG
aaggattatttctgtatttc

SEQ ID NO: 293763 - DNA, 20 bp, Artificial Sequence
  Description of Artificial Sequence: Synthetic oligonucleotide
  Target: ATXN1; (+) strand; PAM type: YTN; PAM sequence: TTA
tttctgtatttctaaatggg

SEQ ID NO: 293764 - DNA, 20 bp, Artificial Sequence
  Description of Artificial Sequence: Synthetic oligonucleotide
  Target: ATXN1; (+) strand; PAM type: YTN; PAM sequence: TTT
ctgtatttctaaatgggctc

SEQ ID NO: 293765 - DNA, 20 bp, Artificial Sequence
  Description of Artificial Sequence: Synthetic oligonucleotide
  Target: ATXN1; (+) strand; PAM type: YTN; PAM sequence: TTC
tgtatttctaaatgggctct

SEQ ID NO: 293766 - DNA, 20 bp, Artificial Sequence
  Description of Artificial Sequence: Synthetic oligonucleotide
  Target: ATXN1; (+) strand; PAM type: YTN; PAM sequence: CTG
tatttctaaatgggctcttt

SEQ ID NO: 293767 - DNA, 20 bp, Artificial Sequence
  Description of Artificial Sequence: Synthetic oligonucleotide
  Target: ATXN1; (+) strand; PAM type: YTN; PAM sequence: TTT
ctaaatgggctctttccttt

SEQ ID NO: 293768 - DNA, 20 bp, Artificial Sequence
  Description of Artificial Sequence: Synthetic oligonucleotide
  Target: ATXN1; (+) strand; PAM type: YTN; PAM sequence: TTC
taaatgggctctttcctttc

SEQ ID NO: 293769 - DNA, 20 bp, Artificial Sequence
  Description of Artificial Sequence: Synthetic oligonucleotide
  Target: ATXN1; (+) strand; PAM type: YTN; PAM sequence: CTA
aatgggctctttcctttctt

SEQ ID NO: 293770 - DNA, 20 bp, Artificial Sequence
  Description of Artificial Sequence: Synthetic oligonucleotide
  Target: ATXN1; (+) strand; PAM type: YTN; PAM sequence: CTC
tttcctttcttcttaccttt

SEQ ID NO: 293771 - DNA, 20 bp, Artificial Sequence
  Description of Artificial Sequence: Synthetic oligonucleotide
  Target: ATXN1; (+) strand; PAM type: YTN; PAM sequence: CTT
tcctttcttcttacctttgt

SEQ ID NO: 293772 - DNA, 20 bp, Artificial Sequence
  Description of Artificial Sequence: Synthetic oligonucleotide
  Target: ATXN1; (+) strand; PAM type: YTN; PAM sequence: TTT
cctttcttcttacctttgta

SEQ ID NO: 293773 - DNA, 20 bp, Artificial Sequence
  Description of Artificial Sequence: Synthetic oligonucleotide
  Target: ATXN1; (+) strand; PAM type: YTN; PAM sequence: TTC
ctttcttcttacctttgtaa

SEQ ID NO: 293774 - DNA, 20 bp, Artificial Sequence
  Description of Artificial Sequence: Synthetic oligonucleotide
  Target: ATXN1; (+) strand; PAM type: YTN; PAM sequence: CTT
tcttcttacctttgtaaata

SEQ ID NO: 293775 - DNA, 20 bp, Artificial Sequence
  Description of Artificial Sequence: Synthetic oligonucleotide
  Target: ATXN1; (+) strand; PAM type: YTN; PAM sequence: TTT
cttcttacctttgtaaatat

SEQ ID NO: 293776 - DNA, 20 bp, Artificial Sequence
  Description of Artificial Sequence: Synthetic oligonucleotide
  Target: ATXN1; (+) strand; PAM type: YTN; PAM sequence: TTC
ttcttacctttgtaaatatt

SEQ ID NO: 293777 - DNA, 20 bp, Artificial Sequence
  Description of Artificial Sequence: Synthetic oligonucleotide
  Target: ATXN1; (+) strand; PAM type: YTN; PAM sequence: CTT
cttacctttgtaaatattta

SEQ ID NO: 293778 - DNA, 20 bp, Artificial Sequence
  Description of Artificial Sequence: Synthetic oligonucleotide
  Target: ATXN1; (+) strand; PAM type: YTN; PAM sequence: TTC
ttacctttgtaaatatttat

SEQ ID NO: 293779 - DNA, 20 bp, Artificial Sequence
  Description of Artificial Sequence: Synthetic oligonucleotide
  Target: ATXN1; (+) strand; PAM type: YTN; PAM sequence: CTT
acctttgtaaatatttatta

SEQ ID NO: 293780 - DNA, 20 bp, Artificial Sequence
  Description of Artificial Sequence: Synthetic oligonucleotide
  Target: ATXN1; (+) strand; PAM type: YTN; PAM sequence: TTA
cctttgtaaatatttattaa

SEQ ID NO: 293781 - DNA, 20 bp, Artificial Sequence
  Description of Artificial Sequence: Synthetic oligonucleotide
  Target: ATXN1; (+) strand; PAM type: YTN; PAM sequence: CTT
tgtaaatatttattaaactg

SEQ ID NO: 293782 - DNA, 20 bp, Artificial Sequence
  Description of Artificial Sequence: Synthetic oligonucleotide
  Target: ATXN1; (+) strand; PAM type: YTN; PAM sequence: TTT
gtaaatatttattaaactgt

SEQ ID NO: 293783 - DNA, 20 bp, Artificial Sequence
  Description of Artificial Sequence: Synthetic oligonucleotide
  Target: ATXN1; (+) strand; PAM type: YTN; PAM sequence: TTG
taaatatttattaaactgta

SEQ ID NO: 293784 - DNA, 20 bp, Artificial Sequence
  Description of Artificial Sequence: Synthetic oligonucleotide
  Target: ATXN1; (+) strand; PAM type: YTN; PAM sequence: TTT
attaaactgtattatatgca

SEQ ID NO: 293785 - DNA, 20 bp, Artificial Sequence
  Description of Artificial Sequence: Synthetic oligonucleotide
  Target: ATXN1; (+) strand; PAM type: YTN; PAM sequence: TTA
ttaaactgtattatatgcag

SEQ ID NO: 293786 - DNA, 20 bp, Artificial Sequence
  Description of Artificial Sequence: Synthetic oligonucleotide
  Target: ATXN1; (+) strand; PAM type: YTN; PAM sequence: TTA
aactgtattatatgcaggaa

SEQ ID NO: 293787 - DNA, 20 bp, Artificial Sequence
  Description of Artificial Sequence: Synthetic oligonucleotide
  Target: ATXN1; (+) strand; PAM type: YTN; PAM sequence: CTG
tattatatgcaggaatgggc

SEQ ID NO: 293788 - DNA, 20 bp, Artificial Sequence
  Description of Artificial Sequence: Synthetic oligonucleotide
  Target: ATXN1; (+) strand; PAM type: YTN; PAM sequence: TTA
tatgcaggaatgggcttaac

SEQ ID NO: 293789 - DNA, 20 bp, Artificial Sequence
  Description of Artificial Sequence: Synthetic oligonucleotide
  Target: ATXN1; (+) strand; PAM type: YTN; PAM sequence: CTT
aacacttggaatacaaggtt

SEQ ID NO: 293790 - DNA, 20 bp, Artificial Sequence
  Description of Artificial Sequence: Synthetic oligonucleotide
  Target: ATXN1; (+) strand; PAM type: YTN; PAM sequence: TTA
acacttggaatacaaggttt

SEQ ID NO: 293791 - DNA, 20 bp, Artificial Sequence
  Description of Artificial Sequence: Synthetic oligonucleotide
  Target: ATXN1; (+) strand; PAM type: YTN; PAM sequence: CTT
ggaatacaaggtttaagata

SEQ ID NO: 293792 - DNA, 20 bp, Artificial Sequence
  Description of Artificial Sequence: Synthetic oligonucleotide
  Target: ATXN1; (+) strand; PAM type: YTN; PAM sequence: TTG
gaatacaaggtttaagataa

SEQ ID NO: 293793 - DNA, 20 bp, Artificial Sequence
  Description of Artificial Sequence: Synthetic oligonucleotide
  Target: ATXN1; (+) strand; PAM type: YTN; PAM sequence: TTT
aagataagtcaatttctgtc

SEQ ID NO: 293794 - DNA, 20 bp, Artificial Sequence
  Description of Artificial Sequence: Synthetic oligonucleotide
  Target: ATXN1; (+) strand; PAM type: YTN; PAM sequence: TTA
agataagtcaatttctgtct

SEQ ID NO: 293795 - DNA, 20 bp, Artificial Sequence
  Description of Artificial Sequence: Synthetic oligonucleotide
  Target: ATXN1; (+) strand; PAM type: YTN; PAM sequence: TTT
ctgtcttcatgaatcattta

SEQ ID NO: 293796 - DNA, 20 bp, Artificial Sequence
  Description of Artificial Sequence: Synthetic oligonucleotide
  Target: ATXN1; (+) strand; PAM type: YTN; PAM sequence: TTC
tgtcttcatgaatcatttac

SEQ ID NO: 293797 - DNA, 20 bp, Artificial Sequence
  Description of Artificial Sequence: Synthetic oligonucleotide
  Target: ATXN1; (+) strand; PAM type: YTN; PAM sequence: CTG
tcttcatgaatcatttacca

SEQ ID NO: 293798 - DNA, 20 bp, Artificial Sequence
  Description of Artificial Sequence: Synthetic oligonucleotide
  Target: ATXN1; (+) strand; PAM type: YTN; PAM sequence: CTT
catgaatcatttaccaagat

SEQ ID NO: 293799 - DNA, 20 bp, Artificial Sequence
  Description of Artificial Sequence: Synthetic oligonucleotide
  Target: ATXN1; (+) strand; PAM type: YTN; PAM sequence: TTC
atgaatcatttaccaagata

SEQ ID NO: 293800 - DNA, 20 bp, Artificial Sequence
  Description of Artificial Sequence: Synthetic oligonucleotide
  Target: ATXN1; (+) strand; PAM type: YTN; PAM sequence: TTT
accaagatagctatatgagc

SEQ ID NO: 293801 - DNA, 20 bp, Artificial Sequence
  Description of Artificial Sequence: Synthetic oligonucleotide
  Target: ATXN1; (+) strand; PAM type: YTN; PAM sequence: TTA
ccaagatagctatatgagca

SEQ ID NO: 293802 - DNA, 20 bp, Artificial Sequence
  Description of Artificial Sequence: Synthetic oligonucleotide
  Target: ATXN1; (+) strand; PAM type: YTN; PAM sequence: CTA
tatgagcagaaaattgcaat

SEQ ID NO: 293803 - DNA, 20 bp, Artificial Sequence
  Description of Artificial Sequence: Synthetic oligonucleotide
  Target: ATXN1; (+) strand; PAM type: YTN; PAM sequence: TTG
caatataatagcggtaacac

SEQ ID NO: 293804 - DNA, 20 bp, Artificial Sequence
  Description of Artificial Sequence: Synthetic oligonucleotide
  Target: ATXN1; (+) strand; PAM type: YTN; PAM sequence: TTT
ctgttttgtttttttttttc

SEQ ID NO: 293805 - DNA, 20 bp, Artificial Sequence
  Description of Artificial Sequence: Synthetic oligonucleotide
  Target: ATXN1; (+) strand; PAM type: YTN; PAM sequence: TTC
tgttttgtttttttttttcc

SEQ ID NO: 293806 - DNA, 20 bp, Artificial Sequence
  Description of Artificial Sequence: Synthetic oligonucleotide
  Target: ATXN1; (+) strand; PAM type: YTN; PAM sequence: CTG
ttttgtttttttttttcctt

SEQ ID NO: 293807 - DNA, 20 bp, Artificial Sequence
  Description of Artificial Sequence: Synthetic oligonucleotide
  Target: ATXN1; (+) strand; PAM type: YTN; PAM sequence: TTT
tgtttttttttttccttgag

SEQ ID NO: 293808 - DNA, 20 bp, Artificial Sequence
  Description of Artificial Sequence: Synthetic oligonucleotide
  Target: ATXN1; (+) strand; PAM type: YTN; PAM sequence: TTT
gtttttttttttccttgaga

SEQ ID NO: 293809 - DNA, 20 bp, Artificial Sequence
  Description of Artificial Sequence: Synthetic oligonucleotide
  Target: ATXN1; (+) strand; PAM type: YTN; PAM sequence: TTG
tttttttttttccttgagac

SEQ ID NO: 293810 - DNA, 20 bp, Artificial Sequence
  Description of Artificial Sequence: Synthetic oligonucleotide
  Target: ATXN1; (+) strand; PAM type: YTN; PAM sequence: TTT
ttttttttccttgagacgag

SEQ ID NO: 293811 - DNA, 20 bp, Artificial Sequence
  Description of Artificial Sequence: Synthetic oligonucleotide
  Target: ATXN1; (+) strand; PAM type: YTN; PAM sequence: TTT
tttttttccttgagacgagc

SEQ ID NO: 293812 - DNA, 20 bp, Artificial Sequence
  Description of Artificial Sequence: Synthetic oligonucleotide
  Target: ATXN1; (+) strand; PAM type: YTN; PAM sequence: TTT
ttttttccttgagacgagct

SEQ ID NO: 293813 - DNA, 20 bp, Artificial Sequence
  Description of Artificial Sequence: Synthetic oligonucleotide
  Target: ATXN1; (+) strand; PAM type: YTN; PAM sequence: TTT
tttttccttgagacgagctc

SEQ ID NO: 293814 - DNA, 20 bp, Artificial Sequence
  Description of Artificial Sequence: Synthetic oligonucleotide
  Target: ATXN1; (+) strand; PAM type: YTN; PAM sequence: TTT
ttttccttgagacgagctct

SEQ ID NO: 293815 - DNA, 20 bp, Artificial Sequence
  Description of Artificial Sequence: Synthetic oligonucleotide
  Target: ATXN1; (+) strand; PAM type: YTN; PAM sequence: TTT
tttccttgagacgagctctc

SEQ ID NO: 293816 - DNA, 20 bp, Artificial Sequence
  Description of Artificial Sequence: Synthetic oligonucleotide
  Target: ATXN1; (+) strand; PAM type: YTN; PAM sequence: TTT
ttccttgagacgagctctct

SEQ ID NO: 293817 - DNA, 20 bp, Artificial Sequence
  Description of Artificial Sequence: Synthetic oligonucleotide
  Target: ATXN1; (+) strand; PAM type: YTN; PAM sequence: TTT
tccttgagacgagctctcta

SEQ ID NO: 293818 - DNA, 20 bp, Artificial Sequence
  Description of Artificial Sequence: Synthetic oligonucleotide
  Target: ATXN1; (+) strand; PAM type: YTN; PAM sequence: TTT
ccttgagacgagctctctat

SEQ ID NO: 293819 - DNA, 20 bp, Artificial Sequence
  Description of Artificial Sequence: Synthetic oligonucleotide
  Target: ATXN1; (+) strand; PAM type: YTN; PAM sequence: TTC
cttgagacgagctctctatc

SEQ ID NO: 293820 - DNA, 20 bp, Artificial Sequence
  Description of Artificial Sequence: Synthetic oligonucleotide
  Target: ATXN1; (+) strand; PAM type: YTN; PAM sequence: CTT
gagacgagctctctatctgt

SEQ ID NO: 293821 - DNA, 20 bp, Artificial Sequence
  Description of Artificial Sequence: Synthetic oligonucleotide
  Target: ATXN1; (+) strand; PAM type: YTN; PAM sequence: TTG
agacgagctctctatctgtt

SEQ ID NO: 293822 - DNA, 20 bp, Artificial Sequence
  Description of Artificial Sequence: Synthetic oligonucleotide
  Target: ATXN1; (+) strand; PAM type: YTN; PAM sequence: CTC
tctatctgttgcccaggctg

SEQ ID NO: 293823 - DNA, 20 bp, Artificial Sequence
  Description of Artificial Sequence: Synthetic oligonucleotide
  Target: ATXN1; (+) strand; PAM type: YTN; PAM sequence: CTC
tatctgttgcccaggctgga

SEQ ID NO: 293824 - DNA, 20 bp, Artificial Sequence
  Description of Artificial Sequence: Synthetic oligonucleotide
  Target: ATXN1; (+) strand; PAM type: YTN; PAM sequence: CTA
tctgttgcccaggctggagt

SEQ ID NO: 293825 - DNA, 20 bp, Artificial Sequence
  Description of Artificial Sequence: Synthetic oligonucleotide
  Target: ATXN1; (+) strand; PAM type: YTN; PAM sequence: CTG
ttgcccaggctggagtggaa

SEQ ID NO: 293826 - DNA, 20 bp, Artificial Sequence
  Description of Artificial Sequence: Synthetic oligonucleotide
  Target: ATXN1; (+) strand; PAM type: YTN; PAM sequence: TTG
cccaggctggagtggaatgg

SEQ ID NO: 293827 - DNA, 20 bp, Artificial Sequence
  Description of Artificial Sequence: Synthetic oligonucleotide
  Target: ATXN1; (+) strand; PAM type: YTN; PAM sequence: CTG
gagtggaatggtgcagtcta

SEQ ID NO: 293828 - DNA, 20 bp, Artificial Sequence
  Description of Artificial Sequence: Synthetic oligonucleotide
  Target: ATXN1; (+) strand; PAM type: YTN; PAM sequence: CTA
aactttctgggctcaagaaa

SEQ ID NO: 293829 - DNA, 20 bp, Artificial Sequence
  Description of Artificial Sequence: Synthetic oligonucleotide
  Target: ATXN1; (+) strand; PAM type: YTN; PAM sequence: CTT
tctgggctcaagaaatcctc

SEQ ID NO: 293830 - DNA, 20 bp, Artificial Sequence
  Description of Artificial Sequence: Synthetic oligonucleotide
  Target: ATXN1; (+) strand; PAM type: YTN; PAM sequence: TTT
ctgggctcaagaaatcctct

SEQ ID NO: 293831 - DNA, 20 bp, Artificial Sequence
  Description of Artificial Sequence: Synthetic oligonucleotide
  Target: ATXN1; (+) strand; PAM type: YTN; PAM sequence: TTC
tgggctcaagaaatcctctt

SEQ ID NO: 293832 - DNA, 20 bp, Artificial Sequence
  Description of Artificial Sequence: Synthetic oligonucleotide
  Target: ATXN1; (+) strand; PAM type: YTN; PAM sequence: CTG
ggctcaagaaatcctcttcc

SEQ ID NO: 293833 - DNA, 20 bp, Artificial Sequence
  Description of Artificial Sequence: Synthetic oligonucleotide
  Target: ATXN1; (+) strand; PAM type: YTN; PAM sequence: CTC
aagaaatcctcttccctcag

SEQ ID NO: 293834 - DNA, 20 bp, Artificial Sequence
  Description of Artificial Sequence: Synthetic oligonucleotide
  Target: ATXN1; (+) strand; PAM type: YTN; PAM sequence: CTC
ttccctcagcctctcaaaat

SEQ ID NO: 293835 - DNA, 20 bp, Artificial Sequence
  Description of Artificial Sequence: Synthetic oligonucleotide
  Target: ATXN1; (+) strand; PAM type: YTN; PAM sequence: CTT
ccctcagcctctcaaaatgc

SEQ ID NO: 293836 - DNA, 20 bp, Artificial Sequence
  Description of Artificial Sequence: Synthetic oligonucleotide
  Target: ATXN1; (+) strand; PAM type: YTN; PAM sequence: TTC
cctcagcctctcaaaatgct

SEQ ID NO: 293837 - DNA, 20 bp, Artificial Sequence
  Description of Artificial Sequence: Synthetic oligonucleotide
  Target: ATXN1; (+) strand; PAM type: YTN; PAM sequence: CTC
agcctctcaaaatgctgaca

SEQ ID NO: 293838 - DNA, 20 bp, Artificial Sequence
  Description of Artificial Sequence: Synthetic oligonucleotide
  Target: ATXN1; (+) strand; PAM type: YTN; PAM sequence: CTC
tcaaaatgctgacattacag

SEQ ID NO: 293839 - DNA, 20 bp, Artificial Sequence
  Description of Artificial Sequence: Synthetic oligonucleotide
  Target: ATXN1; (+) strand; PAM type: YTN; PAM sequence: CTC
aaaatgctgacattacagat

SEQ ID NO: 293840 - DNA, 20 bp, Artificial Sequence
  Description of Artificial Sequence: Synthetic oligonucleotide
  Target: ATXN1; (+) strand; PAM type: YTN; PAM sequence: CTG
acattacagatgtgagacac

SEQ ID NO: 293841 - DNA, 20 bp, Artificial Sequence
  Description of Artificial Sequence: Synthetic oligonucleotide
  Target: ATXN1; (+) strand; PAM type: YTN; PAM sequence: TTA
cagatgtgagacaccatgct

SEQ ID NO: 293842 - DNA, 20 bp, Artificial Sequence
  Description of Artificial Sequence: Synthetic oligonucleotide
  Target: ATXN1; (+) strand; PAM type: YTN; PAM sequence: CTT
ggccaggaatttcaattagg

SEQ ID NO: 293843 - DNA, 20 bp, Artificial Sequence
  Description of Artificial Sequence: Synthetic oligonucleotide
  Target: ATXN1; (+) strand; PAM type: YTN; PAM sequence: TTG
gccaggaatttcaattaggc

SEQ ID NO: 293844 - DNA, 20 bp, Artificial Sequence
  Description of Artificial Sequence: Synthetic oligonucleotide
  Target: ATXN1; (+) strand; PAM type: YTN; PAM sequence: TTT
caattaggcctcaacgaatg

SEQ ID NO: 293845 - DNA, 20 bp, Artificial Sequence
  Description of Artificial Sequence: Synthetic oligonucleotide
  Target: ATXN1; (+) strand; PAM type: YTN; PAM sequence: TTC
aattaggcctcaacgaatga

SEQ ID NO: 293846 - DNA, 20 bp, Artificial Sequence
  Description of Artificial Sequence: Synthetic oligonucleotide
  Target: ATXN1; (+) strand; PAM type: YTN; PAM sequence: TTA
ggcctcaacgaatgagtggg

SEQ ID NO: 293847 - DNA, 20 bp, Artificial Sequence
  Description of Artificial Sequence: Synthetic oligonucleotide
  Target: ATXN1; (+) strand; PAM type: YTN; PAM sequence: CTC
aacgaatgagtgggagttta

SEQ ID NO: 293848 - DNA, 20 bp, Artificial Sequence
  Description of Artificial Sequence: Synthetic oligonucleotide
  Target: ATXN1; (+) strand; PAM type: YTN; PAM sequence: TTT
accaggcagagaacaagagt

SEQ ID NO: 293849 - DNA, 20 bp, Artificial Sequence
  Description of Artificial Sequence: Synthetic oligonucleotide
  Target: ATXN1; (+) strand; PAM type: YTN; PAM sequence: TTA
ccaggcagagaacaagagtc

SEQ ID NO: 293850 - DNA, 20 bp, Artificial Sequence
  Description of Artificial Sequence: Synthetic oligonucleotide
  Target: ATXN1; (+) strand; PAM type: YTN; PAM sequence: CTC
atgcgagaagaaacaacagg

SEQ ID NO: 293851 - DNA, 20 bp, Artificial Sequence
  Description of Artificial Sequence: Synthetic oligonucleotide
  Target: ATXN1; (+) strand; PAM type: YTN; PAM sequence: TTA
ttatatacatagtatgttta

SEQ ID NO: 293852 - DNA, 20 bp, Artificial Sequence
  Description of Artificial Sequence: Synthetic oligonucleotide
  Target: ATXN1; (+) strand; PAM type: YTN; PAM sequence: TTA
tatacatagtatgtttaaga

SEQ ID NO: 293853 - DNA, 20 bp, Artificial Sequence
  Description of Artificial Sequence: Synthetic oligonucleotide
  Target: ATXN1; (+) strand; PAM type: YTN; PAM sequence: TTT
aagaagaaaacaaatattat

SEQ ID NO: 293854 - DNA, 20 bp, Artificial Sequence
  Description of Artificial Sequence: Synthetic oligonucleotide
  Target: ATXN1; (+) strand; PAM type: YTN; PAM sequence: TTA
agaagaaaacaaatattata

SEQ ID NO: 293855 - DNA, 20 bp, Artificial Sequence
  Description of Artificial Sequence: Synthetic oligonucleotide
  Target: ATXN1; (+) strand; PAM type: YTN; PAM sequence: TTA
tatggagagatggaagggat

SEQ ID NO: 293856 - DNA, 20 bp, Artificial Sequence
  Description of Artificial Sequence: Synthetic oligonucleotide
  Target: ATXN1; (+) strand; PAM type: YTN; PAM sequence: TTT
aaatggtaagttgataagga

SEQ ID NO: 293857 - DNA, 20 bp, Artificial Sequence
  Description of Artificial Sequence: Synthetic oligonucleotide
  Target: ATXN1; (+) strand; PAM type: YTN; PAM sequence: TTA
aatggtaagttgataaggaa

SEQ ID NO: 293858 - DNA, 20 bp, Artificial Sequence
  Description of Artificial Sequence: Synthetic oligonucleotide
  Target: ATXN1; (+) strand; PAM type: YTN; PAM sequence: TTG
ataaggaattcctaggggcc

SEQ ID NO: 293859 - DNA, 20 bp, Artificial Sequence
  Description of Artificial Sequence: Synthetic oligonucleotide
  Target: ATXN1; (+) strand; PAM type: YTN; PAM sequence: TTC
ctaggggccttagaggccat

SEQ ID NO: 293860 - DNA, 20 bp, Artificial Sequence
  Description of Artificial Sequence: Synthetic oligonucleotide
  Target: ATXN1; (+) strand; PAM type: YTN; PAM sequence: CTA
ggggccttagaggccatgca

SEQ ID NO: 293861 - DNA, 20 bp, Artificial Sequence
  Description of Artificial Sequence: Synthetic oligonucleotide
  Target: ATXN1; (+) strand; PAM type: YTN; PAM sequence: CTT
agaggccatgcagtgaaatt

SEQ ID NO: 293862 - DNA, 20 bp, Artificial Sequence
  Description of Artificial Sequence: Synthetic oligonucleotide
  Target: ATXN1; (+) strand; PAM type: YTN; PAM sequence: TTA
gaggccatgcagtgaaattc

SEQ ID NO: 293863 - DNA, 20 bp, Artificial Sequence
  Description of Artificial Sequence: Synthetic oligonucleotide
  Target: ATXN1; (+) strand; PAM type: YTN; PAM sequence: TTC
acattttaccttatcaggag

SEQ ID NO: 293864 - DNA, 20 bp, Artificial Sequence
  Description of Artificial Sequence: Synthetic oligonucleotide
  Target: ATXN1; (+) strand; PAM type: YTN; PAM sequence: TTT
taccttatcaggagcagaaa

SEQ ID NO: 293865 - DNA, 20 bp, Artificial Sequence
  Description of Artificial Sequence: Synthetic oligonucleotide
  Target: ATXN1; (+) strand; PAM type: YTN; PAM sequence: TTT
accttatcaggagcagaaag

SEQ ID NO: 293866 - DNA, 20 bp, Artificial Sequence
  Description of Artificial Sequence: Synthetic oligonucleotide
  Target: ATXN1; (+) strand; PAM type: YTN; PAM sequence: TTA
ccttatcaggagcagaaagc

SEQ ID NO: 293867 - DNA, 20 bp, Artificial Sequence
  Description of Artificial Sequence: Synthetic oligonucleotide
  Target: ATXN1; (+) strand; PAM type: YTN; PAM sequence: CTT
atcaggagcagaaagctaac

SEQ ID NO: 293868 - DNA, 20 bp, Artificial Sequence
  Description of Artificial Sequence: Synthetic oligonucleotide
  Target: ATXN1; (+) strand; PAM type: YTN; PAM sequence: TTA
tcaggagcagaaagctaaca

SEQ ID NO: 293869 - DNA, 20 bp, Artificial Sequence
  Description of Artificial Sequence: Synthetic oligonucleotide
  Target: ATXN1; (+) strand; PAM type: YTN; PAM sequence: CTA
acaaaatcctttcaattatt

SEQ ID NO: 293870 - DNA, 20 bp, Artificial Sequence
  Description of Artificial Sequence: Synthetic oligonucleotide
  Target: ATXN1; (+) strand; PAM type: YTN; PAM sequence: CTT
tcaattattcattttacttc

SEQ ID NO: 293871 - DNA, 20 bp, Artificial Sequence
  Description of Artificial Sequence: Synthetic oligonucleotide
  Target: ATXN1; (+) strand; PAM type: YTN; PAM sequence: TTT
caattattcattttacttca

SEQ ID NO: 293872 - DNA, 20 bp, Artificial Sequence
  Description of Artificial Sequence: Synthetic oligonucleotide
  Target: ATXN1; (+) strand; PAM type: YTN; PAM sequence: TTC
aattattcattttacttcac

SEQ ID NO: 293873 - DNA, 20 bp, Artificial Sequence
  Description of Artificial Sequence: Synthetic oligonucleotide
  Target: ATXN1; (+) strand; PAM type: YTN; PAM sequence: TTA
ttcattttacttcaccatat

SEQ ID NO: 293874 - DNA, 20 bp, Artificial Sequence
  Description of Artificial Sequence: Synthetic oligonucleotide
  Target: ATXN1; (+) strand; PAM type: YTN; PAM sequence: TTC
attttacttcaccatattca

SEQ ID NO: 293875 - DNA, 20 bp, Artificial Sequence
  Description of Artificial Sequence: Synthetic oligonucleotide
  Target: ATXN1; (+) strand; PAM type: YTN; PAM sequence: TTT
tacttcaccatattcatttg

SEQ ID NO: 293876 - DNA, 20 bp, Artificial Sequence
  Description of Artificial Sequence: Synthetic oligonucleotide
  Target: ATXN1; (+) strand; PAM type: YTN; PAM sequence: TTT
acttcaccatattcatttgc

SEQ ID NO: 293877 - DNA, 20 bp, Artificial Sequence
  Description of Artificial Sequence: Synthetic oligonucleotide
  Target: ATXN1; (+) strand; PAM type: YTN; PAM sequence: TTA
cttcaccatattcatttgct

SEQ ID NO: 293878 - DNA, 20 bp, Artificial Sequence
  Description of Artificial Sequence: Synthetic oligonucleotide
  Target: ATXN1; (+) strand; PAM type: YTN; PAM sequence: CTT
caccatattcatttgctacc

SEQ ID NO: 293879 - DNA, 20 bp, Artificial Sequence
  Description of Artificial Sequence: Synthetic oligonucleotide
  Target: ATXN1; (+) strand; PAM type: YTN; PAM sequence: TTC
accatattcatttgctacca

SEQ ID NO: 293880 - DNA, 20 bp, Artificial Sequence
  Description of Artificial Sequence: Synthetic oligonucleotide
  Target: ATXN1; (+) strand; PAM type: YTN; PAM sequence: TTC
atttgctaccaaaggagtat

SEQ ID NO: 293881 - DNA, 20 bp, Artificial Sequence
  Description of Artificial Sequence: Synthetic oligonucleotide
  Target: ATXN1; (+) strand; PAM type: YTN; PAM sequence: TTT
gctaccaaaggagtattaaa

SEQ ID NO: 293882 - DNA, 20 bp, Artificial Sequence
  Description of Artificial Sequence: Synthetic oligonucleotide
  Target: ATXN1; (+) strand; PAM type: YTN; PAM sequence: TTG
ctaccaaaggagtattaaaa

SEQ ID NO: 293883 - DNA, 20 bp, Artificial Sequence
  Description of Artificial Sequence: Synthetic oligonucleotide
  Target: ATXN1; (+) strand; PAM type: YTN; PAM sequence: CTA
ccaaaggagtattaaaaaac

SEQ ID NO: 293884 - DNA, 20 bp, Artificial Sequence
  Description of Artificial Sequence: Synthetic oligonucleotide
  Target: ATXN1; (+) strand; PAM type: YTN; PAM sequence: TTA
aaaaacacacacacacatga

SEQ ID NO: 293885 - DNA, 20 bp, Artificial Sequence
  Description of Artificial Sequence: Synthetic oligonucleotide
  Target: ATXN1; (+) strand; PAM type: YTN; PAM sequence: TTG
ccctaatattaaaaatacct

SEQ ID NO: 293886 - DNA, 20 bp, Artificial Sequence
  Description of Artificial Sequence: Synthetic oligonucleotide
  Target: ATXN1; (+) strand; PAM type: YTN; PAM sequence: CTA
atattaaaaataccttcatt

SEQ ID NO: 293887 - DNA, 20 bp, Artificial Sequence
  Description of Artificial Sequence: Synthetic oligonucleotide
  Target: ATXN1; (+) strand; PAM type: YTN; PAM sequence: TTA
aaaataccttcattcttgtt

SEQ ID NO: 293888 - DNA, 20 bp, Artificial Sequence
  Description of Artificial Sequence: Synthetic oligonucleotide
  Target: ATXN1; (+) strand; PAM type: YTN; PAM sequence: CTT
cattcttgttttctttactt

SEQ ID NO: 293889 - DNA, 20 bp, Artificial Sequence
  Description of Artificial Sequence: Synthetic oligonucleotide
  Target: ATXN1; (+) strand; PAM type: YTN; PAM sequence: TTC
attcttgttttctttacttc

SEQ ID NO: 293890 - DNA, 20 bp, Artificial Sequence
  Description of Artificial Sequence: Synthetic oligonucleotide
  Target: ATXN1; (+) strand; PAM type: YTN; PAM sequence: TTC
ttgttttctttacttctagc

SEQ ID NO: 293891 - DNA, 20 bp, Artificial Sequence
  Description of Artificial Sequence: Synthetic oligonucleotide
  Target: ATXN1; (+) strand; PAM type: YTN; PAM sequence: CTT
gttttctttacttctagcct

SEQ ID NO: 293892 - DNA, 20 bp, Artificial Sequence
  Description of Artificial Sequence: Synthetic oligonucleotide
  Target: ATXN1; (+) strand; PAM type: YTN; PAM sequence: TTG
ttttctttacttctagcctt

SEQ ID NO: 293893 - DNA, 20 bp, Artificial Sequence
  Description of Artificial Sequence: Synthetic oligonucleotide
  Target: ATXN1; (+) strand; PAM type: YTN; PAM sequence: TTT
tctttacttctagcctttgt

SEQ ID NO: 293894 - DNA, 20 bp, Artificial Sequence
  Description of Artificial Sequence: Synthetic oligonucleotide
  Target: ATXN1; (+) strand; PAM type: YTN; PAM sequence: TTT
ctttacttctagcctttgtg

SEQ ID NO: 293895 - DNA, 20 bp, Artificial Sequence
  Description of Artificial Sequence: Synthetic oligonucleotide
  Target: ATXN1; (+) strand; PAM type: YTN; PAM sequence: TTC
tttacttctagcctttgtgg

SEQ ID NO: 293896 - DNA, 20 bp, Artificial Sequence
  Description of Artificial Sequence: Synthetic oligonucleotide
  Target: ATXN1; (+) strand; PAM type: YTN; PAM sequence: CTT
tacttctagcctttgtggat

SEQ ID NO: 293897 - DNA, 20 bp, Artificial Sequence
  Description of Artificial Sequence: Synthetic oligonucleotide
  Target: ATXN1; (+) strand; PAM type: YTN; PAM sequence: TTT
acttctagcctttgtggata

SEQ ID NO: 293898 - DNA, 20 bp, Artificial Sequence
  Description of Artificial Sequence: Synthetic oligonucleotide
  Target: ATXN1; (+) strand; PAM type: YTN; PAM sequence: TTA
cttctagcctttgtggatag

SEQ ID NO: 293899 - DNA, 20 bp, Artificial Sequence
  Description of Artificial Sequence: Synthetic oligonucleotide
  Target: ATXN1; (+) strand; PAM type: YTN; PAM sequence: CTT
ctagcctttgtggataggca

SEQ ID NO: 293900 - DNA, 20 bp, Artificial Sequence
  Description of Artificial Sequence: Synthetic oligonucleotide
  Target: ATXN1; (+) strand; PAM type: YTN; PAM sequence: TTC
tagcctttgtggataggcat

SEQ ID NO: 293901 - DNA, 20 bp, Artificial Sequence
  Description of Artificial Sequence: Synthetic oligonucleotide
  Target: ATXN1; (+) strand; PAM type: YTN; PAM sequence: CTA
gcctttgtggataggcatag

SEQ ID NO: 293902 - DNA, 20 bp, Artificial Sequence
  Description of Artificial Sequence: Synthetic oligonucleotide
  Target: ATXN1; (+) strand; PAM type: YTN; PAM sequence: CTT
tgtggataggcatagatttt

SEQ ID NO: 293903 - DNA, 20 bp, Artificial Sequence
  Description of Artificial Sequence: Synthetic oligonucleotide
  Target: ATXN1; (+) strand; PAM type: YTN; PAM sequence: TTT
gtggataggcatagattttt

SEQ ID NO: 293904 - DNA, 20 bp, Artificial Sequence
  Description of Artificial Sequence: Synthetic oligonucleotide
  Target: ATXN1; (+) strand; PAM type: YTN; PAM sequence: TTG
tggataggcatagatttttg

SEQ ID NO: 293905 - DNA, 20 bp, Artificial Sequence
  Description of Artificial Sequence: Synthetic oligonucleotide
  Target: ATXN1; (+) strand; PAM type: YTN; PAM sequence: TTT
ttgtcactgctttgtaatca

SEQ ID NO: 293906 - DNA, 20 bp, Artificial Sequence
  Description of Artificial Sequence: Synthetic oligonucleotide
  Target: ATXN1; (+) strand; PAM type: YTN; PAM sequence: TTT
tgtcactgctttgtaatcaa

SEQ ID NO: 293907 - DNA, 20 bp, Artificial Sequence
  Description of Artificial Sequence: Synthetic oligonucleotide
  Target: ATXN1; (+) strand; PAM type: YTN; PAM sequence: TTT
gtcactgctttgtaatcaat

SEQ ID NO: 293908 - DNA, 20 bp, Artificial Sequence
  Description of Artificial Sequence: Synthetic oligonucleotide
  Target: ATXN1; (+) strand; PAM type: YTN; PAM sequence: TTG
tcactgctttgtaatcaatg

SEQ ID NO: 293909 - DNA, 20 bp, Artificial Sequence
  Description of Artificial Sequence: Synthetic oligonucleotide
  Target: ATXN1; (+) strand; PAM type: YTN; PAM sequence: CTG
ctttgtaatcaatgtgtttg

SEQ ID NO: 293910 - DNA, 20 bp, Artificial Sequence
  Description of Artificial Sequence: Synthetic oligonucleotide
  Target: ATXN1; (+) strand; PAM type: YTN; PAM sequence: CTT
tgtaatcaatgtgtttgcac

SEQ ID NO: 293911 - DNA, 20 bp, Artificial Sequence
  Description of Artificial Sequence: Synthetic oligonucleotide
  Target: ATXN1; (+) strand; PAM type: YTN; PAM sequence: TTT
gtaatcaatgtgtttgcaca

SEQ ID NO: 293912 - DNA, 20 bp, Artificial Sequence
  Description of Artificial Sequence: Synthetic oligonucleotide
  Target: ATXN1; (+) strand; PAM type: YTN; PAM sequence: TTG
taatcaatgtgtttgcacaa

SEQ ID NO: 293913 - DNA, 20 bp, Artificial Sequence
  Description of Artificial Sequence: Synthetic oligonucleotide
  Target: ATXN1; (+) strand; PAM type: YTN; PAM sequence: TTT
gcacaattttgaaatatgaa

SEQ ID NO: 293914 - DNA, 20 bp, Artificial Sequence
  Description of Artificial Sequence: Synthetic oligonucleotide
  Target: ATXN1; (+) strand; PAM type: YTN; PAM sequence: TTG
cacaattttgaaatatgaat

SEQ ID NO: 293915 - DNA, 20 bp, Artificial Sequence
  Description of Artificial Sequence: Synthetic oligonucleotide
  Target: ATXN1; (+) strand; PAM type: YTN; PAM sequence: TTT
tgaaatatgaattttatact

SEQ ID NO: 293916 - DNA, 20 bp, Artificial Sequence
  Description of Artificial Sequence: Synthetic oligonucleotide
  Target: ATXN1; (+) strand; PAM type: YTN; PAM sequence: TTT
gaaatatgaattttatactt

SEQ ID NO: 293917 - DNA, 20 bp, Artificial Sequence
  Description of Artificial Sequence: Synthetic oligonucleotide
  Target: ATXN1; (+) strand; PAM type: YTN; PAM sequence: TTG
aaatatgaattttatactta

SEQ ID NO: 293918 - DNA, 20 bp, Artificial Sequence
  Description of Artificial Sequence: Synthetic oligonucleotide
  Target: ATXN1; (+) strand; PAM type: YTN; PAM sequence: TTT
tatacttaacatttgttggg

SEQ ID NO: 293919 - DNA, 20 bp, Artificial Sequence
  Description of Artificial Sequence: Synthetic oligonucleotide
  Target: ATXN1; (+) strand; PAM type: YTN; PAM sequence: TTT
atacttaacatttgttgggt

SEQ ID NO: 293920 - DNA, 20 bp, Artificial Sequence
  Description of Artificial Sequence: Synthetic oligonucleotide
  Target: ATXN1; (+) strand; PAM type: YTN; PAM sequence: TTA
tacttaacatttgttgggtt

SEQ ID NO: 293921 - DNA, 20 bp, Artificial Sequence
  Description of Artificial Sequence: Synthetic oligonucleotide
  Target: ATXN1; (+) strand; PAM type: YTN; PAM sequence: CTT
aacatttgttgggtttagcc

SEQ ID NO: 293922 - DNA, 20 bp, Artificial Sequence
  Description of Artificial Sequence: Synthetic oligonucleotide
  Target: ATXN1; (+) strand; PAM type: YTN; PAM sequence: TTA
acatttgttgggtttagccg

SEQ ID NO: 293923 - DNA, 20 bp, Artificial Sequence
  Description of Artificial Sequence: Synthetic oligonucleotide
  Target: ATXN1; (+) strand; PAM type: YTN; PAM sequence: TTT
gttgggtttagccgaaagct

SEQ ID NO: 293924 - DNA, 20 bp, Artificial Sequence
  Description of Artificial Sequence: Synthetic oligonucleotide
  Target: ATXN1; (+) strand; PAM type: YTN; PAM sequence: TTG
ttgggtttagccgaaagctg

SEQ ID NO: 293925 - DNA, 20 bp, Artificial Sequence
  Description of Artificial Sequence: Synthetic oligonucleotide
  Target: ATXN1; (+) strand; PAM type: YTN; PAM sequence: TTG
ggtttagccgaaagctgcct

SEQ ID NO: 293926 - DNA, 20 bp, Artificial Sequence
  Description of Artificial Sequence: Synthetic oligonucleotide
  Target: ATXN1; (+) strand; PAM type: YTN; PAM sequence: TTT
agccgaaagctgccttcttc

SEQ ID NO: 293927 - DNA, 20 bp, Artificial Sequence
  Description of Artificial Sequence: Synthetic oligonucleotide
  Target: ATXN1; (+) strand; PAM type: YTN; PAM sequence: TTA
gccgaaagctgccttcttcc

SEQ ID NO: 293928 - DNA, 20 bp, Artificial Sequence
  Description of Artificial Sequence: Synthetic oligonucleotide
  Target: ATXN1; (+) strand; PAM type: YTN; PAM sequence: CTG
ccttcttccatattttaagt

SEQ ID NO: 293929 - DNA, 20 bp, Artificial Sequence
  Description of Artificial Sequence: Synthetic oligonucleotide
  Target: ATXN1; (+) strand; PAM type: YTN; PAM sequence: CTT
cttccatattttaagtttgg

SEQ ID NO: 293930 - DNA, 20 bp, Artificial Sequence
  Description of Artificial Sequence: Synthetic oligonucleotide
  Target: ATXN1; (+) strand; PAM type: YTN; PAM sequence: TTC
ttccatattttaagtttggc

SEQ ID NO: 293931 - DNA, 20 bp, Artificial Sequence
  Description of Artificial Sequence: Synthetic oligonucleotide
  Target: ATXN1; (+) strand; PAM type: YTN; PAM sequence: CTT
ccatattttaagtttggcct

SEQ ID NO: 293932 - DNA, 20 bp, Artificial Sequence
  Description of Artificial Sequence: Synthetic oligonucleotide
  Target: ATXN1; (+) strand; PAM type: YTN; PAM sequence: TTC
catattttaagtttggccta

SEQ ID NO: 293933 - DNA, 20 bp, Artificial Sequence
  Description of Artificial Sequence: Synthetic oligonucleotide
  Target: ATXN1; (+) strand; PAM type: YTN; PAM sequence: TTT
taagtttggcctaaaggttt

SEQ ID NO: 293934 - DNA, 20 bp, Artificial Sequence
  Description of Artificial Sequence: Synthetic oligonucleotide
  Target: ATXN1; (+) strand; PAM type: YTN; PAM sequence: TTT
aagtttggcctaaaggtttc

SEQ ID NO: 293935 - DNA, 20 bp, Artificial Sequence
  Description of Artificial Sequence: Synthetic oligonucleotide
  Target: ATXN1; (+) strand; PAM type: YTN; PAM sequence: TTA
agtttggcctaaaggtttct

SEQ ID NO: 293936 - DNA, 20 bp, Artificial Sequence
  Description of Artificial Sequence: Synthetic oligonucleotide
  Target: ATXN1; (+) strand; PAM type: YTN; PAM sequence: TTT
ggcctaaaggtttctccgca

SEQ ID NO: 293937 - DNA, 20 bp, Artificial Sequence
  Description of Artificial Sequence: Synthetic oligonucleotide
  Target: ATXN1; (+) strand; PAM type: YTN; PAM sequence: TTG
gcctaaaggtttctccgcat

SEQ ID NO: 293938 - DNA, 20 bp, Artificial Sequence
  Description of Artificial Sequence: Synthetic oligonucleotide
  Target: ATXN1; (+) strand; PAM type: YTN; PAM sequence: CTA
aaggtttctccgcatgcagt

SEQ ID NO: 293939 - DNA, 20 bp, Artificial Sequence
  Description of Artificial Sequence: Synthetic oligonucleotide
  Target: ATXN1; (+) strand; PAM type: YTN; PAM sequence: TTT
ctccgcatgcagtgaaccgt

SEQ ID NO: 293940 - DNA, 20 bp, Artificial Sequence
  Description of Artificial Sequence: Synthetic oligonucleotide
  Target: ATXN1; (+) strand; PAM type: YTN; PAM sequence: TTC
tccgcatgcagtgaaccgta

SEQ ID NO: 293941 - DNA, 20 bp, Artificial Sequence
  Description of Artificial Sequence: Synthetic oligonucleotide
  Target: ATXN1; (+) strand; PAM type: YTN; PAM sequence: CTC
cgcatgcagtgaaccgtaac

SEQ ID NO: 293942 - DNA, 20 bp, Artificial Sequence
  Description of Artificial Sequence: Synthetic oligonucleotide
  Target: ATXN1; (+) strand; PAM type: YTN; PAM sequence: CTA
cctggatgtgtaaacaggct

SEQ ID NO: 293943 - DNA, 20 bp, Artificial Sequence
  Description of Artificial Sequence: Synthetic oligonucleotide
  Target: ATXN1; (+) strand; PAM type: YTN; PAM sequence: CTG
gatgtgtaaacaggctgtaa

SEQ ID NO: 293944 - DNA, 20 bp, Artificial Sequence
  Description of Artificial Sequence: Synthetic oligonucleotide
  Target: ATXN1; (+) strand; PAM type: YTN; PAM sequence: CTG
taacctattcttgtaccaat

SEQ ID NO: 293945 - DNA, 20 bp, Artificial Sequence
  Description of Artificial Sequence: Synthetic oligonucleotide
  Target: ATXN1; (+) strand; PAM type: YTN; PAM sequence: CTA
ttcttgtaccaatctctggg

SEQ ID NO: 293946 - DNA, 20 bp, Artificial Sequence
  Description of Artificial Sequence: Synthetic oligonucleotide
  Target: ATXN1; (+) strand; PAM type: YTN; PAM sequence: TTC
ttgtaccaatctctgggttt

SEQ ID NO: 293947 - DNA, 20 bp, Artificial Sequence
  Description of Artificial Sequence: Synthetic oligonucleotide
  Target: ATXN1; (+) strand; PAM type: YTN; PAM sequence: CTT
gtaccaatctctgggtttcg

SEQ ID NO: 293948 - DNA, 20 bp, Artificial Sequence
  Description of Artificial Sequence: Synthetic oligonucleotide
  Target: ATXN1; (+) strand; PAM type: YTN; PAM sequence: TTG
taccaatctctgggtttcgg

SEQ ID NO: 293949 - DNA, 20 bp, Artificial Sequence
  Description of Artificial Sequence: Synthetic oligonucleotide
  Target: ATXN1; (+) strand; PAM type: YTN; PAM sequence: CTC
tgggtttcggcgaatcacag

SEQ ID NO: 293950 - DNA, 20 bp, Artificial Sequence
  Description of Artificial Sequence: Synthetic oligonucleotide
  Target: ATXN1; (+) strand; PAM type: YTN; PAM sequence: CTG
ggtttcggcgaatcacaggc

SEQ ID NO: 293951 - DNA, 20 bp, Artificial Sequence
  Description of Artificial Sequence: Synthetic oligonucleotide
  Target: ATXN1; (+) strand; PAM type: YTN; PAM sequence: TTT
cggcgaatcacaggcagcct

SEQ ID NO: 293952 - DNA, 20 bp, Artificial Sequence
  Description of Artificial Sequence: Synthetic oligonucleotide
  Target: ATXN1; (+) strand; PAM type: YTN; PAM sequence: TTC
ggcgaatcacaggcagccta

SEQ ID NO: 293953 - DNA, 20 bp, Artificial Sequence
  Description of Artificial Sequence: Synthetic oligonucleotide
  Target: ATXN1; (+) strand; PAM type: YTN; PAM sequence: CTA
tcgttcaaaccctgttcaaa

SEQ ID NO: 293954 - DNA, 20 bp, Artificial Sequence
  Description of Artificial Sequence: Synthetic oligonucleotide
  Target: ATXN1; (+) strand; PAM type: YTN; PAM sequence: TTC
aaaccctgttcaaataaggc

SEQ ID NO: 293955 - DNA, 20 bp, Artificial Sequence
  Description of Artificial Sequence: Synthetic oligonucleotide
  Target: ATXN1; (+) strand; PAM type: YTN; PAM sequence: CTG
ttcaaataaggcgaacgctg

SEQ ID NO: 293956 - DNA, 20 bp, Artificial Sequence
  Description of Artificial Sequence: Synthetic oligonucleotide
  Target: ATXN1; (+) strand; PAM type: YTN; PAM sequence: TTC
aaataaggcgaacgctgagc

SEQ ID NO: 293957 - DNA, 20 bp, Artificial Sequence
  Description of Artificial Sequence: Synthetic oligonucleotide
  Target: ATXN1; (+) strand; PAM type: YTN; PAM sequence: CTG
agctgaaaccaatctggctg

SEQ ID NO: 293958 - DNA, 20 bp, Artificial Sequence
  Description of Artificial Sequence: Synthetic oligonucleotide
  Target: ATXN1; (+) strand; PAM type: YTN; PAM sequence: CTG
aaaccaatctggctgtttct

SEQ ID NO: 293959 - DNA, 20 bp, Artificial Sequence
  Description of Artificial Sequence: Synthetic oligonucleotide
  Target: ATXN1; (+) strand; PAM type: YTN; PAM sequence: CTG
gctgtttctgtacctcactt

SEQ ID NO: 293960 - DNA, 20 bp, Artificial Sequence
  Description of Artificial Sequence: Synthetic oligonucleotide
  Target: ATXN1; (+) strand; PAM type: YTN; PAM sequence: CTG
tttctgtacctcacttctgt

SEQ ID NO: 293961 - DNA, 20 bp, Artificial Sequence
  Description of Artificial Sequence: Synthetic oligonucleotide
  Target: ATXN1; (+) strand; PAM type: YTN; PAM sequence: TTT
ctgtacctcacttctgtttt

SEQ ID NO: 293962 - DNA, 20 bp, Artificial Sequence
  Description of Artificial Sequence: Synthetic oligonucleotide
  Target: ATXN1; (+) strand; PAM type: YTN; PAM sequence: TTC
tgtacctcacttctgttttc

SEQ ID NO: 293963 - DNA, 20 bp, Artificial Sequence
  Description of Artificial Sequence: Synthetic oligonucleotide
  Target: ATXN1; (+) strand; PAM type: YTN; PAM sequence: CTG
tacctcacttctgttttctg

SEQ ID NO: 293964 - DNA, 20 bp, Artificial Sequence
  Description of Artificial Sequence: Synthetic oligonucleotide
  Target: ATXN1; (+) strand; PAM type: YTN; PAM sequence: CTC
acttctgttttctgtccgtc

SEQ ID NO: 293965 - DNA, 20 bp, Artificial Sequence
  Description of Artificial Sequence: Synthetic oligonucleotide
  Target: ATXN1; (+) strand; PAM type: YTN; PAM sequence: CTT
ctgttttctgtccgtcgttt

SEQ ID NO: 293966 - DNA, 20 bp, Artificial Sequence
  Description of Artificial Sequence: Synthetic oligonucleotide
  Target: ATXN1; (+) strand; PAM type: YTN; PAM sequence: TTC
tgttttctgtccgtcgtttt

SEQ ID NO: 293967 - DNA, 20 bp, Artificial Sequence
  Description of Artificial Sequence: Synthetic oligonucleotide
  Target: ATXN1; (+) strand; PAM type: YTN; PAM sequence: CTG
ttttctgtccgtcgttttcc

SEQ ID NO: 293968 - DNA, 20 bp, Artificial Sequence
  Description of Artificial Sequence: Synthetic oligonucleotide
  Target: ATXN1; (+) strand; PAM type: YTN; PAM sequence: TTT
tctgtccgtcgttttccttt

SEQ ID NO: 293969 - DNA, 20 bp, Artificial Sequence
  Description of Artificial Sequence: Synthetic oligonucleotide
  Target: ATXN1; (+) strand; PAM type: YTN; PAM sequence: TTT
ctgtccgtcgttttcctttt

SEQ ID NO: 293970 - DNA, 20 bp, Artificial Sequence
  Description of Artificial Sequence: Synthetic oligonucleotide
  Target: ATXN1; (+) strand; PAM type: YTN; PAM sequence: TTC
tgtccgtcgttttccttttt

SEQ ID NO: 293971 - DNA, 20 bp, Artificial Sequence
  Description of Artificial Sequence: Synthetic oligonucleotide
  Target: ATXN1; (+) strand; PAM type: YTN; PAM sequence: CTG
tccgtcgttttcctttttct

SEQ ID NO: 293972 - DNA, 20 bp, Artificial Sequence
  Description of Artificial Sequence: Synthetic oligonucleotide
  Target: ATXN1; (+) strand; PAM type: YTN; PAM sequence: TTT
tcctttttctgtctataaat

SEQ ID NO: 293973 - DNA, 20 bp, Artificial Sequence
  Description of Artificial Sequence: Synthetic oligonucleotide
  Target: ATXN1; (+) strand; PAM type: YTN; PAM sequence: TTT
cctttttctgtctataaatc

SEQ ID NO: 293974 - DNA, 20 bp, Artificial Sequence
  Description of Artificial Sequence: Synthetic oligonucleotide
  Target: ATXN1; (+) strand; PAM type: YTN; PAM sequence: TTC
ctttttctgtctataaatcc

SEQ ID NO: 293975 - DNA, 20 bp, Artificial Sequence
  Description of Artificial Sequence: Synthetic oligonucleotide
  Target: ATXN1; (+) strand; PAM type: YTN; PAM sequence: CTT
tttctgtctataaatcctct

SEQ ID NO: 293976 - DNA, 20 bp, Artificial Sequence
  Description of Artificial Sequence: Synthetic oligonucleotide
  Target: ATXN1; (+) strand; PAM type: YTN; PAM sequence: TTT
ttctgtctataaatcctctc

SEQ ID NO: 293977 - DNA, 20 bp, Artificial Sequence
  Description of Artificial Sequence: Synthetic oligonucleotide
  Target: ATXN1; (+) strand; PAM type: YTN; PAM sequence: TTT
tctgtctataaatcctctcc

SEQ ID NO: 293978 - DNA, 20 bp, Artificial Sequence
  Description of Artificial Sequence: Synthetic oligonucleotide
  Target: ATXN1; (+) strand; PAM type: YTN; PAM sequence: TTT
ctgtctataaatcctctcca

SEQ ID NO: 293979 - DNA, 20 bp, Artificial Sequence
  Description of Artificial Sequence: Synthetic oligonucleotide
  Target: ATXN1; (+) strand; PAM type: YTN; PAM sequence: TTC
tgtctataaatcctctccaa

SEQ ID NO: 293980 - DNA, 20 bp, Artificial Sequence
  Description of Artificial Sequence: Synthetic oligonucleotide
  Target: ATXN1; (+) strand; PAM type: YTN; PAM sequence: CTG
tctataaatcctctccaacc

SEQ ID NO: 293981 - DNA, 20 bp, Artificial Sequence
  Description of Artificial Sequence: Synthetic oligonucleotide
  Target: ATXN1; (+) strand; PAM type: YTN; PAM sequence: CTA
taaatcctctccaaccacac

SEQ ID NO: 293982 - DNA, 20 bp, Artificial Sequence
  Description of Artificial Sequence: Synthetic oligonucleotide
  Target: ATXN1; (+) strand; PAM type: YTN; PAM sequence: CTC
tccaaccacacaacagcatg

SEQ ID NO: 293983 - DNA, 20 bp, Artificial Sequence
  Description of Artificial Sequence: Synthetic oligonucleotide
  Target: ATXN1; (+) strand; PAM type: YTN; PAM sequence: CTC
caaccacacaacagcatgtc

SEQ ID NO: 293984 - DNA, 20 bp, Artificial Sequence
  Description of Artificial Sequence: Synthetic oligonucleotide
  Target: ATXN1; (+) strand; PAM type: YTN; PAM sequence: CTG
aatctattctagttcgggag

SEQ ID NO: 293985 - DNA, 20 bp, Artificial Sequence
  Description of Artificial Sequence: Synthetic oligonucleotide
  Target: ATXN1; (+) strand; PAM type: YTN; PAM sequence: CTA
ttctagttcgggaggaaagg

SEQ ID NO: 293986 - DNA, 20 bp, Artificial Sequence
  Description of Artificial Sequence: Synthetic oligonucleotide
  Target: ATXN1; (+) strand; PAM type: YTN; PAM sequence: TTC
tagttcgggaggaaaggagt

SEQ ID NO: 293987 - DNA, 20 bp, Artificial Sequence
  Description of Artificial Sequence: Synthetic oligonucleotide
  Target: ATXN1; (+) strand; PAM type: YTN; PAM sequence: CTA
gttcgggaggaaaggagtag

SEQ ID NO: 293988 - DNA, 20 bp, Artificial Sequence
  Description of Artificial Sequence: Synthetic oligonucleotide
  Target: ATXN1; (+) strand; PAM type: YTN; PAM sequence: TTC
gggaggaaaggagtagagag

SEQ ID NO: 293989 - DNA, 20 bp, Artificial Sequence
  Description of Artificial Sequence: Synthetic oligonucleotide
  Target: ATXN1; (+) strand; PAM type: YTN; PAM sequence: CTG
cctgatttgcaaatagttct

SEQ ID NO: 293990 - DNA, 20 bp, Artificial Sequence
  Description of Artificial Sequence: Synthetic oligonucleotide
  Target: ATXN1; (+) strand; PAM type: YTN; PAM sequence: CTG
atttgcaaatagttctttgc

SEQ ID NO: 293991 - DNA, 20 bp, Artificial Sequence
  Description of Artificial Sequence: Synthetic oligonucleotide
  Target: ATXN1; (+) strand; PAM type: YTN; PAM sequence: TTT
gcaaatagttctttgctgaa

SEQ ID NO: 293992 - DNA, 20 bp, Artificial Sequence
  Description of Artificial Sequence: Synthetic oligonucleotide
  Target: ATXN1; (+) strand; PAM type: YTN; PAM sequence: TTG
caaatagttctttgctgaat

SEQ ID NO: 293993 - DNA, 20 bp, Artificial Sequence
  Description of Artificial Sequence: Synthetic oligonucleotide
  Target: ATXN1; (+) strand; PAM type: YTN; PAM sequence: TTC
tttgctgaattaaactctgt

SEQ ID NO: 293994 - DNA, 20 bp, Artificial Sequence
  Description of Artificial Sequence: Synthetic oligonucleotide
  Target: ATXN1; (+) strand; PAM type: YTN; PAM sequence: CTT
tgctgaattaaactctgtta

SEQ ID NO: 293995 - DNA, 20 bp, Artificial Sequence
  Description of Artificial Sequence: Synthetic oligonucleotide
  Target: ATXN1; (+) strand; PAM type: YTN; PAM sequence: TTT
gctgaattaaactctgttaa

SEQ ID NO: 293996 - DNA, 20 bp, Artificial Sequence
  Description of Artificial Sequence: Synthetic oligonucleotide
  Target: ATXN1; (+) strand; PAM type: YTN; PAM sequence: TTG
ctgaattaaactctgttaaa

SEQ ID NO: 293997 - DNA, 20 bp, Artificial Sequence
  Description of Artificial Sequence: Synthetic oligonucleotide
  Target: ATXN1; (+) strand; PAM type: YTN; PAM sequence: CTG
aattaaactctgttaaattt

SEQ ID NO: 293998 - DNA, 20 bp, Artificial Sequence
  Description of Artificial Sequence: Synthetic oligonucleotide
  Target: ATXN1; (+) strand; PAM type: YTN; PAM sequence: TTA
aactctgttaaatttaattt

SEQ ID NO: 293999 - DNA, 20 bp, Artificial Sequence
  Description of Artificial Sequence: Synthetic oligonucleotide
  Target: ATXN1; (+) strand; PAM type: YTN; PAM sequence: CTC
tgttaaatttaatttgtcta

SEQ ID NO: 294000 - DNA, 20 bp, Artificial Sequence
  Description of Artificial Sequence: Synthetic oligonucleotide
  Target: ATXN1; (+) strand; PAM type: YTN; PAM sequence: CTG
ttaaatttaatttgtctaaa

SEQ ID NO: 294001 - DNA, 20 bp, Artificial Sequence
  Description of Artificial Sequence: Synthetic oligonucleotide
  Target: ATXN1; (+) strand; PAM type: YTN; PAM sequence: TTA
aatttaatttgtctaaagtt

SEQ ID NO: 294002 - DNA, 20 bp, Artificial Sequence
  Description of Artificial Sequence: Synthetic oligonucleotide
  Target: ATXN1; (+) strand; PAM type: YTN; PAM sequence: TTT
aatttgtctaaagtttttct

SEQ ID NO: 294003 - DNA, 20 bp, Artificial Sequence
  Description of Artificial Sequence: Synthetic oligonucleotide
  Target: ATXN1; (+) strand; PAM type: YTN; PAM sequence: TTA
atttgtctaaagtttttctt

SEQ ID NO: 294004 - DNA, 20 bp, Artificial Sequence
  Description of Artificial Sequence: Synthetic oligonucleotide
  Target: ATXN1; (+) strand; PAM type: YTN; PAM sequence: TTT
gtctaaagtttttcttttaa

SEQ ID NO: 294005 - DNA, 20 bp, Artificial Sequence
  Description of Artificial Sequence: Synthetic oligonucleotide
  Target: ATXN1; (+) strand; PAM type: YTN; PAM sequence: TTG
tctaaagtttttcttttaac

SEQ ID NO: 294006 - DNA, 20 bp, Artificial Sequence
  Description of Artificial Sequence: Synthetic oligonucleotide
  Target: ATXN1; (+) strand; PAM type: YTN; PAM sequence: CTA
aagtttttcttttaacacat

SEQ ID NO: 294007 - DNA, 20 bp, Artificial Sequence
  Description of Artificial Sequence: Synthetic oligonucleotide
  Target: ATXN1; (+) strand; PAM type: YTN; PAM sequence: TTT
ttcttttaacacattagatt

SEQ ID NO: 294008 - DNA, 20 bp, Artificial Sequence
  Description of Artificial Sequence: Synthetic oligonucleotide
  Target: ATXN1; (+) strand; PAM type: YTN; PAM sequence: TTT
tcttttaacacattagatta

SEQ ID NO: 294009 - DNA, 20 bp, Artificial Sequence
  Description of Artificial Sequence: Synthetic oligonucleotide
  Target: ATXN1; (+) strand; PAM type: YTN; PAM sequence: TTT
cttttaacacattagattat

SEQ ID NO: 294010 - DNA, 20 bp, Artificial Sequence
  Description of Artificial Sequence: Synthetic oligonucleotide
  Target: ATXN1; (+) strand; PAM type: YTN; PAM sequence: TTC
ttttaacacattagattatg

SEQ ID NO: 294011 - DNA, 20 bp, Artificial Sequence
  Description of Artificial Sequence: Synthetic oligonucleotide
  Target: ATXN1; (+) strand; PAM type: YTN; PAM sequence: CTT
ttaacacattagattatgag

SEQ ID NO: 294012 - DNA, 20 bp, Artificial Sequence
  Description of Artificial Sequence: Synthetic oligonucleotide
  Target: ATXN1; (+) strand; PAM type: YTN; PAM sequence: TTT
taacacattagattatgagt

SEQ ID NO: 294013 - DNA, 20 bp, Artificial Sequence
  Description of Artificial Sequence: Synthetic oligonucleotide
  Target: ATXN1; (+) strand; PAM type: YTN; PAM sequence: TTT
aacacattagattatgagta

SEQ ID NO: 294014 - DNA, 20 bp, Artificial Sequence
  Description of Artificial Sequence: Synthetic oligonucleotide
  Target: ATXN1; (+) strand; PAM type: YTN; PAM sequence: TTA
acacattagattatgagtac

SEQ ID NO: 294015 - DNA, 20 bp, Artificial Sequence
  Description of Artificial Sequence: Synthetic oligonucleotide
  Target: ATXN1; (+) strand; PAM type: YTN; PAM sequence: TTA
gattatgagtacttttccat

SEQ ID NO: 294016 - DNA, 20 bp, Artificial Sequence
  Description of Artificial Sequence: Synthetic oligonucleotide
  Target: ATXN1; (+) strand; PAM type: YTN; PAM sequence: TTA
tgagtacttttccatatttc

SEQ ID NO: 294017 - DNA, 20 bp, Artificial Sequence
  Description of Artificial Sequence: Synthetic oligonucleotide
  Target: ATXN1; (+) strand; PAM type: YTN; PAM sequence: CTT
ttccatatttccacatacta

SEQ ID NO: 294018 - DNA, 20 bp, Artificial Sequence
  Description of Artificial Sequence: Synthetic oligonucleotide
  Target: ATXN1; (+) strand; PAM type: YTN; PAM sequence: TTT
tccatatttccacatactac

SEQ ID NO: 294019 - DNA, 20 bp, Artificial Sequence
  Description of Artificial Sequence: Synthetic oligonucleotide
  Target: ATXN1; (+) strand; PAM type: YTN; PAM sequence: TTT
ccatatttccacatactacc

SEQ ID NO: 294020 - DNA, 20 bp, Artificial Sequence
  Description of Artificial Sequence: Synthetic oligonucleotide
  Target: ATXN1; (+) strand; PAM type: YTN; PAM sequence: TTC
catatttccacatactacca

SEQ ID NO: 294021 - DNA, 20 bp, Artificial Sequence
  Description of Artificial Sequence: Synthetic oligonucleotide
  Target: ATXN1; (+) strand; PAM type: YTN; PAM sequence: TTT
ccacatactaccaaggattt

SEQ ID NO: 294022 - DNA, 20 bp, Artificial Sequence
  Description of Artificial Sequence: Synthetic oligonucleotide
  Target: ATXN1; (+) strand; PAM type: YTN; PAM sequence: TTC
cacatactaccaaggatttt

SEQ ID NO: 294023 - DNA, 20 bp, Artificial Sequence
  Description of Artificial Sequence: Synthetic oligonucleotide
  Target: ATXN1; (+) strand; PAM type: YTN; PAM sequence: CTA
ccaaggattttcaagtgtag

SEQ ID NO: 294024 - DNA, 20 bp, Artificial Sequence
  Description of Artificial Sequence: Synthetic oligonucleotide
  Target: ATXN1; (+) strand; PAM type: YTN; PAM sequence: TTT
tcaagtgtaggagtaattca

SEQ ID NO: 294025 - DNA, 20 bp, Artificial Sequence
  Description of Artificial Sequence: Synthetic oligonucleotide
  Target: ATXN1; (+) strand; PAM type: YTN; PAM sequence: TTT
caagtgtaggagtaattcaa

SEQ ID NO: 294026 - DNA, 20 bp, Artificial Sequence
  Description of Artificial Sequence: Synthetic oligonucleotide
  Target: ATXN1; (+) strand; PAM type: YTN; PAM sequence: TTC
aagtgtaggagtaattcaat

SEQ ID NO: 294027 - DNA, 20 bp, Artificial Sequence
  Description of Artificial Sequence: Synthetic oligonucleotide
  Target: ATXN1; (+) strand; PAM type: YTN; PAM sequence: TTC
aatcagaccctttctttcat

SEQ ID NO: 294028 - DNA, 20 bp, Artificial Sequence
  Description of Artificial Sequence: Synthetic oligonucleotide
  Target: ATXN1; (+) strand; PAM type: YTN; PAM sequence: CTT
tctttcatatgagaattctc

SEQ ID NO: 294029 - DNA, 20 bp, Artificial Sequence
  Description of Artificial Sequence: Synthetic oligonucleotide
  Target: ATXN1; (+) strand; PAM type: YTN; PAM sequence: TTT
ctttcatatgagaattctca

SEQ ID NO: 294030 - DNA, 20 bp, Artificial Sequence
  Description of Artificial Sequence: Synthetic oligonucleotide
  Target: ATXN1; (+) strand; PAM type: YTN; PAM sequence: TTC
tttcatatgagaattctcaa

SEQ ID NO: 294031 - DNA, 20 bp, Artificial Sequence
  Description of Artificial Sequence: Synthetic oligonucleotide
  Target: ATXN1; (+) strand; PAM type: YTN; PAM sequence: CTT
tcatatgagaattctcaaaa

SEQ ID NO: 294032 - DNA, 20 bp, Artificial Sequence
  Description of Artificial Sequence: Synthetic oligonucleotide
  Target: ATXN1; (+) strand; PAM type: YTN; PAM sequence: TTT
catatgagaattctcaaaag

SEQ ID NO: 294033 - DNA, 20 bp, Artificial Sequence
  Description of Artificial Sequence: Synthetic oligonucleotide
  Target: ATXN1; (+) strand; PAM type: YTN; PAM sequence: TTC
atatgagaattctcaaaaga

SEQ ID NO: 294034 - DNA, 20 bp, Artificial Sequence
  Description of Artificial Sequence: Synthetic oligonucleotide
  Target: ATXN1; (+) strand; PAM type: YTN; PAM sequence: TTC
tcaaaagagtagaataaatg

SEQ ID NO: 294035 - DNA, 20 bp, Artificial Sequence
  Description of Artificial Sequence: Synthetic oligonucleotide
  Target: ATXN1; (+) strand; PAM type: YTN; PAM sequence: CTC
aaaagagtagaataaatgga

SEQ ID NO: 294036 - DNA, 20 bp, Artificial Sequence
  Description of Artificial Sequence: Synthetic oligonucleotide
  Target: ATXN1; (+) strand; PAM type: YTN; PAM sequence: CTT
taagcaaggggcttcttgga

SEQ ID NO: 294037 - DNA, 20 bp, Artificial Sequence
  Description of Artificial Sequence: Synthetic oligonucleotide
  Target: ATXN1; (+) strand; PAM type: YTN; PAM sequence: TTT
aagcaaggggcttcttggaa

SEQ ID NO: 294038 - DNA, 20 bp, Artificial Sequence
  Description of Artificial Sequence: Synthetic oligonucleotide
  Target: ATXN1; (+) strand; PAM type: YTN; PAM sequence: TTA
agcaaggggcttcttggaag

SEQ ID NO: 294039 - DNA, 20 bp, Artificial Sequence
  Description of Artificial Sequence: Synthetic oligonucleotide
  Target: ATXN1; (+) strand; PAM type: YTN; PAM sequence: CTT
cttggaagccactgcagcag

SEQ ID NO: 294040 - DNA, 20 bp, Artificial Sequence
  Description of Artificial Sequence: Synthetic oligonucleotide
  Target: ATXN1; (+) strand; PAM type: YTN; PAM sequence: TTC
ttggaagccactgcagcagt

SEQ ID NO: 294041 - DNA, 20 bp, Artificial Sequence
  Description of Artificial Sequence: Synthetic oligonucleotide
  Target: ATXN1; (+) strand; PAM type: YTN; PAM sequence: CTT
ggaagccactgcagcagtcc

SEQ ID NO: 294042 - DNA, 20 bp, Artificial Sequence
  Description of Artificial Sequence: Synthetic oligonucleotide
  Target: ATXN1; (+) strand; PAM type: YTN; PAM sequence: TTG
gaagccactgcagcagtcca

SEQ ID NO: 294043 - DNA, 20 bp, Artificial Sequence
  Description of Artificial Sequence: Synthetic oligonucleotide
  Target: ATXN1; (+) strand; PAM type: YTN; PAM sequence: CTG
cagcagtccaggcaagtgat

SEQ ID NO: 294044 - DNA, 20 bp, Artificial Sequence
  Description of Artificial Sequence: Synthetic oligonucleotide
  Target: ATXN1; (+) strand; PAM type: YTN; PAM sequence: CTG
aaggtctgcaacagaacagg

SEQ ID NO: 294045 - DNA, 20 bp, Artificial Sequence
  Description of Artificial Sequence: Synthetic oligonucleotide
  Target: ATXN1; (+) strand; PAM type: YTN; PAM sequence: CTG
caacagaacaggggcccgag

SEQ ID NO: 294046 - DNA, 20 bp, Artificial Sequence
  Description of Artificial Sequence: Synthetic oligonucleotide
  Target: ATXN1; (+) strand; PAM type: YTN; PAM sequence: CTA
tcatattaaagaggccaaac

SEQ ID NO: 294047 - DNA, 20 bp, Artificial Sequence
  Description of Artificial Sequence: Synthetic oligonucleotide
  Target: ATXN1; (+) strand; PAM type: YTN; PAM sequence: TTA
aagaggccaaactcagactg

SEQ ID NO: 294048 - DNA, 20 bp, Artificial Sequence
  Description of Artificial Sequence: Synthetic oligonucleotide
  Target: ATXN1; (+) strand; PAM type: YTN; PAM sequence: CTC
agactgggggcagtggctca

SEQ ID NO: 294049 - DNA, 20 bp, Artificial Sequence
  Description of Artificial Sequence: Synthetic oligonucleotide
  Target: ATXN1; (+) strand; PAM type: YTN; PAM sequence: CTG
ggggcagtggctcacgcctg

SEQ ID NO: 294050 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccaacact

SEQ ID NO: 294051 - DNA, 20 bp, Artificial Sequence
  Description of Artificial Sequence: Synthetic oligonucleotide
  Target: ATXN1; (+) strand; PAM type: YTN; PAM sequence: CTG
taatcccaacactttgggag

SEQ ID NO: 294052 - DNA, 20 bp, Artificial Sequence
  Description of Artificial Sequence: Synthetic oligonucleotide
  Target: ATXN1; (+) strand; PAM type: YTN; PAM sequence: CTT
tgggaggcttaggcaggcgg

SEQ ID NO: 294053 - DNA, 20 bp, Artificial Sequence
  Description of Artificial Sequence: Synthetic oligonucleotide
  Target: ATXN1; (+) strand; PAM type: YTN; PAM sequence: TTT
gggaggcttaggcaggcgga

SEQ ID NO: 294054 - DNA, 20 bp, Artificial Sequence
  Description of Artificial Sequence: Synthetic oligonucleotide
  Target: ATXN1; (+) strand; PAM type: YTN; PAM sequence: TTG
ggaggcttaggcaggcggat

SEQ ID NO: 294055 - DNA, 20 bp, Artificial Sequence
  Description of Artificial Sequence: Synthetic oligonucleotide
  Target: ATXN1; (+) strand; PAM type: YTN; PAM sequence: CTT
aggcaggcggatcatgaggt

SEQ ID NO: 294056 - DNA, 20 bp, Artificial Sequence
  Description of Artificial Sequence: Synthetic oligonucleotide
  Target: ATXN1; (+) strand; PAM type: YTN; PAM sequence: TTA
ggcaggcggatcatgaggtc

SEQ ID NO: 294057 - DNA, 20 bp, Artificial Sequence
  Description of Artificial Sequence: Synthetic oligonucleotide
  Target: ATXN1; (+) strand; PAM type: YTN; PAM sequence: TTT
gagaccaacctgaccaacat

SEQ ID NO: 294058 - DNA, 20 bp, Artificial Sequence
  Description of Artificial Sequence: Synthetic oligonucleotide
  Target: ATXN1; (+) strand; PAM type: YTN; PAM sequence: TTG
agaccaacctgaccaacatg

SEQ ID NO: 294059 - DNA, 20 bp, Artificial Sequence
  Description of Artificial Sequence: Synthetic oligonucleotide
  Target: ATXN1; (+) strand; PAM type: YTN; PAM sequence: CTG
accaacatggtgaaacccca

SEQ ID NO: 294060 - DNA, 20 bp, Artificial Sequence
  Description of Artificial Sequence: Synthetic oligonucleotide
  Target: ATXN1; (+) strand; PAM type: YTN; PAM sequence: CTC
taccaaaaatacaaaaaatt

SEQ ID NO: 294061 - DNA, 20 bp, Artificial Sequence
  Description of Artificial Sequence: Synthetic oligonucleotide
  Target: ATXN1; (+) strand; PAM type: YTN; PAM sequence: CTA
ccaaaaatacaaaaaattag

SEQ ID NO: 294062 - DNA, 20 bp, Artificial Sequence
  Description of Artificial Sequence: Synthetic oligonucleotide
  Target: ATXN1; (+) strand; PAM type: YTN; PAM sequence: TTA
gccaggtgtggtggtgcgca

SEQ ID NO: 294063 - DNA, 20 bp, Artificial Sequence
  Description of Artificial Sequence: Synthetic oligonucleotide
  Target: ATXN1; (+) strand; PAM type: YTN; PAM sequence: CTG
taatccaagctactcaggag

SEQ ID NO: 294064 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggctgaggcagga

SEQ ID NO: 294065 - DNA, 20 bp, Artificial Sequence
  Description of Artificial Sequence: Synthetic oligonucleotide
  Target: ATXN1; (+) strand; PAM type: YTN; PAM sequence: CTC
aggaggctgaggcaggagaa

SEQ ID NO: 294066 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcccttgaa

SEQ ID NO: 294067 - DNA, 20 bp, Artificial Sequence
  Description of Artificial Sequence: Synthetic oligonucleotide
  Target: ATXN1; (+) strand; PAM type: YTN; PAM sequence: CTT
gaacctgggaagcagaggtt

SEQ ID NO: 294068 - DNA, 20 bp, Artificial Sequence
  Description of Artificial Sequence: Synthetic oligonucleotide
  Target: ATXN1; (+) strand; PAM type: YTN; PAM sequence: TTG
aacctgggaagcagaggttg

SEQ ID NO: 294069 - DNA, 20 bp, Artificial Sequence
  Description of Artificial Sequence: Synthetic oligonucleotide
  Target: ATXN1; (+) strand; PAM type: YTN; PAM sequence: CTG
ggaagcagaggttgcagtaa

SEQ ID NO: 294070 - DNA, 20 bp, Artificial Sequence
  Description of Artificial Sequence: Synthetic oligonucleotide
  Target: ATXN1; (+) strand; PAM type: YTN; PAM sequence: TTG
cagtaagctgagatggtgcc

SEQ ID NO: 294071 - DNA, 20 bp, Artificial Sequence
  Description of Artificial Sequence: Synthetic oligonucleotide
  Target: ATXN1; (+) strand; PAM type: YTN; PAM sequence: CTG
agatggtgccactgcactcc

SEQ ID NO: 294072 - DNA, 20 bp, Artificial Sequence
  Description of Artificial Sequence: Synthetic oligonucleotide
  Target: ATXN1; (+) strand; PAM type: YTN; PAM sequence: CTG
cactccagcgtgggtgacag

SEQ ID NO: 294073 - DNA, 20 bp, Artificial Sequence
  Description of Artificial Sequence: Synthetic oligonucleotide
  Target: ATXN1; (+) strand; PAM type: YTN; PAM sequence: CTC
cagcgtgggtgacagagaga

SEQ ID NO: 294074 - DNA, 20 bp, Artificial Sequence
  Description of Artificial Sequence: Synthetic oligonucleotide
  Target: ATXN1; (+) strand; PAM type: YTN; PAM sequence: CTC
tgtctcaaaaaaaaaaaaaa

SEQ ID NO: 294075 - DNA, 20 bp, Artificial Sequence
  Description of Artificial Sequence: Synthetic oligonucleotide
  Target: ATXN1; (+) strand; PAM type: YTN; PAM sequence: CTG
tctcaaaaaaaaaaaaaagg

SEQ ID NO: 294076 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaaggcaga

SEQ ID NO: 294077 - DNA, 20 bp, Artificial Sequence
  Description of Artificial Sequence: Synthetic oligonucleotide
  Target: ATXN1; (+) strand; PAM type: YTN; PAM sequence: CTC
cagcatatgagctagggatg

SEQ ID NO: 294078 - DNA, 20 bp, Artificial Sequence
  Description of Artificial Sequence: Synthetic oligonucleotide
  Target: ATXN1; (+) strand; PAM type: YTN; PAM sequence: CTA
gggatgaagcagaggaagag

SEQ ID NO: 294079 - DNA, 20 bp, Artificial Sequence
  Description of Artificial Sequence: Synthetic oligonucleotide
  Target: ATXN1; (+) strand; PAM type: YTN; PAM sequence: CTA
gtgaccctggagcccataaa

SEQ ID NO: 294080 - DNA, 20 bp, Artificial Sequence
  Description of Artificial Sequence: Synthetic oligonucleotide
  Target: ATXN1; (+) strand; PAM type: YTN; PAM sequence: CTG
gagcccataaacgtaggaca

SEQ ID NO: 294081 - DNA, 20 bp, Artificial Sequence
  Description of Artificial Sequence: Synthetic oligonucleotide
  Target: ATXN1; (+) strand; PAM type: YTN; PAM sequence: TTT
agattcaaattgaagacacc

SEQ ID NO: 294082 - DNA, 20 bp, Artificial Sequence
  Description of Artificial Sequence: Synthetic oligonucleotide
  Target: ATXN1; (+) strand; PAM type: YTN; PAM sequence: TTA
gattcaaattgaagacacct

SEQ ID NO: 294083 - DNA, 20 bp, Artificial Sequence
  Description of Artificial Sequence: Synthetic oligonucleotide
  Target: ATXN1; (+) strand; PAM type: YTN; PAM sequence: TTC
aaattgaagacacctatgtg

SEQ ID NO: 294084 - DNA, 20 bp, Artificial Sequence
  Description of Artificial Sequence: Synthetic oligonucleotide
  Target: ATXN1; (+) strand; PAM type: YTN; PAM sequence: TTG
aagacacctatgtgatatcc

SEQ ID NO: 294085 - DNA, 20 bp, Artificial Sequence
  Description of Artificial Sequence: Synthetic oligonucleotide
  Target: ATXN1; (+) strand; PAM type: YTN; PAM sequence: CTA
tgtgatatccagctggagtc

SEQ ID NO: 294086 - DNA, 20 bp, Artificial Sequence
  Description of Artificial Sequence: Synthetic oligonucleotide
  Target: ATXN1; (+) strand; PAM type: YTN; PAM sequence: CTG
gagtcatgtgggaggaagtt

SEQ ID NO: 294087 - DNA, 20 bp, Artificial Sequence
  Description of Artificial Sequence: Synthetic oligonucleotide
  Target: ATXN1; (+) strand; PAM type: YTN; PAM sequence: TTG
gaaatcattgagcttaaact

SEQ ID NO: 294088 - DNA, 20 bp, Artificial Sequence
  Description of Artificial Sequence: Synthetic oligonucleotide
  Target: ATXN1; (+) strand; PAM type: YTN; PAM sequence: TTG
agcttaaactctgaagagaa

SEQ ID NO: 294089 - DNA, 20 bp, Artificial Sequence
  Description of Artificial Sequence: Synthetic oligonucleotide
  Target: ATXN1; (+) strand; PAM type: YTN; PAM sequence: CTT
aaactctgaagagaaagaga

SEQ ID NO: 294090 - DNA, 20 bp, Artificial Sequence
  Description of Artificial Sequence: Synthetic oligonucleotide
  Target: ATXN1; (+) strand; PAM type: YTN; PAM sequence: TTA
aactctgaagagaaagagac

SEQ ID NO: 294091 - DNA, 20 bp, Artificial Sequence
  Description of Artificial Sequence: Synthetic oligonucleotide
  Target: ATXN1; (+) strand; PAM type: YTN; PAM sequence: CTC
tgaagagaaagagacagaaa

SEQ ID NO: 294092 - DNA, 20 bp, Artificial Sequence
  Description of Artificial Sequence: Synthetic oligonucleotide
  Target: ATXN1; (+) strand; PAM type: YTN; PAM sequence: CTG
aagagaaagagacagaaata

SEQ ID NO: 294093 - DNA, 20 bp, Artificial Sequence
  Description of Artificial Sequence: Synthetic oligonucleotide
  Target: ATXN1; (+) strand; PAM type: YTN; PAM sequence: CTA
gttgtgtgtgcagagttgat

SEQ ID NO: 294094 - DNA, 20 bp, Artificial Sequence
  Description of Artificial Sequence: Synthetic oligonucleotide
  Target: ATXN1; (+) strand; PAM type: YTN; PAM sequence: TTG
tgtgtgcagagttgatgagg

SEQ ID NO: 294095 - DNA, 20 bp, Artificial Sequence
  Description of Artificial Sequence: Synthetic oligonucleotide
  Target: ATXN1; (+) strand; PAM type: YTN; PAM sequence: TTG
atgaggacatcatgatggtg

SEQ ID NO: 294096 - DNA, 20 bp, Artificial Sequence
  Description of Artificial Sequence: Synthetic oligonucleotide
  Target: ATXN1; (+) strand; PAM type: YTN; PAM sequence: CTT
cagggaaagcatgtgcggta

SEQ ID NO: 294097 - DNA, 20 bp, Artificial Sequence
  Description of Artificial Sequence: Synthetic oligonucleotide
  Target: ATXN1; (+) strand; PAM type: YTN; PAM sequence: TTC
agggaaagcatgtgcggtaa

SEQ ID NO: 294098 - DNA, 20 bp, Artificial Sequence
  Description of Artificial Sequence: Synthetic oligonucleotide
  Target: ATXN1; (+) strand; PAM type: YTN; PAM sequence: CTC
taggtcactgcttttccttt

SEQ ID NO: 294099 - DNA, 20 bp, Artificial Sequence
  Description of Artificial Sequence: Synthetic oligonucleotide
  Target: ATXN1; (+) strand; PAM type: YTN; PAM sequence: CTA
ggtcactgcttttccttttt

SEQ ID NO: 294100 - DNA, 20 bp, Artificial Sequence
  Description of Artificial Sequence: Synthetic oligonucleotide
  Target: ATXN1; (+) strand; PAM type: YTN; PAM sequence: CTG
cttttcctttttactccaac

SEQ ID NO: 294101 - DNA, 20 bp, Artificial Sequence
  Description of Artificial Sequence: Synthetic oligonucleotide
  Target: ATXN1; (+) strand; PAM type: YTN; PAM sequence: CTT
ttcctttttactccaacaat

SEQ ID NO: 294102 - DNA, 20 bp, Artificial Sequence
  Description of Artificial Sequence: Synthetic oligonucleotide
  Target: ATXN1; (+) strand; PAM type: YTN; PAM sequence: TTT
tcctttttactccaacaatg

SEQ ID NO: 294103 - DNA, 20 bp, Artificial Sequence
  Description of Artificial Sequence: Synthetic oligonucleotide
  Target: ATXN1; (+) strand; PAM type: YTN; PAM sequence: TTT
cctttttactccaacaatgt

SEQ ID NO: 294104 - DNA, 20 bp, Artificial Sequence
  Description of Artificial Sequence: Synthetic oligonucleotide
  Target: ATXN1; (+) strand; PAM type: YTN; PAM sequence: TTC
ctttttactccaacaatgtg

SEQ ID NO: 294105 - DNA, 20 bp, Artificial Sequence
  Description of Artificial Sequence: Synthetic oligonucleotide
  Target: ATXN1; (+) strand; PAM type: YTN; PAM sequence: CTT
tttactccaacaatgtgcac

SEQ ID NO: 294106 - DNA, 20 bp, Artificial Sequence
  Description of Artificial Sequence: Synthetic oligonucleotide
  Target: ATXN1; (+) strand; PAM type: YTN; PAM sequence: TTT
ttactccaacaatgtgcacg

SEQ ID NO: 294107 - DNA, 20 bp, Artificial Sequence
  Description of Artificial Sequence: Synthetic oligonucleotide
  Target: ATXN1; (+) strand; PAM type: YTN; PAM sequence: TTT
tactccaacaatgtgcacgt

SEQ ID NO: 294108 - DNA, 20 bp, Artificial Sequence
  Description of Artificial Sequence: Synthetic oligonucleotide
  Target: ATXN1; (+) strand; PAM type: YTN; PAM sequence: TTT
actccaacaatgtgcacgtg

SEQ ID NO: 294109 - DNA, 20 bp, Artificial Sequence
  Description of Artificial Sequence: Synthetic oligonucleotide
  Target: ATXN1; (+) strand; PAM type: YTN; PAM sequence: TTA
ctccaacaatgtgcacgtgt

SEQ ID NO: 294110 - DNA, 20 bp, Artificial Sequence
  Description of Artificial Sequence: Synthetic oligonucleotide
  Target: ATXN1; (+) strand; PAM type: YTN; PAM sequence: CTC
caacaatgtgcacgtgtgcc

SEQ ID NO: 294111 - DNA, 20 bp, Artificial Sequence
  Description of Artificial Sequence: Synthetic oligonucleotide
  Target: ATXN1; (+) strand; PAM type: YTN; PAM sequence: TTT
aattctgatttcttctgatg

SEQ ID NO: 294112 - DNA, 20 bp, Artificial Sequence
  Description of Artificial Sequence: Synthetic oligonucleotide
  Target: ATXN1; (+) strand; PAM type: YTN; PAM sequence: TTA
attctgatttcttctgatgc

SEQ ID NO: 294113 - DNA, 20 bp, Artificial Sequence
  Description of Artificial Sequence: Synthetic oligonucleotide
  Target: ATXN1; (+) strand; PAM type: YTN; PAM sequence: TTC
tgatttcttctgatgcacgg

SEQ ID NO: 294114 - DNA, 20 bp, Artificial Sequence
  Description of Artificial Sequence: Synthetic oligonucleotide
  Target: ATXN1; (+) strand; PAM type: YTN; PAM sequence: CTG
atttcttctgatgcacggca

SEQ ID NO: 294115 - DNA, 20 bp, Artificial Sequence
  Description of Artificial Sequence: Synthetic oligonucleotide
  Target: ATXN1; (+) strand; PAM type: YTN; PAM sequence: TTT
cttctgatgcacggcaaatg

SEQ ID NO: 294116 - DNA, 20 bp, Artificial Sequence
  Description of Artificial Sequence: Synthetic oligonucleotide
  Target: ATXN1; (+) strand; PAM type: YTN; PAM sequence: TTC
ttctgatgcacggcaaatgc

SEQ ID NO: 294117 - DNA, 20 bp, Artificial Sequence
  Description of Artificial Sequence: Synthetic oligonucleotide
  Target: ATXN1; (+) strand; PAM type: YTN; PAM sequence: CTT
ctgatgcacggcaaatgcct

SEQ ID NO: 294118 - DNA, 20 bp, Artificial Sequence
  Description of Artificial Sequence: Synthetic oligonucleotide
  Target: ATXN1; (+) strand; PAM type: YTN; PAM sequence: TTC
tgatgcacggcaaatgcctc

SEQ ID NO: 294119 - DNA, 20 bp, Artificial Sequence
  Description of Artificial Sequence: Synthetic oligonucleotide
  Target: ATXN1; (+) strand; PAM type: YTN; PAM sequence: CTG
atgcacggcaaatgcctccc

SEQ ID NO: 294120 - DNA, 20 bp, Artificial Sequence
  Description of Artificial Sequence: Synthetic oligonucleotide
  Target: ATXN1; (+) strand; PAM type: YTN; PAM sequence: CTC
ccttcaaagctctcaaattg

SEQ ID NO: 294121 - DNA, 20 bp, Artificial Sequence
  Description of Artificial Sequence: Synthetic oligonucleotide
  Target: ATXN1; (+) strand; PAM type: YTN; PAM sequence: CTT
caaagctctcaaattgtcac

SEQ ID NO: 294122 - DNA, 20 bp, Artificial Sequence
  Description of Artificial Sequence: Synthetic oligonucleotide
  Target: ATXN1; (+) strand; PAM type: YTN; PAM sequence: TTC
aaagctctcaaattgtcact

SEQ ID NO: 294123 - DNA, 20 bp, Artificial Sequence
  Description of Artificial Sequence: Synthetic oligonucleotide
  Target: ATXN1; (+) strand; PAM type: YTN; PAM sequence: CTC
tcaaattgtcactaaagaag

SEQ ID NO: 294124 - DNA, 20 bp, Artificial Sequence
  Description of Artificial Sequence: Synthetic oligonucleotide
  Target: ATXN1; (+) strand; PAM type: YTN; PAM sequence: CTC
aaattgtcactaaagaaggg

SEQ ID NO: 294125 - DNA, 20 bp, Artificial Sequence
  Description of Artificial Sequence: Synthetic oligonucleotide
  Target: ATXN1; (+) strand; PAM type: YTN; PAM sequence: TTG
tcactaaagaaggggaccta

SEQ ID NO: 294126 - DNA, 20 bp, Artificial Sequence
  Description of Artificial Sequence: Synthetic oligonucleotide
  Target: ATXN1; (+) strand; PAM type: YTN; PAM sequence: CTA
aagaaggggacctaccatgt

SEQ ID NO: 294127 - DNA, 20 bp, Artificial Sequence
  Description of Artificial Sequence: Synthetic oligonucleotide
  Target: ATXN1; (+) strand; PAM type: YTN; PAM sequence: CTA
ccatgtaaatcagcatctgt

SEQ ID NO: 294128 - DNA, 20 bp, Artificial Sequence
  Description of Artificial Sequence: Synthetic oligonucleotide
  Target: ATXN1; (+) strand; PAM type: YTN; PAM sequence: CTG
ttttgatgatgcctgttaga

SEQ ID NO: 294129 - DNA, 20 bp, Artificial Sequence
  Description of Artificial Sequence: Synthetic oligonucleotide
  Target: ATXN1; (+) strand; PAM type: YTN; PAM sequence: TTT
tgatgatgcctgttagaaga

SEQ ID NO: 294130 - DNA, 20 bp, Artificial Sequence
  Description of Artificial Sequence: Synthetic oligonucleotide
  Target: ATXN1; (+) strand; PAM type: YTN; PAM sequence: TTT
gatgatgcctgttagaagaa

SEQ ID NO: 294131 - DNA, 20 bp, Artificial Sequence
  Description of Artificial Sequence: Synthetic oligonucleotide
  Target: ATXN1; (+) strand; PAM type: YTN; PAM sequence: TTG
atgatgcctgttagaagaaa

SEQ ID NO: 294132 - DNA, 20 bp, Artificial Sequence
  Description of Artificial Sequence: Synthetic oligonucleotide
  Target: ATXN1; (+) strand; PAM type: YTN; PAM sequence: CTG
ttagaagaaagtacattgca

SEQ ID NO: 294133 - DNA, 20 bp, Artificial Sequence
  Description of Artificial Sequence: Synthetic oligonucleotide
  Target: ATXN1; (+) strand; PAM type: YTN; PAM sequence: TTA
gaagaaagtacattgcattt

SEQ ID NO: 294134 - DNA, 20 bp, Artificial Sequence
  Description of Artificial Sequence: Synthetic oligonucleotide
  Target: ATXN1; (+) strand; PAM type: YTN; PAM sequence: TTG
catttcctgaatgggtgtgg

SEQ ID NO: 294135 - DNA, 20 bp, Artificial Sequence
  Description of Artificial Sequence: Synthetic oligonucleotide
  Target: ATXN1; (+) strand; PAM type: YTN; PAM sequence: TTT
cctgaatgggtgtggtttta

SEQ ID NO: 294136 - DNA, 20 bp, Artificial Sequence
  Description of Artificial Sequence: Synthetic oligonucleotide
  Target: ATXN1; (+) strand; PAM type: YTN; PAM sequence: TTC
ctgaatgggtgtggttttac

SEQ ID NO: 294137 - DNA, 20 bp, Artificial Sequence
  Description of Artificial Sequence: Synthetic oligonucleotide
  Target: ATXN1; (+) strand; PAM type: YTN; PAM sequence: CTG
aatgggtgtggttttactca

SEQ ID NO: 294138 - DNA, 20 bp, Artificial Sequence
  Description of Artificial Sequence: Synthetic oligonucleotide
  Target: ATXN1; (+) strand; PAM type: YTN; PAM sequence: TTT
tactcacagctatacaaaac

SEQ ID NO: 294139 - DNA, 20 bp, Artificial Sequence
  Description of Artificial Sequence: Synthetic oligonucleotide
  Target: ATXN1; (+) strand; PAM type: YTN; PAM sequence: TTT
actcacagctatacaaaacc

SEQ ID NO: 294140 - DNA, 20 bp, Artificial Sequence
  Description of Artificial Sequence: Synthetic oligonucleotide
  Target: ATXN1; (+) strand; PAM type: YTN; PAM sequence: TTA
ctcacagctatacaaaacca

SEQ ID NO: 294141 - DNA, 20 bp, Artificial Sequence
  Description of Artificial Sequence: Synthetic oligonucleotide
  Target: ATXN1; (+) strand; PAM type: YTN; PAM sequence: CTC
acagctatacaaaaccacac

SEQ ID NO: 294142 - DNA, 20 bp, Artificial Sequence
  Description of Artificial Sequence: Synthetic oligonucleotide
  Target: ATXN1; (+) strand; PAM type: YTN; PAM sequence: CTA
tacaaaaccacacagcttct

SEQ ID NO: 294143 - DNA, 20 bp, Artificial Sequence
  Description of Artificial Sequence: Synthetic oligonucleotide
  Target: ATXN1; (+) strand; PAM type: YTN; PAM sequence: CTT
ctctgaaggacttagacaat

SEQ ID NO: 294144 - DNA, 20 bp, Artificial Sequence
  Description of Artificial Sequence: Synthetic oligonucleotide
  Target: ATXN1; (+) strand; PAM type: YTN; PAM sequence: TTC
tctgaaggacttagacaatc

SEQ ID NO: 294145 - DNA, 20 bp, Artificial Sequence
  Description of Artificial Sequence: Synthetic oligonucleotide
  Target: ATXN1; (+) strand; PAM type: YTN; PAM sequence: CTC
tgaaggacttagacaatcat

SEQ ID NO: 294146 - DNA, 20 bp, Artificial Sequence
  Description of Artificial Sequence: Synthetic oligonucleotide
  Target: ATXN1; (+) strand; PAM type: YTN; PAM sequence: CTG
aaggacttagacaatcatta

SEQ ID NO: 294147 - DNA, 20 bp, Artificial Sequence
  Description of Artificial Sequence: Synthetic oligonucleotide
  Target: ATXN1; (+) strand; PAM type: YTN; PAM sequence: CTT
agacaatcattagcctgtga

SEQ ID NO: 294148 - DNA, 20 bp, Artificial Sequence
  Description of Artificial Sequence: Synthetic oligonucleotide
  Target: ATXN1; (+) strand; PAM type: YTN; PAM sequence: TTA
gacaatcattagcctgtgat

SEQ ID NO: 294149 - DNA, 20 bp, Artificial Sequence
  Description of Artificial Sequence: Synthetic oligonucleotide
  Target: ATXN1; (+) strand; PAM type: YTN; PAM sequence: TTA
gcctgtgatagcatcagcaa

SEQ ID NO: 294150 - DNA, 20 bp, Artificial Sequence
  Description of Artificial Sequence: Synthetic oligonucleotide
  Target: ATXN1; (+) strand; PAM type: YTN; PAM sequence: CTG
tgatagcatcagcaagagga

SEQ ID NO: 294151 - DNA, 20 bp, Artificial Sequence
  Description of Artificial Sequence: Synthetic oligonucleotide
  Target: ATXN1; (+) strand; PAM type: YTN; PAM sequence: TTA
gaacacatttaacaaaaggc

SEQ ID NO: 294152 - DNA, 20 bp, Artificial Sequence
  Description of Artificial Sequence: Synthetic oligonucleotide
  Target: ATXN1; (+) strand; PAM type: YTN; PAM sequence: TTT
aacaaaaggcattttgggtg

SEQ ID NO: 294153 - DNA, 20 bp, Artificial Sequence
  Description of Artificial Sequence: Synthetic oligonucleotide
  Target: ATXN1; (+) strand; PAM type: YTN; PAM sequence: TTA
acaaaaggcattttgggtgc

SEQ ID NO: 294154 - DNA, 20 bp, Artificial Sequence
  Description of Artificial Sequence: Synthetic oligonucleotide
  Target: ATXN1; (+) strand; PAM type: YTN; PAM sequence: TTT
tgggtgctgctttaccgaac

SEQ ID NO: 294155 - DNA, 20 bp, Artificial Sequence
  Description of Artificial Sequence: Synthetic oligonucleotide
  Target: ATXN1; (+) strand; PAM type: YTN; PAM sequence: TTT
gggtgctgctttaccgaaca

SEQ ID NO: 294156 - DNA, 20 bp, Artificial Sequence
  Description of Artificial Sequence: Synthetic oligonucleotide
  Target: ATXN1; (+) strand; PAM type: YTN; PAM sequence: TTG
ggtgctgctttaccgaacac

SEQ ID NO: 294157 - DNA, 20 bp, Artificial Sequence
  Description of Artificial Sequence: Synthetic oligonucleotide
  Target: ATXN1; (+) strand; PAM type: YTN; PAM sequence: CTG
ctttaccgaacactggctta

SEQ ID NO: 294158 - DNA, 20 bp, Artificial Sequence
  Description of Artificial Sequence: Synthetic oligonucleotide
  Target: ATXN1; (+) strand; PAM type: YTN; PAM sequence: CTT
taccgaacactggcttaagt

SEQ ID NO: 294159 - DNA, 20 bp, Artificial Sequence
  Description of Artificial Sequence: Synthetic oligonucleotide
  Target: ATXN1; (+) strand; PAM type: YTN; PAM sequence: TTT
accgaacactggcttaagta

SEQ ID NO: 294160 - DNA, 20 bp, Artificial Sequence
  Description of Artificial Sequence: Synthetic oligonucleotide
  Target: ATXN1; (+) strand; PAM type: YTN; PAM sequence: TTA
ccgaacactggcttaagtac

SEQ ID NO: 294161 - DNA, 20 bp, Artificial Sequence
  Description of Artificial Sequence: Synthetic oligonucleotide
  Target: ATXN1; (+) strand; PAM type: YTN; PAM sequence: CTG
gcttaagtacctgaagggaa

SEQ ID NO: 294162 - DNA, 20 bp, Artificial Sequence
  Description of Artificial Sequence: Synthetic oligonucleotide
  Target: ATXN1; (+) strand; PAM type: YTN; PAM sequence: CTT
aagtacctgaagggaactac

SEQ ID NO: 294163 - DNA, 20 bp, Artificial Sequence
  Description of Artificial Sequence: Synthetic oligonucleotide
  Target: ATXN1; (+) strand; PAM type: YTN; PAM sequence: TTA
agtacctgaagggaactaca

SEQ ID NO: 294164 - DNA, 20 bp, Artificial Sequence
  Description of Artificial Sequence: Synthetic oligonucleotide
  Target: ATXN1; (+) strand; PAM type: YTN; PAM sequence: CTG
aagggaactacactcctcta

SEQ ID NO: 294165 - DNA, 20 bp, Artificial Sequence
  Description of Artificial Sequence: Synthetic oligonucleotide
  Target: ATXN1; (+) strand; PAM type: YTN; PAM sequence: CTA
cactcctctaagctggaaag

SEQ ID NO: 294166 - DNA, 20 bp, Artificial Sequence
  Description of Artificial Sequence: Synthetic oligonucleotide
  Target: ATXN1; (+) strand; PAM type: YTN; PAM sequence: CTC
ctctaagctggaaagcactg

SEQ ID NO: 294167 - DNA, 20 bp, Artificial Sequence
  Description of Artificial Sequence: Synthetic oligonucleotide
  Target: ATXN1; (+) strand; PAM type: YTN; PAM sequence: CTC
taagctggaaagcactgcga

SEQ ID NO: 294168 - DNA, 20 bp, Artificial Sequence
  Description of Artificial Sequence: Synthetic oligonucleotide
  Target: ATXN1; (+) strand; PAM type: YTN; PAM sequence: CTA
agctggaaagcactgcgaga

SEQ ID NO: 294169 - DNA, 20 bp, Artificial Sequence
  Description of Artificial Sequence: Synthetic oligonucleotide
  Target: ATXN1; (+) strand; PAM type: YTN; PAM sequence: CTG
gaaagcactgcgagagcttt

SEQ ID NO: 294170 - DNA, 20 bp, Artificial Sequence
  Description of Artificial Sequence: Synthetic oligonucleotide
  Target: ATXN1; (+) strand; PAM type: YTN; PAM sequence: CTG
cgagagctttctaacgatgg

SEQ ID NO: 294171 - DNA, 20 bp, Artificial Sequence
  Description of Artificial Sequence: Synthetic oligonucleotide
  Target: ATXN1; (+) strand; PAM type: YTN; PAM sequence: CTT
tctaacgatggtctttagtg

SEQ ID NO: 294172 - DNA, 20 bp, Artificial Sequence
  Description of Artificial Sequence: Synthetic oligonucleotide
  Target: ATXN1; (+) strand; PAM type: YTN; PAM sequence: TTT
ctaacgatggtctttagtgg

SEQ ID NO: 294173 - DNA, 20 bp, Artificial Sequence
  Description of Artificial Sequence: Synthetic oligonucleotide
  Target: ATXN1; (+) strand; PAM type: YTN; PAM sequence: TTC
taacgatggtctttagtggg

SEQ ID NO: 294174 - DNA, 20 bp, Artificial Sequence
  Description of Artificial Sequence: Synthetic oligonucleotide
  Target: ATXN1; (+) strand; PAM type: YTN; PAM sequence: CTA
acgatggtctttagtggggg

SEQ ID NO: 294175 - DNA, 20 bp, Artificial Sequence
  Description of Artificial Sequence: Synthetic oligonucleotide
  Target: ATXN1; (+) strand; PAM type: YTN; PAM sequence: CTT
tagtgggggtactggactgg

SEQ ID NO: 294176 - DNA, 20 bp, Artificial Sequence
  Description of Artificial Sequence: Synthetic oligonucleotide
  Target: ATXN1; (+) strand; PAM type: YTN; PAM sequence: TTT
agtgggggtactggactggc

SEQ ID NO: 294177 - DNA, 20 bp, Artificial Sequence
  Description of Artificial Sequence: Synthetic oligonucleotide
  Target: ATXN1; (+) strand; PAM type: YTN; PAM sequence: TTA
gtgggggtactggactggcg

SEQ ID NO: 294178 - DNA, 20 bp, Artificial Sequence
  Description of Artificial Sequence: Synthetic oligonucleotide
  Target: ATXN1; (+) strand; PAM type: YTN; PAM sequence: CTG
gactggcgcttttcctattt

SEQ ID NO: 294179 - DNA, 20 bp, Artificial Sequence
  Description of Artificial Sequence: Synthetic oligonucleotide
  Target: ATXN1; (+) strand; PAM type: YTN; PAM sequence: CTG
gcgcttttcctatttacatc

SEQ ID NO: 294180 - DNA, 20 bp, Artificial Sequence
  Description of Artificial Sequence: Synthetic oligonucleotide
  Target: ATXN1; (+) strand; PAM type: YTN; PAM sequence: CTT
ttcctatttacatctgttcc

SEQ ID NO: 294181 - DNA, 20 bp, Artificial Sequence
  Description of Artificial Sequence: Synthetic oligonucleotide
  Target: ATXN1; (+) strand; PAM type: YTN; PAM sequence: TTT
tcctatttacatctgttcca

SEQ ID NO: 294182 - DNA, 20 bp, Artificial Sequence
  Description of Artificial Sequence: Synthetic oligonucleotide
  Target: ATXN1; (+) strand; PAM type: YTN; PAM sequence: TTT
cctatttacatctgttccaa

SEQ ID NO: 294183 - DNA, 20 bp, Artificial Sequence
  Description of Artificial Sequence: Synthetic oligonucleotide
  Target: ATXN1; (+) strand; PAM type: YTN; PAM sequence: TTC
ctatttacatctgttccaaa

SEQ ID NO: 294184 - DNA, 20 bp, Artificial Sequence
  Description of Artificial Sequence: Synthetic oligonucleotide
  Target: ATXN1; (+) strand; PAM type: YTN; PAM sequence: CTA
tttacatctgttccaaaagc

SEQ ID NO: 294185 - DNA, 20 bp, Artificial Sequence
  Description of Artificial Sequence: Synthetic oligonucleotide
  Target: ATXN1; (+) strand; PAM type: YTN; PAM sequence: TTT
acatctgttccaaaagcagt

SEQ ID NO: 294186 - DNA, 20 bp, Artificial Sequence
  Description of Artificial Sequence: Synthetic oligonucleotide
  Target: ATXN1; (+) strand; PAM type: YTN; PAM sequence: TTA
catctgttccaaaagcagta

SEQ ID NO: 294187 - DNA, 20 bp, Artificial Sequence
  Description of Artificial Sequence: Synthetic oligonucleotide
  Target: ATXN1; (+) strand; PAM type: YTN; PAM sequence: CTG
ttccaaaagcagtacctatg

SEQ ID NO: 294188 - DNA, 20 bp, Artificial Sequence
  Description of Artificial Sequence: Synthetic oligonucleotide
  Target: ATXN1; (+) strand; PAM type: YTN; PAM sequence: TTC
caaaagcagtacctatgatt

SEQ ID NO: 294189 - DNA, 20 bp, Artificial Sequence
  Description of Artificial Sequence: Synthetic oligonucleotide
  Target: ATXN1; (+) strand; PAM type: YTN; PAM sequence: CTA
tgatttaggtggctgtttgg

SEQ ID NO: 294190 - DNA, 20 bp, Artificial Sequence
  Description of Artificial Sequence: Synthetic oligonucleotide
  Target: ATXN1; (+) strand; PAM type: YTN; PAM sequence: TTT
aggtggctgtttggaaatca

SEQ ID NO: 294191 - DNA, 20 bp, Artificial Sequence
  Description of Artificial Sequence: Synthetic oligonucleotide
  Target: ATXN1; (+) strand; PAM type: YTN; PAM sequence: TTA
ggtggctgtttggaaatcat

SEQ ID NO: 294192 - DNA, 20 bp, Artificial Sequence
  Description of Artificial Sequence: Synthetic oligonucleotide
  Target: ATXN1; (+) strand; PAM type: YTN; PAM sequence: CTG
tttggaaatcatgtacctct

SEQ ID NO: 294193 - DNA, 20 bp, Artificial Sequence
  Description of Artificial Sequence: Synthetic oligonucleotide
  Target: ATXN1; (+) strand; PAM type: YTN; PAM sequence: TTT
ggaaatcatgtacctctcaa

SEQ ID NO: 294194 - DNA, 20 bp, Artificial Sequence
  Description of Artificial Sequence: Synthetic oligonucleotide
  Target: ATXN1; (+) strand; PAM type: YTN; PAM sequence: TTG
gaaatcatgtacctctcaag

SEQ ID NO: 294195 - DNA, 20 bp, Artificial Sequence
  Description of Artificial Sequence: Synthetic oligonucleotide
  Target: ATXN1; (+) strand; PAM type: YTN; PAM sequence: CTC
tcaaggatgcctcacggtaa

SEQ ID NO: 294196 - DNA, 20 bp, Artificial Sequence
  Description of Artificial Sequence: Synthetic oligonucleotide
  Target: ATXN1; (+) strand; PAM type: YTN; PAM sequence: CTC
aaggatgcctcacggtaaac

SEQ ID NO: 294197 - DNA, 20 bp, Artificial Sequence
  Description of Artificial Sequence: Synthetic oligonucleotide
  Target: ATXN1; (+) strand; PAM type: YTN; PAM sequence: CTC
acggtaaacgatacaagtga

SEQ ID NO: 294198 - DNA, 20 bp, Artificial Sequence
  Description of Artificial Sequence: Synthetic oligonucleotide
  Target: ATXN1; (+) strand; PAM type: YTN; PAM sequence: TTT
ctaactagacaaatgctctt

SEQ ID NO: 294199 - DNA, 20 bp, Artificial Sequence
  Description of Artificial Sequence: Synthetic oligonucleotide
  Target: ATXN1; (+) strand; PAM type: YTN; PAM sequence: TTC
taactagacaaatgctcttt

SEQ ID NO: 294200 - DNA, 20 bp, Artificial Sequence
  Description of Artificial Sequence: Synthetic oligonucleotide
  Target: ATXN1; (+) strand; PAM type: YTN; PAM sequence: CTA
actagacaaatgctctttta

SEQ ID NO: 294201 - DNA, 20 bp, Artificial Sequence
  Description of Artificial Sequence: Synthetic oligonucleotide
  Target: ATXN1; (+) strand; PAM type: YTN; PAM sequence: CTA
gacaaatgctcttttagaat

SEQ ID NO: 294202 - DNA, 20 bp, Artificial Sequence
  Description of Artificial Sequence: Synthetic oligonucleotide
  Target: ATXN1; (+) strand; PAM type: YTN; PAM sequence: CTC
ttttagaatcatttttttct

SEQ ID NO: 294203 - DNA, 20 bp, Artificial Sequence
  Description of Artificial Sequence: Synthetic oligonucleotide
  Target: ATXN1; (+) strand; PAM type: YTN; PAM sequence: CTT
ttagaatcatttttttctgt

SEQ ID NO: 294204 - DNA, 20 bp, Artificial Sequence
  Description of Artificial Sequence: Synthetic oligonucleotide
  Target: ATXN1; (+) strand; PAM type: YTN; PAM sequence: TTT
tagaatcatttttttctgtt

SEQ ID NO: 294205 - DNA, 20 bp, Artificial Sequence
  Description of Artificial Sequence: Synthetic oligonucleotide
  Target: ATXN1; (+) strand; PAM type: YTN; PAM sequence: TTT
agaatcatttttttctgttt

SEQ ID NO: 294206 - DNA, 20 bp, Artificial Sequence
  Description of Artificial Sequence: Synthetic oligonucleotide
  Target: ATXN1; (+) strand; PAM type: YTN; PAM sequence: TTA
gaatcatttttttctgtttt

SEQ ID NO: 294207 - DNA, 20 bp, Artificial Sequence
  Description of Artificial Sequence: Synthetic oligonucleotide
  Target: ATXN1; (+) strand; PAM type: YTN; PAM sequence: TTT
ttttctgttttcctaccatg

SEQ ID NO: 294208 - DNA, 20 bp, Artificial Sequence
  Description of Artificial Sequence: Synthetic oligonucleotide
  Target: ATXN1; (+) strand; PAM type: YTN; PAM sequence: TTT
tttctgttttcctaccatgg

SEQ ID NO: 294209 - DNA, 20 bp, Artificial Sequence
  Description of Artificial Sequence: Synthetic oligonucleotide
  Target: ATXN1; (+) strand; PAM type: YTN; PAM sequence: TTT
ttctgttttcctaccatgga

SEQ ID NO: 294210 - DNA, 20 bp, Artificial Sequence
  Description of Artificial Sequence: Synthetic oligonucleotide
  Target: ATXN1; (+) strand; PAM type: YTN; PAM sequence: TTT
tctgttttcctaccatggat

SEQ ID NO: 294211 - DNA, 20 bp, Artificial Sequence
  Description of Artificial Sequence: Synthetic oligonucleotide
  Target: ATXN1; (+) strand; PAM type: YTN; PAM sequence: TTT
ctgttttcctaccatggatg

SEQ ID NO: 294212 - DNA, 20 bp, Artificial Sequence
  Description of Artificial Sequence: Synthetic oligonucleotide
  Target: ATXN1; (+) strand; PAM type: YTN; PAM sequence: TTC
tgttttcctaccatggatgg

SEQ ID NO: 294213 - DNA, 20 bp, Artificial Sequence
  Description of Artificial Sequence: Synthetic oligonucleotide
  Target: ATXN1; (+) strand; PAM type: YTN; PAM sequence: CTG
ttttcctaccatggatggtt

SEQ ID NO: 294214 - DNA, 20 bp, Artificial Sequence
  Description of Artificial Sequence: Synthetic oligonucleotide
  Target: ATXN1; (+) strand; PAM type: YTN; PAM sequence: TTT
tcctaccatggatggttact

SEQ ID NO: 294215 - DNA, 20 bp, Artificial Sequence
  Description of Artificial Sequence: Synthetic oligonucleotide
  Target: ATXN1; (+) strand; PAM type: YTN; PAM sequence: TTT
cctaccatggatggttactt

SEQ ID NO: 294216 - DNA, 20 bp, Artificial Sequence
  Description of Artificial Sequence: Synthetic oligonucleotide
  Target: ATXN1; (+) strand; PAM type: YTN; PAM sequence: TTC
ctaccatggatggttacttg

SEQ ID NO: 294217 - DNA, 20 bp, Artificial Sequence
  Description of Artificial Sequence: Synthetic oligonucleotide
  Target: ATXN1; (+) strand; PAM type: YTN; PAM sequence: CTA
ccatggatggttacttgcaa

SEQ ID NO: 294218 - DNA, 20 bp, Artificial Sequence
  Description of Artificial Sequence: Synthetic oligonucleotide
  Target: ATXN1; (+) strand; PAM type: YTN; PAM sequence: TTA
cttgcaaggaaatagtttac

SEQ ID NO: 294219 - DNA, 20 bp, Artificial Sequence
  Description of Artificial Sequence: Synthetic oligonucleotide
  Target: ATXN1; (+) strand; PAM type: YTN; PAM sequence: CTT
gcaaggaaatagtttacatg

SEQ ID NO: 294220 - DNA, 20 bp, Artificial Sequence
  Description of Artificial Sequence: Synthetic oligonucleotide
  Target: ATXN1; (+) strand; PAM type: YTN; PAM sequence: TTG
caaggaaatagtttacatgg

SEQ ID NO: 294221 - DNA, 20 bp, Artificial Sequence
  Description of Artificial Sequence: Synthetic oligonucleotide
  Target: ATXN1; (+) strand; PAM type: YTN; PAM sequence: TTT
acatggaccactaaagacct

SEQ ID NO: 294222 - DNA, 20 bp, Artificial Sequence
  Description of Artificial Sequence: Synthetic oligonucleotide
  Target: ATXN1; (+) strand; PAM type: YTN; PAM sequence: TTA
catggaccactaaagacctc

SEQ ID NO: 294223 - DNA, 20 bp, Artificial Sequence
  Description of Artificial Sequence: Synthetic oligonucleotide
  Target: ATXN1; (+) strand; PAM type: YTN; PAM sequence: CTA
aagacctccaaaacagaaat

SEQ ID NO: 294224 - DNA, 20 bp, Artificial Sequence
  Description of Artificial Sequence: Synthetic oligonucleotide
  Target: ATXN1; (+) strand; PAM type: YTN; PAM sequence: CTC
caaaacagaaatgccaacat

SEQ ID NO: 294225 - DNA, 20 bp, Artificial Sequence
  Description of Artificial Sequence: Synthetic oligonucleotide
  Target: ATXN1; (+) strand; PAM type: YTN; PAM sequence: CTG
gcattttgctaaaatcctgt

SEQ ID NO: 294226 - DNA, 20 bp, Artificial Sequence
  Description of Artificial Sequence: Synthetic oligonucleotide
  Target: ATXN1; (+) strand; PAM type: YTN; PAM sequence: TTT
tgctaaaatcctgtactcta

SEQ ID NO: 294227 - DNA, 20 bp, Artificial Sequence
  Description of Artificial Sequence: Synthetic oligonucleotide
  Target: ATXN1; (+) strand; PAM type: YTN; PAM sequence: TTT
gctaaaatcctgtactctat

SEQ ID NO: 294228 - DNA, 20 bp, Artificial Sequence
  Description of Artificial Sequence: Synthetic oligonucleotide
  Target: ATXN1; (+) strand; PAM type: YTN; PAM sequence: TTG
ctaaaatcctgtactctata

SEQ ID NO: 294229 - DNA, 20 bp, Artificial Sequence
  Description of Artificial Sequence: Synthetic oligonucleotide
  Target: ATXN1; (+) strand; PAM type: YTN; PAM sequence: CTA
aaatcctgtactctataatt

SEQ ID NO: 294230 - DNA, 20 bp, Artificial Sequence
  Description of Artificial Sequence: Synthetic oligonucleotide
  Target: ATXN1; (+) strand; PAM type: YTN; PAM sequence: CTG
tactctataattttttaaaa

SEQ ID NO: 294231 - DNA, 20 bp, Artificial Sequence
  Description of Artificial Sequence: Synthetic oligonucleotide
  Target: ATXN1; (+) strand; PAM type: YTN; PAM sequence: CTC
tataattttttaaaaatctc

SEQ ID NO: 294232 - DNA, 20 bp, Artificial Sequence
  Description of Artificial Sequence: Synthetic oligonucleotide
  Target: ATXN1; (+) strand; PAM type: YTN; PAM sequence: CTA
taattttttaaaaatctcgc

SEQ ID NO: 294233 - DNA, 20 bp, Artificial Sequence
  Description of Artificial Sequence: Synthetic oligonucleotide
  Target: ATXN1; (+) strand; PAM type: YTN; PAM sequence: TTT
tttaaaaatctcgcccctca

SEQ ID NO: 294234 - DNA, 20 bp, Artificial Sequence
  Description of Artificial Sequence: Synthetic oligonucleotide
  Target: ATXN1; (+) strand; PAM type: YTN; PAM sequence: TTT
ttaaaaatctcgcccctcat

SEQ ID NO: 294235 - DNA, 20 bp, Artificial Sequence
  Description of Artificial Sequence: Synthetic oligonucleotide
  Target: ATXN1; (+) strand; PAM type: YTN; PAM sequence: TTT
taaaaatctcgcccctcatt

SEQ ID NO: 294236 - DNA, 20 bp, Artificial Sequence
  Description of Artificial Sequence: Synthetic oligonucleotide
  Target: ATXN1; (+) strand; PAM type: YTN; PAM sequence: TTT
aaaaatctcgcccctcatta

SEQ ID NO: 294237 - DNA, 20 bp, Artificial Sequence
  Description of Artificial Sequence: Synthetic oligonucleotide
  Target: ATXN1; (+) strand; PAM type: YTN; PAM sequence: TTA
aaaatctcgcccctcattac

SEQ ID NO: 294238 - DNA, 20 bp, Artificial Sequence
  Description of Artificial Sequence: Synthetic oligonucleotide
  Target: ATXN1; (+) strand; PAM type: YTN; PAM sequence: CTC
gcccctcattactcctccac

SEQ ID NO: 294239 - DNA, 20 bp, Artificial Sequence
  Description of Artificial Sequence: Synthetic oligonucleotide
  Target: ATXN1; (+) strand; PAM type: YTN; PAM sequence: CTC
attactcctccacctgacat

SEQ ID NO: 294240 - DNA, 20 bp, Artificial Sequence
  Description of Artificial Sequence: Synthetic oligonucleotide
  Target: ATXN1; (+) strand; PAM type: YTN; PAM sequence: TTA
ctcctccacctgacatcctt

SEQ ID NO: 294241 - DNA, 20 bp, Artificial Sequence
  Description of Artificial Sequence: Synthetic oligonucleotide
  Target: ATXN1; (+) strand; PAM type: YTN; PAM sequence: CTC
ctccacctgacatcctttta

SEQ ID NO: 294242 - DNA, 20 bp, Artificial Sequence
  Description of Artificial Sequence: Synthetic oligonucleotide
  Target: ATXN1; (+) strand; PAM type: YTN; PAM sequence: CTC
cacctgacatccttttagac

SEQ ID NO: 294243 - DNA, 20 bp, Artificial Sequence
  Description of Artificial Sequence: Synthetic oligonucleotide
  Target: ATXN1; (+) strand; PAM type: YTN; PAM sequence: CTG
acatccttttagacaaaggc

SEQ ID NO: 294244 - DNA, 20 bp, Artificial Sequence
  Description of Artificial Sequence: Synthetic oligonucleotide
  Target: ATXN1; (+) strand; PAM type: YTN; PAM sequence: CTT
ttagacaaaggctcaaagtc

SEQ ID NO: 294245 - DNA, 20 bp, Artificial Sequence
  Description of Artificial Sequence: Synthetic oligonucleotide
  Target: ATXN1; (+) strand; PAM type: YTN; PAM sequence: TTT
tagacaaaggctcaaagtca

SEQ ID NO: 294246 - DNA, 20 bp, Artificial Sequence
  Description of Artificial Sequence: Synthetic oligonucleotide
  Target: ATXN1; (+) strand; PAM type: YTN; PAM sequence: TTT
agacaaaggctcaaagtcaa

SEQ ID NO: 294247 - DNA, 20 bp, Artificial Sequence
  Description of Artificial Sequence: Synthetic oligonucleotide
  Target: ATXN1; (+) strand; PAM type: YTN; PAM sequence: TTA
gacaaaggctcaaagtcaat

SEQ ID NO: 294248 - DNA, 20 bp, Artificial Sequence
  Description of Artificial Sequence: Synthetic oligonucleotide
  Target: ATXN1; (+) strand; PAM type: YTN; PAM sequence: CTC
aaagtcaattatgcagacaa

SEQ ID NO: 294249 - DNA, 20 bp, Artificial Sequence
  Description of Artificial Sequence: Synthetic oligonucleotide
  Target: ATXN1; (+) strand; PAM type: YTN; PAM sequence: TTA
tgcagacaatggcacctttc

SEQ ID NO: 294250 - DNA, 20 bp, Artificial Sequence
  Description of Artificial Sequence: Synthetic oligonucleotide
  Target: ATXN1; (+) strand; PAM type: YTN; PAM sequence: CTT
tctcttctgtagctgacaac

SEQ ID NO: 294251 - DNA, 20 bp, Artificial Sequence
  Description of Artificial Sequence: Synthetic oligonucleotide
  Target: ATXN1; (+) strand; PAM type: YTN; PAM sequence: TTT
ctcttctgtagctgacaacc

SEQ ID NO: 294252 - DNA, 20 bp, Artificial Sequence
  Description of Artificial Sequence: Synthetic oligonucleotide
  Target: ATXN1; (+) strand; PAM type: YTN; PAM sequence: TTC
tcttctgtagctgacaacct

SEQ ID NO: 294253 - DNA, 20 bp, Artificial Sequence
  Description of Artificial Sequence: Synthetic oligonucleotide
  Target: ATXN1; (+) strand; PAM type: YTN; PAM sequence: CTC
ttctgtagctgacaacctgg

SEQ ID NO: 294254 - DNA, 20 bp, Artificial Sequence
  Description of Artificial Sequence: Synthetic oligonucleotide
  Target: ATXN1; (+) strand; PAM type: YTN; PAM sequence: CTT
ctgtagctgacaacctggct

SEQ ID NO: 294255 - DNA, 20 bp, Artificial Sequence
  Description of Artificial Sequence: Synthetic oligonucleotide
  Target: ATXN1; (+) strand; PAM type: YTN; PAM sequence: TTC
tgtagctgacaacctggctc

SEQ ID NO: 294256 - DNA, 20 bp, Artificial Sequence
  Description of Artificial Sequence: Synthetic oligonucleotide
  Target: ATXN1; (+) strand; PAM type: YTN; PAM sequence: CTG
tagctgacaacctggctctt

SEQ ID NO: 294257 - DNA, 20 bp, Artificial Sequence
  Description of Artificial Sequence: Synthetic oligonucleotide
  Target: ATXN1; (+) strand; PAM type: YTN; PAM sequence: CTG
acaacctggctcttgccttc

SEQ ID NO: 294258 - DNA, 20 bp, Artificial Sequence
  Description of Artificial Sequence: Synthetic oligonucleotide
  Target: ATXN1; (+) strand; PAM type: YTN; PAM sequence: CTG
gctcttgccttctgcaaccc

SEQ ID NO: 294259 - DNA, 20 bp, Artificial Sequence
  Description of Artificial Sequence: Synthetic oligonucleotide
  Target: ATXN1; (+) strand; PAM type: YTN; PAM sequence: CTC
ttgccttctgcaacccaaaa

SEQ ID NO: 294260 - DNA, 20 bp, Artificial Sequence
  Description of Artificial Sequence: Synthetic oligonucleotide
  Target: ATXN1; (+) strand; PAM type: YTN; PAM sequence: CTT
gccttctgcaacccaaaaac

SEQ ID NO: 294261 - DNA, 20 bp, Artificial Sequence
  Description of Artificial Sequence: Synthetic oligonucleotide
  Target: ATXN1; (+) strand; PAM type: YTN; PAM sequence: TTG
ccttctgcaacccaaaaaca

SEQ ID NO: 294262 - DNA, 20 bp, Artificial Sequence
  Description of Artificial Sequence: Synthetic oligonucleotide
  Target: ATXN1; (+) strand; PAM type: YTN; PAM sequence: CTT
ctgcaacccaaaaacagccc

SEQ ID NO: 294263 - DNA, 20 bp, Artificial Sequence
  Description of Artificial Sequence: Synthetic oligonucleotide
  Target: ATXN1; (+) strand; PAM type: YTN; PAM sequence: TTC
tgcaacccaaaaacagccct

SEQ ID NO: 294264 - DNA, 20 bp, Artificial Sequence
  Description of Artificial Sequence: Synthetic oligonucleotide
  Target: ATXN1; (+) strand; PAM type: YTN; PAM sequence: CTG
caacccaaaaacagccctcg

SEQ ID NO: 294265 - DNA, 20 bp, Artificial Sequence
  Description of Artificial Sequence: Synthetic oligonucleotide
  Target: ATXN1; (+) strand; PAM type: YTN; PAM sequence: CTC
gctcccatcagatggaaaga

SEQ ID NO: 294266 - DNA, 20 bp, Artificial Sequence
  Description of Artificial Sequence: Synthetic oligonucleotide
  Target: ATXN1; (+) strand; PAM type: YTN; PAM sequence: CTC
ccatcagatggaaagaacta

SEQ ID NO: 294267 - DNA, 20 bp, Artificial Sequence
  Description of Artificial Sequence: Synthetic oligonucleotide
  Target: ATXN1; (+) strand; PAM type: YTN; PAM sequence: CTA
cgcagaggaaaatctagtaa

SEQ ID NO: 294268 - DNA, 20 bp, Artificial Sequence
  Description of Artificial Sequence: Synthetic oligonucleotide
  Target: ATXN1; (+) strand; PAM type: YTN; PAM sequence: CTA
gtaaggtctccatgaagcac

SEQ ID NO: 294269 - DNA, 20 bp, Artificial Sequence
  Description of Artificial Sequence: Synthetic oligonucleotide
  Target: ATXN1; (+) strand; PAM type: YTN; PAM sequence: CTC
catgaagcacatattaaaag

SEQ ID NO: 294270 - DNA, 20 bp, Artificial Sequence
  Description of Artificial Sequence: Synthetic oligonucleotide
  Target: ATXN1; (+) strand; PAM type: YTN; PAM sequence: TTA
aaagcctaatgtgcccttaa

SEQ ID NO: 294271 - DNA, 20 bp, Artificial Sequence
  Description of Artificial Sequence: Synthetic oligonucleotide
  Target: ATXN1; (+) strand; PAM type: YTN; PAM sequence: CTA
atgtgcccttaacatggctt

SEQ ID NO: 294272 - DNA, 20 bp, Artificial Sequence
  Description of Artificial Sequence: Synthetic oligonucleotide
  Target: ATXN1; (+) strand; PAM type: YTN; PAM sequence: CTT
aacatggcttcagcaaactg

SEQ ID NO: 294273 - DNA, 20 bp, Artificial Sequence
  Description of Artificial Sequence: Synthetic oligonucleotide
  Target: ATXN1; (+) strand; PAM type: YTN; PAM sequence: TTA
acatggcttcagcaaactgg

SEQ ID NO: 294274 - DNA, 20 bp, Artificial Sequence
  Description of Artificial Sequence: Synthetic oligonucleotide
  Target: ATXN1; (+) strand; PAM type: YTN; PAM sequence: CTT
cagcaaactgggcttttttc

SEQ ID NO: 294275 - DNA, 20 bp, Artificial Sequence
  Description of Artificial Sequence: Synthetic oligonucleotide
  Target: ATXN1; (+) strand; PAM type: YTN; PAM sequence: TTC
agcaaactgggcttttttcc

SEQ ID NO: 294276 - DNA, 20 bp, Artificial Sequence
  Description of Artificial Sequence: Synthetic oligonucleotide
  Target: ATXN1; (+) strand; PAM type: YTN; PAM sequence: CTG
ggcttttttccttcacttag

SEQ ID NO: 294277 - DNA, 20 bp, Artificial Sequence
  Description of Artificial Sequence: Synthetic oligonucleotide
  Target: ATXN1; (+) strand; PAM type: YTN; PAM sequence: CTT
ttttccttcacttagatgag

SEQ ID NO: 294278 - DNA, 20 bp, Artificial Sequence
  Description of Artificial Sequence: Synthetic oligonucleotide
  Target: ATXN1; (+) strand; PAM type: YTN; PAM sequence: TTT
tttccttcacttagatgaga

SEQ ID NO: 294279 - DNA, 20 bp, Artificial Sequence
  Description of Artificial Sequence: Synthetic oligonucleotide
  Target: ATXN1; (+) strand; PAM type: YTN; PAM sequence: TTT
ttccttcacttagatgagaa

SEQ ID NO: 294280 - DNA, 20 bp, Artificial Sequence
  Description of Artificial Sequence: Synthetic oligonucleotide
  Target: ATXN1; (+) strand; PAM type: YTN; PAM sequence: TTT
tccttcacttagatgagaat

SEQ ID NO: 294281 - DNA, 20 bp, Artificial Sequence
  Description of Artificial Sequence: Synthetic oligonucleotide
  Target: ATXN1; (+) strand; PAM type: YTN; PAM sequence: TTT
ccttcacttagatgagaatt

SEQ ID NO: 294282 - DNA, 20 bp, Artificial Sequence
  Description of Artificial Sequence: Synthetic oligonucleotide
  Target: ATXN1; (+) strand; PAM type: YTN; PAM sequence: TTC
cttcacttagatgagaattt

SEQ ID NO: 294283 - DNA, 20 bp, Artificial Sequence
  Description of Artificial Sequence: Synthetic oligonucleotide
  Target: ATXN1; (+) strand; PAM type: YTN; PAM sequence: CTT
cacttagatgagaatttgag

SEQ ID NO: 294284 - DNA, 20 bp, Artificial Sequence
  Description of Artificial Sequence: Synthetic oligonucleotide
  Target: ATXN1; (+) strand; PAM type: YTN; PAM sequence: TTC
acttagatgagaatttgaga

SEQ ID NO: 294285 - DNA, 20 bp, Artificial Sequence
  Description of Artificial Sequence: Synthetic oligonucleotide
  Target: ATXN1; (+) strand; PAM type: YTN; PAM sequence: CTT
agatgagaatttgagaagaa

SEQ ID NO: 294286 - DNA, 20 bp, Artificial Sequence
  Description of Artificial Sequence: Synthetic oligonucleotide
  Target: ATXN1; (+) strand; PAM type: YTN; PAM sequence: TTA
gatgagaatttgagaagaat

SEQ ID NO: 294287 - DNA, 20 bp, Artificial Sequence
  Description of Artificial Sequence: Synthetic oligonucleotide
  Target: ATXN1; (+) strand; PAM type: YTN; PAM sequence: TTT
gagaagaatccactcggtaa

SEQ ID NO: 294288 - DNA, 20 bp, Artificial Sequence
  Description of Artificial Sequence: Synthetic oligonucleotide
  Target: ATXN1; (+) strand; PAM type: YTN; PAM sequence: TTG
agaagaatccactcggtaat

SEQ ID NO: 294289 - DNA, 20 bp, Artificial Sequence
  Description of Artificial Sequence: Synthetic oligonucleotide
  Target: ATXN1; (+) strand; PAM type: YTN; PAM sequence: CTC
ggtaatacctttctgctcgc

SEQ ID NO: 294290 - DNA, 20 bp, Artificial Sequence
  Description of Artificial Sequence: Synthetic oligonucleotide
  Target: ATXN1; (+) strand; PAM type: YTN; PAM sequence: CTT
tctgctcgccaaacctcctt

SEQ ID NO: 294291 - DNA, 20 bp, Artificial Sequence
  Description of Artificial Sequence: Synthetic oligonucleotide
  Target: ATXN1; (+) strand; PAM type: YTN; PAM sequence: TTT
ctgctcgccaaacctccttt

SEQ ID NO: 294292 - DNA, 20 bp, Artificial Sequence
  Description of Artificial Sequence: Synthetic oligonucleotide
  Target: ATXN1; (+) strand; PAM type: YTN; PAM sequence: TTC
tgctcgccaaacctccttta

SEQ ID NO: 294293 - DNA, 20 bp, Artificial Sequence
  Description of Artificial Sequence: Synthetic oligonucleotide
  Target: ATXN1; (+) strand; PAM type: YTN; PAM sequence: CTG
ctcgccaaacctcctttagt

SEQ ID NO: 294294 - DNA, 20 bp, Artificial Sequence
  Description of Artificial Sequence: Synthetic oligonucleotide
  Target: ATXN1; (+) strand; PAM type: YTN; PAM sequence: CTC
gccaaacctcctttagtcaa

SEQ ID NO: 294295 - DNA, 20 bp, Artificial Sequence
  Description of Artificial Sequence: Synthetic oligonucleotide
  Target: ATXN1; (+) strand; PAM type: YTN; PAM sequence: CTC
ctttagtcaaaactgaatag

SEQ ID NO: 294296 - DNA, 20 bp, Artificial Sequence
  Description of Artificial Sequence: Synthetic oligonucleotide
  Target: ATXN1; (+) strand; PAM type: YTN; PAM sequence: CTT
tagtcaaaactgaatagaga

SEQ ID NO: 294297 - DNA, 20 bp, Artificial Sequence
  Description of Artificial Sequence: Synthetic oligonucleotide
  Target: ATXN1; (+) strand; PAM type: YTN; PAM sequence: TTT
agtcaaaactgaatagagac

SEQ ID NO: 294298 - DNA, 20 bp, Artificial Sequence
  Description of Artificial Sequence: Synthetic oligonucleotide
  Target: ATXN1; (+) strand; PAM type: YTN; PAM sequence: TTA
gtcaaaactgaatagagacc

SEQ ID NO: 294299 - DNA, 20 bp, Artificial Sequence
  Description of Artificial Sequence: Synthetic oligonucleotide
  Target: ATXN1; (+) strand; PAM type: YTN; PAM sequence: CTG
aatagagacctgggagaaga

SEQ ID NO: 294300 - DNA, 20 bp, Artificial Sequence
  Description of Artificial Sequence: Synthetic oligonucleotide
  Target: ATXN1; (+) strand; PAM type: YTN; PAM sequence: CTG
ggagaagatacttctccaac

SEQ ID NO: 294301 - DNA, 20 bp, Artificial Sequence
  Description of Artificial Sequence: Synthetic oligonucleotide
  Target: ATXN1; (+) strand; PAM type: YTN; PAM sequence: CTT
ctccaacactgggcttgaag

SEQ ID NO: 294302 - DNA, 20 bp, Artificial Sequence
  Description of Artificial Sequence: Synthetic oligonucleotide
  Target: ATXN1; (+) strand; PAM type: YTN; PAM sequence: TTC
tccaacactgggcttgaagg

SEQ ID NO: 294303 - DNA, 20 bp, Artificial Sequence
  Description of Artificial Sequence: Synthetic oligonucleotide
  Target: ATXN1; (+) strand; PAM type: YTN; PAM sequence: CTC
caacactgggcttgaaggtg

SEQ ID NO: 294304 - DNA, 20 bp, Artificial Sequence
  Description of Artificial Sequence: Synthetic oligonucleotide
  Target: ATXN1; (+) strand; PAM type: YTN; PAM sequence: CTG
ggcttgaaggtgcttgcttt

SEQ ID NO: 294305 - DNA, 20 bp, Artificial Sequence
  Description of Artificial Sequence: Synthetic oligonucleotide
  Target: ATXN1; (+) strand; PAM type: YTN; PAM sequence: CTT
gaaggtgcttgctttttcac

SEQ ID NO: 294306 - DNA, 20 bp, Artificial Sequence
  Description of Artificial Sequence: Synthetic oligonucleotide
  Target: ATXN1; (+) strand; PAM type: YTN; PAM sequence: TTG
aaggtgcttgctttttcaca

SEQ ID NO: 294307 - DNA, 20 bp, Artificial Sequence
  Description of Artificial Sequence: Synthetic oligonucleotide
  Target: ATXN1; (+) strand; PAM type: YTN; PAM sequence: CTT
gctttttcacacaaactgaa

SEQ ID NO: 294308 - DNA, 20 bp, Artificial Sequence
  Description of Artificial Sequence: Synthetic oligonucleotide
  Target: ATXN1; (+) strand; PAM type: YTN; PAM sequence: TTG
ctttttcacacaaactgaat

SEQ ID NO: 294309 - DNA, 20 bp, Artificial Sequence
  Description of Artificial Sequence: Synthetic oligonucleotide
  Target: ATXN1; (+) strand; PAM type: YTN; PAM sequence: CTT
tttcacacaaactgaattca

SEQ ID NO: 294310 - DNA, 20 bp, Artificial Sequence
  Description of Artificial Sequence: Synthetic oligonucleotide
  Target: ATXN1; (+) strand; PAM type: YTN; PAM sequence: TTT
ttcacacaaactgaattcag

SEQ ID NO: 294311 - DNA, 20 bp, Artificial Sequence
  Description of Artificial Sequence: Synthetic oligonucleotide
  Target: ATXN1; (+) strand; PAM type: YTN; PAM sequence: TTT
tcacacaaactgaattcagg

SEQ ID NO: 294312 - DNA, 20 bp, Artificial Sequence
  Description of Artificial Sequence: Synthetic oligonucleotide
  Target: ATXN1; (+) strand; PAM type: YTN; PAM sequence: TTT
cacacaaactgaattcagga

SEQ ID NO: 294313 - DNA, 20 bp, Artificial Sequence
  Description of Artificial Sequence: Synthetic oligonucleotide
  Target: ATXN1; (+) strand; PAM type: YTN; PAM sequence: TTC
acacaaactgaattcaggat

SEQ ID NO: 294314 - DNA, 20 bp, Artificial Sequence
  Description of Artificial Sequence: Synthetic oligonucleotide
  Target: ATXN1; (+) strand; PAM type: YTN; PAM sequence: CTG
aattcaggattgccacaact

SEQ ID NO: 294315 - DNA, 20 bp, Artificial Sequence
  Description of Artificial Sequence: Synthetic oligonucleotide
  Target: ATXN1; (+) strand; PAM type: YTN; PAM sequence: TTC
aggattgccacaacttctcc

SEQ ID NO: 294316 - DNA, 20 bp, Artificial Sequence
  Description of Artificial Sequence: Synthetic oligonucleotide
  Target: ATXN1; (+) strand; PAM type: YTN; PAM sequence: TTG
ccacaacttctccaagcaaa

SEQ ID NO: 294317 - DNA, 20 bp, Artificial Sequence
  Description of Artificial Sequence: Synthetic oligonucleotide
  Target: ATXN1; (+) strand; PAM type: YTN; PAM sequence: CTT
ctccaagcaaaactgaacta

SEQ ID NO: 294318 - DNA, 20 bp, Artificial Sequence
  Description of Artificial Sequence: Synthetic oligonucleotide
  Target: ATXN1; (+) strand; PAM type: YTN; PAM sequence: TTC
tccaagcaaaactgaactaa

SEQ ID NO: 294319 - DNA, 20 bp, Artificial Sequence
  Description of Artificial Sequence: Synthetic oligonucleotide
  Target: ATXN1; (+) strand; PAM type: YTN; PAM sequence: CTC
caagcaaaactgaactaagc

SEQ ID NO: 294320 - DNA, 20 bp, Artificial Sequence
  Description of Artificial Sequence: Synthetic oligonucleotide
  Target: ATXN1; (+) strand; PAM type: YTN; PAM sequence: CTG
aactaagcaacagccaaata

SEQ ID NO: 294321 - DNA, 20 bp, Artificial Sequence
  Description of Artificial Sequence: Synthetic oligonucleotide
  Target: ATXN1; (+) strand; PAM type: YTN; PAM sequence: CTA
agcaacagccaaataaaaga

SEQ ID NO: 294322 - DNA, 20 bp, Artificial Sequence
  Description of Artificial Sequence: Synthetic oligonucleotide
  Target: ATXN1; (+) strand; PAM type: YTN; PAM sequence: TTG
tcaaaaaaaatgtgttaatg

SEQ ID NO: 294323 - DNA, 20 bp, Artificial Sequence
  Description of Artificial Sequence: Synthetic oligonucleotide
  Target: ATXN1; (+) strand; PAM type: YTN; PAM sequence: TTA
atgcatttggtagtggttag

SEQ ID NO: 294324 - DNA, 20 bp, Artificial Sequence
  Description of Artificial Sequence: Synthetic oligonucleotide
  Target: ATXN1; (+) strand; PAM type: YTN; PAM sequence: TTT
ggtagtggttagattaacag

SEQ ID NO: 294325 - DNA, 20 bp, Artificial Sequence
  Description of Artificial Sequence: Synthetic oligonucleotide
  Target: ATXN1; (+) strand; PAM type: YTN; PAM sequence: TTG
gtagtggttagattaacagc

SEQ ID NO: 294326 - DNA, 20 bp, Artificial Sequence
  Description of Artificial Sequence: Synthetic oligonucleotide
  Target: ATXN1; (+) strand; PAM type: YTN; PAM sequence: TTA
gattaacagctaataaatgt

SEQ ID NO: 294327 - DNA, 20 bp, Artificial Sequence
  Description of Artificial Sequence: Synthetic oligonucleotide
  Target: ATXN1; (+) strand; PAM type: YTN; PAM sequence: TTA
acagctaataaatgtcctga

SEQ ID NO: 294328 - DNA, 20 bp, Artificial Sequence
  Description of Artificial Sequence: Synthetic oligonucleotide
  Target: ATXN1; (+) strand; PAM type: YTN; PAM sequence: CTA
ataaatgtcctgatggccac

SEQ ID NO: 294329 - DNA, 20 bp, Artificial Sequence
  Description of Artificial Sequence: Synthetic oligonucleotide
  Target: ATXN1; (+) strand; PAM type: YTN; PAM sequence: CTG
atggccacgctggttccttt

SEQ ID NO: 294330 - DNA, 20 bp, Artificial Sequence
  Description of Artificial Sequence: Synthetic oligonucleotide
  Target: ATXN1; (+) strand; PAM type: YTN; PAM sequence: CTG
gttcctttctaggctagcta

SEQ ID NO: 294331 - DNA, 20 bp, Artificial Sequence
  Description of Artificial Sequence: Synthetic oligonucleotide
  Target: ATXN1; (+) strand; PAM type: YTN; PAM sequence: TTC
ctttctaggctagctaagct

SEQ ID NO: 294332 - DNA, 20 bp, Artificial Sequence
  Description of Artificial Sequence: Synthetic oligonucleotide
  Target: ATXN1; (+) strand; PAM type: YTN; PAM sequence: CTT
tctaggctagctaagcttct

SEQ ID NO: 294333 - DNA, 20 bp, Artificial Sequence
  Description of Artificial Sequence: Synthetic oligonucleotide
  Target: ATXN1; (+) strand; PAM type: YTN; PAM sequence: TTT
ctaggctagctaagcttctg

SEQ ID NO: 294334 - DNA, 20 bp, Artificial Sequence
  Description of Artificial Sequence: Synthetic oligonucleotide
  Target: ATXN1; (+) strand; PAM type: YTN; PAM sequence: TTC
taggctagctaagcttctgt

SEQ ID NO: 294335 - DNA, 20 bp, Artificial Sequence
  Description of Artificial Sequence: Synthetic oligonucleotide
  Target: ATXN1; (+) strand; PAM type: YTN; PAM sequence: CTA
ggctagctaagcttctgtga

SEQ ID NO: 294336 - DNA, 20 bp, Artificial Sequence
  Description of Artificial Sequence: Synthetic oligonucleotide
  Target: ATXN1; (+) strand; PAM type: YTN; PAM sequence: CTA
gctaagcttctgtgagttct

SEQ ID NO: 294337 - DNA, 20 bp, Artificial Sequence
  Description of Artificial Sequence: Synthetic oligonucleotide
  Target: ATXN1; (+) strand; PAM type: YTN; PAM sequence: CTA
agcttctgtgagttcttctg

SEQ ID NO: 294338 - DNA, 20 bp, Artificial Sequence
  Description of Artificial Sequence: Synthetic oligonucleotide
  Target: ATXN1; (+) strand; PAM type: YTN; PAM sequence: CTT
ctgtgagttcttctgtttgg

SEQ ID NO: 294339 - DNA, 20 bp, Artificial Sequence
  Description of Artificial Sequence: Synthetic oligonucleotide
  Target: ATXN1; (+) strand; PAM type: YTN; PAM sequence: TTC
tgtgagttcttctgtttgga

SEQ ID NO: 294340 - DNA, 20 bp, Artificial Sequence
  Description of Artificial Sequence: Synthetic oligonucleotide
  Target: ATXN1; (+) strand; PAM type: YTN; PAM sequence: CTG
tgagttcttctgtttggatt

SEQ ID NO: 294341 - DNA, 20 bp, Artificial Sequence
  Description of Artificial Sequence: Synthetic oligonucleotide
  Target: ATXN1; (+) strand; PAM type: YTN; PAM sequence: TTC
ttctgtttggattccatcta

SEQ ID NO: 294342 - DNA, 20 bp, Artificial Sequence
  Description of Artificial Sequence: Synthetic oligonucleotide
  Target: ATXN1; (+) strand; PAM type: YTN; PAM sequence: CTT
ctgtttggattccatctacc

SEQ ID NO: 294343 - DNA, 20 bp, Artificial Sequence
  Description of Artificial Sequence: Synthetic oligonucleotide
  Target: ATXN1; (+) strand; PAM type: YTN; PAM sequence: TTC
tgtttggattccatctacca

SEQ ID NO: 294344 - DNA, 20 bp, Artificial Sequence
  Description of Artificial Sequence: Synthetic oligonucleotide
  Target: ATXN1; (+) strand; PAM type: YTN; PAM sequence: CTG
tttggattccatctaccagg

SEQ ID NO: 294345 - DNA, 20 bp, Artificial Sequence
  Description of Artificial Sequence: Synthetic oligonucleotide
  Target: ATXN1; (+) strand; PAM type: YTN; PAM sequence: TTT
ggattccatctaccagggct

SEQ ID NO: 294346 - DNA, 20 bp, Artificial Sequence
  Description of Artificial Sequence: Synthetic oligonucleotide
  Target: ATXN1; (+) strand; PAM type: YTN; PAM sequence: TTG
gattccatctaccagggctg

SEQ ID NO: 294347 - DNA, 20 bp, Artificial Sequence
  Description of Artificial Sequence: Synthetic oligonucleotide
  Target: ATXN1; (+) strand; PAM type: YTN; PAM sequence: TTC
catctaccagggctggagcc

SEQ ID NO: 294348 - DNA, 20 bp, Artificial Sequence
  Description of Artificial Sequence: Synthetic oligonucleotide
  Target: ATXN1; (+) strand; PAM type: YTN; PAM sequence: CTA
ccagggctggagccaccagc

SEQ ID NO: 294349 - DNA, 20 bp, Artificial Sequence
  Description of Artificial Sequence: Synthetic oligonucleotide
  Target: ATXN1; (+) strand; PAM type: YTN; PAM sequence: CTG
gagccaccagcaagggcatt

SEQ ID NO: 294350 - DNA, 20 bp, Artificial Sequence
  Description of Artificial Sequence: Synthetic oligonucleotide
  Target: ATXN1; (+) strand; PAM type: YTN; PAM sequence: TTC
aggaggtgcaccagaagcag

SEQ ID NO: 294351 - DNA, 20 bp, Artificial Sequence
  Description of Artificial Sequence: Synthetic oligonucleotide
  Target: ATXN1; (+) strand; PAM type: YTN; PAM sequence: CTG
caaatctctcctggatcatc

SEQ ID NO: 294352 - DNA, 20 bp, Artificial Sequence
  Description of Artificial Sequence: Synthetic oligonucleotide
  Target: ATXN1; (+) strand; PAM type: YTN; PAM sequence: CTC
tcctggatcatccaagacca

SEQ ID NO: 294353 - DNA, 20 bp, Artificial Sequence
  Description of Artificial Sequence: Synthetic oligonucleotide
  Target: ATXN1; (+) strand; PAM type: YTN; PAM sequence: CTC
ctggatcatccaagaccagg

SEQ ID NO: 294354 - DNA, 20 bp, Artificial Sequence
  Description of Artificial Sequence: Synthetic oligonucleotide
  Target: ATXN1; (+) strand; PAM type: YTN; PAM sequence: CTG
gatcatccaagaccaggcat

SEQ ID NO: 294355 - DNA, 20 bp, Artificial Sequence
  Description of Artificial Sequence: Synthetic oligonucleotide
  Target: ATXN1; (+) strand; PAM type: YTN; PAM sequence: CTT
gctggaacaagaggcggacg

SEQ ID NO: 294356 - DNA, 20 bp, Artificial Sequence
  Description of Artificial Sequence: Synthetic oligonucleotide
  Target: ATXN1; (+) strand; PAM type: YTN; PAM sequence: TTG
ctggaacaagaggcggacgg

SEQ ID NO: 294357 - DNA, 20 bp, Artificial Sequence
  Description of Artificial Sequence: Synthetic oligonucleotide
  Target: ATXN1; (+) strand; PAM type: YTN; PAM sequence: CTG
gaacaagaggcggacggaag

SEQ ID NO: 294358 - DNA, 20 bp, Artificial Sequence
  Description of Artificial Sequence: Synthetic oligonucleotide
  Target: ATXN1; (+) strand; PAM type: YTN; PAM sequence: CTG
cagtctgctaacattggatt

SEQ ID NO: 294359 - DNA, 20 bp, Artificial Sequence
  Description of Artificial Sequence: Synthetic oligonucleotide
  Target: ATXN1; (+) strand; PAM type: YTN; PAM sequence: CTG
ctaacattggattcaaatcc

SEQ ID NO: 294360 - DNA, 20 bp, Artificial Sequence
  Description of Artificial Sequence: Synthetic oligonucleotide
  Target: ATXN1; (+) strand; PAM type: YTN; PAM sequence: CTA
acattggattcaaatcctga

SEQ ID NO: 294361 - DNA, 20 bp, Artificial Sequence
  Description of Artificial Sequence: Synthetic oligonucleotide
  Target: ATXN1; (+) strand; PAM type: YTN; PAM sequence: TTG
gattcaaatcctgaatccac

SEQ ID NO: 294362 - DNA, 20 bp, Artificial Sequence
  Description of Artificial Sequence: Synthetic oligonucleotide
  Target: ATXN1; (+) strand; PAM type: YTN; PAM sequence: TTC
aaatcctgaatccaccactg

SEQ ID NO: 294363 - DNA, 20 bp, Artificial Sequence
  Description of Artificial Sequence: Synthetic oligonucleotide
  Target: ATXN1; (+) strand; PAM type: YTN; PAM sequence: CTG
aatccaccactgtgcactgt

SEQ ID NO: 294364 - DNA, 20 bp, Artificial Sequence
  Description of Artificial Sequence: Synthetic oligonucleotide
  Target: ATXN1; (+) strand; PAM type: YTN; PAM sequence: CTG
tgcactgtaggtgctttgat

SEQ ID NO: 294365 - DNA, 20 bp, Artificial Sequence
  Description of Artificial Sequence: Synthetic oligonucleotide
  Target: ATXN1; (+) strand; PAM type: YTN; PAM sequence: CTG
taggtgctttgatgtgcgtc

SEQ ID NO: 294366 - DNA, 20 bp, Artificial Sequence
  Description of Artificial Sequence: Synthetic oligonucleotide
  Target: ATXN1; (+) strand; PAM type: YTN; PAM sequence: CTT
tgatgtgcgtccactagagc

SEQ ID NO: 294367 - DNA, 20 bp, Artificial Sequence
  Description of Artificial Sequence: Synthetic oligonucleotide
  Target: ATXN1; (+) strand; PAM type: YTN; PAM sequence: TTT
gatgtgcgtccactagagct

SEQ ID NO: 294368 - DNA, 20 bp, Artificial Sequence
  Description of Artificial Sequence: Synthetic oligonucleotide
  Target: ATXN1; (+) strand; PAM type: YTN; PAM sequence: TTG
atgtgcgtccactagagcta

SEQ ID NO: 294369 - DNA, 20 bp, Artificial Sequence
  Description of Artificial Sequence: Synthetic oligonucleotide
  Target: ATXN1; (+) strand; PAM type: YTN; PAM sequence: CTA
gagctaaacttgatcctttt

SEQ ID NO: 294370 - DNA, 20 bp, Artificial Sequence
  Description of Artificial Sequence: Synthetic oligonucleotide
  Target: ATXN1; (+) strand; PAM type: YTN; PAM sequence: CTA
aacttgatccttttcagcag

SEQ ID NO: 294371 - DNA, 20 bp, Artificial Sequence
  Description of Artificial Sequence: Synthetic oligonucleotide
  Target: ATXN1; (+) strand; PAM type: YTN; PAM sequence: CTT
gatccttttcagcagcggga

SEQ ID NO: 294372 - DNA, 20 bp, Artificial Sequence
  Description of Artificial Sequence: Synthetic oligonucleotide
  Target: ATXN1; (+) strand; PAM type: YTN; PAM sequence: TTG
atccttttcagcagcgggac

SEQ ID NO: 294373 - DNA, 20 bp, Artificial Sequence
  Description of Artificial Sequence: Synthetic oligonucleotide
  Target: ATXN1; (+) strand; PAM type: YTN; PAM sequence: CTT
ttcagcagcgggaccgctct

SEQ ID NO: 294374 - DNA, 20 bp, Artificial Sequence
  Description of Artificial Sequence: Synthetic oligonucleotide
  Target: ATXN1; (+) strand; PAM type: YTN; PAM sequence: TTT
tcagcagcgggaccgctctt

SEQ ID NO: 294375 - DNA, 20 bp, Artificial Sequence
  Description of Artificial Sequence: Synthetic oligonucleotide
  Target: ATXN1; (+) strand; PAM type: YTN; PAM sequence: TTT
cagcagcgggaccgctcttc

SEQ ID NO: 294376 - DNA, 20 bp, Artificial Sequence
  Description of Artificial Sequence: Synthetic oligonucleotide
  Target: ATXN1; (+) strand; PAM type: YTN; PAM sequence: TTC
agcagcgggaccgctcttct

SEQ ID NO: 294377 - DNA, 20 bp, Artificial Sequence
  Description of Artificial Sequence: Synthetic oligonucleotide
  Target: ATXN1; (+) strand; PAM type: YTN; PAM sequence: CTC
ttctgccaccaaaactgaca

SEQ ID NO: 294378 - DNA, 20 bp, Artificial Sequence
  Description of Artificial Sequence: Synthetic oligonucleotide
  Target: ATXN1; (+) strand; PAM type: YTN; PAM sequence: CTT
ctgccaccaaaactgacaac

SEQ ID NO: 294379 - DNA, 20 bp, Artificial Sequence
  Description of Artificial Sequence: Synthetic oligonucleotide
  Target: ATXN1; (+) strand; PAM type: YTN; PAM sequence: TTC
tgccaccaaaactgacaacc

SEQ ID NO: 294380 - DNA, 20 bp, Artificial Sequence
  Description of Artificial Sequence: Synthetic oligonucleotide
  Target: ATXN1; (+) strand; PAM type: YTN; PAM sequence: CTG
ccaccaaaactgacaacctg

SEQ ID NO: 294381 - DNA, 20 bp, Artificial Sequence
  Description of Artificial Sequence: Synthetic oligonucleotide
  Target: ATXN1; (+) strand; PAM type: YTN; PAM sequence: CTG
acaacctgcgaggcctaaca

SEQ ID NO: 294382 - DNA, 20 bp, Artificial Sequence
  Description of Artificial Sequence: Synthetic oligonucleotide
  Target: ATXN1; (+) strand; PAM type: YTN; PAM sequence: CTG
cgaggcctaacagctgaaag

SEQ ID NO: 294383 - DNA, 20 bp, Artificial Sequence
  Description of Artificial Sequence: Synthetic oligonucleotide
  Target: ATXN1; (+) strand; PAM type: YTN; PAM sequence: CTA
acagctgaaagaaataccac

SEQ ID NO: 294384 - DNA, 20 bp, Artificial Sequence
  Description of Artificial Sequence: Synthetic oligonucleotide
  Target: ATXN1; (+) strand; PAM type: YTN; PAM sequence: CTG
aaagaaataccactcagaat

SEQ ID NO: 294385 - DNA, 20 bp, Artificial Sequence
  Description of Artificial Sequence: Synthetic oligonucleotide
  Target: ATXN1; (+) strand; PAM type: YTN; PAM sequence: CTC
agaataaactgccaagggta

SEQ ID NO: 294386 - DNA, 20 bp, Artificial Sequence
  Description of Artificial Sequence: Synthetic oligonucleotide
  Target: ATXN1; (+) strand; PAM type: YTN; PAM sequence: CTG
ccaagggtagcaggtgtggc

SEQ ID NO: 294387 - DNA, 20 bp, Artificial Sequence
  Description of Artificial Sequence: Synthetic oligonucleotide
  Target: ATXN1; (+) strand; PAM type: YTN; PAM sequence: CTT
tgggagccaaggataaagct

SEQ ID NO: 294388 - DNA, 20 bp, Artificial Sequence
  Description of Artificial Sequence: Synthetic oligonucleotide
  Target: ATXN1; (+) strand; PAM type: YTN; PAM sequence: TTT
gggagccaaggataaagctt

SEQ ID NO: 294389 - DNA, 20 bp, Artificial Sequence
  Description of Artificial Sequence: Synthetic oligonucleotide
  Target: ATXN1; (+) strand; PAM type: YTN; PAM sequence: TTG
ggagccaaggataaagcttc

SEQ ID NO: 294390 - DNA, 20 bp, Artificial Sequence
  Description of Artificial Sequence: Synthetic oligonucleotide
  Target: ATXN1; (+) strand; PAM type: YTN; PAM sequence: CTT
ctagtttagcacagtccggt

SEQ ID NO: 294391 - DNA, 20 bp, Artificial Sequence
  Description of Artificial Sequence: Synthetic oligonucleotide
  Target: ATXN1; (+) strand; PAM type: YTN; PAM sequence: TTC
tagtttagcacagtccggtt

SEQ ID NO: 294392 - DNA, 20 bp, Artificial Sequence
  Description of Artificial Sequence: Synthetic oligonucleotide
  Target: ATXN1; (+) strand; PAM type: YTN; PAM sequence: CTA
gtttagcacagtccggttcc

SEQ ID NO: 294393 - DNA, 20 bp, Artificial Sequence
  Description of Artificial Sequence: Synthetic oligonucleotide
  Target: ATXN1; (+) strand; PAM type: YTN; PAM sequence: TTT
agcacagtccggttcctatc

SEQ ID NO: 294394 - DNA, 20 bp, Artificial Sequence
  Description of Artificial Sequence: Synthetic oligonucleotide
  Target: ATXN1; (+) strand; PAM type: YTN; PAM sequence: TTA
gcacagtccggttcctatcc

SEQ ID NO: 294395 - DNA, 20 bp, Artificial Sequence
  Description of Artificial Sequence: Synthetic oligonucleotide
  Target: ATXN1; (+) strand; PAM type: YTN; PAM sequence: TTC
ctatcctcagatctttctcc

SEQ ID NO: 294396 - DNA, 20 bp, Artificial Sequence
  Description of Artificial Sequence: Synthetic oligonucleotide
  Target: ATXN1; (+) strand; PAM type: YTN; PAM sequence: CTA
tcctcagatctttctcctag

SEQ ID NO: 294397 - DNA, 20 bp, Artificial Sequence
  Description of Artificial Sequence: Synthetic oligonucleotide
  Target: ATXN1; (+) strand; PAM type: YTN; PAM sequence: CTC
agatctttctcctagcctgc

SEQ ID NO: 294398 - DNA, 20 bp, Artificial Sequence
  Description of Artificial Sequence: Synthetic oligonucleotide
  Target: ATXN1; (+) strand; PAM type: YTN; PAM sequence: CTT
tctcctagcctgctgctcca

SEQ ID NO: 294399 - DNA, 20 bp, Artificial Sequence
  Description of Artificial Sequence: Synthetic oligonucleotide
  Target: ATXN1; (+) strand; PAM type: YTN; PAM sequence: TTT
ctcctagcctgctgctccag

SEQ ID NO: 294400 - DNA, 20 bp, Artificial Sequence
  Description of Artificial Sequence: Synthetic oligonucleotide
  Target: ATXN1; (+) strand; PAM type: YTN; PAM sequence: TTC
tcctagcctgctgctccagc

SEQ ID NO: 294401 - DNA, 20 bp, Artificial Sequence
  Description of Artificial Sequence: Synthetic oligonucleotide
  Target: ATXN1; (+) strand; PAM type: YTN; PAM sequence: CTC
ctagcctgctgctccagccc

SEQ ID NO: 294402 - DNA, 20 bp, Artificial Sequence
  Description of Artificial Sequence: Synthetic oligonucleotide
  Target: ATXN1; (+) strand; PAM type: YTN; PAM sequence: CTA
gcctgctgctccagcccagc

SEQ ID NO: 294403 - DNA, 20 bp, Artificial Sequence
  Description of Artificial Sequence: Synthetic oligonucleotide
  Target: ATXN1; (+) strand; PAM type: YTN; PAM sequence: CTG
ctgctccagcccagctcctc

SEQ ID NO: 294404 - DNA, 20 bp, Artificial Sequence
  Description of Artificial Sequence: Synthetic oligonucleotide
  Target: ATXN1; (+) strand; PAM type: YTN; PAM sequence: CTG
ctccagcccagctcctcata

SEQ ID NO: 294405 - DNA, 20 bp, Artificial Sequence
  Description of Artificial Sequence: Synthetic oligonucleotide
  Target: ATXN1; (+) strand; PAM type: YTN; PAM sequence: CTC
cagcccagctcctcatagct

SEQ ID NO: 294406 - DNA, 20 bp, Artificial Sequence
  Description of Artificial Sequence: Synthetic oligonucleotide
  Target: ATXN1; (+) strand; PAM type: YTN; PAM sequence: CTC
ctcatagctgatgtccccac

SEQ ID NO: 294407 - DNA, 20 bp, Artificial Sequence
  Description of Artificial Sequence: Synthetic oligonucleotide
  Target: ATXN1; (+) strand; PAM type: YTN; PAM sequence: CTC
atagctgatgtccccactat

SEQ ID NO: 294408 - DNA, 20 bp, Artificial Sequence
  Description of Artificial Sequence: Synthetic oligonucleotide
  Target: ATXN1; (+) strand; PAM type: YTN; PAM sequence: CTG
atgtccccactatcccaatc

SEQ ID NO: 294409 - DNA, 20 bp, Artificial Sequence
  Description of Artificial Sequence: Synthetic oligonucleotide
  Target: ATXN1; (+) strand; PAM type: YTN; PAM sequence: CTA
tcccaatcttagtcaggggc

SEQ ID NO: 294410 - DNA, 20 bp, Artificial Sequence
  Description of Artificial Sequence: Synthetic oligonucleotide
  Target: ATXN1; (+) strand; PAM type: YTN; PAM sequence: CTT
agtcaggggctcctgtcatt

SEQ ID NO: 294411 - DNA, 20 bp, Artificial Sequence
  Description of Artificial Sequence: Synthetic oligonucleotide
  Target: ATXN1; (+) strand; PAM type: YTN; PAM sequence: TTA
gtcaggggctcctgtcatta

SEQ ID NO: 294412 - DNA, 20 bp, Artificial Sequence
  Description of Artificial Sequence: Synthetic oligonucleotide
  Target: ATXN1; (+) strand; PAM type: YTN; PAM sequence: CTC
ctgtcattaccaccaacaga

SEQ ID NO: 294413 - DNA, 20 bp, Artificial Sequence
  Description of Artificial Sequence: Synthetic oligonucleotide
  Target: ATXN1; (+) strand; PAM type: YTN; PAM sequence: CTG
tcattaccaccaacagagtt

SEQ ID NO: 294414 - DNA, 20 bp, Artificial Sequence
  Description of Artificial Sequence: Synthetic oligonucleotide
  Target: ATXN1; (+) strand; PAM type: YTN; PAM sequence: TTA
ccaccaacagagttagtgat

SEQ ID NO: 294415 - DNA, 20 bp, Artificial Sequence
  Description of Artificial Sequence: Synthetic oligonucleotide
  Target: ATXN1; (+) strand; PAM type: YTN; PAM sequence: TTA
gtgattacaaaagataaaga

SEQ ID NO: 294416 - DNA, 20 bp, Artificial Sequence
  Description of Artificial Sequence: Synthetic oligonucleotide
  Target: ATXN1; (+) strand; PAM type: YTN; PAM sequence: TTA
caaaagataaagagacaaaa

SEQ ID NO: 294417 - DNA, 20 bp, Artificial Sequence
  Description of Artificial Sequence: Synthetic oligonucleotide
  Target: ATXN1; (+) strand; PAM type: YTN; PAM sequence: TTT
ccaaaagagcctctgcccta

SEQ ID NO: 294418 - DNA, 20 bp, Artificial Sequence
  Description of Artificial Sequence: Synthetic oligonucleotide
  Target: ATXN1; (+) strand; PAM type: YTN; PAM sequence: TTC
caaaagagcctctgccctag

SEQ ID NO: 294419 - DNA, 20 bp, Artificial Sequence
  Description of Artificial Sequence: Synthetic oligonucleotide
  Target: ATXN1; (+) strand; PAM type: YTN; PAM sequence: CTC
tgccctaggggaacacttta

SEQ ID NO: 294420 - DNA, 20 bp, Artificial Sequence
  Description of Artificial Sequence: Synthetic oligonucleotide
  Target: ATXN1; (+) strand; PAM type: YTN; PAM sequence: CTG
ccctaggggaacactttacg

SEQ ID NO: 294421 - DNA, 20 bp, Artificial Sequence
  Description of Artificial Sequence: Synthetic oligonucleotide
  Target: ATXN1; (+) strand; PAM type: YTN; PAM sequence: CTA
ggggaacactttacgtattt

SEQ ID NO: 294422 - DNA, 20 bp, Artificial Sequence
  Description of Artificial Sequence: Synthetic oligonucleotide
  Target: ATXN1; (+) strand; PAM type: YTN; PAM sequence: CTT
tacgtatttggaagaaagtg

SEQ ID NO: 294423 - DNA, 20 bp, Artificial Sequence
  Description of Artificial Sequence: Synthetic oligonucleotide
  Target: ATXN1; (+) strand; PAM type: YTN; PAM sequence: TTT
acgtatttggaagaaagtgg

SEQ ID NO: 294424 - DNA, 20 bp, Artificial Sequence
  Description of Artificial Sequence: Synthetic oligonucleotide
  Target: ATXN1; (+) strand; PAM type: YTN; PAM sequence: TTA
cgtatttggaagaaagtggg

SEQ ID NO: 294425 - DNA, 20 bp, Artificial Sequence
  Description of Artificial Sequence: Synthetic oligonucleotide
  Target: ATXN1; (+) strand; PAM type: YTN; PAM sequence: TTT
ggaagaaagtgggtttctaa

SEQ ID NO: 294426 - DNA, 20 bp, Artificial Sequence
  Description of Artificial Sequence: Synthetic oligonucleotide
  Target: ATXN1; (+) strand; PAM type: YTN; PAM sequence: TTG
gaagaaagtgggtttctaaa

SEQ ID NO: 294427 - DNA, 20 bp, Artificial Sequence
  Description of Artificial Sequence: Synthetic oligonucleotide
  Target: ATXN1; (+) strand; PAM type: YTN; PAM sequence: TTT
ctaaaggttcagagaatatg

SEQ ID NO: 294428 - DNA, 20 bp, Artificial Sequence
  Description of Artificial Sequence: Synthetic oligonucleotide
  Target: ATXN1; (+) strand; PAM type: YTN; PAM sequence: TTC
taaaggttcagagaatatgc

SEQ ID NO: 294429 - DNA, 20 bp, Artificial Sequence
  Description of Artificial Sequence: Synthetic oligonucleotide
  Target: ATXN1; (+) strand; PAM type: YTN; PAM sequence: CTA
aaggttcagagaatatgctg

SEQ ID NO: 294430 - DNA, 20 bp, Artificial Sequence
  Description of Artificial Sequence: Synthetic oligonucleotide
  Target: ATXN1; (+) strand; PAM type: YTN; PAM sequence: TTC
agagaatatgctgacctcac

SEQ ID NO: 294431 - DNA, 20 bp, Artificial Sequence
  Description of Artificial Sequence: Synthetic oligonucleotide
  Target: ATXN1; (+) strand; PAM type: YTN; PAM sequence: CTG
acctcacatcctgaaaaagc

SEQ ID NO: 294432 - DNA, 20 bp, Artificial Sequence
  Description of Artificial Sequence: Synthetic oligonucleotide
  Target: ATXN1; (+) strand; PAM type: YTN; PAM sequence: CTC
acatcctgaaaaagcttggc

SEQ ID NO: 294433 - DNA, 20 bp, Artificial Sequence
  Description of Artificial Sequence: Synthetic oligonucleotide
  Target: ATXN1; (+) strand; PAM type: YTN; PAM sequence: CTG
aaaaagcttggcaactgaag

SEQ ID NO: 294434 - DNA, 20 bp, Artificial Sequence
  Description of Artificial Sequence: Synthetic oligonucleotide
  Target: ATXN1; (+) strand; PAM type: YTN; PAM sequence: CTT
ggcaactgaagagggaatgc

SEQ ID NO: 294435 - DNA, 20 bp, Artificial Sequence
  Description of Artificial Sequence: Synthetic oligonucleotide
  Target: ATXN1; (+) strand; PAM type: YTN; PAM sequence: TTG
gcaactgaagagggaatgca

SEQ ID NO: 294436 - DNA, 20 bp, Artificial Sequence
  Description of Artificial Sequence: Synthetic oligonucleotide
  Target: ATXN1; (+) strand; PAM type: YTN; PAM sequence: CTG
aagagggaatgcaaccctca

SEQ ID NO: 294437 - DNA, 20 bp, Artificial Sequence
  Description of Artificial Sequence: Synthetic oligonucleotide
  Target: ATXN1; (+) strand; PAM type: YTN; PAM sequence: CTC
atggcttgatgttgcttagg

SEQ ID NO: 294438 - DNA, 20 bp, Artificial Sequence
  Description of Artificial Sequence: Synthetic oligonucleotide
  Target: ATXN1; (+) strand; PAM type: YTN; PAM sequence: CTT
gatgttgcttaggtcaacaa

SEQ ID NO: 294439 - DNA, 20 bp, Artificial Sequence
  Description of Artificial Sequence: Synthetic oligonucleotide
  Target: ATXN1; (+) strand; PAM type: YTN; PAM sequence: TTG
atgttgcttaggtcaacaag

SEQ ID NO: 294440 - DNA, 20 bp, Artificial Sequence
  Description of Artificial Sequence: Synthetic oligonucleotide
  Target: ATXN1; (+) strand; PAM type: YTN; PAM sequence: TTG
cttaggtcaacaagcaaata

SEQ ID NO: 294441 - DNA, 20 bp, Artificial Sequence
  Description of Artificial Sequence: Synthetic oligonucleotide
  Target: ATXN1; (+) strand; PAM type: YTN; PAM sequence: CTT
aggtcaacaagcaaatattt

SEQ ID NO: 294442 - DNA, 20 bp, Artificial Sequence
  Description of Artificial Sequence: Synthetic oligonucleotide
  Target: ATXN1; (+) strand; PAM type: YTN; PAM sequence: TTA
ggtcaacaagcaaatatttc

SEQ ID NO: 294443 - DNA, 20 bp, Artificial Sequence
  Description of Artificial Sequence: Synthetic oligonucleotide
  Target: ATXN1; (+) strand; PAM type: YTN; PAM sequence: TTT
cctggacacctaccataggc

SEQ ID NO: 294444 - DNA, 20 bp, Artificial Sequence
  Description of Artificial Sequence: Synthetic oligonucleotide
  Target: ATXN1; (+) strand; PAM type: YTN; PAM sequence: TTC
ctggacacctaccataggct

SEQ ID NO: 294445 - DNA, 20 bp, Artificial Sequence
  Description of Artificial Sequence: Synthetic oligonucleotide
  Target: ATXN1; (+) strand; PAM type: YTN; PAM sequence: CTG
gacacctaccataggctcag

SEQ ID NO: 294446 - DNA, 20 bp, Artificial Sequence
  Description of Artificial Sequence: Synthetic oligonucleotide
  Target: ATXN1; (+) strand; PAM type: YTN; PAM sequence: CTA
ccataggctcagacctggac

SEQ ID NO: 294447 - DNA, 20 bp, Artificial Sequence
  Description of Artificial Sequence: Synthetic oligonucleotide
  Target: ATXN1; (+) strand; PAM type: YTN; PAM sequence: CTC
agacctggaccctttgctgt

SEQ ID NO: 294448 - DNA, 20 bp, Artificial Sequence
  Description of Artificial Sequence: Synthetic oligonucleotide
  Target: ATXN1; (+) strand; PAM type: YTN; PAM sequence: CTG
gaccctttgctgtgggagag

SEQ ID NO: 294449 - DNA, 20 bp, Artificial Sequence
  Description of Artificial Sequence: Synthetic oligonucleotide
  Target: ATXN1; (+) strand; PAM type: YTN; PAM sequence: CTT
tgctgtgggagaggaggcaa

SEQ ID NO: 294450 - DNA, 20 bp, Artificial Sequence
  Description of Artificial Sequence: Synthetic oligonucleotide
  Target: ATXN1; (+) strand; PAM type: YTN; PAM sequence: TTT
gctgtgggagaggaggcaaa

SEQ ID NO: 294451 - DNA, 20 bp, Artificial Sequence
  Description of Artificial Sequence: Synthetic oligonucleotide
  Target: ATXN1; (+) strand; PAM type: YTN; PAM sequence: TTG
ctgtgggagaggaggcaaag

SEQ ID NO: 294452 - DNA, 20 bp, Artificial Sequence
  Description of Artificial Sequence: Synthetic oligonucleotide
  Target: ATXN1; (+) strand; PAM type: YTN; PAM sequence: CTG
tgggagaggaggcaaagagg

SEQ ID NO: 294453 - DNA, 20 bp, Artificial Sequence
  Description of Artificial Sequence: Synthetic oligonucleotide
  Target: ATXN1; (+) strand; PAM type: YTN; PAM sequence: TTA
ttttcagatagttattctca

SEQ ID NO: 294454 - DNA, 20 bp, Artificial Sequence
  Description of Artificial Sequence: Synthetic oligonucleotide
  Target: ATXN1; (+) strand; PAM type: YTN; PAM sequence: TTT
tcagatagttattctcaaac

SEQ ID NO: 294455 - DNA, 20 bp, Artificial Sequence
  Description of Artificial Sequence: Synthetic oligonucleotide
  Target: ATXN1; (+) strand; PAM type: YTN; PAM sequence: TTT
cagatagttattctcaaacc

SEQ ID NO: 294456 - DNA, 20 bp, Artificial Sequence
  Description of Artificial Sequence: Synthetic oligonucleotide
  Target: ATXN1; (+) strand; PAM type: YTN; PAM sequence: TTC
agatagttattctcaaacct

SEQ ID NO: 294457 - DNA, 20 bp, Artificial Sequence
  Description of Artificial Sequence: Synthetic oligonucleotide
  Target: ATXN1; (+) strand; PAM type: YTN; PAM sequence: TTA
ttctcaaacctcagtgtgca

SEQ ID NO: 294458 - DNA, 20 bp, Artificial Sequence
  Description of Artificial Sequence: Synthetic oligonucleotide
  Target: ATXN1; (+) strand; PAM type: YTN; PAM sequence: TTC
tcaaacctcagtgtgcaaaa

SEQ ID NO: 294459 - DNA, 20 bp, Artificial Sequence
  Description of Artificial Sequence: Synthetic oligonucleotide
  Target: ATXN1; (+) strand; PAM type: YTN; PAM sequence: CTC
aaacctcagtgtgcaaaagt

SEQ ID NO: 294460 - DNA, 20 bp, Artificial Sequence
  Description of Artificial Sequence: Synthetic oligonucleotide
  Target: ATXN1; (+) strand; PAM type: YTN; PAM sequence: CTC
agtgtgcaaaagttaactaa

SEQ ID NO: 294461 - DNA, 20 bp, Artificial Sequence
  Description of Artificial Sequence: Synthetic oligonucleotide
  Target: ATXN1; (+) strand; PAM type: YTN; PAM sequence: TTA
actaaggtgagtttcctggg

SEQ ID NO: 294462 - DNA, 20 bp, Artificial Sequence
  Description of Artificial Sequence: Synthetic oligonucleotide
  Target: ATXN1; (+) strand; PAM type: YTN; PAM sequence: CTA
aggtgagtttcctgggttct

SEQ ID NO: 294463 - DNA, 20 bp, Artificial Sequence
  Description of Artificial Sequence: Synthetic oligonucleotide
  Target: ATXN1; (+) strand; PAM type: YTN; PAM sequence: TTT
cctgggttctacatccccag

SEQ ID NO: 294464 - DNA, 20 bp, Artificial Sequence
  Description of Artificial Sequence: Synthetic oligonucleotide
  Target: ATXN1; (+) strand; PAM type: YTN; PAM sequence: TTC
ctgggttctacatccccaga

SEQ ID NO: 294465 - DNA, 20 bp, Artificial Sequence
  Description of Artificial Sequence: Synthetic oligonucleotide
  Target: ATXN1; (+) strand; PAM type: YTN; PAM sequence: CTG
ggttctacatccccagaact

SEQ ID NO: 294466 - DNA, 20 bp, Artificial Sequence
  Description of Artificial Sequence: Synthetic oligonucleotide
  Target: ATXN1; (+) strand; PAM type: YTN; PAM sequence: TTC
tacatccccagaacttctga

SEQ ID NO: 294467 - DNA, 20 bp, Artificial Sequence
  Description of Artificial Sequence: Synthetic oligonucleotide
  Target: ATXN1; (+) strand; PAM type: YTN; PAM sequence: CTA
catccccagaacttctgatt

SEQ ID NO: 294468 - DNA, 20 bp, Artificial Sequence
  Description of Artificial Sequence: Synthetic oligonucleotide
  Target: ATXN1; (+) strand; PAM type: YTN; PAM sequence: CTT
ctgattcataagcctggtgt

SEQ ID NO: 294469 - DNA, 20 bp, Artificial Sequence
  Description of Artificial Sequence: Synthetic oligonucleotide
  Target: ATXN1; (+) strand; PAM type: YTN; PAM sequence: TTC
tgattcataagcctggtgtt

SEQ ID NO: 294470 - DNA, 20 bp, Artificial Sequence
  Description of Artificial Sequence: Synthetic oligonucleotide
  Target: ATXN1; (+) strand; PAM type: YTN; PAM sequence: CTG
attcataagcctggtgttgc

SEQ ID NO: 294471 - DNA, 20 bp, Artificial Sequence
  Description of Artificial Sequence: Synthetic oligonucleotide
  Target: ATXN1; (+) strand; PAM type: YTN; PAM sequence: TTC
ataagcctggtgttgctgaa

SEQ ID NO: 294472 - DNA, 20 bp, Artificial Sequence
  Description of Artificial Sequence: Synthetic oligonucleotide
  Target: ATXN1; (+) strand; PAM type: YTN; PAM sequence: CTG
gtgttgctgaatctgcaact

SEQ ID NO: 294473 - DNA, 20 bp, Artificial Sequence
  Description of Artificial Sequence: Synthetic oligonucleotide
  Target: ATXN1; (+) strand; PAM type: YTN; PAM sequence: TTG
ctgaatctgcaactttaata

SEQ ID NO: 294474 - DNA, 20 bp, Artificial Sequence
  Description of Artificial Sequence: Synthetic oligonucleotide
  Target: ATXN1; (+) strand; PAM type: YTN; PAM sequence: CTG
aatctgcaactttaataaac

SEQ ID NO: 294475 - DNA, 20 bp, Artificial Sequence
  Description of Artificial Sequence: Synthetic oligonucleotide
  Target: ATXN1; (+) strand; PAM type: YTN; PAM sequence: CTG
caactttaataaacatatcc

SEQ ID NO: 294476 - DNA, 20 bp, Artificial Sequence
  Description of Artificial Sequence: Synthetic oligonucleotide
  Target: ATXN1; (+) strand; PAM type: YTN; PAM sequence: CTT
taataaacatatccaagaga

SEQ ID NO: 294477 - DNA, 20 bp, Artificial Sequence
  Description of Artificial Sequence: Synthetic oligonucleotide
  Target: ATXN1; (+) strand; PAM type: YTN; PAM sequence: TTT
aataaacatatccaagagat

SEQ ID NO: 294478 - DNA, 20 bp, Artificial Sequence
  Description of Artificial Sequence: Synthetic oligonucleotide
  Target: ATXN1; (+) strand; PAM type: YTN; PAM sequence: TTA
ataaacatatccaagagatt

SEQ ID NO: 294479 - DNA, 20 bp, Artificial Sequence
  Description of Artificial Sequence: Synthetic oligonucleotide
  Target: ATXN1; (+) strand; PAM type: YTN; PAM sequence: TTC
ggaagcaggaggtactggga

SEQ ID NO: 294480 - DNA, 20 bp, Artificial Sequence
  Description of Artificial Sequence: Synthetic oligonucleotide
  Target: ATXN1; (+) strand; PAM type: YTN; PAM sequence: CTG
ggattagaccacccttggga

SEQ ID NO: 294481 - DNA, 20 bp, Artificial Sequence
  Description of Artificial Sequence: Synthetic oligonucleotide
  Target: ATXN1; (+) strand; PAM type: YTN; PAM sequence: TTA
gaccacccttgggaaacact

SEQ ID NO: 294482 - DNA, 20 bp, Artificial Sequence
  Description of Artificial Sequence: Synthetic oligonucleotide
  Target: ATXN1; (+) strand; PAM type: YTN; PAM sequence: CTT
gggaaacactggtctgtgat

SEQ ID NO: 294483 - DNA, 20 bp, Artificial Sequence
  Description of Artificial Sequence: Synthetic oligonucleotide
  Target: ATXN1; (+) strand; PAM type: YTN; PAM sequence: TTG
ggaaacactggtctgtgatt

SEQ ID NO: 294484 - DNA, 20 bp, Artificial Sequence
  Description of Artificial Sequence: Synthetic oligonucleotide
  Target: ATXN1; (+) strand; PAM type: YTN; PAM sequence: CTG
gtctgtgatttgattcctgc

SEQ ID NO: 294485 - DNA, 20 bp, Artificial Sequence
  Description of Artificial Sequence: Synthetic oligonucleotide
  Target: ATXN1; (+) strand; PAM type: YTN; PAM sequence: CTG
tgatttgattcctgccttga

SEQ ID NO: 294486 - DNA, 20 bp, Artificial Sequence
  Description of Artificial Sequence: Synthetic oligonucleotide
  Target: ATXN1; (+) strand; PAM type: YTN; PAM sequence: TTT
gattcctgccttgaagccat

SEQ ID NO: 294487 - DNA, 20 bp, Artificial Sequence
  Description of Artificial Sequence: Synthetic oligonucleotide
  Target: ATXN1; (+) strand; PAM type: YTN; PAM sequence: TTG
attcctgccttgaagccatg

SEQ ID NO: 294488 - DNA, 20 bp, Artificial Sequence
  Description of Artificial Sequence: Synthetic oligonucleotide
  Target: ATXN1; (+) strand; PAM type: YTN; PAM sequence: TTC
ctgccttgaagccatgtgca

SEQ ID NO: 294489 - DNA, 20 bp, Artificial Sequence
  Description of Artificial Sequence: Synthetic oligonucleotide
  Target: ATXN1; (+) strand; PAM type: YTN; PAM sequence: CTG
ccttgaagccatgtgcaacc

SEQ ID NO: 294490 - DNA, 20 bp, Artificial Sequence
  Description of Artificial Sequence: Synthetic oligonucleotide
  Target: ATXN1; (+) strand; PAM type: YTN; PAM sequence: CTT
gaagccatgtgcaacccatg

SEQ ID NO: 294491 - DNA, 20 bp, Artificial Sequence
  Description of Artificial Sequence: Synthetic oligonucleotide
  Target: ATXN1; (+) strand; PAM type: YTN; PAM sequence: TTG
aagccatgtgcaacccatgt

SEQ ID NO: 294492 - DNA, 20 bp, Artificial Sequence
  Description of Artificial Sequence: Synthetic oligonucleotide
  Target: ATXN1; (+) strand; PAM type: YTN; PAM sequence: TTG
tgctgatggcaaacactcac

SEQ ID NO: 294493 - DNA, 20 bp, Artificial Sequence
  Description of Artificial Sequence: Synthetic oligonucleotide
  Target: ATXN1; (+) strand; PAM type: YTN; PAM sequence: CTG
atggcaaacactcacagagt

SEQ ID NO: 294494 - DNA, 20 bp, Artificial Sequence
  Description of Artificial Sequence: Synthetic oligonucleotide
  Target: ATXN1; (+) strand; PAM type: YTN; PAM sequence: CTC
acagagtaatgcacagcagt

SEQ ID NO: 294495 - DNA, 20 bp, Artificial Sequence
  Description of Artificial Sequence: Synthetic oligonucleotide
  Target: ATXN1; (+) strand; PAM type: YTN; PAM sequence: TTC
tgtaagaagcaggccctaaa

SEQ ID NO: 294496 - DNA, 20 bp, Artificial Sequence
  Description of Artificial Sequence: Synthetic oligonucleotide
  Target: ATXN1; (+) strand; PAM type: YTN; PAM sequence: CTG
taagaagcaggccctaaatg

SEQ ID NO: 294497 - DNA, 20 bp, Artificial Sequence
  Description of Artificial Sequence: Synthetic oligonucleotide
  Target: ATXN1; (+) strand; PAM type: YTN; PAM sequence: CTA
aatgtgatagaagttcataa

SEQ ID NO: 294498 - DNA, 20 bp, Artificial Sequence
  Description of Artificial Sequence: Synthetic oligonucleotide
  Target: ATXN1; (+) strand; PAM type: YTN; PAM sequence: TTC
ataaagagagactgctcagg

SEQ ID NO: 294499 - DNA, 20 bp, Artificial Sequence
  Description of Artificial Sequence: Synthetic oligonucleotide
  Target: ATXN1; (+) strand; PAM type: YTN; PAM sequence: CTG
ctcagggccgggcgcagtgg

SEQ ID NO: 294500 - DNA, 20 bp, Artificial Sequence
  Description of Artificial Sequence: Synthetic oligonucleotide
  Target: ATXN1; (+) strand; PAM type: YTN; PAM sequence: CTC
agggccgggcgcagtggctt

SEQ ID NO: 294501 - DNA, 20 bp, Artificial Sequence
  Description of Artificial Sequence: Synthetic oligonucleotide
  Target: ATXN1; (+) strand; PAM type: YTN; PAM sequence: CTT
acacctgtaatctcagcact

SEQ ID NO: 294502 - DNA, 20 bp, Artificial Sequence
  Description of Artificial Sequence: Synthetic oligonucleotide
  Target: ATXN1; (+) strand; PAM type: YTN; PAM sequence: TTA
cacctgtaatctcagcactt

SEQ ID NO: 294503 - DNA, 20 bp, Artificial Sequence
  Description of Artificial Sequence: Synthetic oligonucleotide
  Target: ATXN1; (+) strand; PAM type: YTN; PAM sequence: CTG
taatctcagcactttggaag

SEQ ID NO: 294504 - DNA, 20 bp, Artificial Sequence
  Description of Artificial Sequence: Synthetic oligonucleotide
  Target: ATXN1; (+) strand; PAM type: YTN; PAM sequence: CTC
agcactttggaaggccaagg

SEQ ID NO: 294505 - DNA, 20 bp, Artificial Sequence
  Description of Artificial Sequence: Synthetic oligonucleotide
  Target: ATXN1; (+) strand; PAM type: YTN; PAM sequence: CTT
tggaaggccaaggcagatgg

SEQ ID NO: 294506 - DNA, 20 bp, Artificial Sequence
  Description of Artificial Sequence: Synthetic oligonucleotide
  Target: ATXN1; (+) strand; PAM type: YTN; PAM sequence: TTT
ggaaggccaaggcagatgga

SEQ ID NO: 294507 - DNA, 20 bp, Artificial Sequence
  Description of Artificial Sequence: Synthetic oligonucleotide
  Target: ATXN1; (+) strand; PAM type: YTN; PAM sequence: TTG
gaaggccaaggcagatggat

SEQ ID NO: 294508 - DNA, 20 bp, Artificial Sequence
  Description of Artificial Sequence: Synthetic oligonucleotide
  Target: ATXN1; (+) strand; PAM type: YTN; PAM sequence: CTG
gccaacatggtgaaacccca

SEQ ID NO: 294509 - DNA, 20 bp, Artificial Sequence
  Description of Artificial Sequence: Synthetic oligonucleotide
  Target: ATXN1; (+) strand; PAM type: YTN; PAM sequence: TTT
ctactaaaaatagaaaaatt

SEQ ID NO: 294510 - DNA, 20 bp, Artificial Sequence
  Description of Artificial Sequence: Synthetic oligonucleotide
  Target: ATXN1; (+) strand; PAM type: YTN; PAM sequence: TTC
tactaaaaatagaaaaatta

SEQ ID NO: 294511 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatagaaaaattagc

SEQ ID NO: 294512 - DNA, 20 bp, Artificial Sequence
  Description of Artificial Sequence: Synthetic oligonucleotide
  Target: ATXN1; (+) strand; PAM type: YTN; PAM sequence: CTA
aaaatagaaaaattagctgg

SEQ ID NO: 294513 - DNA, 20 bp, Artificial Sequence
  Description of Artificial Sequence: Synthetic oligonucleotide
  Target: ATXN1; (+) strand; PAM type: YTN; PAM sequence: TTA
gctgggcacggtggcgcatg

SEQ ID NO: 294514 - DNA, 20 bp, Artificial Sequence
  Description of Artificial Sequence: Synthetic oligonucleotide
  Target: ATXN1; (+) strand; PAM type: YTN; PAM sequence: CTG
ggcacggtggcgcatgcctg

SEQ ID NO: 294515 - DNA, 20 bp, Artificial Sequence
  Description of Artificial Sequence: Synthetic oligonucleotide
  Target: ATXN1; (+) strand; PAM type: YTN; PAM sequence: CTG
taatcccagctactcaggag

SEQ ID NO: 294516 - DNA, 20 bp, Artificial Sequence
  Description of Artificial Sequence: Synthetic oligonucleotide
  Target: ATXN1; (+) strand; PAM type: YTN; PAM sequence: CTA
ctcaggaggctgaggcaaga

SEQ ID NO: 294517 - DNA, 20 bp, Artificial Sequence
  Description of Artificial Sequence: Synthetic oligonucleotide
  Target: ATXN1; (+) strand; PAM type: YTN; PAM sequence: CTC
aggaggctgaggcaagagaa

SEQ ID NO: 294518 - DNA, 20 bp, Artificial Sequence
  Description of Artificial Sequence: Synthetic oligonucleotide
  Target: ATXN1; (+) strand; PAM type: YTN; PAM sequence: CTG
aggcaagagaattgcttgaa

SEQ ID NO: 294519 - DNA, 20 bp, Artificial Sequence
  Description of Artificial Sequence: Synthetic oligonucleotide
  Target: ATXN1; (+) strand; PAM type: YTN; PAM sequence: TTG
cttgaacctgggaggcgaag

SEQ ID NO: 294520 - DNA, 20 bp, Artificial Sequence
  Description of Artificial Sequence: Synthetic oligonucleotide
  Target: ATXN1; (+) strand; PAM type: YTN; PAM sequence: CTT
gaacctgggaggcgaaggtt

SEQ ID NO: 294521 - DNA, 20 bp, Artificial Sequence
  Description of Artificial Sequence: Synthetic oligonucleotide
  Target: ATXN1; (+) strand; PAM type: YTN; PAM sequence: TTG
aacctgggaggcgaaggttg

SEQ ID NO: 294522 - DNA, 20 bp, Artificial Sequence
  Description of Artificial Sequence: Synthetic oligonucleotide
  Target: ATXN1; (+) strand; PAM type: YTN; PAM sequence: CTG
ggaggcgaaggttgcagtga

SEQ ID NO: 294523 - DNA, 20 bp, Artificial Sequence
  Description of Artificial Sequence: Synthetic oligonucleotide
  Target: ATXN1; (+) strand; PAM type: YTN; PAM sequence: TTG
cagtgagccaagattgccac

SEQ ID NO: 294524 - DNA, 20 bp, Artificial Sequence
  Description of Artificial Sequence: Synthetic oligonucleotide
  Target: ATXN1; (+) strand; PAM type: YTN; PAM sequence: TTG
ccactgcactccagcctagc

SEQ ID NO: 294525 - DNA, 20 bp, Artificial Sequence
  Description of Artificial Sequence: Synthetic oligonucleotide
  Target: ATXN1; (+) strand; PAM type: YTN; PAM sequence: CTG
cactccagcctagcaacaga

SEQ ID NO: 294526 - DNA, 20 bp, Artificial Sequence
  Description of Artificial Sequence: Synthetic oligonucleotide
  Target: ATXN1; (+) strand; PAM type: YTN; PAM sequence: CTC
cagcctagcaacagacccaa

SEQ ID NO: 294527 - DNA, 20 bp, Artificial Sequence
  Description of Artificial Sequence: Synthetic oligonucleotide
  Target: ATXN1; (+) strand; PAM type: YTN; PAM sequence: CTA
gcaacagacccaagactctg

SEQ ID NO: 294528 - DNA, 20 bp, Artificial Sequence
  Description of Artificial Sequence: Synthetic oligonucleotide
  Target: ATXN1; (+) strand; PAM type: YTN; PAM sequence: CTC
tgccttaaaaaaaaaaaaaa

SEQ ID NO: 294529 - DNA, 20 bp, Artificial Sequence
  Description of Artificial Sequence: Synthetic oligonucleotide
  Target: ATXN1; (+) strand; PAM type: YTN; PAM sequence: CTG
ccttaaaaaaaaaaaaaaaa

SEQ ID NO: 294530 - DNA, 20 bp, Artificial Sequence
  Description of Artificial Sequence: Synthetic oligonucleotide
  Target: ATXN1; (+) strand; PAM type: YTN; PAM sequence: CTT
aaaaaaaaaaaaaaaaaaaa

SEQ ID NO: 294531 - DNA, 20 bp, Artificial Sequence
  Description of Artificial Sequence: Synthetic oligonucleotide
  Target: ATXN1; (+) strand; PAM type: YTN; PAM sequence: TTA
aaaaaaaaaaaaaaaaaaaa

SEQ ID NO: 294532 - DNA, 20 bp, Artificial Sequence
  Description of Artificial Sequence: Synthetic oligonucleotide
  Target: ATXN1; (+) strand; PAM type: YTN; PAM sequence: CTG
aggattcagggaagactttg

SEQ ID NO: 294533 - DNA, 20 bp, Artificial Sequence
  Description of Artificial Sequence: Synthetic oligonucleotide
  Target: ATXN1; (+) strand; PAM type: YTN; PAM sequence: TTC
agggaagactttgtaagtga

SEQ ID NO: 294534 - DNA, 20 bp, Artificial Sequence
  Description of Artificial Sequence: Synthetic oligonucleotide
  Target: ATXN1; (+) strand; PAM type: YTN; PAM sequence: CTT
tgtaagtgacagccaggatt

SEQ ID NO: 294535 - DNA, 20 bp, Artificial Sequence
  Description of Artificial Sequence: Synthetic oligonucleotide
  Target: ATXN1; (+) strand; PAM type: YTN; PAM sequence: TTT
gtaagtgacagccaggattt

SEQ ID NO: 294536 - DNA, 20 bp, Artificial Sequence
  Description of Artificial Sequence: Synthetic oligonucleotide
  Target: ATXN1; (+) strand; PAM type: YTN; PAM sequence: TTG
taagtgacagccaggatttg

SEQ ID NO: 294537 - DNA, 20 bp, Artificial Sequence
  Description of Artificial Sequence: Synthetic oligonucleotide
  Target: ATXN1; (+) strand; PAM type: YTN; PAM sequence: TTT
gtggtgaggcagaactttga

SEQ ID NO: 294538 - DNA, 20 bp, Artificial Sequence
  Description of Artificial Sequence: Synthetic oligonucleotide
  Target: ATXN1; (+) strand; PAM type: YTN; PAM sequence: TTG
tggtgaggcagaactttgat

SEQ ID NO: 294539 - DNA, 20 bp, Artificial Sequence
  Description of Artificial Sequence: Synthetic oligonucleotide
  Target: ATXN1; (+) strand; PAM type: YTN; PAM sequence: CTT
tgatagagatagtccccaag

SEQ ID NO: 294540 - DNA, 20 bp, Artificial Sequence
  Description of Artificial Sequence: Synthetic oligonucleotide
  Target: ATXN1; (+) strand; PAM type: YTN; PAM sequence: TTT
gatagagatagtccccaagc

SEQ ID NO: 294541 - DNA, 20 bp, Artificial Sequence
  Description of Artificial Sequence: Synthetic oligonucleotide
  Target: ATXN1; (+) strand; PAM type: YTN; PAM sequence: TTG
atagagatagtccccaagca

SEQ ID NO: 294542 - DNA, 20 bp, Artificial Sequence
  Description of Artificial Sequence: Synthetic oligonucleotide
  Target: ATXN1; (+) strand; PAM type: YTN; PAM sequence: CTG
tcttaatcaaacctcccgat

SEQ ID NO: 294543 - DNA, 20 bp, Artificial Sequence
  Description of Artificial Sequence: Synthetic oligonucleotide
  Target: ATXN1; (+) strand; PAM type: YTN; PAM sequence: CTT
aatcaaacctcccgattcag

SEQ ID NO: 294544 - DNA, 20 bp, Artificial Sequence
  Description of Artificial Sequence: Synthetic oligonucleotide
  Target: ATXN1; (+) strand; PAM type: YTN; PAM sequence: TTA
atcaaacctcccgattcagc

SEQ ID NO: 294545 - DNA, 20 bp, Artificial Sequence
  Description of Artificial Sequence: Synthetic oligonucleotide
  Target: ATXN1; (+) strand; PAM type: YTN; PAM sequence: CTC
ccgattcagcatgacaaagt

SEQ ID NO: 294546 - DNA, 20 bp, Artificial Sequence
  Description of Artificial Sequence: Synthetic oligonucleotide
  Target: ATXN1; (+) strand; PAM type: YTN; PAM sequence: TTC
agcatgacaaagtggccatg

SEQ ID NO: 294547 - DNA, 20 bp, Artificial Sequence
  Description of Artificial Sequence: Synthetic oligonucleotide
  Target: ATXN1; (+) strand; PAM type: YTN; PAM sequence: TTC
ctatgttgattacaggaagg

SEQ ID NO: 294548 - DNA, 20 bp, Artificial Sequence
  Description of Artificial Sequence: Synthetic oligonucleotide
  Target: ATXN1; (+) strand; PAM type: YTN; PAM sequence: CTA
tgttgattacaggaaggata

SEQ ID NO: 294549 - DNA, 20 bp, Artificial Sequence
  Description of Artificial Sequence: Synthetic oligonucleotide
  Target: ATXN1; (+) strand; PAM type: YTN; PAM sequence: TTG
attacaggaaggatactgtc

SEQ ID NO: 294550 - DNA, 20 bp, Artificial Sequence
  Description of Artificial Sequence: Synthetic oligonucleotide
  Target: ATXN1; (+) strand; PAM type: YTN; PAM sequence: TTA
caggaaggatactgtcacca

SEQ ID NO: 294551 - DNA, 20 bp, Artificial Sequence
  Description of Artificial Sequence: Synthetic oligonucleotide
  Target: ATXN1; (+) strand; PAM type: YTN; PAM sequence: CTG
tcaccaggagaatcacaaaa

SEQ ID NO: 294552 - DNA, 20 bp, Artificial Sequence
  Description of Artificial Sequence: Synthetic oligonucleotide
  Target: ATXN1; (+) strand; PAM type: YTN; PAM sequence: CTA
gcacttccagataacactgt

SEQ ID NO: 294553 - DNA, 20 bp, Artificial Sequence
  Description of Artificial Sequence: Synthetic oligonucleotide
  Target: ATXN1; (+) strand; PAM type: YTN; PAM sequence: CTT
ccagataacactgtgtttgc

SEQ ID NO: 294554 - DNA, 20 bp, Artificial Sequence
  Description of Artificial Sequence: Synthetic oligonucleotide
  Target: ATXN1; (+) strand; PAM type: YTN; PAM sequence: TTC
cagataacactgtgtttgca

SEQ ID NO: 294555 - DNA, 20 bp, Artificial Sequence
  Description of Artificial Sequence: Synthetic oligonucleotide
  Target: ATXN1; (+) strand; PAM type: YTN; PAM sequence: CTG
tgtttgcatttgctttctac

SEQ ID NO: 294556 - DNA, 20 bp, Artificial Sequence
  Description of Artificial Sequence: Synthetic oligonucleotide
  Target: ATXN1; (+) strand; PAM type: YTN; PAM sequence: TTT
gcatttgctttctaccacat

SEQ ID NO: 294557 - DNA, 20 bp, Artificial Sequence
  Description of Artificial Sequence: Synthetic oligonucleotide
  Target: ATXN1; (+) strand; PAM type: YTN; PAM sequence: TTG
catttgctttctaccacatt

SEQ ID NO: 294558 - DNA, 20 bp, Artificial Sequence
  Description of Artificial Sequence: Synthetic oligonucleotide
  Target: ATXN1; (+) strand; PAM type: YTN; PAM sequence: TTT
gctttctaccacattcatgt

SEQ ID NO: 294559 - DNA, 20 bp, Artificial Sequence
  Description of Artificial Sequence: Synthetic oligonucleotide
  Target: ATXN1; (+) strand; PAM type: YTN; PAM sequence: TTG
ctttctaccacattcatgtg

SEQ ID NO: 294560 - DNA, 20 bp, Artificial Sequence
  Description of Artificial Sequence: Synthetic oligonucleotide
  Target: ATXN1; (+) strand; PAM type: YTN; PAM sequence: CTT
tctaccacattcatgtggtt

SEQ ID NO: 294561 - DNA, 20 bp, Artificial Sequence
  Description of Artificial Sequence: Synthetic oligonucleotide
  Target: ATXN1; (+) strand; PAM type: YTN; PAM sequence: TTT
ctaccacattcatgtggttt

SEQ ID NO: 294562 - DNA, 20 bp, Artificial Sequence
  Description of Artificial Sequence: Synthetic oligonucleotide
  Target: ATXN1; (+) strand; PAM type: YTN; PAM sequence: TTC
taccacattcatgtggtttc

SEQ ID NO: 294563 - DNA, 20 bp, Artificial Sequence
  Description of Artificial Sequence: Synthetic oligonucleotide
  Target: ATXN1; (+) strand; PAM type: YTN; PAM sequence: CTA
ccacattcatgtggtttcct

SEQ ID NO: 294564 - DNA, 20 bp, Artificial Sequence
  Description of Artificial Sequence: Synthetic oligonucleotide
  Target: ATXN1; (+) strand; PAM type: YTN; PAM sequence: TTC
atgtggtttcctgcacttca

SEQ ID NO: 294565 - DNA, 20 bp, Artificial Sequence
  Description of Artificial Sequence: Synthetic oligonucleotide
  Target: ATXN1; (+) strand; PAM type: YTN; PAM sequence: TTT
cctgcacttcataatttaat

SEQ ID NO: 294566 - DNA, 20 bp, Artificial Sequence
  Description of Artificial Sequence: Synthetic oligonucleotide
  Target: ATXN1; (+) strand; PAM type: YTN; PAM sequence: TTC
ctgcacttcataatttaata

SEQ ID NO: 294567 - DNA, 20 bp, Artificial Sequence
  Description of Artificial Sequence: Synthetic oligonucleotide
  Target: ATXN1; (+) strand; PAM type: YTN; PAM sequence: CTG
cacttcataatttaatattt

SEQ ID NO: 294568 - DNA, 20 bp, Artificial Sequence
  Description of Artificial Sequence: Synthetic oligonucleotide
  Target: ATXN1; (+) strand; PAM type: YTN; PAM sequence: CTT
cataatttaatatttgtaag

SEQ ID NO: 294569 - DNA, 20 bp, Artificial Sequence
  Description of Artificial Sequence: Synthetic oligonucleotide
  Target: ATXN1; (+) strand; PAM type: YTN; PAM sequence: TTC
ataatttaatatttgtaaga

SEQ ID NO: 294570 - DNA, 20 bp, Artificial Sequence
  Description of Artificial Sequence: Synthetic oligonucleotide
  Target: ATXN1; (+) strand; PAM type: YTN; PAM sequence: TTT
aatatttgtaagagaaaaaa

SEQ ID NO: 294571 - DNA, 20 bp, Artificial Sequence
  Description of Artificial Sequence: Synthetic oligonucleotide
  Target: ATXN1; (+) strand; PAM type: YTN; PAM sequence: TTA
atatttgtaagagaaaaaaa

SEQ ID NO: 294572 - DNA, 20 bp, Artificial Sequence
  Description of Artificial Sequence: Synthetic oligonucleotide
  Target: ATXN1; (+) strand; PAM type: YTN; PAM sequence: TTT
gtaagagaaaaaaaaatgct

SEQ ID NO: 294573 - DNA, 20 bp, Artificial Sequence
  Description of Artificial Sequence: Synthetic oligonucleotide
  Target: ATXN1; (+) strand; PAM type: YTN; PAM sequence: TTG
taagagaaaaaaaaatgctg

SEQ ID NO: 294574 - DNA, 20 bp, Artificial Sequence
  Description of Artificial Sequence: Synthetic oligonucleotide
  Target: ATXN1; (+) strand; PAM type: YTN; PAM sequence: CTG
ttatgaaaccccaataatgc

SEQ ID NO: 294575 - DNA, 20 bp, Artificial Sequence
  Description of Artificial Sequence: Synthetic oligonucleotide
  Target: ATXN1; (+) strand; PAM type: YTN; PAM sequence: TTA
tgaaaccccaataatgcatc

SEQ ID NO: 294576 - DNA, 20 bp, Artificial Sequence
  Description of Artificial Sequence: Synthetic oligonucleotide
  Target: ATXN1; (+) strand; PAM type: YTN; PAM sequence: CTT
gaaggcagaaagccagctgc

SEQ ID NO: 294577 - DNA, 20 bp, Artificial Sequence
  Description of Artificial Sequence: Synthetic oligonucleotide
  Target: ATXN1; (+) strand; PAM type: YTN; PAM sequence: TTG
aaggcagaaagccagctgct

SEQ ID NO: 294578 - DNA, 20 bp, Artificial Sequence
  Description of Artificial Sequence: Synthetic oligonucleotide
  Target: ATXN1; (+) strand; PAM type: YTN; PAM sequence: CTG
ctaacaagagtgacatctga

SEQ ID NO: 294579 - DNA, 20 bp, Artificial Sequence
  Description of Artificial Sequence: Synthetic oligonucleotide
  Target: ATXN1; (+) strand; PAM type: YTN; PAM sequence: CTA
acaagagtgacatctgagca

SEQ ID NO: 294580 - DNA, 20 bp, Artificial Sequence
  Description of Artificial Sequence: Synthetic oligonucleotide
  Target: ATXN1; (+) strand; PAM type: YTN; PAM sequence: CTG
agcatcatttctgaagctct

SEQ ID NO: 294581 - DNA, 20 bp, Artificial Sequence
  Description of Artificial Sequence: Synthetic oligonucleotide
  Target: ATXN1; (+) strand; PAM type: YTN; PAM sequence: TTT
ctgaagctctgcttcagaaa

SEQ ID NO: 294582 - DNA, 20 bp, Artificial Sequence
  Description of Artificial Sequence: Synthetic oligonucleotide
  Target: ATXN1; (+) strand; PAM type: YTN; PAM sequence: TTC
tgaagctctgcttcagaaag

SEQ ID NO: 294583 - DNA, 20 bp, Artificial Sequence
  Description of Artificial Sequence: Synthetic oligonucleotide
  Target: ATXN1; (+) strand; PAM type: YTN; PAM sequence: CTG
aagctctgcttcagaaaggg

SEQ ID NO: 294584 - DNA, 20 bp, Artificial Sequence
  Description of Artificial Sequence: Synthetic oligonucleotide
  Target: ATXN1; (+) strand; PAM type: YTN; PAM sequence: CTC
tgcttcagaaaggggatgtt

SEQ ID NO: 294585 - DNA, 20 bp, Artificial Sequence
  Description of Artificial Sequence: Synthetic oligonucleotide
  Target: ATXN1; (+) strand; PAM type: YTN; PAM sequence: CTG
cttcagaaaggggatgttta

SEQ ID NO: 294586 - DNA, 20 bp, Artificial Sequence
  Description of Artificial Sequence: Synthetic oligonucleotide
  Target: ATXN1; (+) strand; PAM type: YTN; PAM sequence: CTT
cagaaaggggatgtttagta

SEQ ID NO: 294587 - DNA, 20 bp, Artificial Sequence
  Description of Artificial Sequence: Synthetic oligonucleotide
  Target: ATXN1; (+) strand; PAM type: YTN; PAM sequence: TTC
agaaaggggatgtttagtaa

SEQ ID NO: 294588 - DNA, 20 bp, Artificial Sequence
  Description of Artificial Sequence: Synthetic oligonucleotide
  Target: ATXN1; (+) strand; PAM type: YTN; PAM sequence: TTT
agtaagaaagaacaataata

SEQ ID NO: 294589 - DNA, 20 bp, Artificial Sequence
  Description of Artificial Sequence: Synthetic oligonucleotide
  Target: ATXN1; (+) strand; PAM type: YTN; PAM sequence: TTA
gtaagaaagaacaataataa

SEQ ID NO: 294590 - DNA, 20 bp, Artificial Sequence
  Description of Artificial Sequence: Synthetic oligonucleotide
  Target: ATXN1; (+) strand; PAM type: YTN; PAM sequence: CTA
ttcaacgtaaaacaaagtgt

SEQ ID NO: 294591 - DNA, 20 bp, Artificial Sequence
  Description of Artificial Sequence: Synthetic oligonucleotide
  Target: ATXN1; (+) strand; PAM type: YTN; PAM sequence: TTC
aacgtaaaacaaagtgtggg

SEQ ID NO: 294592 - DNA, 20 bp, Artificial Sequence
  Description of Artificial Sequence: Synthetic oligonucleotide
  Target: ATXN1; (+) strand; PAM type: YTN; PAM sequence: TTA
acaggctggccggtaaccag

SEQ ID NO: 294593 - DNA, 20 bp, Artificial Sequence
  Description of Artificial Sequence: Synthetic oligonucleotide
  Target: ATXN1; (+) strand; PAM type: YTN; PAM sequence: CTG
gccggtaaccagtaacacaa

SEQ ID NO: 294594 - DNA, 20 bp, Artificial Sequence
  Description of Artificial Sequence: Synthetic oligonucleotide
  Target: ATXN1; (+) strand; PAM type: YTN; PAM sequence: CTA
aagaaaaacaaaggacagta

SEQ ID NO: 294595 - DNA, 20 bp, Artificial Sequence
  Description of Artificial Sequence: Synthetic oligonucleotide
  Target: ATXN1; (+) strand; PAM type: YTN; PAM sequence: TTT
caaaagaagcctatctcact

SEQ ID NO: 294596 - DNA, 20 bp, Artificial Sequence
  Description of Artificial Sequence: Synthetic oligonucleotide
  Target: ATXN1; (+) strand; PAM type: YTN; PAM sequence: TTC
aaaagaagcctatctcactt

SEQ ID NO: 294597 - DNA, 20 bp, Artificial Sequence
  Description of Artificial Sequence: Synthetic oligonucleotide
  Target: ATXN1; (+) strand; PAM type: YTN; PAM sequence: CTA
tctcacttatttggatataa

SEQ ID NO: 294598 - DNA, 20 bp, Artificial Sequence
  Description of Artificial Sequence: Synthetic oligonucleotide
  Target: ATXN1; (+) strand; PAM type: YTN; PAM sequence: CTC
acttatttggatataatatt

SEQ ID NO: 294599 - DNA, 20 bp, Artificial Sequence
  Description of Artificial Sequence: Synthetic oligonucleotide
  Target: ATXN1; (+) strand; PAM type: YTN; PAM sequence: CTT
atttggatataatattcagg

SEQ ID NO: 294600 - DNA, 20 bp, Artificial Sequence
  Description of Artificial Sequence: Synthetic oligonucleotide
  Target: ATXN1; (+) strand; PAM type: YTN; PAM sequence: TTA
tttggatataatattcaggc

SEQ ID NO: 294601 - DNA, 20 bp, Artificial Sequence
  Description of Artificial Sequence: Synthetic oligonucleotide
  Target: ATXN1; (+) strand; PAM type: YTN; PAM sequence: TTT
ggatataatattcaggccag

SEQ ID NO: 294602 - DNA, 20 bp, Artificial Sequence
  Description of Artificial Sequence: Synthetic oligonucleotide
  Target: ATXN1; (+) strand; PAM type: YTN; PAM sequence: TTG
gatataatattcaggccagg

SEQ ID NO: 294603 - DNA, 20 bp, Artificial Sequence
  Description of Artificial Sequence: Synthetic oligonucleotide
  Target: ATXN1; (+) strand; PAM type: YTN; PAM sequence: TTC
aggccaggcacagtggtgca

SEQ ID NO: 294604 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgagag

SEQ ID NO: 294605 - DNA, 20 bp, Artificial Sequence
  Description of Artificial Sequence: Synthetic oligonucleotide
  Target: ATXN1; (+) strand; PAM type: YTN; PAM sequence: CTT
tgagaggccaaggcaggatg

SEQ ID NO: 294606 - DNA, 20 bp, Artificial Sequence
  Description of Artificial Sequence: Synthetic oligonucleotide
  Target: ATXN1; (+) strand; PAM type: YTN; PAM sequence: TTT
gagaggccaaggcaggatga

SEQ ID NO: 294607 - DNA, 20 bp, Artificial Sequence
  Description of Artificial Sequence: Synthetic oligonucleotide
  Target: ATXN1; (+) strand; PAM type: YTN; PAM sequence: TTG
agaggccaaggcaggatgat

SEQ ID NO: 294608 - DNA, 20 bp, Artificial Sequence
  Description of Artificial Sequence: Synthetic oligonucleotide
  Target: ATXN1; (+) strand; PAM type: YTN; PAM sequence: TTG
ctggagcccaggagttccag

SEQ ID NO: 294609 - DNA, 20 bp, Artificial Sequence
  Description of Artificial Sequence: Synthetic oligonucleotide
  Target: ATXN1; (+) strand; PAM type: YTN; PAM sequence: CTG
gagcccaggagttccagacc

SEQ ID NO: 294610 - DNA, 20 bp, Artificial Sequence
  Description of Artificial Sequence: Synthetic oligonucleotide
  Target: ATXN1; (+) strand; PAM type: YTN; PAM sequence: TTC
cagaccagtctggacaacat

SEQ ID NO: 294611 - DNA, 20 bp, Artificial Sequence
  Description of Artificial Sequence: Synthetic oligonucleotide
  Target: ATXN1; (+) strand; PAM type: YTN; PAM sequence: CTG
gacaacatagcgagacctcg

SEQ ID NO: 294612 - DNA, 20 bp, Artificial Sequence
  Description of Artificial Sequence: Synthetic oligonucleotide
  Target: ATXN1; (+) strand; PAM type: YTN; PAM sequence: CTC
gtatctacaaaaaaatggaa

SEQ ID NO: 294613 - DNA, 20 bp, Artificial Sequence
  Description of Artificial Sequence: Synthetic oligonucleotide
  Target: ATXN1; (+) strand; PAM type: YTN; PAM sequence: CTA
caaaaaaatggaaaaattag

SEQ ID NO: 294614 - DNA, 20 bp, Artificial Sequence
  Description of Artificial Sequence: Synthetic oligonucleotide
  Target: ATXN1; (+) strand; PAM type: YTN; PAM sequence: TTA
gccaggcatggtggcgcgtg

SEQ ID NO: 294615 - DNA, 20 bp, Artificial Sequence
  Description of Artificial Sequence: Synthetic oligonucleotide
  Target: ATXN1; (+) strand; PAM type: YTN; PAM sequence: CTG
tagtctcggctactggtctg

SEQ ID NO: 294616 - DNA, 20 bp, Artificial Sequence
  Description of Artificial Sequence: Synthetic oligonucleotide
  Target: ATXN1; (+) strand; PAM type: YTN; PAM sequence: CTC
ggctactggtctgtgatgat

SEQ ID NO: 294617 - DNA, 20 bp, Artificial Sequence
  Description of Artificial Sequence: Synthetic oligonucleotide
  Target: ATXN1; (+) strand; PAM type: YTN; PAM sequence: CTA
ctggtctgtgatgatgattc

SEQ ID NO: 294618 - DNA, 20 bp, Artificial Sequence
  Description of Artificial Sequence: Synthetic oligonucleotide
  Target: ATXN1; (+) strand; PAM type: YTN; PAM sequence: CTG
gtctgtgatgatgattcctg

SEQ ID NO: 294619 - DNA, 20 bp, Artificial Sequence
  Description of Artificial Sequence: Synthetic oligonucleotide
  Target: ATXN1; (+) strand; PAM type: YTN; PAM sequence: CTG
tgatgatgattcctgccctg

SEQ ID NO: 294620 - DNA, 20 bp, Artificial Sequence
  Description of Artificial Sequence: Synthetic oligonucleotide
  Target: ATXN1; (+) strand; PAM type: YTN; PAM sequence: TTC
ctgccctgaagctgtgtgta

SEQ ID NO: 294621 - DNA, 20 bp, Artificial Sequence
  Description of Artificial Sequence: Synthetic oligonucleotide
  Target: ATXN1; (+) strand; PAM type: YTN; PAM sequence: CTG
ccctgaagctgtgtgtaccc

SEQ ID NO: 294622 - DNA, 20 bp, Artificial Sequence
  Description of Artificial Sequence: Synthetic oligonucleotide
  Target: ATXN1; (+) strand; PAM type: YTN; PAM sequence: CTG
aagctgtgtgtacccctgat

SEQ ID NO: 294623 - DNA, 20 bp, Artificial Sequence
  Description of Artificial Sequence: Synthetic oligonucleotide
  Target: ATXN1; (+) strand; PAM type: YTN; PAM sequence: CTG
tgtgtacccctgatggcgtg

SEQ ID NO: 294624 - DNA, 20 bp, Artificial Sequence
  Description of Artificial Sequence: Synthetic oligonucleotide
  Target: ATXN1; (+) strand; PAM type: YTN; PAM sequence: CTG
atggcgtgatgacaaacact

SEQ ID NO: 294625 - DNA, 20 bp, Artificial Sequence
  Description of Artificial Sequence: Synthetic oligonucleotide
  Target: ATXN1; (+) strand; PAM type: YTN; PAM sequence: CTA
acagaacaacacatagcagt

SEQ ID NO: 294626 - DNA, 20 bp, Artificial Sequence
  Description of Artificial Sequence: Synthetic oligonucleotide
  Target: ATXN1; (+) strand; PAM type: YTN; PAM sequence: TTT
tatatgatgcaggccctaaa

SEQ ID NO: 294627 - DNA, 20 bp, Artificial Sequence
  Description of Artificial Sequence: Synthetic oligonucleotide
  Target: ATXN1; (+) strand; PAM type: YTN; PAM sequence: TTT
atatgatgcaggccctaaat

SEQ ID NO: 294628 - DNA, 20 bp, Artificial Sequence
  Description of Artificial Sequence: Synthetic oligonucleotide
  Target: ATXN1; (+) strand; PAM type: YTN; PAM sequence: TTA
tatgatgcaggccctaaatg

SEQ ID NO: 294629 - DNA, 20 bp, Artificial Sequence
  Description of Artificial Sequence: Synthetic oligonucleotide
  Target: ATXN1; (+) strand; PAM type: YTN; PAM sequence: CTA
aatgtgacagaagttcataa

SEQ ID NO: 294630 - DNA, 20 bp, Artificial Sequence
  Description of Artificial Sequence: Synthetic oligonucleotide
  Target: ATXN1; (+) strand; PAM type: YTN; PAM sequence: TTC
ataaagagagaccagtcagc

SEQ ID NO: 294631 - DNA, 20 bp, Artificial Sequence
  Description of Artificial Sequence: Synthetic oligonucleotide
  Target: ATXN1; (+) strand; PAM type: YTN; PAM sequence: CTA
aaaattcagtgaagacttta

SEQ ID NO: 294632 - DNA, 20 bp, Artificial Sequence
  Description of Artificial Sequence: Synthetic oligonucleotide
  Target: ATXN1; (+) strand; PAM type: YTN; PAM sequence: TTC
agtgaagactttatgaatga

SEQ ID NO: 294633 - DNA, 20 bp, Artificial Sequence
  Description of Artificial Sequence: Synthetic oligonucleotide
  Target: ATXN1; (+) strand; PAM type: YTN; PAM sequence: CTT
tatgaatgacagccaggata

SEQ ID NO: 294634 - DNA, 20 bp, Artificial Sequence
  Description of Artificial Sequence: Synthetic oligonucleotide
  Target: ATXN1; (+) strand; PAM type: YTN; PAM sequence: TTT
atgaatgacagccaggatag

SEQ ID NO: 294635 - DNA, 20 bp, Artificial Sequence
  Description of Artificial Sequence: Synthetic oligonucleotide
  Target: ATXN1; (+) strand; PAM type: YTN; PAM sequence: TTA
tgaatgacagccaggatagt

SEQ ID NO: 294636 - DNA, 20 bp, Artificial Sequence
  Description of Artificial Sequence: Synthetic oligonucleotide
  Target: ATXN1; (+) strand; PAM type: YTN; PAM sequence: CTC
atatggtcccagcacaagct

SEQ ID NO: 294637 - DNA, 20 bp, Artificial Sequence
  Description of Artificial Sequence: Synthetic oligonucleotide
  Target: ATXN1; (+) strand; PAM type: YTN; PAM sequence: CTA
cgattgcaccactgcagtcc

SEQ ID NO: 294638 - DNA, 20 bp, Artificial Sequence
  Description of Artificial Sequence: Synthetic oligonucleotide
  Target: ATXN1; (+) strand; PAM type: YTN; PAM sequence: TTG
caccactgcagtccagcctg

SEQ ID NO: 294639 - DNA, 20 bp, Artificial Sequence
  Description of Artificial Sequence: Synthetic oligonucleotide
  Target: ATXN1; (+) strand; PAM type: YTN; PAM sequence: CTG
cagtccagcctgggcaacaa

SEQ ID NO: 294640 - DNA, 20 bp, Artificial Sequence
  Description of Artificial Sequence: Synthetic oligonucleotide
  Target: ATXN1; (+) strand; PAM type: YTN; PAM sequence: CTG
ggcaacaaagagaaagaaac

SEQ ID NO: 294641 - DNA, 20 bp, Artificial Sequence
  Description of Artificial Sequence: Synthetic oligonucleotide
  Target: ATXN1; (+) strand; PAM type: YTN; PAM sequence: CTC
aaataaataaataaataaat

SEQ ID NO: 294642 - DNA, 20 bp, Artificial Sequence
  Description of Artificial Sequence: Synthetic oligonucleotide
  Target: ATXN1; (+) strand; PAM type: YTN; PAM sequence: TTA
aaattaaatacataaaaatg

SEQ ID NO: 294643 - DNA, 20 bp, Artificial Sequence
  Description of Artificial Sequence: Synthetic oligonucleotide
  Target: ATXN1; (+) strand; PAM type: YTN; PAM sequence: TTA
aatacataaaaatgaatata

SEQ ID NO: 294644 - DNA, 20 bp, Artificial Sequence
  Description of Artificial Sequence: Synthetic oligonucleotide
  Target: ATXN1; (+) strand; PAM type: YTN; PAM sequence: TTC
ataaagcactgtgccacatt

SEQ ID NO: 294645 - DNA, 20 bp, Artificial Sequence
  Description of Artificial Sequence: Synthetic oligonucleotide
  Target: ATXN1; (+) strand; PAM type: YTN; PAM sequence: CTG
tgccacatttttttttaatg

SEQ ID NO: 294646 - DNA, 20 bp, Artificial Sequence
  Description of Artificial Sequence: Synthetic oligonucleotide
  Target: ATXN1; (+) strand; PAM type: YTN; PAM sequence: TTT
ttttttaatgttgcaaggga

SEQ ID NO: 294647 - DNA, 20 bp, Artificial Sequence
  Description of Artificial Sequence: Synthetic oligonucleotide
  Target: ATXN1; (+) strand; PAM type: YTN; PAM sequence: TTT
tttttaatgttgcaagggaa

SEQ ID NO: 294648 - DNA, 20 bp, Artificial Sequence
  Description of Artificial Sequence: Synthetic oligonucleotide
  Target: ATXN1; (+) strand; PAM type: YTN; PAM sequence: TTT
ttttaatgttgcaagggaat

SEQ ID NO: 294649 - DNA, 20 bp, Artificial Sequence
  Description of Artificial Sequence: Synthetic oligonucleotide
  Target: ATXN1; (+) strand; PAM type: YTN; PAM sequence: TTT
tttaatgttgcaagggaata

SEQ ID NO: 294650 - DNA, 20 bp, Artificial Sequence
  Description of Artificial Sequence: Synthetic oligonucleotide
  Target: ATXN1; (+) strand; PAM type: YTN; PAM sequence: TTT
ttaatgttgcaagggaataa

SEQ ID NO: 294651 - DNA, 20 bp, Artificial Sequence
  Description of Artificial Sequence: Synthetic oligonucleotide
  Target: ATXN1; (+) strand; PAM type: YTN; PAM sequence: TTT
taatgttgcaagggaataaa

SEQ ID NO: 294652 - DNA, 20 bp, Artificial Sequence
  Description of Artificial Sequence: Synthetic oligonucleotide
  Target: ATXN1; (+) strand; PAM type: YTN; PAM sequence: TTT
aatgttgcaagggaataaat

SEQ ID NO: 294653 - DNA, 20 bp, Artificial Sequence
  Description of Artificial Sequence: Synthetic oligonucleotide
  Target: ATXN1; (+) strand; PAM type: YTN; PAM sequence: TTA
atgttgcaagggaataaatt

SEQ ID NO: 294654 - DNA, 20 bp, Artificial Sequence
  Description of Artificial Sequence: Synthetic oligonucleotide
  Target: ATXN1; (+) strand; PAM type: YTN; PAM sequence: TTG
caagggaataaattatttac

SEQ ID NO: 294655 - DNA, 20 bp, Artificial Sequence
  Description of Artificial Sequence: Synthetic oligonucleotide
  Target: ATXN1; (+) strand; PAM type: YTN; PAM sequence: TTA
tttactgcgggccgggtgca

SEQ ID NO: 294656 - DNA, 20 bp, Artificial Sequence
  Description of Artificial Sequence: Synthetic oligonucleotide
  Target: ATXN1; (+) strand; PAM type: YTN; PAM sequence: TTT
actgcgggccgggtgcagtg

SEQ ID NO: 294657 - DNA, 20 bp, Artificial Sequence
  Description of Artificial Sequence: Synthetic oligonucleotide
  Target: ATXN1; (+) strand; PAM type: YTN; PAM sequence: TTA
ctgcgggccgggtgcagtgg

SEQ ID NO: 294658 - DNA, 20 bp, Artificial Sequence
  Description of Artificial Sequence: Synthetic oligonucleotide
  Target: ATXN1; (+) strand; PAM type: YTN; PAM sequence: CTG
cgggccgggtgcagtggttc

SEQ ID NO: 294659 - DNA, 20 bp, Artificial Sequence
  Description of Artificial Sequence: Synthetic oligonucleotide
  Target: ATXN1; (+) strand; PAM type: YTN; PAM sequence: TTC
acatctgtaatcccagcact

SEQ ID NO: 294660 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 294661 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgaggcaggcgg

SEQ ID NO: 294662 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaggcaggcgga

SEQ ID NO: 294663 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggcggat

SEQ ID NO: 294664 - DNA, 20 bp, Artificial Sequence
  Description of Artificial Sequence: Synthetic oligonucleotide
  Target: ATXN1; (+) strand; PAM type: YTN; PAM sequence: CTG
aggcaggcggatcacctgag

SEQ ID NO: 294665 - DNA, 20 bp, Artificial Sequence
  Description of Artificial Sequence: Synthetic oligonucleotide
  Target: ATXN1; (+) strand; PAM type: YTN; PAM sequence: CTG
aggtgaggagatcgagacca

SEQ ID NO: 294666 - DNA, 20 bp, Artificial Sequence
  Description of Artificial Sequence: Synthetic oligonucleotide
  Target: ATXN1; (+) strand; PAM type: YTN; PAM sequence: CTG
gctaacatggtgaaacccca

SEQ ID NO: 294667 - DNA, 20 bp, Artificial Sequence
  Description of Artificial Sequence: Synthetic oligonucleotide
  Target: ATXN1; (+) strand; PAM type: YTN; PAM sequence: CTA
acatggtgaaaccccagctc

SEQ ID NO: 294668 - DNA, 20 bp, Artificial Sequence
  Description of Artificial Sequence: Synthetic oligonucleotide
  Target: ATXN1; (+) strand; PAM type: YTN; PAM sequence: CTC
tactaaaaatacaaaaatta

SEQ ID NO: 294669 - DNA, 20 bp, Artificial Sequence
  Description of Artificial Sequence: Synthetic oligonucleotide
  Target: ATXN1; (+) strand; PAM type: YTN; PAM sequence: CTA
ctaaaaatacaaaaattagc

SEQ ID NO: 294670 - DNA, 20 bp, Artificial Sequence
  Description of Artificial Sequence: Synthetic oligonucleotide
  Target: ATXN1; (+) strand; PAM type: YTN; PAM sequence: CTA
aaaatacaaaaattagctgg

SEQ ID NO: 294671 - DNA, 20 bp, Artificial Sequence
  Description of Artificial Sequence: Synthetic oligonucleotide
  Target: ATXN1; (+) strand; PAM type: YTN; PAM sequence: TTA
gctgggcatggtggcacgca

SEQ ID NO: 294672 - DNA, 20 bp, Artificial Sequence
  Description of Artificial Sequence: Synthetic oligonucleotide
  Target: ATXN1; (+) strand; PAM type: YTN; PAM sequence: CTG
ggcatggtggcacgcatctg

SEQ ID NO: 294673 - DNA, 20 bp, Artificial Sequence
  Description of Artificial Sequence: Synthetic oligonucleotide
  Target: ATXN1; (+) strand; PAM type: YTN; PAM sequence: CTG
tagtcccagctactcgggag

SEQ ID NO: 294674 - DNA, 20 bp, Artificial Sequence
  Description of Artificial Sequence: Synthetic oligonucleotide
  Target: ATXN1; (+) strand; PAM type: YTN; PAM sequence: CTA
ctcgggaggttgaggcagga

SEQ ID NO: 294675 - DNA, 20 bp, Artificial Sequence
  Description of Artificial Sequence: Synthetic oligonucleotide
  Target: ATXN1; (+) strand; PAM type: YTN; PAM sequence: CTC
gggaggttgaggcaggagaa

SEQ ID NO: 294676 - DNA, 20 bp, Artificial Sequence
  Description of Artificial Sequence: Synthetic oligonucleotide
  Target: ATXN1; (+) strand; PAM type: YTN; PAM sequence: TTG
aggcaggagaatcgcttgaa

SEQ ID NO: 294677 - DNA, 20 bp, Artificial Sequence
  Description of Artificial Sequence: Synthetic oligonucleotide
  Target: ATXN1; (+) strand; PAM type: YTN; PAM sequence: CTT
gaacctgggaggtggaggtt

SEQ ID NO: 294678 - DNA, 20 bp, Artificial Sequence
  Description of Artificial Sequence: Synthetic oligonucleotide
  Target: ATXN1; (+) strand; PAM type: YTN; PAM sequence: TTG
aacctgggaggtggaggttg

SEQ ID NO: 294679 - DNA, 20 bp, Artificial Sequence
  Description of Artificial Sequence: Synthetic oligonucleotide
  Target: ATXN1; (+) strand; PAM type: YTN; PAM sequence: CTG
ggaggtggaggttgcagtga

SEQ ID NO: 294680 - DNA, 20 bp, Artificial Sequence
  Description of Artificial Sequence: Synthetic oligonucleotide
  Target: ATXN1; (+) strand; PAM type: YTN; PAM sequence: TTG
cagtgaactgagactgtgcc

SEQ ID NO: 294681 - DNA, 20 bp, Artificial Sequence
  Description of Artificial Sequence: Synthetic oligonucleotide
  Target: ATXN1; (+) strand; PAM type: YTN; PAM sequence: CTG
agactgtgccactgcactcc

SEQ ID NO: 294682 - DNA, 20 bp, Artificial Sequence
  Description of Artificial Sequence: Synthetic oligonucleotide
  Target: ATXN1; (+) strand; PAM type: YTN; PAM sequence: CTG
tgccactgcactccagcctg

SEQ ID NO: 294683 - DNA, 20 bp, Artificial Sequence
  Description of Artificial Sequence: Synthetic oligonucleotide
  Target: ATXN1; (+) strand; PAM type: YTN; PAM sequence: CTG
cactccagcctggtgacaga

SEQ ID NO: 294684 - DNA, 20 bp, Artificial Sequence
  Description of Artificial Sequence: Synthetic oligonucleotide
  Target: ATXN1; (+) strand; PAM type: YTN; PAM sequence: CTC
cagcctggtgacagagcaag

SEQ ID NO: 294685 - DNA, 20 bp, Artificial Sequence
  Description of Artificial Sequence: Synthetic oligonucleotide
  Target: ATXN1; (+) strand; PAM type: YTN; PAM sequence: CTG
gtgacagagcaagactccat

SEQ ID NO: 294686 - DNA, 20 bp, Artificial Sequence
  Description of Artificial Sequence: Synthetic oligonucleotide
  Target: ATXN1; (+) strand; PAM type: YTN; PAM sequence: CTC
catctcaaaaaaaaaaaaaa

SEQ ID NO: 294687 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaaacaaaaa

SEQ ID NO: 294688 - DNA, 20 bp, Artificial Sequence
  Description of Artificial Sequence: Synthetic oligonucleotide
  Target: ATXN1; (+) strand; PAM type: YTN; PAM sequence: TTA
tttactgcagatgctgacag

SEQ ID NO: 294689 - DNA, 20 bp, Artificial Sequence
  Description of Artificial Sequence: Synthetic oligonucleotide
  Target: ATXN1; (+) strand; PAM type: YTN; PAM sequence: TTT
actgcagatgctgacagtcc

SEQ ID NO: 294690 - DNA, 20 bp, Artificial Sequence
  Description of Artificial Sequence: Synthetic oligonucleotide
  Target: ATXN1; (+) strand; PAM type: YTN; PAM sequence: TTA
ctgcagatgctgacagtcct

SEQ ID NO: 294691 - DNA, 20 bp, Artificial Sequence
  Description of Artificial Sequence: Synthetic oligonucleotide
  Target: ATXN1; (+) strand; PAM type: YTN; PAM sequence: CTG
cagatgctgacagtcctgtt

SEQ ID NO: 294692 - DNA, 20 bp, Artificial Sequence
  Description of Artificial Sequence: Synthetic oligonucleotide
  Target: ATXN1; (+) strand; PAM type: YTN; PAM sequence: CTG
acagtcctgtttgaccaaag

SEQ ID NO: 294693 - DNA, 20 bp, Artificial Sequence
  Description of Artificial Sequence: Synthetic oligonucleotide
  Target: ATXN1; (+) strand; PAM type: YTN; PAM sequence: CTG
tttgaccaaagggctggctg

SEQ ID NO: 294694 - DNA, 20 bp, Artificial Sequence
  Description of Artificial Sequence: Synthetic oligonucleotide
  Target: ATXN1; (+) strand; PAM type: YTN; PAM sequence: TTT
gaccaaagggctggctgtca

SEQ ID NO: 294695 - DNA, 20 bp, Artificial Sequence
  Description of Artificial Sequence: Synthetic oligonucleotide
  Target: ATXN1; (+) strand; PAM type: YTN; PAM sequence: TTG
accaaagggctggctgtcaa

SEQ ID NO: 294696 - DNA, 20 bp, Artificial Sequence
  Description of Artificial Sequence: Synthetic oligonucleotide
  Target: ATXN1; (+) strand; PAM type: YTN; PAM sequence: CTG
gctgtcaaatgggcaaatgg

SEQ ID NO: 294697 - DNA, 20 bp, Artificial Sequence
  Description of Artificial Sequence: Synthetic oligonucleotide
  Target: ATXN1; (+) strand; PAM type: YTN; PAM sequence: CTG
tcaaatgggcaaatggggcc

SEQ ID NO: 294698 - DNA, 20 bp, Artificial Sequence
  Description of Artificial Sequence: Synthetic oligonucleotide
  Target: ATXN1; (+) strand; PAM type: YTN; PAM sequence: CTG
gctcctttcctccacactgg

SEQ ID NO: 294699 - DNA, 20 bp, Artificial Sequence
  Description of Artificial Sequence: Synthetic oligonucleotide
  Target: ATXN1; (+) strand; PAM type: YTN; PAM sequence: CTC
ctttcctccacactggttga

SEQ ID NO: 294700 - DNA, 20 bp, Artificial Sequence
  Description of Artificial Sequence: Synthetic oligonucleotide
  Target: ATXN1; (+) strand; PAM type: YTN; PAM sequence: CTT
tcctccacactggttgatac

SEQ ID NO: 294701 - DNA, 20 bp, Artificial Sequence
  Description of Artificial Sequence: Synthetic oligonucleotide
  Target: ATXN1; (+) strand; PAM type: YTN; PAM sequence: TTT
cctccacactggttgataca

SEQ ID NO: 294702 - DNA, 20 bp, Artificial Sequence
  Description of Artificial Sequence: Synthetic oligonucleotide
  Target: ATXN1; (+) strand; PAM type: YTN; PAM sequence: TTC
ctccacactggttgatacaa

SEQ ID NO: 294703 - DNA, 20 bp, Artificial Sequence
  Description of Artificial Sequence: Synthetic oligonucleotide
  Target: ATXN1; (+) strand; PAM type: YTN; PAM sequence: CTC
cacactggttgatacaatga

SEQ ID NO: 294704 - DNA, 20 bp, Artificial Sequence
  Description of Artificial Sequence: Synthetic oligonucleotide
  Target: ATXN1; (+) strand; PAM type: YTN; PAM sequence: CTG
gttgatacaatgagcccctc

SEQ ID NO: 294705 - DNA, 20 bp, Artificial Sequence
  Description of Artificial Sequence: Synthetic oligonucleotide
  Target: ATXN1; (+) strand; PAM type: YTN; PAM sequence: TTG
atacaatgagcccctctgca

SEQ ID NO: 294706 - DNA, 20 bp, Artificial Sequence
  Description of Artificial Sequence: Synthetic oligonucleotide
  Target: ATXN1; (+) strand; PAM type: YTN; PAM sequence: CTC
tgcaaatgaccaccaagcct

SEQ ID NO: 294707 - DNA, 20 bp, Artificial Sequence
  Description of Artificial Sequence: Synthetic oligonucleotide
  Target: ATXN1; (+) strand; PAM type: YTN; PAM sequence: CTG
caaatgaccaccaagcctac

SEQ ID NO: 294708 - DNA, 20 bp, Artificial Sequence
  Description of Artificial Sequence: Synthetic oligonucleotide
  Target: ATXN1; (+) strand; PAM type: YTN; PAM sequence: CTA
cacagaaattctgttgggca

SEQ ID NO: 294709 - DNA, 20 bp, Artificial Sequence
  Description of Artificial Sequence: Synthetic oligonucleotide
  Target: ATXN1; (+) strand; PAM type: YTN; PAM sequence: TTC
tgttgggcaagaactgaagt

SEQ ID NO: 294710 - DNA, 20 bp, Artificial Sequence
  Description of Artificial Sequence: Synthetic oligonucleotide
  Target: ATXN1; (+) strand; PAM type: YTN; PAM sequence: CTG
ttgggcaagaactgaagtgg

SEQ ID NO: 294711 - DNA, 20 bp, Artificial Sequence
  Description of Artificial Sequence: Synthetic oligonucleotide
  Target: ATXN1; (+) strand; PAM type: YTN; PAM sequence: TTG
ggcaagaactgaagtggata

SEQ ID NO: 294712 - DNA, 20 bp, Artificial Sequence
  Description of Artificial Sequence: Synthetic oligonucleotide
  Target: ATXN1; (+) strand; PAM type: YTN; PAM sequence: CTG
aagtggataattatttaatt

SEQ ID NO: 294713 - DNA, 20 bp, Artificial Sequence
  Description of Artificial Sequence: Synthetic oligonucleotide
  Target: ATXN1; (+) strand; PAM type: YTN; PAM sequence: TTA
tttaattcattgcactagag

SEQ ID NO: 294714 - DNA, 20 bp, Artificial Sequence
  Description of Artificial Sequence: Synthetic oligonucleotide
  Target: ATXN1; (+) strand; PAM type: YTN; PAM sequence: TTT
aattcattgcactagaggga

SEQ ID NO: 294715 - DNA, 20 bp, Artificial Sequence
  Description of Artificial Sequence: Synthetic oligonucleotide
  Target: ATXN1; (+) strand; PAM type: YTN; PAM sequence: TTA
attcattgcactagagggaa

SEQ ID NO: 294716 - DNA, 20 bp, Artificial Sequence
  Description of Artificial Sequence: Synthetic oligonucleotide
  Target: ATXN1; (+) strand; PAM type: YTN; PAM sequence: TTC
attgcactagagggaactga

SEQ ID NO: 294717 - DNA, 20 bp, Artificial Sequence
  Description of Artificial Sequence: Synthetic oligonucleotide
  Target: ATXN1; (+) strand; PAM type: YTN; PAM sequence: TTG
cactagagggaactgaatta

SEQ ID NO: 294718 - DNA, 20 bp, Artificial Sequence
  Description of Artificial Sequence: Synthetic oligonucleotide
  Target: ATXN1; (+) strand; PAM type: YTN; PAM sequence: CTA
gagggaactgaattataaat

SEQ ID NO: 294719 - DNA, 20 bp, Artificial Sequence
  Description of Artificial Sequence: Synthetic oligonucleotide
  Target: ATXN1; (+) strand; PAM type: YTN; PAM sequence: CTG
aattataaatttgcaggaga

SEQ ID NO: 294720 - DNA, 20 bp, Artificial Sequence
  Description of Artificial Sequence: Synthetic oligonucleotide
  Target: ATXN1; (+) strand; PAM type: YTN; PAM sequence: TTA
taaatttgcaggagaccttg

SEQ ID NO: 294721 - DNA, 20 bp, Artificial Sequence
  Description of Artificial Sequence: Synthetic oligonucleotide
  Target: ATXN1; (+) strand; PAM type: YTN; PAM sequence: TTT
gcaggagaccttggagatca

SEQ ID NO: 294722 - DNA, 20 bp, Artificial Sequence
  Description of Artificial Sequence: Synthetic oligonucleotide
  Target: ATXN1; (+) strand; PAM type: YTN; PAM sequence: TTG
caggagaccttggagatcag

SEQ ID NO: 294723 - DNA, 20 bp, Artificial Sequence
  Description of Artificial Sequence: Synthetic oligonucleotide
  Target: ATXN1; (+) strand; PAM type: YTN; PAM sequence: CTT
ggagatcagttaggcacata

SEQ ID NO: 294724 - DNA, 20 bp, Artificial Sequence
  Description of Artificial Sequence: Synthetic oligonucleotide
  Target: ATXN1; (+) strand; PAM type: YTN; PAM sequence: TTG
gagatcagttaggcacatac

SEQ ID NO: 294725 - DNA, 20 bp, Artificial Sequence
  Description of Artificial Sequence: Synthetic oligonucleotide
  Target: ATXN1; (+) strand; PAM type: YTN; PAM sequence: TTA
ggcacatacatctttaaagg

SEQ ID NO: 294726 - DNA, 20 bp, Artificial Sequence
  Description of Artificial Sequence: Synthetic oligonucleotide
  Target: ATXN1; (+) strand; PAM type: YTN; PAM sequence: CTT
taaaggcaagtcgttccaag

SEQ ID NO: 294727 - DNA, 20 bp, Artificial Sequence
  Description of Artificial Sequence: Synthetic oligonucleotide
  Target: ATXN1; (+) strand; PAM type: YTN; PAM sequence: TTT
aaaggcaagtcgttccaaga

SEQ ID NO: 294728 - DNA, 20 bp, Artificial Sequence
  Description of Artificial Sequence: Synthetic oligonucleotide
  Target: ATXN1; (+) strand; PAM type: YTN; PAM sequence: TTA
aaggcaagtcgttccaagat

SEQ ID NO: 294729 - DNA, 20 bp, Artificial Sequence
  Description of Artificial Sequence: Synthetic oligonucleotide
  Target: ATXN1; (+) strand; PAM type: YTN; PAM sequence: TTC
caagatgatgagcaagttct

SEQ ID NO: 294730 - DNA, 20 bp, Artificial Sequence
  Description of Artificial Sequence: Synthetic oligonucleotide
  Target: ATXN1; (+) strand; PAM type: YTN; PAM sequence: TTC
tccaaggtgaccaagatagg

SEQ ID NO: 294731 - DNA, 20 bp, Artificial Sequence
  Description of Artificial Sequence: Synthetic oligonucleotide
  Target: ATXN1; (+) strand; PAM type: YTN; PAM sequence: CTC
caaggtgaccaagataggtg

SEQ ID NO: 294732 - DNA, 20 bp, Artificial Sequence
  Description of Artificial Sequence: Synthetic oligonucleotide
  Target: ATXN1; (+) strand; PAM type: YTN; PAM sequence: CTA
ggcttcaatttgaggactct

SEQ ID NO: 294733 - DNA, 20 bp, Artificial Sequence
  Description of Artificial Sequence: Synthetic oligonucleotide
  Target: ATXN1; (+) strand; PAM type: YTN; PAM sequence: CTT
caatttgaggactctgcttc

SEQ ID NO: 294734 - DNA, 20 bp, Artificial Sequence
  Description of Artificial Sequence: Synthetic oligonucleotide
  Target: ATXN1; (+) strand; PAM type: YTN; PAM sequence: TTC
aatttgaggactctgcttcc

SEQ ID NO: 294735 - DNA, 20 bp, Artificial Sequence
  Description of Artificial Sequence: Synthetic oligonucleotide
  Target: ATXN1; (+) strand; PAM type: YTN; PAM sequence: TTT
gaggactctgcttccaggta

SEQ ID NO: 294736 - DNA, 20 bp, Artificial Sequence
  Description of Artificial Sequence: Synthetic oligonucleotide
  Target: ATXN1; (+) strand; PAM type: YTN; PAM sequence: TTG
aggactctgcttccaggtaa

SEQ ID NO: 294737 - DNA, 20 bp, Artificial Sequence
  Description of Artificial Sequence: Synthetic oligonucleotide
  Target: ATXN1; (+) strand; PAM type: YTN; PAM sequence: CTC
tgcttccaggtaatatcatg

SEQ ID NO: 294738 - DNA, 20 bp, Artificial Sequence
  Description of Artificial Sequence: Synthetic oligonucleotide
  Target: ATXN1; (+) strand; PAM type: YTN; PAM sequence: CTG
cttccaggtaatatcatgaa

SEQ ID NO: 294739 - DNA, 20 bp, Artificial Sequence
  Description of Artificial Sequence: Synthetic oligonucleotide
  Target: ATXN1; (+) strand; PAM type: YTN; PAM sequence: CTT
ccaggtaatatcatgaacgg

SEQ ID NO: 294740 - DNA, 20 bp, Artificial Sequence
  Description of Artificial Sequence: Synthetic oligonucleotide
  Target: ATXN1; (+) strand; PAM type: YTN; PAM sequence: TTC
caggtaatatcatgaacggg

SEQ ID NO: 294741 - DNA, 20 bp, Artificial Sequence
  Description of Artificial Sequence: Synthetic oligonucleotide
  Target: ATXN1; (+) strand; PAM type: YTN; PAM sequence: TTG
ataaaaaaaaaattcctgga

SEQ ID NO: 294742 - DNA, 20 bp, Artificial Sequence
  Description of Artificial Sequence: Synthetic oligonucleotide
  Target: ATXN1; (+) strand; PAM type: YTN; PAM sequence: TTC
ctggaagtccacattatgtt

SEQ ID NO: 294743 - DNA, 20 bp, Artificial Sequence
  Description of Artificial Sequence: Synthetic oligonucleotide
  Target: ATXN1; (+) strand; PAM type: YTN; PAM sequence: CTG
gaagtccacattatgttggt

SEQ ID NO: 294744 - DNA, 20 bp, Artificial Sequence
  Description of Artificial Sequence: Synthetic oligonucleotide
  Target: ATXN1; (+) strand; PAM type: YTN; PAM sequence: TTA
tgttggtgtatgctctggaa

SEQ ID NO: 294745 - DNA, 20 bp, Artificial Sequence
  Description of Artificial Sequence: Synthetic oligonucleotide
  Target: ATXN1; (+) strand; PAM type: YTN; PAM sequence: TTG
gtgtatgctctggaatggtt

SEQ ID NO: 294746 - DNA, 20 bp, Artificial Sequence
  Description of Artificial Sequence: Synthetic oligonucleotide
  Target: ATXN1; (+) strand; PAM type: YTN; PAM sequence: CTC
tggaatggttttatcattta

SEQ ID NO: 294747 - DNA, 20 bp, Artificial Sequence
  Description of Artificial Sequence: Synthetic oligonucleotide
  Target: ATXN1; (+) strand; PAM type: YTN; PAM sequence: CTG
gaatggttttatcatttatt

SEQ ID NO: 294748 - DNA, 20 bp, Artificial Sequence
  Description of Artificial Sequence: Synthetic oligonucleotide
  Target: ATXN1; (+) strand; PAM type: YTN; PAM sequence: TTT
tatcatttatttatagttta

SEQ ID NO: 294749 - DNA, 20 bp, Artificial Sequence
  Description of Artificial Sequence: Synthetic oligonucleotide
  Target: ATXN1; (+) strand; PAM type: YTN; PAM sequence: TTT
atcatttatttatagtttag

SEQ ID NO: 294750 - DNA, 20 bp, Artificial Sequence
  Description of Artificial Sequence: Synthetic oligonucleotide
  Target: ATXN1; (+) strand; PAM type: YTN; PAM sequence: TTA
tcatttatttatagtttaga

SEQ ID NO: 294751 - DNA, 20 bp, Artificial Sequence
  Description of Artificial Sequence: Synthetic oligonucleotide
  Target: ATXN1; (+) strand; PAM type: YTN; PAM sequence: TTT
atttatagtttagagtgttt

SEQ ID NO: 294752 - DNA, 20 bp, Artificial Sequence
  Description of Artificial Sequence: Synthetic oligonucleotide
  Target: ATXN1; (+) strand; PAM type: YTN; PAM sequence: TTA
tttatagtttagagtgtttg

SEQ ID NO: 294753 - DNA, 20 bp, Artificial Sequence
  Description of Artificial Sequence: Synthetic oligonucleotide
  Target: ATXN1; (+) strand; PAM type: YTN; PAM sequence: TTT
atagtttagagtgtttgaat

SEQ ID NO: 294754 - DNA, 20 bp, Artificial Sequence
  Description of Artificial Sequence: Synthetic oligonucleotide
  Target: ATXN1; (+) strand; PAM type: YTN; PAM sequence: TTA
tagtttagagtgtttgaatt

SEQ ID NO: 294755 - DNA, 20 bp, Artificial Sequence
  Description of Artificial Sequence: Synthetic oligonucleotide
  Target: ATXN1; (+) strand; PAM type: YTN; PAM sequence: TTT
agagtgtttgaattccaacc

SEQ ID NO: 294756 - DNA, 20 bp, Artificial Sequence
  Description of Artificial Sequence: Synthetic oligonucleotide
  Target: ATXN1; (+) strand; PAM type: YTN; PAM sequence: TTA
gagtgtttgaattccaaccc

SEQ ID NO: 294757 - DNA, 20 bp, Artificial Sequence
  Description of Artificial Sequence: Synthetic oligonucleotide
  Target: ATXN1; (+) strand; PAM type: YTN; PAM sequence: TTT
gaattccaacccccagacta

SEQ ID NO: 294758 - DNA, 20 bp, Artificial Sequence
  Description of Artificial Sequence: Synthetic oligonucleotide
  Target: ATXN1; (+) strand; PAM type: YTN; PAM sequence: TTG
aattccaacccccagactaa

SEQ ID NO: 294759 - DNA, 20 bp, Artificial Sequence
  Description of Artificial Sequence: Synthetic oligonucleotide
  Target: ATXN1; (+) strand; PAM type: YTN; PAM sequence: TTC
caacccccagactaagactg

SEQ ID NO: 294760 - DNA, 20 bp, Artificial Sequence
  Description of Artificial Sequence: Synthetic oligonucleotide
  Target: ATXN1; (+) strand; PAM type: YTN; PAM sequence: CTA
agactgtcattcaagggccc

SEQ ID NO: 294761 - DNA, 20 bp, Artificial Sequence
  Description of Artificial Sequence: Synthetic oligonucleotide
  Target: ATXN1; (+) strand; PAM type: YTN; PAM sequence: CTG
tcattcaagggcccatgtat

SEQ ID NO: 294762 - DNA, 20 bp, Artificial Sequence
  Description of Artificial Sequence: Synthetic oligonucleotide
  Target: ATXN1; (+) strand; PAM type: YTN; PAM sequence: TTC
aagggcccatgtatacttaa

SEQ ID NO: 294763 - DNA, 20 bp, Artificial Sequence
  Description of Artificial Sequence: Synthetic oligonucleotide
  Target: ATXN1; (+) strand; PAM type: YTN; PAM sequence: CTT
aaaagttactcagtaaatgt

SEQ ID NO: 294764 - DNA, 20 bp, Artificial Sequence
  Description of Artificial Sequence: Synthetic oligonucleotide
  Target: ATXN1; (+) strand; PAM type: YTN; PAM sequence: TTA
aaagttactcagtaaatgtt

SEQ ID NO: 294765 - DNA, 20 bp, Artificial Sequence
  Description of Artificial Sequence: Synthetic oligonucleotide
  Target: ATXN1; (+) strand; PAM type: YTN; PAM sequence: TTA
ctcagtaaatgtttgctgaa

SEQ ID NO: 294766 - DNA, 20 bp, Artificial Sequence
  Description of Artificial Sequence: Synthetic oligonucleotide
  Target: ATXN1; (+) strand; PAM type: YTN; PAM sequence: CTC
agtaaatgtttgctgaacag

SEQ ID NO: 294767 - DNA, 20 bp, Artificial Sequence
  Description of Artificial Sequence: Synthetic oligonucleotide
  Target: ATXN1; (+) strand; PAM type: YTN; PAM sequence: TTT
gctgaacaggacttggaaac

SEQ ID NO: 294768 - DNA, 20 bp, Artificial Sequence
  Description of Artificial Sequence: Synthetic oligonucleotide
  Target: ATXN1; (+) strand; PAM type: YTN; PAM sequence: TTG
ctgaacaggacttggaaacc

SEQ ID NO: 294769 - DNA, 20 bp, Artificial Sequence
  Description of Artificial Sequence: Synthetic oligonucleotide
  Target: ATXN1; (+) strand; PAM type: YTN; PAM sequence: CTG
aacaggacttggaaaccccc

SEQ ID NO: 294770 - DNA, 20 bp, Artificial Sequence
  Description of Artificial Sequence: Synthetic oligonucleotide
  Target: ATXN1; (+) strand; PAM type: YTN; PAM sequence: CTT
ggaaacccccatcatctttc

SEQ ID NO: 294771 - DNA, 20 bp, Artificial Sequence
  Description of Artificial Sequence: Synthetic oligonucleotide
  Target: ATXN1; (+) strand; PAM type: YTN; PAM sequence: TTG
gaaacccccatcatctttca

SEQ ID NO: 294772 - DNA, 20 bp, Artificial Sequence
  Description of Artificial Sequence: Synthetic oligonucleotide
  Target: ATXN1; (+) strand; PAM type: YTN; PAM sequence: CTT
tcaccttgcccatcacaata

SEQ ID NO: 294773 - DNA, 20 bp, Artificial Sequence
  Description of Artificial Sequence: Synthetic oligonucleotide
  Target: ATXN1; (+) strand; PAM type: YTN; PAM sequence: TTT
caccttgcccatcacaatag

SEQ ID NO: 294774 - DNA, 20 bp, Artificial Sequence
  Description of Artificial Sequence: Synthetic oligonucleotide
  Target: ATXN1; (+) strand; PAM type: YTN; PAM sequence: TTC
accttgcccatcacaatagt

SEQ ID NO: 294775 - DNA, 20 bp, Artificial Sequence
  Description of Artificial Sequence: Synthetic oligonucleotide
  Target: ATXN1; (+) strand; PAM type: YTN; PAM sequence: CTT
gcccatcacaatagtcatgc

SEQ ID NO: 294776 - DNA, 20 bp, Artificial Sequence
  Description of Artificial Sequence: Synthetic oligonucleotide
  Target: ATXN1; (+) strand; PAM type: YTN; PAM sequence: TTG
cccatcacaatagtcatgca

SEQ ID NO: 294777 - DNA, 20 bp, Artificial Sequence
  Description of Artificial Sequence: Synthetic oligonucleotide
  Target: ATXN1; (+) strand; PAM type: YTN; PAM sequence: TTT
aatgacagggatatgctctg

SEQ ID NO: 294778 - DNA, 20 bp, Artificial Sequence
  Description of Artificial Sequence: Synthetic oligonucleotide
  Target: ATXN1; (+) strand; PAM type: YTN; PAM sequence: TTA
atgacagggatatgctctga

SEQ ID NO: 294779 - DNA, 20 bp, Artificial Sequence
  Description of Artificial Sequence: Synthetic oligonucleotide
  Target: ATXN1; (+) strand; PAM type: YTN; PAM sequence: CTC
tgagaaatgcattgttaggt

SEQ ID NO: 294780 - DNA, 20 bp, Artificial Sequence
  Description of Artificial Sequence: Synthetic oligonucleotide
  Target: ATXN1; (+) strand; PAM type: YTN; PAM sequence: CTG
agaaatgcattgttaggtga

SEQ ID NO: 294781 - DNA, 20 bp, Artificial Sequence
  Description of Artificial Sequence: Synthetic oligonucleotide
  Target: ATXN1; (+) strand; PAM type: YTN; PAM sequence: TTG
ttaggtgactttgtcactgt

SEQ ID NO: 294782 - DNA, 20 bp, Artificial Sequence
  Description of Artificial Sequence: Synthetic oligonucleotide
  Target: ATXN1; (+) strand; PAM type: YTN; PAM sequence: TTA
ggtgactttgtcactgtgca

SEQ ID NO: 294783 - DNA, 20 bp, Artificial Sequence
  Description of Artificial Sequence: Synthetic oligonucleotide
  Target: ATXN1; (+) strand; PAM type: YTN; PAM sequence: CTT
tgtcactgtgcaacatcaca

SEQ ID NO: 294784 - DNA, 20 bp, Artificial Sequence
  Description of Artificial Sequence: Synthetic oligonucleotide
  Target: ATXN1; (+) strand; PAM type: YTN; PAM sequence: TTT
gtcactgtgcaacatcacag

SEQ ID NO: 294785 - DNA, 20 bp, Artificial Sequence
  Description of Artificial Sequence: Synthetic oligonucleotide
  Target: ATXN1; (+) strand; PAM type: YTN; PAM sequence: TTG
tcactgtgcaacatcacaga

SEQ ID NO: 294786 - DNA, 20 bp, Artificial Sequence
  Description of Artificial Sequence: Synthetic oligonucleotide
  Target: ATXN1; (+) strand; PAM type: YTN; PAM sequence: CTG
tgcaacatcacagagtactt

SEQ ID NO: 294787 - DNA, 20 bp, Artificial Sequence
  Description of Artificial Sequence: Synthetic oligonucleotide
  Target: ATXN1; (+) strand; PAM type: YTN; PAM sequence: CTT
tcacaggcctggatggtaca

SEQ ID NO: 294788 - DNA, 20 bp, Artificial Sequence
  Description of Artificial Sequence: Synthetic oligonucleotide
  Target: ATXN1; (+) strand; PAM type: YTN; PAM sequence: TTT
cacaggcctggatggtacac

SEQ ID NO: 294789 - DNA, 20 bp, Artificial Sequence
  Description of Artificial Sequence: Synthetic oligonucleotide
  Target: ATXN1; (+) strand; PAM type: YTN; PAM sequence: TTC
acaggcctggatggtacacc

SEQ ID NO: 294790 - DNA, 20 bp, Artificial Sequence
  Description of Artificial Sequence: Synthetic oligonucleotide
  Target: ATXN1; (+) strand; PAM type: YTN; PAM sequence: CTG
gatggtacaccctactacac

SEQ ID NO: 294791 - DNA, 20 bp, Artificial Sequence
  Description of Artificial Sequence: Synthetic oligonucleotide
  Target: ATXN1; (+) strand; PAM type: YTN; PAM sequence: CTA
ctacacgcctgcgctatacg

SEQ ID NO: 294792 - DNA, 20 bp, Artificial Sequence
  Description of Artificial Sequence: Synthetic oligonucleotide
  Target: ATXN1; (+) strand; PAM type: YTN; PAM sequence: CTA
cacgcctgcgctatacggta

SEQ ID NO: 294793 - DNA, 20 bp, Artificial Sequence
  Description of Artificial Sequence: Synthetic oligonucleotide
  Target: ATXN1; (+) strand; PAM type: YTN; PAM sequence: CTG
cgctatacggtatagcttat

SEQ ID NO: 294794 - DNA, 20 bp, Artificial Sequence
  Description of Artificial Sequence: Synthetic oligonucleotide
  Target: ATXN1; (+) strand; PAM type: YTN; PAM sequence: CTA
tacggtatagcttattgctc

SEQ ID NO: 294795 - DNA, 20 bp, Artificial Sequence
  Description of Artificial Sequence: Synthetic oligonucleotide
  Target: ATXN1; (+) strand; PAM type: YTN; PAM sequence: CTT
attgctcctaggctacaaac

SEQ ID NO: 294796 - DNA, 20 bp, Artificial Sequence
  Description of Artificial Sequence: Synthetic oligonucleotide
  Target: ATXN1; (+) strand; PAM type: YTN; PAM sequence: TTA
ttgctcctaggctacaaacc

SEQ ID NO: 294797 - DNA, 20 bp, Artificial Sequence
  Description of Artificial Sequence: Synthetic oligonucleotide
  Target: ATXN1; (+) strand; PAM type: YTN; PAM sequence: TTG
ctcctaggctacaaacctgg

SEQ ID NO: 294798 - DNA, 20 bp, Artificial Sequence
  Description of Artificial Sequence: Synthetic oligonucleotide
  Target: ATXN1; (+) strand; PAM type: YTN; PAM sequence: CTC
ctaggctacaaacctggacg

SEQ ID NO: 294799 - DNA, 20 bp, Artificial Sequence
  Description of Artificial Sequence: Synthetic oligonucleotide
  Target: ATXN1; (+) strand; PAM type: YTN; PAM sequence: CTA
ggctacaaacctggacggca

SEQ ID NO: 294800 - DNA, 20 bp, Artificial Sequence
  Description of Artificial Sequence: Synthetic oligonucleotide
  Target: ATXN1; (+) strand; PAM type: YTN; PAM sequence: CTA
caaacctggacggcatgcta

SEQ ID NO: 294801 - DNA, 20 bp, Artificial Sequence
  Description of Artificial Sequence: Synthetic oligonucleotide
  Target: ATXN1; (+) strand; PAM type: YTN; PAM sequence: CTG
gacggcatgctactgtagtg

SEQ ID NO: 294802 - DNA, 20 bp, Artificial Sequence
  Description of Artificial Sequence: Synthetic oligonucleotide
  Target: ATXN1; (+) strand; PAM type: YTN; PAM sequence: CTA
ctgtagtgaatactgtaggc

SEQ ID NO: 294803 - DNA, 20 bp, Artificial Sequence
  Description of Artificial Sequence: Synthetic oligonucleotide
  Target: ATXN1; (+) strand; PAM type: YTN; PAM sequence: CTG
tagtgaatactgtaggcaac

SEQ ID NO: 294804 - DNA, 20 bp, Artificial Sequence
  Description of Artificial Sequence: Synthetic oligonucleotide
  Target: ATXN1; (+) strand; PAM type: YTN; PAM sequence: CTG
taggcaactgtaacacaatg

SEQ ID NO: 294805 - DNA, 20 bp, Artificial Sequence
  Description of Artificial Sequence: Synthetic oligonucleotide
  Target: ATXN1; (+) strand; PAM type: YTN; PAM sequence: CTG
taacacaatggtaggcattt

SEQ ID NO: 294806 - DNA, 20 bp, Artificial Sequence
  Description of Artificial Sequence: Synthetic oligonucleotide
  Target: ATXN1; (+) strand; PAM type: YTN; PAM sequence: TTT
gtgcctctaaacacatctaa

SEQ ID NO: 294807 - DNA, 20 bp, Artificial Sequence
  Description of Artificial Sequence: Synthetic oligonucleotide
  Target: ATXN1; (+) strand; PAM type: YTN; PAM sequence: TTG
tgcctctaaacacatctaaa

SEQ ID NO: 294808 - DNA, 20 bp, Artificial Sequence
  Description of Artificial Sequence: Synthetic oligonucleotide
  Target: ATXN1; (+) strand; PAM type: YTN; PAM sequence: CTC
taaacacatctaaacataga

SEQ ID NO: 294809 - DNA, 20 bp, Artificial Sequence
  Description of Artificial Sequence: Synthetic oligonucleotide
  Target: ATXN1; (+) strand; PAM type: YTN; PAM sequence: CTA
aacacatctaaacatagaaa

SEQ ID NO: 294810 - DNA, 20 bp, Artificial Sequence
  Description of Artificial Sequence: Synthetic oligonucleotide
  Target: ATXN1; (+) strand; PAM type: YTN; PAM sequence: CTA
aacatagaaaaggtacaacc

SEQ ID NO: 294811 - DNA, 20 bp, Artificial Sequence
  Description of Artificial Sequence: Synthetic oligonucleotide
  Target: ATXN1; (+) strand; PAM type: YTN; PAM sequence: TTA
taatcttttttttttttttt

SEQ ID NO: 294812 - DNA, 20 bp, Artificial Sequence
  Description of Artificial Sequence: Synthetic oligonucleotide
  Target: ATXN1; (+) strand; PAM type: YTN; PAM sequence: CTT
ttttttttttttttttttga

SEQ ID NO: 294813 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttgag

SEQ ID NO: 294814 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttgaga

SEQ ID NO: 294815 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttgagat

SEQ ID NO: 294816 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttgagatg

SEQ ID NO: 294817 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgagatgg

SEQ ID NO: 294818 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgagatgga

SEQ ID NO: 294819 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgagatggag

SEQ ID NO: 294820 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgagatggagt

SEQ ID NO: 294821 - DNA, 20 bp, Artificial Sequence
  Description of Artificial Sequence: Synthetic oligonucleotide
  Target: ATXN1; (+) strand; PAM type: YTN; PAM sequence: TTT
tttttttttgagatggagtc

SEQ ID NO: 294822 - DNA, 20 bp, Artificial Sequence
  Description of Artificial Sequence: Synthetic oligonucleotide
  Target: ATXN1; (+) strand; PAM type: YTN; PAM sequence: TTT
ttttttttgagatggagtct

SEQ ID NO: 294823 - DNA, 20 bp, Artificial Sequence
  Description of Artificial Sequence: Synthetic oligonucleotide
  Target: ATXN1; (+) strand; PAM type: YTN; PAM sequence: TTT
tttttttgagatggagtctc

SEQ ID NO: 294824 - DNA, 20 bp, Artificial Sequence
  Description of Artificial Sequence: Synthetic oligonucleotide
  Target: ATXN1; (+) strand; PAM type: YTN; PAM sequence: TTT
ttttttgagatggagtctcg

SEQ ID NO: 294825 - DNA, 20 bp, Artificial Sequence
  Description of Artificial Sequence: Synthetic oligonucleotide
  Target: ATXN1; (+) strand; PAM type: YTN; PAM sequence: TTT
tttttgagatggagtctcgc

SEQ ID NO: 294826 - DNA, 20 bp, Artificial Sequence
  Description of Artificial Sequence: Synthetic oligonucleotide
  Target: ATXN1; (+) strand; PAM type: YTN; PAM sequence: TTT
ttttgagatggagtctcgct

SEQ ID NO: 294827 - DNA, 20 bp, Artificial Sequence
  Description of Artificial Sequence: Synthetic oligonucleotide
  Target: ATXN1; (+) strand; PAM type: YTN; PAM sequence: TTT
tttgagatggagtctcgctc

SEQ ID NO: 294828 - DNA, 20 bp, Artificial Sequence
  Description of Artificial Sequence: Synthetic oligonucleotide
  Target: ATXN1; (+) strand; PAM type: YTN; PAM sequence: TTT
ttgagatggagtctcgctct

SEQ ID NO: 294829 - DNA, 20 bp, Artificial Sequence
  Description of Artificial Sequence: Synthetic oligonucleotide
  Target: ATXN1; (+) strand; PAM type: YTN; PAM sequence: TTT
tgagatggagtctcgctctg

SEQ ID NO: 294830 - DNA, 20 bp, Artificial Sequence
  Description of Artificial Sequence: Synthetic oligonucleotide
  Target: ATXN1; (+) strand; PAM type: YTN; PAM sequence: TTT
gagatggagtctcgctctgt

SEQ ID NO: 294831 - DNA, 20 bp, Artificial Sequence
  Description of Artificial Sequence: Synthetic oligonucleotide
  Target: ATXN1; (+) strand; PAM type: YTN; PAM sequence: TTG
agatggagtctcgctctgtc

SEQ ID NO: 294832 - DNA, 20 bp, Artificial Sequence
  Description of Artificial Sequence: Synthetic oligonucleotide
  Target: ATXN1; (+) strand; PAM type: YTN; PAM sequence: CTC
gctctgtcgcccaggctgga

SEQ ID NO: 294833 - DNA, 20 bp, Artificial Sequence
  Description of Artificial Sequence: Synthetic oligonucleotide
  Target: ATXN1; (+) strand; PAM type: YTN; PAM sequence: CTC
tgtcgcccaggctggagtgc

SEQ ID NO: 294834 - DNA, 20 bp, Artificial Sequence
  Description of Artificial Sequence: Synthetic oligonucleotide
  Target: ATXN1; (+) strand; PAM type: YTN; PAM sequence: CTG
tcgcccaggctggagtgcag

SEQ ID NO: 294835 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggtgcaatctc

SEQ ID NO: 294836 - DNA, 20 bp, Artificial Sequence
  Description of Artificial Sequence: Synthetic oligonucleotide
  Target: ATXN1; (+) strand; PAM type: YTN; PAM sequence: CTC
ggctcactgcaagctctgcc

SEQ ID NO: 294837 - DNA, 20 bp, Artificial Sequence
  Description of Artificial Sequence: Synthetic oligonucleotide
  Target: ATXN1; (+) strand; PAM type: YTN; PAM sequence: CTC
actgcaagctctgcctccca

SEQ ID NO: 294838 - DNA, 20 bp, Artificial Sequence
  Description of Artificial Sequence: Synthetic oligonucleotide
  Target: ATXN1; (+) strand; PAM type: YTN; PAM sequence: CTG
caagctctgcctcccaggtt

SEQ ID NO: 294839 - DNA, 20 bp, Artificial Sequence
  Description of Artificial Sequence: Synthetic oligonucleotide
  Target: ATXN1; (+) strand; PAM type: YTN; PAM sequence: CTC
tgcctcccaggttcacgcca

SEQ ID NO: 294840 - DNA, 20 bp, Artificial Sequence
  Description of Artificial Sequence: Synthetic oligonucleotide
  Target: ATXN1; (+) strand; PAM type: YTN; PAM sequence: CTG
cctcccaggttcacgccatt

SEQ ID NO: 294841 - DNA, 20 bp, Artificial Sequence
  Description of Artificial Sequence: Synthetic oligonucleotide
  Target: ATXN1; (+) strand; PAM type: YTN; PAM sequence: CTC
ccaggttcacgccattctgc

SEQ ID NO: 294842 - DNA, 20 bp, Artificial Sequence
  Description of Artificial Sequence: Synthetic oligonucleotide
  Target: ATXN1; (+) strand; PAM type: YTN; PAM sequence: TTC
acgccattctgctgcctcag

SEQ ID NO: 294843 - DNA, 20 bp, Artificial Sequence
  Description of Artificial Sequence: Synthetic oligonucleotide
  Target: ATXN1; (+) strand; PAM type: YTN; PAM sequence: TTC
tgctgcctcagcctcccaag

SEQ ID NO: 294844 - DNA, 20 bp, Artificial Sequence
  Description of Artificial Sequence: Synthetic oligonucleotide
  Target: ATXN1; (+) strand; PAM type: YTN; PAM sequence: CTG
ctgcctcagcctcccaagta

SEQ ID NO: 294845 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaagtagct

SEQ ID NO: 294846 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagtagctggga

SEQ ID NO: 294847 - DNA, 20 bp, Artificial Sequence
  Description of Artificial Sequence: Synthetic oligonucleotide
  Target: ATXN1; (+) strand; PAM type: YTN; PAM sequence: CTC
ccaagtagctgggactacaa

SEQ ID NO: 294848 - DNA, 20 bp, Artificial Sequence
  Description of Artificial Sequence: Synthetic oligonucleotide
  Target: ATXN1; (+) strand; PAM type: YTN; PAM sequence: CTG
ggactacaagcgcccgccac

SEQ ID NO: 294849 - DNA, 20 bp, Artificial Sequence
  Description of Artificial Sequence: Synthetic oligonucleotide
  Target: ATXN1; (+) strand; PAM type: YTN; PAM sequence: CTA
caagcgcccgccactacacc

SEQ ID NO: 294850 - DNA, 20 bp, Artificial Sequence
  Description of Artificial Sequence: Synthetic oligonucleotide
  Target: ATXN1; (+) strand; PAM type: YTN; PAM sequence: CTA
cacccggctaattttttttt

SEQ ID NO: 294851 - DNA, 20 bp, Artificial Sequence
  Description of Artificial Sequence: Synthetic oligonucleotide
  Target: ATXN1; (+) strand; PAM type: YTN; PAM sequence: CTA
attttttttttgtattctta

SEQ ID NO: 294852 - DNA, 20 bp, Artificial Sequence
  Description of Artificial Sequence: Synthetic oligonucleotide
  Target: ATXN1; (+) strand; PAM type: YTN; PAM sequence: TTT
tttttttgtattcttagtag

SEQ ID NO: 294853 - DNA, 20 bp, Artificial Sequence
  Description of Artificial Sequence: Synthetic oligonucleotide
  Target: ATXN1; (+) strand; PAM type: YTN; PAM sequence: TTT
ttttttgtattcttagtaga

SEQ ID NO: 294854 - DNA, 20 bp, Artificial Sequence
  Description of Artificial Sequence: Synthetic oligonucleotide
  Target: ATXN1; (+) strand; PAM type: YTN; PAM sequence: TTT
tttttgtattcttagtagag

SEQ ID NO: 294855 - DNA, 20 bp, Artificial Sequence
  Description of Artificial Sequence: Synthetic oligonucleotide
  Target: ATXN1; (+) strand; PAM type: YTN; PAM sequence: TTT
ttttgtattcttagtagaga

SEQ ID NO: 294856 - DNA, 20 bp, Artificial Sequence
  Description of Artificial Sequence: Synthetic oligonucleotide
  Target: ATXN1; (+) strand; PAM type: YTN; PAM sequence: TTT
tttgtattcttagtagagac

SEQ ID NO: 294857 - DNA, 20 bp, Artificial Sequence
  Description of Artificial Sequence: Synthetic oligonucleotide
  Target: ATXN1; (+) strand; PAM type: YTN; PAM sequence: TTT
ttgtattcttagtagagaca

SEQ ID NO: 294858 - DNA, 20 bp, Artificial Sequence
  Description of Artificial Sequence: Synthetic oligonucleotide
  Target: ATXN1; (+) strand; PAM type: YTN; PAM sequence: TTT
tgtattcttagtagagacag

SEQ ID NO: 294859 - DNA, 20 bp, Artificial Sequence
  Description of Artificial Sequence: Synthetic oligonucleotide
  Target: ATXN1; (+) strand; PAM type: YTN; PAM sequence: TTT
gtattcttagtagagacagg

SEQ ID NO: 294860 - DNA, 20 bp, Artificial Sequence
  Description of Artificial Sequence: Synthetic oligonucleotide
  Target: ATXN1; (+) strand; PAM type: YTN; PAM sequence: TTG
tattcttagtagagacaggg

SEQ ID NO: 294861 - DNA, 20 bp, Artificial Sequence
  Description of Artificial Sequence: Synthetic oligonucleotide
  Target: ATXN1; (+) strand; PAM type: YTN; PAM sequence: TTC
ttagtagagacagggtttca

SEQ ID NO: 294862 - DNA, 20 bp, Artificial Sequence
  Description of Artificial Sequence: Synthetic oligonucleotide
  Target: ATXN1; (+) strand; PAM type: YTN; PAM sequence: CTT
agtagagacagggtttcacc

SEQ ID NO: 294863 - DNA, 20 bp, Artificial Sequence
  Description of Artificial Sequence: Synthetic oligonucleotide
  Target: ATXN1; (+) strand; PAM type: YTN; PAM sequence: TTA
gtagagacagggtttcaccg

SEQ ID NO: 294864 - DNA, 20 bp, Artificial Sequence
  Description of Artificial Sequence: Synthetic oligonucleotide
  Target: ATXN1; (+) strand; PAM type: YTN; PAM sequence: TTT
caccgcgttagccaggatga

SEQ ID NO: 294865 - DNA, 20 bp, Artificial Sequence
  Description of Artificial Sequence: Synthetic oligonucleotide
  Target: ATXN1; (+) strand; PAM type: YTN; PAM sequence: TTC
accgcgttagccaggatgat

SEQ ID NO: 294866 - DNA, 20 bp, Artificial Sequence
  Description of Artificial Sequence: Synthetic oligonucleotide
  Target: ATXN1; (+) strand; PAM type: YTN; PAM sequence: TTA
gccaggatgatctcaatctc

SEQ ID NO: 294867 - DNA, 20 bp, Artificial Sequence
  Description of Artificial Sequence: Synthetic oligonucleotide
  Target: ATXN1; (+) strand; PAM type: YTN; PAM sequence: CTC
aatctcctgacctcgtgatc

SEQ ID NO: 294868 - DNA, 20 bp, Artificial Sequence
  Description of Artificial Sequence: Synthetic oligonucleotide
  Target: ATXN1; (+) strand; PAM type: YTN; PAM sequence: CTC
ctgacctcgtgatccgcgcg

SEQ ID NO: 294869 - DNA, 20 bp, Artificial Sequence
  Description of Artificial Sequence: Synthetic oligonucleotide
  Target: ATXN1; (+) strand; PAM type: YTN; PAM sequence: CTG
acctcgtgatccgcgcgcct

SEQ ID NO: 294870 - DNA, 20 bp, Artificial Sequence
  Description of Artificial Sequence: Synthetic oligonucleotide
  Target: ATXN1; (+) strand; PAM type: YTN; PAM sequence: CTC
gtgatccgcgcgcctcggcc

SEQ ID NO: 294871 - DNA, 20 bp, Artificial Sequence
  Description of Artificial Sequence: Synthetic oligonucleotide
  Target: ATXN1; (+) strand; PAM type: YTN; PAM sequence: CTC
ggcctcccaaagtgctggga

SEQ ID NO: 294872 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattacag

SEQ ID NO: 294873 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcgtgagccac

SEQ ID NO: 294874 - DNA, 20 bp, Artificial Sequence
  Description of Artificial Sequence: Synthetic oligonucleotide
  Target: ATXN1; (+) strand; PAM type: YTN; PAM sequence: TTA
caggcgtgagccaccacacc

SEQ ID NO: 294875 - DNA, 20 bp, Artificial Sequence
  Description of Artificial Sequence: Synthetic oligonucleotide
  Target: ATXN1; (+) strand; PAM type: YTN; PAM sequence: TTA
taatcttatgggaccactgt

SEQ ID NO: 294876 - DNA, 20 bp, Artificial Sequence
  Description of Artificial Sequence: Synthetic oligonucleotide
  Target: ATXN1; (+) strand; PAM type: YTN; PAM sequence: CTT
atgggaccactgtaatacgt

SEQ ID NO: 294877 - DNA, 20 bp, Artificial Sequence
  Description of Artificial Sequence: Synthetic oligonucleotide
  Target: ATXN1; (+) strand; PAM type: YTN; PAM sequence: TTA
tgggaccactgtaatacgtg

SEQ ID NO: 294878 - DNA, 20 bp, Artificial Sequence
  Description of Artificial Sequence: Synthetic oligonucleotide
  Target: ATXN1; (+) strand; PAM type: YTN; PAM sequence: CTG
taatacgtgtgatctgtcgt

SEQ ID NO: 294879 - DNA, 20 bp, Artificial Sequence
  Description of Artificial Sequence: Synthetic oligonucleotide
  Target: ATXN1; (+) strand; PAM type: YTN; PAM sequence: CTG
tcgttgactgaaacttcatt

SEQ ID NO: 294880 - DNA, 20 bp, Artificial Sequence
  Description of Artificial Sequence: Synthetic oligonucleotide
  Target: ATXN1; (+) strand; PAM type: YTN; PAM sequence: TTG
actgaaacttcattatgtgg

SEQ ID NO: 294881 - DNA, 20 bp, Artificial Sequence
  Description of Artificial Sequence: Synthetic oligonucleotide
  Target: ATXN1; (+) strand; PAM type: YTN; PAM sequence: CTG
aaacttcattatgtggcaca

SEQ ID NO: 294882 - DNA, 20 bp, Artificial Sequence
  Description of Artificial Sequence: Synthetic oligonucleotide
  Target: ATXN1; (+) strand; PAM type: YTN; PAM sequence: CTT
cattatgtggcacatgactg

SEQ ID NO: 294883 - DNA, 20 bp, Artificial Sequence
  Description of Artificial Sequence: Synthetic oligonucleotide
  Target: ATXN1; (+) strand; PAM type: YTN; PAM sequence: TTC
attatgtggcacatgactgt

SEQ ID NO: 294884 - DNA, 20 bp, Artificial Sequence
  Description of Artificial Sequence: Synthetic oligonucleotide
  Target: ATXN1; (+) strand; PAM type: YTN; PAM sequence: TTA
tgtggcacatgactgtattt

SEQ ID NO: 294885 - DNA, 20 bp, Artificial Sequence
  Description of Artificial Sequence: Synthetic oligonucleotide
  Target: ATXN1; (+) strand; PAM type: YTN; PAM sequence: CTG
tatttgatcacaagacgcaa

SEQ ID NO: 294886 - DNA, 20 bp, Artificial Sequence
  Description of Artificial Sequence: Synthetic oligonucleotide
  Target: ATXN1; (+) strand; PAM type: YTN; PAM sequence: TTT
gatcacaagacgcaaaaaac

SEQ ID NO: 294887 - DNA, 20 bp, Artificial Sequence
  Description of Artificial Sequence: Synthetic oligonucleotide
  Target: ATXN1; (+) strand; PAM type: YTN; PAM sequence: TTG
atcacaagacgcaaaaaact

SEQ ID NO: 294888 - DNA, 20 bp, Artificial Sequence
  Description of Artificial Sequence: Synthetic oligonucleotide
  Target: ATXN1; (+) strand; PAM type: YTN; PAM sequence: CTT
gccattaaattgaatctact

SEQ ID NO: 294889 - DNA, 20 bp, Artificial Sequence
  Description of Artificial Sequence: Synthetic oligonucleotide
  Target: ATXN1; (+) strand; PAM type: YTN; PAM sequence: TTG
ccattaaattgaatctactt

SEQ ID NO: 294890 - DNA, 20 bp, Artificial Sequence
  Description of Artificial Sequence: Synthetic oligonucleotide
  Target: ATXN1; (+) strand; PAM type: YTN; PAM sequence: TTA
aattgaatctacttcctctc

SEQ ID NO: 294891 - DNA, 20 bp, Artificial Sequence
  Description of Artificial Sequence: Synthetic oligonucleotide
  Target: ATXN1; (+) strand; PAM type: YTN; PAM sequence: TTG
aatctacttcctctcgtgcg

SEQ ID NO: 294892 - DNA, 20 bp, Artificial Sequence
  Description of Artificial Sequence: Synthetic oligonucleotide
  Target: ATXN1; (+) strand; PAM type: YTN; PAM sequence: CTA
cttcctctcgtgcgattaat

SEQ ID NO: 294893 - DNA, 20 bp, Artificial Sequence
  Description of Artificial Sequence: Synthetic oligonucleotide
  Target: ATXN1; (+) strand; PAM type: YTN; PAM sequence: CTT
cctctcgtgcgattaatccc

SEQ ID NO: 294894 - DNA, 20 bp, Artificial Sequence
  Description of Artificial Sequence: Synthetic oligonucleotide
  Target: ATXN1; (+) strand; PAM type: YTN; PAM sequence: TTC
ctctcgtgcgattaatccct

SEQ ID NO: 294895 - DNA, 20 bp, Artificial Sequence
  Description of Artificial Sequence: Synthetic oligonucleotide
  Target: ATXN1; (+) strand; PAM type: YTN; PAM sequence: CTC
tcgtgcgattaatcccttat

SEQ ID NO: 294896 - DNA, 20 bp, Artificial Sequence
  Description of Artificial Sequence: Synthetic oligonucleotide
  Target: ATXN1; (+) strand; PAM type: YTN; PAM sequence: CTC
gtgcgattaatcccttatgt

SEQ ID NO: 294897 - DNA, 20 bp, Artificial Sequence
  Description of Artificial Sequence: Synthetic oligonucleotide
  Target: ATXN1; (+) strand; PAM type: YTN; PAM sequence: TTA
atcccttatgttttcagcta

SEQ ID NO: 294898 - DNA, 20 bp, Artificial Sequence
  Description of Artificial Sequence: Synthetic oligonucleotide
  Target: ATXN1; (+) strand; PAM type: YTN; PAM sequence: CTT
atgttttcagctaaaatgga

SEQ ID NO: 294899 - DNA, 20 bp, Artificial Sequence
  Description of Artificial Sequence: Synthetic oligonucleotide
  Target: ATXN1; (+) strand; PAM type: YTN; PAM sequence: TTA
tgttttcagctaaaatggag

SEQ ID NO: 294900 - DNA, 20 bp, Artificial Sequence
  Description of Artificial Sequence: Synthetic oligonucleotide
  Target: ATXN1; (+) strand; PAM type: YTN; PAM sequence: TTT
tcagctaaaatggagtatct

SEQ ID NO: 294901 - DNA, 20 bp, Artificial Sequence
  Description of Artificial Sequence: Synthetic oligonucleotide
  Target: ATXN1; (+) strand; PAM type: YTN; PAM sequence: TTT
cagctaaaatggagtatctg

SEQ ID NO: 294902 - DNA, 20 bp, Artificial Sequence
  Description of Artificial Sequence: Synthetic oligonucleotide
  Target: ATXN1; (+) strand; PAM type: YTN; PAM sequence: TTC
agctaaaatggagtatctgg

SEQ ID NO: 294903 - DNA, 20 bp, Artificial Sequence
  Description of Artificial Sequence: Synthetic oligonucleotide
  Target: ATXN1; (+) strand; PAM type: YTN; PAM sequence: CTA
aaatggagtatctggtagat

SEQ ID NO: 294904 - DNA, 20 bp, Artificial Sequence
  Description of Artificial Sequence: Synthetic oligonucleotide
  Target: ATXN1; (+) strand; PAM type: YTN; PAM sequence: CTG
gtagatgtagtttatttgct

SEQ ID NO: 294905 - DNA, 20 bp, Artificial Sequence
  Description of Artificial Sequence: Synthetic oligonucleotide
  Target: ATXN1; (+) strand; PAM type: YTN; PAM sequence: TTT
atttgctgtttgtgtgttta

SEQ ID NO: 294906 - DNA, 20 bp, Artificial Sequence
  Description of Artificial Sequence: Synthetic oligonucleotide
  Target: ATXN1; (+) strand; PAM type: YTN; PAM sequence: TTA
tttgctgtttgtgtgtttag

SEQ ID NO: 294907 - DNA, 20 bp, Artificial Sequence
  Description of Artificial Sequence: Synthetic oligonucleotide
  Target: ATXN1; (+) strand; PAM type: YTN; PAM sequence: TTT
gctgtttgtgtgtttagttg

SEQ ID NO: 294908 - DNA, 20 bp, Artificial Sequence
  Description of Artificial Sequence: Synthetic oligonucleotide
  Target: ATXN1; (+) strand; PAM type: YTN; PAM sequence: TTG
ctgtttgtgtgtttagttgt

SEQ ID NO: 294909 - DNA, 20 bp, Artificial Sequence
  Description of Artificial Sequence: Synthetic oligonucleotide
  Target: ATXN1; (+) strand; PAM type: YTN; PAM sequence: CTG
tttgtgtgtttagttgtttg

SEQ ID NO: 294910 - DNA, 20 bp, Artificial Sequence
  Description of Artificial Sequence: Synthetic oligonucleotide
  Target: ATXN1; (+) strand; PAM type: YTN; PAM sequence: TTT
gtgtgtttagttgtttgggt

SEQ ID NO: 294911 - DNA, 20 bp, Artificial Sequence
  Description of Artificial Sequence: Synthetic oligonucleotide
  Target: ATXN1; (+) strand; PAM type: YTN; PAM sequence: TTG
tgtgtttagttgtttgggtt

SEQ ID NO: 294912 - DNA, 20 bp, Artificial Sequence
  Description of Artificial Sequence: Synthetic oligonucleotide
  Target: ATXN1; (+) strand; PAM type: YTN; PAM sequence: TTT
agttgtttgggtttgctttg

SEQ ID NO: 294913 - DNA, 20 bp, Artificial Sequence
  Description of Artificial Sequence: Synthetic oligonucleotide
  Target: ATXN1; (+) strand; PAM type: YTN; PAM sequence: TTA
gttgtttgggtttgctttgt

SEQ ID NO: 294914 - DNA, 20 bp, Artificial Sequence
  Description of Artificial Sequence: Synthetic oligonucleotide
  Target: ATXN1; (+) strand; PAM type: YTN; PAM sequence: TTG
tttgggtttgctttgttttt

SEQ ID NO: 294915 - DNA, 20 bp, Artificial Sequence
  Description of Artificial Sequence: Synthetic oligonucleotide
  Target: ATXN1; (+) strand; PAM type: YTN; PAM sequence: TTT
gggtttgctttgtttttgct

SEQ ID NO: 294916 - DNA, 20 bp, Artificial Sequence
  Description of Artificial Sequence: Synthetic oligonucleotide
  Target: ATXN1; (+) strand; PAM type: YTN; PAM sequence: TTG
ggtttgctttgtttttgctt

SEQ ID NO: 294917 - DNA, 20 bp, Artificial Sequence
  Description of Artificial Sequence: Synthetic oligonucleotide
  Target: ATXN1; (+) strand; PAM type: YTN; PAM sequence: TTT
gctttgtttttgcttttgtt

SEQ ID NO: 294918 - DNA, 20 bp, Artificial Sequence
  Description of Artificial Sequence: Synthetic oligonucleotide
  Target: ATXN1; (+) strand; PAM type: YTN; PAM sequence: TTG
ctttgtttttgcttttgttc

SEQ ID NO: 294919 - DNA, 20 bp, Artificial Sequence
  Description of Artificial Sequence: Synthetic oligonucleotide
  Target: ATXN1; (+) strand; PAM type: YTN; PAM sequence: CTT
tgtttttgcttttgttcttt

SEQ ID NO: 294920 - DNA, 20 bp, Artificial Sequence
  Description of Artificial Sequence: Synthetic oligonucleotide
  Target: ATXN1; (+) strand; PAM type: YTN; PAM sequence: TTT
gtttttgcttttgttctttt

SEQ ID NO: 294921 - DNA, 20 bp, Artificial Sequence
  Description of Artificial Sequence: Synthetic oligonucleotide
  Target: ATXN1; (+) strand; PAM type: YTN; PAM sequence: TTG
tttttgcttttgttcttttt

SEQ ID NO: 294922 - DNA, 20 bp, Artificial Sequence
  Description of Artificial Sequence: Synthetic oligonucleotide
  Target: ATXN1; (+) strand; PAM type: YTN; PAM sequence: TTT
ttgcttttgttcttttttct

SEQ ID NO: 294923 - DNA, 20 bp, Artificial Sequence
  Description of Artificial Sequence: Synthetic oligonucleotide
  Target: ATXN1; (+) strand; PAM type: YTN; PAM sequence: TTT
tgcttttgttcttttttcta

SEQ ID NO: 294924 - DNA, 20 bp, Artificial Sequence
  Description of Artificial Sequence: Synthetic oligonucleotide
  Target: ATXN1; (+) strand; PAM type: YTN; PAM sequence: TTT
gcttttgttcttttttctaa

SEQ ID NO: 294925 - DNA, 20 bp, Artificial Sequence
  Description of Artificial Sequence: Synthetic oligonucleotide
  Target: ATXN1; (+) strand; PAM type: YTN; PAM sequence: TTG
cttttgttcttttttctaac

SEQ ID NO: 294926 - DNA, 20 bp, Artificial Sequence
  Description of Artificial Sequence: Synthetic oligonucleotide
  Target: ATXN1; (+) strand; PAM type: YTN; PAM sequence: CTT
ttgttcttttttctaaccac

SEQ ID NO: 294927 - DNA, 20 bp, Artificial Sequence
  Description of Artificial Sequence: Synthetic oligonucleotide
  Target: ATXN1; (+) strand; PAM type: YTN; PAM sequence: TTT
tgttcttttttctaaccaca

SEQ ID NO: 294928 - DNA, 20 bp, Artificial Sequence
  Description of Artificial Sequence: Synthetic oligonucleotide
  Target: ATXN1; (+) strand; PAM type: YTN; PAM sequence: TTT
gttcttttttctaaccacaa

SEQ ID NO: 294929 - DNA, 20 bp, Artificial Sequence
  Description of Artificial Sequence: Synthetic oligonucleotide
  Target: ATXN1; (+) strand; PAM type: YTN; PAM sequence: TTG
ttcttttttctaaccacaaa

SEQ ID NO: 294930 - DNA, 20 bp, Artificial Sequence
  Description of Artificial Sequence: Synthetic oligonucleotide
  Target: ATXN1; (+) strand; PAM type: YTN; PAM sequence: TTC
ttttttctaaccacaaatac

SEQ ID NO: 294931 - DNA, 20 bp, Artificial Sequence
  Description of Artificial Sequence: Synthetic oligonucleotide
  Target: ATXN1; (+) strand; PAM type: YTN; PAM sequence: CTT
ttttctaaccacaaatacat

SEQ ID NO: 294932 - DNA, 20 bp, Artificial Sequence
  Description of Artificial Sequence: Synthetic oligonucleotide
  Target: ATXN1; (+) strand; PAM type: YTN; PAM sequence: TTT
tttctaaccacaaatacatt

SEQ ID NO: 294933 - DNA, 20 bp, Artificial Sequence
  Description of Artificial Sequence: Synthetic oligonucleotide
  Target: ATXN1; (+) strand; PAM type: YTN; PAM sequence: TTT
ttctaaccacaaatacattc

SEQ ID NO: 294934 - DNA, 20 bp, Artificial Sequence
  Description of Artificial Sequence: Synthetic oligonucleotide
  Target: ATXN1; (+) strand; PAM type: YTN; PAM sequence: TTT
tctaaccacaaatacattct

SEQ ID NO: 294935 - DNA, 20 bp, Artificial Sequence
  Description of Artificial Sequence: Synthetic oligonucleotide
  Target: ATXN1; (+) strand; PAM type: YTN; PAM sequence: TTT
ctaaccacaaatacattcta

SEQ ID NO: 294936 - DNA, 20 bp, Artificial Sequence
  Description of Artificial Sequence: Synthetic oligonucleotide
  Target: ATXN1; (+) strand; PAM type: YTN; PAM sequence: TTC
taaccacaaatacattctat

SEQ ID NO: 294937 - DNA, 20 bp, Artificial Sequence
  Description of Artificial Sequence: Synthetic oligonucleotide
  Target: ATXN1; (+) strand; PAM type: YTN; PAM sequence: CTA
accacaaatacattctattc

SEQ ID NO: 294938 - DNA, 20 bp, Artificial Sequence
  Description of Artificial Sequence: Synthetic oligonucleotide
  Target: ATXN1; (+) strand; PAM type: YTN; PAM sequence: TTC
tattcagatcatactattct

SEQ ID NO: 294939 - DNA, 20 bp, Artificial Sequence
  Description of Artificial Sequence: Synthetic oligonucleotide
  Target: ATXN1; (+) strand; PAM type: YTN; PAM sequence: CTA
ttcagatcatactattctgc

SEQ ID NO: 294940 - DNA, 20 bp, Artificial Sequence
  Description of Artificial Sequence: Synthetic oligonucleotide
  Target: ATXN1; (+) strand; PAM type: YTN; PAM sequence: TTC
agatcatactattctgcaag

SEQ ID NO: 294941 - DNA, 20 bp, Artificial Sequence
  Description of Artificial Sequence: Synthetic oligonucleotide
  Target: ATXN1; (+) strand; PAM type: YTN; PAM sequence: CTA
ttctgcaagtttcagaaaca

SEQ ID NO: 294942 - DNA, 20 bp, Artificial Sequence
  Description of Artificial Sequence: Synthetic oligonucleotide
  Target: ATXN1; (+) strand; PAM type: YTN; PAM sequence: TTC
tgcaagtttcagaaacaaac

SEQ ID NO: 294943 - DNA, 20 bp, Artificial Sequence
  Description of Artificial Sequence: Synthetic oligonucleotide
  Target: ATXN1; (+) strand; PAM type: YTN; PAM sequence: CTG
caagtttcagaaacaaacac

SEQ ID NO: 294944 - DNA, 20 bp, Artificial Sequence
  Description of Artificial Sequence: Synthetic oligonucleotide
  Target: ATXN1; (+) strand; PAM type: YTN; PAM sequence: TTT
cagaaacaaacacataaagt

SEQ ID NO: 294945 - DNA, 20 bp, Artificial Sequence
  Description of Artificial Sequence: Synthetic oligonucleotide
  Target: ATXN1; (+) strand; PAM type: YTN; PAM sequence: TTC
agaaacaaacacataaagta

SEQ ID NO: 294946 - DNA, 20 bp, Artificial Sequence
  Description of Artificial Sequence: Synthetic oligonucleotide
  Target: ATXN1; (+) strand; PAM type: YTN; PAM sequence: TTG
ctctctcagtgctctgtcac

SEQ ID NO: 294947 - DNA, 20 bp, Artificial Sequence
  Description of Artificial Sequence: Synthetic oligonucleotide
  Target: ATXN1; (+) strand; PAM type: YTN; PAM sequence: CTC
tctcagtgctctgtcactag

SEQ ID NO: 294948 - DNA, 20 bp, Artificial Sequence
  Description of Artificial Sequence: Synthetic oligonucleotide
  Target: ATXN1; (+) strand; PAM type: YTN; PAM sequence: CTC
tcagtgctctgtcactagga

SEQ ID NO: 294949 - DNA, 20 bp, Artificial Sequence
  Description of Artificial Sequence: Synthetic oligonucleotide
  Target: ATXN1; (+) strand; PAM type: YTN; PAM sequence: CTC
agtgctctgtcactaggaca

SEQ ID NO: 294950 - DNA, 20 bp, Artificial Sequence
  Description of Artificial Sequence: Synthetic oligonucleotide
  Target: ATXN1; (+) strand; PAM type: YTN; PAM sequence: CTC
tgtcactaggacaacatttt

SEQ ID NO: 294951 - DNA, 20 bp, Artificial Sequence
  Description of Artificial Sequence: Synthetic oligonucleotide
  Target: ATXN1; (+) strand; PAM type: YTN; PAM sequence: CTG
tcactaggacaacatttttt

SEQ ID NO: 294952 - DNA, 20 bp, Artificial Sequence
  Description of Artificial Sequence: Synthetic oligonucleotide
  Target: ATXN1; (+) strand; PAM type: YTN; PAM sequence: CTA
ggacaacattttttcaaatg

SEQ ID NO: 294953 - DNA, 20 bp, Artificial Sequence
  Description of Artificial Sequence: Synthetic oligonucleotide
  Target: ATXN1; (+) strand; PAM type: YTN; PAM sequence: TTT
tttcaaatgtcctgttattt

SEQ ID NO: 294954 - DNA, 20 bp, Artificial Sequence
  Description of Artificial Sequence: Synthetic oligonucleotide
  Target: ATXN1; (+) strand; PAM type: YTN; PAM sequence: TTT
ttcaaatgtcctgttattta

SEQ ID NO: 294955 - DNA, 20 bp, Artificial Sequence
  Description of Artificial Sequence: Synthetic oligonucleotide
  Target: ATXN1; (+) strand; PAM type: YTN; PAM sequence: TTT
tcaaatgtcctgttatttag

SEQ ID NO: 294956 - DNA, 20 bp, Artificial Sequence
  Description of Artificial Sequence: Synthetic oligonucleotide
  Target: ATXN1; (+) strand; PAM type: YTN; PAM sequence: TTT
caaatgtcctgttatttagg

SEQ ID NO: 294957 - DNA, 20 bp, Artificial Sequence
  Description of Artificial Sequence: Synthetic oligonucleotide
  Target: ATXN1; (+) strand; PAM type: YTN; PAM sequence: TTC
aaatgtcctgttatttagga

SEQ ID NO: 294958 - DNA, 20 bp, Artificial Sequence
  Description of Artificial Sequence: Synthetic oligonucleotide
  Target: ATXN1; (+) strand; PAM type: YTN; PAM sequence: CTG
ttatttaggatgtagagaaa

SEQ ID NO: 294959 - DNA, 20 bp, Artificial Sequence
  Description of Artificial Sequence: Synthetic oligonucleotide
  Target: ATXN1; (+) strand; PAM type: YTN; PAM sequence: TTA
tttaggatgtagagaaatag

SEQ ID NO: 294960 - DNA, 20 bp, Artificial Sequence
  Description of Artificial Sequence: Synthetic oligonucleotide
  Target: ATXN1; (+) strand; PAM type: YTN; PAM sequence: TTT
aggatgtagagaaatagcaa

SEQ ID NO: 294961 - DNA, 20 bp, Artificial Sequence
  Description of Artificial Sequence: Synthetic oligonucleotide
  Target: ATXN1; (+) strand; PAM type: YTN; PAM sequence: TTA
ggatgtagagaaatagcaat

SEQ ID NO: 294962 - DNA, 20 bp, Artificial Sequence
  Description of Artificial Sequence: Synthetic oligonucleotide
  Target: ATXN1; (+) strand; PAM type: YTN; PAM sequence: CTT
gaagaagaagttctggtaca

SEQ ID NO: 294963 - DNA, 20 bp, Artificial Sequence
  Description of Artificial Sequence: Synthetic oligonucleotide
  Target: ATXN1; (+) strand; PAM type: YTN; PAM sequence: TTG
aagaagaagttctggtacac

SEQ ID NO: 294964 - DNA, 20 bp, Artificial Sequence
  Description of Artificial Sequence: Synthetic oligonucleotide
  Target: ATXN1; (+) strand; PAM type: YTN; PAM sequence: TTC
tggtacaccagtgaagtgat

SEQ ID NO: 294965 - DNA, 20 bp, Artificial Sequence
  Description of Artificial Sequence: Synthetic oligonucleotide
  Target: ATXN1; (+) strand; PAM type: YTN; PAM sequence: CTG
gtacaccagtgaagtgatgc

SEQ ID NO: 294966 - DNA, 20 bp, Artificial Sequence
  Description of Artificial Sequence: Synthetic oligonucleotide
  Target: ATXN1; (+) strand; PAM type: YTN; PAM sequence: TTT
aaagctaaaagatgtcaagt

SEQ ID NO: 294967 - DNA, 20 bp, Artificial Sequence
  Description of Artificial Sequence: Synthetic oligonucleotide
  Target: ATXN1; (+) strand; PAM type: YTN; PAM sequence: TTA
aagctaaaagatgtcaagtc

SEQ ID NO: 294968 - DNA, 20 bp, Artificial Sequence
  Description of Artificial Sequence: Synthetic oligonucleotide
  Target: ATXN1; (+) strand; PAM type: YTN; PAM sequence: CTA
aaagatgtcaagtcttttgg

SEQ ID NO: 294969 - DNA, 20 bp, Artificial Sequence
  Description of Artificial Sequence: Synthetic oligonucleotide
  Target: ATXN1; (+) strand; PAM type: YTN; PAM sequence: CTT
ttggatgacttaccaaaaac

SEQ ID NO: 294970 - DNA, 20 bp, Artificial Sequence
  Description of Artificial Sequence: Synthetic oligonucleotide
  Target: ATXN1; (+) strand; PAM type: YTN; PAM sequence: TTT
tggatgacttaccaaaaacc

SEQ ID NO: 294971 - DNA, 20 bp, Artificial Sequence
  Description of Artificial Sequence: Synthetic oligonucleotide
  Target: ATXN1; (+) strand; PAM type: YTN; PAM sequence: TTT
ggatgacttaccaaaaacca

SEQ ID NO: 294972 - DNA, 20 bp, Artificial Sequence
  Description of Artificial Sequence: Synthetic oligonucleotide
  Target: ATXN1; (+) strand; PAM type: YTN; PAM sequence: TTG
gatgacttaccaaaaaccat

SEQ ID NO: 294973 - DNA, 20 bp, Artificial Sequence
  Description of Artificial Sequence: Synthetic oligonucleotide
  Target: ATXN1; (+) strand; PAM type: YTN; PAM sequence: CTT
accaaaaaccatttgtgttt

SEQ ID NO: 294974 - DNA, 20 bp, Artificial Sequence
  Description of Artificial Sequence: Synthetic oligonucleotide
  Target: ATXN1; (+) strand; PAM type: YTN; PAM sequence: TTA
ccaaaaaccatttgtgtttc

SEQ ID NO: 294975 - DNA, 20 bp, Artificial Sequence
  Description of Artificial Sequence: Synthetic oligonucleotide
  Target: ATXN1; (+) strand; PAM type: YTN; PAM sequence: TTT
gtgtttcaagaccatccgtg

SEQ ID NO: 294976 - DNA, 20 bp, Artificial Sequence
  Description of Artificial Sequence: Synthetic oligonucleotide
  Target: ATXN1; (+) strand; PAM type: YTN; PAM sequence: TTG
tgtttcaagaccatccgtgc

SEQ ID NO: 294977 - DNA, 20 bp, Artificial Sequence
  Description of Artificial Sequence: Synthetic oligonucleotide
  Target: ATXN1; (+) strand; PAM type: YTN; PAM sequence: TTT
caagaccatccgtgcaggct

SEQ ID NO: 294978 - DNA, 20 bp, Artificial Sequence
  Description of Artificial Sequence: Synthetic oligonucleotide
  Target: ATXN1; (+) strand; PAM type: YTN; PAM sequence: TTC
aagaccatccgtgcaggctg

SEQ ID NO: 294979 - DNA, 20 bp, Artificial Sequence
  Description of Artificial Sequence: Synthetic oligonucleotide
  Target: ATXN1; (+) strand; PAM type: YTN; PAM sequence: CTG
aaatccactctttctctctt

SEQ ID NO: 294980 - DNA, 20 bp, Artificial Sequence
  Description of Artificial Sequence: Synthetic oligonucleotide
  Target: ATXN1; (+) strand; PAM type: YTN; PAM sequence: CTC
tttctctcttgttcctggtc

SEQ ID NO: 294981 - DNA, 20 bp, Artificial Sequence
  Description of Artificial Sequence: Synthetic oligonucleotide
  Target: ATXN1; (+) strand; PAM type: YTN; PAM sequence: CTT
tctctcttgttcctggtctg

SEQ ID NO: 294982 - DNA, 20 bp, Artificial Sequence
  Description of Artificial Sequence: Synthetic oligonucleotide
  Target: ATXN1; (+) strand; PAM type: YTN; PAM sequence: TTT
ctctcttgttcctggtctgc

SEQ ID NO: 294983 - DNA, 20 bp, Artificial Sequence
  Description of Artificial Sequence: Synthetic oligonucleotide
  Target: ATXN1; (+) strand; PAM type: YTN; PAM sequence: TTC
tctcttgttcctggtctgca

SEQ ID NO: 294984 - DNA, 20 bp, Artificial Sequence
  Description of Artificial Sequence: Synthetic oligonucleotide
  Target: ATXN1; (+) strand; PAM type: YTN; PAM sequence: CTC
tcttgttcctggtctgcagc

SEQ ID NO: 294985 - DNA, 20 bp, Artificial Sequence
  Description of Artificial Sequence: Synthetic oligonucleotide
  Target: ATXN1; (+) strand; PAM type: YTN; PAM sequence: CTC
ttgttcctggtctgcagcag

SEQ ID NO: 294986 - DNA, 20 bp, Artificial Sequence
  Description of Artificial Sequence: Synthetic oligonucleotide
  Target: ATXN1; (+) strand; PAM type: YTN; PAM sequence: CTT
gttcctggtctgcagcagca

SEQ ID NO: 294987 - DNA, 20 bp, Artificial Sequence
  Description of Artificial Sequence: Synthetic oligonucleotide
  Target: ATXN1; (+) strand; PAM type: YTN; PAM sequence: TTG
ttcctggtctgcagcagcac

SEQ ID NO: 294988 - DNA, 20 bp, Artificial Sequence
  Description of Artificial Sequence: Synthetic oligonucleotide
  Target: ATXN1; (+) strand; PAM type: YTN; PAM sequence: TTC
ctggtctgcagcagcactaa

SEQ ID NO: 294989 - DNA, 20 bp, Artificial Sequence
  Description of Artificial Sequence: Synthetic oligonucleotide
  Target: ATXN1; (+) strand; PAM type: YTN; PAM sequence: CTG
gtctgcagcagcactaagtt

SEQ ID NO: 294990 - DNA, 20 bp, Artificial Sequence
  Description of Artificial Sequence: Synthetic oligonucleotide
  Target: ATXN1; (+) strand; PAM type: YTN; PAM sequence: CTG
cagcagcactaagtttgaag

SEQ ID NO: 294991 - DNA, 20 bp, Artificial Sequence
  Description of Artificial Sequence: Synthetic oligonucleotide
  Target: ATXN1; (+) strand; PAM type: YTN; PAM sequence: CTA
agtttgaagcttcaaaatag

SEQ ID NO: 294992 - DNA, 20 bp, Artificial Sequence
  Description of Artificial Sequence: Synthetic oligonucleotide
  Target: ATXN1; (+) strand; PAM type: YTN; PAM sequence: TTT
gaagcttcaaaatagactct

SEQ ID NO: 294993 - DNA, 20 bp, Artificial Sequence
  Description of Artificial Sequence: Synthetic oligonucleotide
  Target: ATXN1; (+) strand; PAM type: YTN; PAM sequence: TTG
aagcttcaaaatagactctt

SEQ ID NO: 294994 - DNA, 20 bp, Artificial Sequence
  Description of Artificial Sequence: Synthetic oligonucleotide
  Target: ATXN1; (+) strand; PAM type: YTN; PAM sequence: CTT
caaaatagactctttcacta

SEQ ID NO: 294995 - DNA, 20 bp, Artificial Sequence
  Description of Artificial Sequence: Synthetic oligonucleotide
  Target: ATXN1; (+) strand; PAM type: YTN; PAM sequence: TTC
aaaatagactctttcactat

SEQ ID NO: 294996 - DNA, 20 bp, Artificial Sequence
  Description of Artificial Sequence: Synthetic oligonucleotide
  Target: ATXN1; (+) strand; PAM type: YTN; PAM sequence: CTC
tttcactatgctccagtatg

SEQ ID NO: 294997 - DNA, 20 bp, Artificial Sequence
  Description of Artificial Sequence: Synthetic oligonucleotide
  Target: ATXN1; (+) strand; PAM type: YTN; PAM sequence: CTT
tcactatgctccagtatgct

SEQ ID NO: 294998 - DNA, 20 bp, Artificial Sequence
  Description of Artificial Sequence: Synthetic oligonucleotide
  Target: ATXN1; (+) strand; PAM type: YTN; PAM sequence: TTT
cactatgctccagtatgctg

SEQ ID NO: 294999 - DNA, 20 bp, Artificial Sequence
  Description of Artificial Sequence: Synthetic oligonucleotide
  Target: ATXN1; (+) strand; PAM type: YTN; PAM sequence: TTC
actatgctccagtatgctgc

SEQ ID NO: 295000 - DNA, 20 bp, Artificial Sequence
  Description of Artificial Sequence: Synthetic oligonucleotide
  Target: ATXN1; (+) strand; PAM type: YTN; PAM sequence: CTA
tgctccagtatgctgcagtc

SEQ ID NO: 295001 - DNA, 20 bp, Artificial Sequence
  Description of Artificial Sequence: Synthetic oligonucleotide
  Target: ATXN1; (+) strand; PAM type: YTN; PAM sequence: CTC
cagtatgctgcagtcaaaca

SEQ ID NO: 295002 - DNA, 20 bp, Artificial Sequence
  Description of Artificial Sequence: Synthetic oligonucleotide
  Target: ATXN1; (+) strand; PAM type: YTN; PAM sequence: CTG
cagtcaaacaaaacaaaata

SEQ ID NO: 295003 - DNA, 20 bp, Artificial Sequence
  Description of Artificial Sequence: Synthetic oligonucleotide
  Target: ATXN1; (+) strand; PAM type: YTN; PAM sequence: CTT
caagcagttagtggatattc

SEQ ID NO: 295004 - DNA, 20 bp, Artificial Sequence
  Description of Artificial Sequence: Synthetic oligonucleotide
  Target: ATXN1; (+) strand; PAM type: YTN; PAM sequence: TTC
aagcagttagtggatattca

SEQ ID NO: 295005 - DNA, 20 bp, Artificial Sequence
  Description of Artificial Sequence: Synthetic oligonucleotide
  Target: ATXN1; (+) strand; PAM type: YTN; PAM sequence: TTA
gtggatattcagggggaaat

SEQ ID NO: 295006 - DNA, 20 bp, Artificial Sequence
  Description of Artificial Sequence: Synthetic oligonucleotide
  Target: ATXN1; (+) strand; PAM type: YTN; PAM sequence: TTC
agggggaaatccctggcctt

SEQ ID NO: 295007 - DNA, 20 bp, Artificial Sequence
  Description of Artificial Sequence: Synthetic oligonucleotide
  Target: ATXN1; (+) strand; PAM type: YTN; PAM sequence: CTG
gcctttctcaaatgtatatt

SEQ ID NO: 295008 - DNA, 20 bp, Artificial Sequence
  Description of Artificial Sequence: Synthetic oligonucleotide
  Target: ATXN1; (+) strand; PAM type: YTN; PAM sequence: CTT
tctcaaatgtatatttcata

SEQ ID NO: 295009 - DNA, 20 bp, Artificial Sequence
  Description of Artificial Sequence: Synthetic oligonucleotide
  Target: ATXN1; (+) strand; PAM type: YTN; PAM sequence: TTT
ctcaaatgtatatttcataa

SEQ ID NO: 295010 - DNA, 20 bp, Artificial Sequence
  Description of Artificial Sequence: Synthetic oligonucleotide
  Target: ATXN1; (+) strand; PAM type: YTN; PAM sequence: TTC
tcaaatgtatatttcataac

SEQ ID NO: 295011 - DNA, 20 bp, Artificial Sequence
  Description of Artificial Sequence: Synthetic oligonucleotide
  Target: ATXN1; (+) strand; PAM type: YTN; PAM sequence: CTC
aaatgtatatttcataacct

SEQ ID NO: 295012 - DNA, 20 bp, Artificial Sequence
  Description of Artificial Sequence: Synthetic oligonucleotide
  Target: ATXN1; (+) strand; PAM type: YTN; PAM sequence: TTT
cataacctcaaacaagcatg

SEQ ID NO: 295013 - DNA, 20 bp, Artificial Sequence
  Description of Artificial Sequence: Synthetic oligonucleotide
  Target: ATXN1; (+) strand; PAM type: YTN; PAM sequence: TTC
ataacctcaaacaagcatgt

SEQ ID NO: 295014 - DNA, 20 bp, Artificial Sequence
  Description of Artificial Sequence: Synthetic oligonucleotide
  Target: ATXN1; (+) strand; PAM type: YTN; PAM sequence: CTC
aaacaagcatgttaattatc

SEQ ID NO: 295015 - DNA, 20 bp, Artificial Sequence
  Description of Artificial Sequence: Synthetic oligonucleotide
  Target: ATXN1; (+) strand; PAM type: YTN; PAM sequence: TTA
attatcaggatgaagccatc

SEQ ID NO: 295016 - DNA, 20 bp, Artificial Sequence
  Description of Artificial Sequence: Synthetic oligonucleotide
  Target: ATXN1; (+) strand; PAM type: YTN; PAM sequence: TTA
tcaggatgaagccatctcac

SEQ ID NO: 295017 - DNA, 20 bp, Artificial Sequence
  Description of Artificial Sequence: Synthetic oligonucleotide
  Target: ATXN1; (+) strand; PAM type: YTN; PAM sequence: CTC
actgcttatctacataaggt

SEQ ID NO: 295018 - DNA, 20 bp, Artificial Sequence
  Description of Artificial Sequence: Synthetic oligonucleotide
  Target: ATXN1; (+) strand; PAM type: YTN; PAM sequence: CTG
cttatctacataaggtgccc

SEQ ID NO: 295019 - DNA, 20 bp, Artificial Sequence
  Description of Artificial Sequence: Synthetic oligonucleotide
  Target: ATXN1; (+) strand; PAM type: YTN; PAM sequence: CTT
atctacataaggtgccctaa

SEQ ID NO: 295020 - DNA, 20 bp, Artificial Sequence
  Description of Artificial Sequence: Synthetic oligonucleotide
  Target: ATXN1; (+) strand; PAM type: YTN; PAM sequence: TTA
tctacataaggtgccctaaa

SEQ ID NO: 295021 - DNA, 20 bp, Artificial Sequence
  Description of Artificial Sequence: Synthetic oligonucleotide
  Target: ATXN1; (+) strand; PAM type: YTN; PAM sequence: CTA
cataaggtgccctaaaatac

SEQ ID NO: 295022 - DNA, 20 bp, Artificial Sequence
  Description of Artificial Sequence: Synthetic oligonucleotide
  Target: ATXN1; (+) strand; PAM type: YTN; PAM sequence: CTA
aaatactggaggtggggtgt

SEQ ID NO: 295023 - DNA, 20 bp, Artificial Sequence
  Description of Artificial Sequence: Synthetic oligonucleotide
  Target: ATXN1; (+) strand; PAM type: YTN; PAM sequence: CTG
gaggtggggtgtgggaagga

SEQ ID NO: 295024 - DNA, 20 bp, Artificial Sequence
  Description of Artificial Sequence: Synthetic oligonucleotide
  Target: ATXN1; (+) strand; PAM type: YTN; PAM sequence: CTG
ggggaggtagcaggtcttga

SEQ ID NO: 295025 - DNA, 20 bp, Artificial Sequence
  Description of Artificial Sequence: Synthetic oligonucleotide
  Target: ATXN1; (+) strand; PAM type: YTN; PAM sequence: CTT
gaaaatcagaatgtacacca

SEQ ID NO: 295026 - DNA, 20 bp, Artificial Sequence
  Description of Artificial Sequence: Synthetic oligonucleotide
  Target: ATXN1; (+) strand; PAM type: YTN; PAM sequence: TTG
aaaatcagaatgtacaccag

SEQ ID NO: 295027 - DNA, 20 bp, Artificial Sequence
  Description of Artificial Sequence: Synthetic oligonucleotide
  Target: ATXN1; (+) strand; PAM type: YTN; PAM sequence: CTT
gcaaaatttcaagtttaccg

SEQ ID NO: 295028 - DNA, 20 bp, Artificial Sequence
  Description of Artificial Sequence: Synthetic oligonucleotide
  Target: ATXN1; (+) strand; PAM type: YTN; PAM sequence: TTG
caaaatttcaagtttaccga

SEQ ID NO: 295029 - DNA, 20 bp, Artificial Sequence
  Description of Artificial Sequence: Synthetic oligonucleotide
  Target: ATXN1; (+) strand; PAM type: YTN; PAM sequence: TTT
caagtttaccgattgaaaga

SEQ ID NO: 295030 - DNA, 20 bp, Artificial Sequence
  Description of Artificial Sequence: Synthetic oligonucleotide
  Target: ATXN1; (+) strand; PAM type: YTN; PAM sequence: TTC
aagtttaccgattgaaagat

SEQ ID NO: 295031 - DNA, 20 bp, Artificial Sequence
  Description of Artificial Sequence: Synthetic oligonucleotide
  Target: ATXN1; (+) strand; PAM type: YTN; PAM sequence: TTT
accgattgaaagatgtgaat

SEQ ID NO: 295032 - DNA, 20 bp, Artificial Sequence
  Description of Artificial Sequence: Synthetic oligonucleotide
  Target: ATXN1; (+) strand; PAM type: YTN; PAM sequence: TTA
ccgattgaaagatgtgaata

SEQ ID NO: 295033 - DNA, 20 bp, Artificial Sequence
  Description of Artificial Sequence: Synthetic oligonucleotide
  Target: ATXN1; (+) strand; PAM type: YTN; PAM sequence: TTG
aaagatgtgaataaagaaaa

SEQ ID NO: 295034 - DNA, 20 bp, Artificial Sequence
  Description of Artificial Sequence: Synthetic oligonucleotide
  Target: ATXN1; (+) strand; PAM type: YTN; PAM sequence: TTC
agtacgtctaagtgattaaa

SEQ ID NO: 295035 - DNA, 20 bp, Artificial Sequence
  Description of Artificial Sequence: Synthetic oligonucleotide
  Target: ATXN1; (+) strand; PAM type: YTN; PAM sequence: CTA
agtgattaaagactgatgtg

SEQ ID NO: 295036 - DNA, 20 bp, Artificial Sequence
  Description of Artificial Sequence: Synthetic oligonucleotide
  Target: ATXN1; (+) strand; PAM type: YTN; PAM sequence: TTA
aagactgatgtgcagtatca

SEQ ID NO: 295037 - DNA, 20 bp, Artificial Sequence
  Description of Artificial Sequence: Synthetic oligonucleotide
  Target: ATXN1; (+) strand; PAM type: YTN; PAM sequence: CTG
atgtgcagtatcaagggcag

SEQ ID NO: 295038 - DNA, 20 bp, Artificial Sequence
  Description of Artificial Sequence: Synthetic oligonucleotide
  Target: ATXN1; (+) strand; PAM type: YTN; PAM sequence: TTT
gcttcaaatgaaagactcag

SEQ ID NO: 295039 - DNA, 20 bp, Artificial Sequence
  Description of Artificial Sequence: Synthetic oligonucleotide
  Target: ATXN1; (+) strand; PAM type: YTN; PAM sequence: TTG
cttcaaatgaaagactcaga

SEQ ID NO: 295040 - DNA, 20 bp, Artificial Sequence
  Description of Artificial Sequence: Synthetic oligonucleotide
  Target: ATXN1; (+) strand; PAM type: YTN; PAM sequence: CTT
caaatgaaagactcagacta

SEQ ID NO: 295041 - DNA, 20 bp, Artificial Sequence
  Description of Artificial Sequence: Synthetic oligonucleotide
  Target: ATXN1; (+) strand; PAM type: YTN; PAM sequence: TTC
aaatgaaagactcagactaa

SEQ ID NO: 295042 - DNA, 20 bp, Artificial Sequence
  Description of Artificial Sequence: Synthetic oligonucleotide
  Target: ATXN1; (+) strand; PAM type: YTN; PAM sequence: CTC
agactaatcaactgatgtga

SEQ ID NO: 295043 - DNA, 20 bp, Artificial Sequence
  Description of Artificial Sequence: Synthetic oligonucleotide
  Target: ATXN1; (+) strand; PAM type: YTN; PAM sequence: CTA
atcaactgatgtgaatactt

SEQ ID NO: 295044 - DNA, 20 bp, Artificial Sequence
  Description of Artificial Sequence: Synthetic oligonucleotide
  Target: ATXN1; (+) strand; PAM type: YTN; PAM sequence: CTG
atgtgaatactttttaaata

SEQ ID NO: 295045 - DNA, 20 bp, Artificial Sequence
  Description of Artificial Sequence: Synthetic oligonucleotide
  Target: ATXN1; (+) strand; PAM type: YTN; PAM sequence: CTT
tttaaataaagagctattaa

SEQ ID NO: 295046 - DNA, 20 bp, Artificial Sequence
  Description of Artificial Sequence: Synthetic oligonucleotide
  Target: ATXN1; (+) strand; PAM type: YTN; PAM sequence: TTT
ttaaataaagagctattaag

SEQ ID NO: 295047 - DNA, 20 bp, Artificial Sequence
  Description of Artificial Sequence: Synthetic oligonucleotide
  Target: ATXN1; (+) strand; PAM type: YTN; PAM sequence: TTT
taaataaagagctattaaga

SEQ ID NO: 295048 - DNA, 20 bp, Artificial Sequence
  Description of Artificial Sequence: Synthetic oligonucleotide
  Target: ATXN1; (+) strand; PAM type: YTN; PAM sequence: TTT
aaataaagagctattaagat

SEQ ID NO: 295049 - DNA, 20 bp, Artificial Sequence
  Description of Artificial Sequence: Synthetic oligonucleotide
  Target: ATXN1; (+) strand; PAM type: YTN; PAM sequence: TTA
aataaagagctattaagatg

SEQ ID NO: 295050 - DNA, 20 bp, Artificial Sequence
  Description of Artificial Sequence: Synthetic oligonucleotide
  Target: ATXN1; (+) strand; PAM type: YTN; PAM sequence: CTA
ttaagatggaacaaaaaaga

SEQ ID NO: 295051 - DNA, 20 bp, Artificial Sequence
  Description of Artificial Sequence: Synthetic oligonucleotide
  Target: ATXN1; (+) strand; PAM type: YTN; PAM sequence: TTA
agatggaacaaaaaagataa

SEQ ID NO: 295052 - DNA, 20 bp, Artificial Sequence
  Description of Artificial Sequence: Synthetic oligonucleotide
  Target: ATXN1; (+) strand; PAM type: YTN; PAM sequence: TTT
tccattttgccctataagta

SEQ ID NO: 295053 - DNA, 20 bp, Artificial Sequence
  Description of Artificial Sequence: Synthetic oligonucleotide
  Target: ATXN1; (+) strand; PAM type: YTN; PAM sequence: TTT
ccattttgccctataagtag

SEQ ID NO: 295054 - DNA, 20 bp, Artificial Sequence
  Description of Artificial Sequence: Synthetic oligonucleotide
  Target: ATXN1; (+) strand; PAM type: YTN; PAM sequence: TTC
cattttgccctataagtagg

SEQ ID NO: 295055 - DNA, 20 bp, Artificial Sequence
  Description of Artificial Sequence: Synthetic oligonucleotide
  Target: ATXN1; (+) strand; PAM type: YTN; PAM sequence: TTT
tgccctataagtaggtaatg

SEQ ID NO: 295056 - DNA, 20 bp, Artificial Sequence
  Description of Artificial Sequence: Synthetic oligonucleotide
  Target: ATXN1; (+) strand; PAM type: YTN; PAM sequence: TTT
gccctataagtaggtaatgc

SEQ ID NO: 295057 - DNA, 20 bp, Artificial Sequence
  Description of Artificial Sequence: Synthetic oligonucleotide
  Target: ATXN1; (+) strand; PAM type: YTN; PAM sequence: TTG
ccctataagtaggtaatgca

SEQ ID NO: 295058 - DNA, 20 bp, Artificial Sequence
  Description of Artificial Sequence: Synthetic oligonucleotide
  Target: ATXN1; (+) strand; PAM type: YTN; PAM sequence: CTA
taagtaggtaatgcatgggt

SEQ ID NO: 295059 - DNA, 20 bp, Artificial Sequence
  Description of Artificial Sequence: Synthetic oligonucleotide
  Target: ATXN1; (+) strand; PAM type: YTN; PAM sequence: TTT
cccttgtgtgattcttgata

SEQ ID NO: 295060 - DNA, 20 bp, Artificial Sequence
  Description of Artificial Sequence: Synthetic oligonucleotide
  Target: ATXN1; (+) strand; PAM type: YTN; PAM sequence: TTC
ccttgtgtgattcttgataa

SEQ ID NO: 295061 - DNA, 20 bp, Artificial Sequence
  Description of Artificial Sequence: Synthetic oligonucleotide
  Target: ATXN1; (+) strand; PAM type: YTN; PAM sequence: CTT
gtgtgattcttgataaatac

SEQ ID NO: 295062 - DNA, 20 bp, Artificial Sequence
  Description of Artificial Sequence: Synthetic oligonucleotide
  Target: ATXN1; (+) strand; PAM type: YTN; PAM sequence: TTG
tgtgattcttgataaatact

SEQ ID NO: 295063 - DNA, 20 bp, Artificial Sequence
  Description of Artificial Sequence: Synthetic oligonucleotide
  Target: ATXN1; (+) strand; PAM type: YTN; PAM sequence: TTC
ttgataaatactttctccac

SEQ ID NO: 295064 - DNA, 20 bp, Artificial Sequence
  Description of Artificial Sequence: Synthetic oligonucleotide
  Target: ATXN1; (+) strand; PAM type: YTN; PAM sequence: CTT
gataaatactttctccaccc

SEQ ID NO: 295065 - DNA, 20 bp, Artificial Sequence
  Description of Artificial Sequence: Synthetic oligonucleotide
  Target: ATXN1; (+) strand; PAM type: YTN; PAM sequence: TTG
ataaatactttctccaccca

SEQ ID NO: 295066 - DNA, 20 bp, Artificial Sequence
  Description of Artificial Sequence: Synthetic oligonucleotide
  Target: ATXN1; (+) strand; PAM type: YTN; PAM sequence: CTT
tctccacccaagctgaaaag

SEQ ID NO: 295067 - DNA, 20 bp, Artificial Sequence
  Description of Artificial Sequence: Synthetic oligonucleotide
  Target: ATXN1; (+) strand; PAM type: YTN; PAM sequence: TTT
ctccacccaagctgaaaagc

SEQ ID NO: 295068 - DNA, 20 bp, Artificial Sequence
  Description of Artificial Sequence: Synthetic oligonucleotide
  Target: ATXN1; (+) strand; PAM type: YTN; PAM sequence: TTC
tccacccaagctgaaaagca

SEQ ID NO: 295069 - DNA, 20 bp, Artificial Sequence
  Description of Artificial Sequence: Synthetic oligonucleotide
  Target: ATXN1; (+) strand; PAM type: YTN; PAM sequence: CTC
cacccaagctgaaaagcagt

SEQ ID NO: 295070 - DNA, 20 bp, Artificial Sequence
  Description of Artificial Sequence: Synthetic oligonucleotide
  Target: ATXN1; (+) strand; PAM type: YTN; PAM sequence: CTG
aaaagcagtagttactttac

SEQ ID NO: 295071 - DNA, 20 bp, Artificial Sequence
  Description of Artificial Sequence: Synthetic oligonucleotide
  Target: ATXN1; (+) strand; PAM type: YTN; PAM sequence: TTA
ctttacacactgaatatgaa

SEQ ID NO: 295072 - DNA, 20 bp, Artificial Sequence
  Description of Artificial Sequence: Synthetic oligonucleotide
  Target: ATXN1; (+) strand; PAM type: YTN; PAM sequence: CTT
tacacactgaatatgaaatg

SEQ ID NO: 295073 - DNA, 20 bp, Artificial Sequence
  Description of Artificial Sequence: Synthetic oligonucleotide
  Target: ATXN1; (+) strand; PAM type: YTN; PAM sequence: TTT
acacactgaatatgaaatga

SEQ ID NO: 295074 - DNA, 20 bp, Artificial Sequence
  Description of Artificial Sequence: Synthetic oligonucleotide
  Target: ATXN1; (+) strand; PAM type: YTN; PAM sequence: TTA
cacactgaatatgaaatgaa

SEQ ID NO: 295075 - DNA, 20 bp, Artificial Sequence
  Description of Artificial Sequence: Synthetic oligonucleotide
  Target: ATXN1; (+) strand; PAM type: YTN; PAM sequence: CTG
aatatgaaatgaatgtttaa

SEQ ID NO: 295076 - DNA, 20 bp, Artificial Sequence
  Description of Artificial Sequence: Synthetic oligonucleotide
  Target: ATXN1; (+) strand; PAM type: YTN; PAM sequence: TTT
aaaatatgcatgcctcttta

SEQ ID NO: 295077 - DNA, 20 bp, Artificial Sequence
  Description of Artificial Sequence: Synthetic oligonucleotide
  Target: ATXN1; (+) strand; PAM type: YTN; PAM sequence: TTA
aaatatgcatgcctctttac

SEQ ID NO: 295078 - DNA, 20 bp, Artificial Sequence
  Description of Artificial Sequence: Synthetic oligonucleotide
  Target: ATXN1; (+) strand; PAM type: YTN; PAM sequence: CTC
tttacccccactcagagcag

SEQ ID NO: 295079 - DNA, 20 bp, Artificial Sequence
  Description of Artificial Sequence: Synthetic oligonucleotide
  Target: ATXN1; (+) strand; PAM type: YTN; PAM sequence: CTT
tacccccactcagagcagct

SEQ ID NO: 295080 - DNA, 20 bp, Artificial Sequence
  Description of Artificial Sequence: Synthetic oligonucleotide
  Target: ATXN1; (+) strand; PAM type: YTN; PAM sequence: TTT
acccccactcagagcagctg

SEQ ID NO: 295081 - DNA, 20 bp, Artificial Sequence
  Description of Artificial Sequence: Synthetic oligonucleotide
  Target: ATXN1; (+) strand; PAM type: YTN; PAM sequence: TTA
cccccactcagagcagctga

SEQ ID NO: 295082 - DNA, 20 bp, Artificial Sequence
  Description of Artificial Sequence: Synthetic oligonucleotide
  Target: ATXN1; (+) strand; PAM type: YTN; PAM sequence: CTC
agagcagctgataaagccta

SEQ ID NO: 295083 - DNA, 20 bp, Artificial Sequence
  Description of Artificial Sequence: Synthetic oligonucleotide
  Target: ATXN1; (+) strand; PAM type: YTN; PAM sequence: CTG
ataaagcctacacattagaa

SEQ ID NO: 295084 - DNA, 20 bp, Artificial Sequence
  Description of Artificial Sequence: Synthetic oligonucleotide
  Target: ATXN1; (+) strand; PAM type: YTN; PAM sequence: CTA
cacattagaacctcgtctga

SEQ ID NO: 295085 - DNA, 20 bp, Artificial Sequence
  Description of Artificial Sequence: Synthetic oligonucleotide
  Target: ATXN1; (+) strand; PAM type: YTN; PAM sequence: TTA
gaacctcgtctgacaaggtc

SEQ ID NO: 295086 - DNA, 20 bp, Artificial Sequence
  Description of Artificial Sequence: Synthetic oligonucleotide
  Target: ATXN1; (+) strand; PAM type: YTN; PAM sequence: CTC
gtctgacaaggtcactctga

SEQ ID NO: 295087 - DNA, 20 bp, Artificial Sequence
  Description of Artificial Sequence: Synthetic oligonucleotide
  Target: ATXN1; (+) strand; PAM type: YTN; PAM sequence: CTG
acaaggtcactctgaaaagt

SEQ ID NO: 295088 - DNA, 20 bp, Artificial Sequence
  Description of Artificial Sequence: Synthetic oligonucleotide
  Target: ATXN1; (+) strand; PAM type: YTN; PAM sequence: CTC
tgaaaagttcctttctgcct

SEQ ID NO: 295089 - DNA, 20 bp, Artificial Sequence
  Description of Artificial Sequence: Synthetic oligonucleotide
  Target: ATXN1; (+) strand; PAM type: YTN; PAM sequence: CTG
aaaagttcctttctgccttg

SEQ ID NO: 295090 - DNA, 20 bp, Artificial Sequence
  Description of Artificial Sequence: Synthetic oligonucleotide
  Target: ATXN1; (+) strand; PAM type: YTN; PAM sequence: TTC
ctttctgccttgtgagcttt

SEQ ID NO: 295091 - DNA, 20 bp, Artificial Sequence
  Description of Artificial Sequence: Synthetic oligonucleotide
  Target: ATXN1; (+) strand; PAM type: YTN; PAM sequence: CTT
tctgccttgtgagcttttaa

SEQ ID NO: 295092 - DNA, 20 bp, Artificial Sequence
  Description of Artificial Sequence: Synthetic oligonucleotide
  Target: ATXN1; (+) strand; PAM type: YTN; PAM sequence: TTT
ctgccttgtgagcttttaac

SEQ ID NO: 295093 - DNA, 20 bp, Artificial Sequence
  Description of Artificial Sequence: Synthetic oligonucleotide
  Target: ATXN1; (+) strand; PAM type: YTN; PAM sequence: TTC
tgccttgtgagcttttaacg

SEQ ID NO: 295094 - DNA, 20 bp, Artificial Sequence
  Description of Artificial Sequence: Synthetic oligonucleotide
  Target: ATXN1; (+) strand; PAM type: YTN; PAM sequence: CTG
ccttgtgagcttttaacgct

SEQ ID NO: 295095 - DNA, 20 bp, Artificial Sequence
  Description of Artificial Sequence: Synthetic oligonucleotide
  Target: ATXN1; (+) strand; PAM type: YTN; PAM sequence: CTT
gtgagcttttaacgctcact

SEQ ID NO: 295096 - DNA, 20 bp, Artificial Sequence
  Description of Artificial Sequence: Synthetic oligonucleotide
  Target: ATXN1; (+) strand; PAM type: YTN; PAM sequence: TTG
tgagcttttaacgctcactt

SEQ ID NO: 295097 - DNA, 20 bp, Artificial Sequence
  Description of Artificial Sequence: Synthetic oligonucleotide
  Target: ATXN1; (+) strand; PAM type: YTN; PAM sequence: CTT
ttaacgctcacttgtcacag

SEQ ID NO: 295098 - DNA, 20 bp, Artificial Sequence
  Description of Artificial Sequence: Synthetic oligonucleotide
  Target: ATXN1; (+) strand; PAM type: YTN; PAM sequence: TTT
taacgctcacttgtcacagg

SEQ ID NO: 295099 - DNA, 20 bp, Artificial Sequence
  Description of Artificial Sequence: Synthetic oligonucleotide
  Target: ATXN1; (+) strand; PAM type: YTN; PAM sequence: TTT
aacgctcacttgtcacaggc

SEQ ID NO: 295100 - DNA, 20 bp, Artificial Sequence
  Description of Artificial Sequence: Synthetic oligonucleotide
  Target: ATXN1; (+) strand; PAM type: YTN; PAM sequence: TTA
acgctcacttgtcacaggct

SEQ ID NO: 295101 - DNA, 20 bp, Artificial Sequence
  Description of Artificial Sequence: Synthetic oligonucleotide
  Target: ATXN1; (+) strand; PAM type: YTN; PAM sequence: CTC
acttgtcacaggctgttgtt

SEQ ID NO: 295102 - DNA, 20 bp, Artificial Sequence
  Description of Artificial Sequence: Synthetic oligonucleotide
  Target: ATXN1; (+) strand; PAM type: YTN; PAM sequence: CTT
gtcacaggctgttgttaaag

SEQ ID NO: 295103 - DNA, 20 bp, Artificial Sequence
  Description of Artificial Sequence: Synthetic oligonucleotide
  Target: ATXN1; (+) strand; PAM type: YTN; PAM sequence: TTG
tcacaggctgttgttaaagc

SEQ ID NO: 295104 - DNA, 20 bp, Artificial Sequence
  Description of Artificial Sequence: Synthetic oligonucleotide
  Target: ATXN1; (+) strand; PAM type: YTN; PAM sequence: CTG
ttgttaaagcatcttctgat

SEQ ID NO: 295105 - DNA, 20 bp, Artificial Sequence
  Description of Artificial Sequence: Synthetic oligonucleotide
  Target: ATXN1; (+) strand; PAM type: YTN; PAM sequence: TTG
ttaaagcatcttctgatgct

SEQ ID NO: 295106 - DNA, 20 bp, Artificial Sequence
  Description of Artificial Sequence: Synthetic oligonucleotide
  Target: ATXN1; (+) strand; PAM type: YTN; PAM sequence: TTA
aagcatcttctgatgcttag

SEQ ID NO: 295107 - DNA, 20 bp, Artificial Sequence
  Description of Artificial Sequence: Synthetic oligonucleotide
  Target: ATXN1; (+) strand; PAM type: YTN; PAM sequence: CTT
ctgatgcttagtcaaatcca

SEQ ID NO: 295108 - DNA, 20 bp, Artificial Sequence
  Description of Artificial Sequence: Synthetic oligonucleotide
  Target: ATXN1; (+) strand; PAM type: YTN; PAM sequence: TTC
tgatgcttagtcaaatccac

SEQ ID NO: 295109 - DNA, 20 bp, Artificial Sequence
  Description of Artificial Sequence: Synthetic oligonucleotide
  Target: ATXN1; (+) strand; PAM type: YTN; PAM sequence: CTG
atgcttagtcaaatccaccc

SEQ ID NO: 295110 - DNA, 20 bp, Artificial Sequence
  Description of Artificial Sequence: Synthetic oligonucleotide
  Target: ATXN1; (+) strand; PAM type: YTN; PAM sequence: CTT
agtcaaatccaccccactgt

SEQ ID NO: 295111 - DNA, 20 bp, Artificial Sequence
  Description of Artificial Sequence: Synthetic oligonucleotide
  Target: ATXN1; (+) strand; PAM type: YTN; PAM sequence: TTA
gtcaaatccaccccactgtt

SEQ ID NO: 295112 - DNA, 20 bp, Artificial Sequence
  Description of Artificial Sequence: Synthetic oligonucleotide
  Target: ATXN1; (+) strand; PAM type: YTN; PAM sequence: CTG
tttgttttttgacaatggcc

SEQ ID NO: 295113 - DNA, 20 bp, Artificial Sequence
  Description of Artificial Sequence: Synthetic oligonucleotide
  Target: ATXN1; (+) strand; PAM type: YTN; PAM sequence: TTT
gttttttgacaatggccatt

SEQ ID NO: 295114 - DNA, 20 bp, Artificial Sequence
  Description of Artificial Sequence: Synthetic oligonucleotide
  Target: ATXN1; (+) strand; PAM type: YTN; PAM sequence: TTG
ttttttgacaatggccattt

SEQ ID NO: 295115 - DNA, 20 bp, Artificial Sequence
  Description of Artificial Sequence: Synthetic oligonucleotide
  Target: ATXN1; (+) strand; PAM type: YTN; PAM sequence: TTT
tttgacaatggccatttgag

SEQ ID NO: 295116 - DNA, 20 bp, Artificial Sequence
  Description of Artificial Sequence: Synthetic oligonucleotide
  Target: ATXN1; (+) strand; PAM type: YTN; PAM sequence: TTT
ttgacaatggccatttgaga

SEQ ID NO: 295117 - DNA, 20 bp, Artificial Sequence
  Description of Artificial Sequence: Synthetic oligonucleotide
  Target: ATXN1; (+) strand; PAM type: YTN; PAM sequence: TTT
tgacaatggccatttgagag

SEQ ID NO: 295118 - DNA, 20 bp, Artificial Sequence
  Description of Artificial Sequence: Synthetic oligonucleotide
  Target: ATXN1; (+) strand; PAM type: YTN; PAM sequence: TTT
gacaatggccatttgagagc

SEQ ID NO: 295119 - DNA, 20 bp, Artificial Sequence
  Description of Artificial Sequence: Synthetic oligonucleotide
  Target: ATXN1; (+) strand; PAM type: YTN; PAM sequence: TTG
acaatggccatttgagagcc

SEQ ID NO: 295120 - DNA, 20 bp, Artificial Sequence
  Description of Artificial Sequence: Synthetic oligonucleotide
  Target: ATXN1; (+) strand; PAM type: YTN; PAM sequence: TTT
gagagcctagaaacagtctt

SEQ ID NO: 295121 - DNA, 20 bp, Artificial Sequence
  Description of Artificial Sequence: Synthetic oligonucleotide
  Target: ATXN1; (+) strand; PAM type: YTN; PAM sequence: TTG
agagcctagaaacagtcttc

SEQ ID NO: 295122 - DNA, 20 bp, Artificial Sequence
  Description of Artificial Sequence: Synthetic oligonucleotide
  Target: ATXN1; (+) strand; PAM type: YTN; PAM sequence: CTA
gaaacagtcttccaaaggtg

SEQ ID NO: 295123 - DNA, 20 bp, Artificial Sequence
  Description of Artificial Sequence: Synthetic oligonucleotide
  Target: ATXN1; (+) strand; PAM type: YTN; PAM sequence: CTT
ccaaaggtgtctgcctcctt

SEQ ID NO: 295124 - DNA, 20 bp, Artificial Sequence
  Description of Artificial Sequence: Synthetic oligonucleotide
  Target: ATXN1; (+) strand; PAM type: YTN; PAM sequence: TTC
caaaggtgtctgcctccttt

SEQ ID NO: 295125 - DNA, 20 bp, Artificial Sequence
  Description of Artificial Sequence: Synthetic oligonucleotide
  Target: ATXN1; (+) strand; PAM type: YTN; PAM sequence: CTG
cctccttttttagcctttta

SEQ ID NO: 295126 - DNA, 20 bp, Artificial Sequence
  Description of Artificial Sequence: Synthetic oligonucleotide
  Target: ATXN1; (+) strand; PAM type: YTN; PAM sequence: CTC
cttttttagccttttatgag

SEQ ID NO: 295127 - DNA, 20 bp, Artificial Sequence
  Description of Artificial Sequence: Synthetic oligonucleotide
  Target: ATXN1; (+) strand; PAM type: YTN; PAM sequence: CTT
ttttagccttttatgagctc

SEQ ID NO: 295128 - DNA, 20 bp, Artificial Sequence
  Description of Artificial Sequence: Synthetic oligonucleotide
  Target: ATXN1; (+) strand; PAM type: YTN; PAM sequence: TTT
tttagccttttatgagctca

SEQ ID NO: 295129 - DNA, 20 bp, Artificial Sequence
  Description of Artificial Sequence: Synthetic oligonucleotide
  Target: ATXN1; (+) strand; PAM type: YTN; PAM sequence: TTT
ttagccttttatgagctcat

SEQ ID NO: 295130 - DNA, 20 bp, Artificial Sequence
  Description of Artificial Sequence: Synthetic oligonucleotide
  Target: ATXN1; (+) strand; PAM type: YTN; PAM sequence: TTT
tagccttttatgagctcatc

SEQ ID NO: 295131 - DNA, 20 bp, Artificial Sequence
  Description of Artificial Sequence: Synthetic oligonucleotide
  Target: ATXN1; (+) strand; PAM type: YTN; PAM sequence: TTT
agccttttatgagctcatcc

SEQ ID NO: 295132 - DNA, 20 bp, Artificial Sequence
  Description of Artificial Sequence: Synthetic oligonucleotide
  Target: ATXN1; (+) strand; PAM type: YTN; PAM sequence: TTA
gccttttatgagctcatcct

SEQ ID NO: 295133 - DNA, 20 bp, Artificial Sequence
  Description of Artificial Sequence: Synthetic oligonucleotide
  Target: ATXN1; (+) strand; PAM type: YTN; PAM sequence: CTT
ttatgagctcatcctcatct

SEQ ID NO: 295134 - DNA, 20 bp, Artificial Sequence
  Description of Artificial Sequence: Synthetic oligonucleotide
  Target: ATXN1; (+) strand; PAM type: YTN; PAM sequence: TTT
tatgagctcatcctcatcta

SEQ ID NO: 295135 - DNA, 20 bp, Artificial Sequence
  Description of Artificial Sequence: Synthetic oligonucleotide
  Target: ATXN1; (+) strand; PAM type: YTN; PAM sequence: TTT
atgagctcatcctcatctat

SEQ ID NO: 295136 - DNA, 20 bp, Artificial Sequence
  Description of Artificial Sequence: Synthetic oligonucleotide
  Target: ATXN1; (+) strand; PAM type: YTN; PAM sequence: TTA
tgagctcatcctcatctatg

SEQ ID NO: 295137 - DNA, 20 bp, Artificial Sequence
  Description of Artificial Sequence: Synthetic oligonucleotide
  Target: ATXN1; (+) strand; PAM type: YTN; PAM sequence: CTC
atcctcatctatgttgaaaa

SEQ ID NO: 295138 - DNA, 20 bp, Artificial Sequence
  Description of Artificial Sequence: Synthetic oligonucleotide
  Target: ATXN1; (+) strand; PAM type: YTN; PAM sequence: CTC
atctatgttgaaaacccatc

SEQ ID NO: 295139 - DNA, 20 bp, Artificial Sequence
  Description of Artificial Sequence: Synthetic oligonucleotide
  Target: ATXN1; (+) strand; PAM type: YTN; PAM sequence: CTA
tgttgaaaacccatcggctg

SEQ ID NO: 295140 - DNA, 20 bp, Artificial Sequence
  Description of Artificial Sequence: Synthetic oligonucleotide
  Target: ATXN1; (+) strand; PAM type: YTN; PAM sequence: TTG
aaaacccatcggctgactgt

SEQ ID NO: 295141 - DNA, 20 bp, Artificial Sequence
  Description of Artificial Sequence: Synthetic oligonucleotide
  Target: ATXN1; (+) strand; PAM type: YTN; PAM sequence: CTG
actgtcatccagttccctga

SEQ ID NO: 295142 - DNA, 20 bp, Artificial Sequence
  Description of Artificial Sequence: Synthetic oligonucleotide
  Target: ATXN1; (+) strand; PAM type: YTN; PAM sequence: CTG
tcatccagttccctgagtat

SEQ ID NO: 295143 - DNA, 20 bp, Artificial Sequence
  Description of Artificial Sequence: Synthetic oligonucleotide
  Target: ATXN1; (+) strand; PAM type: YTN; PAM sequence: TTC
cctgagtatggtggccacat

SEQ ID NO: 295144 - DNA, 20 bp, Artificial Sequence
  Description of Artificial Sequence: Synthetic oligonucleotide
  Target: ATXN1; (+) strand; PAM type: YTN; PAM sequence: CTG
agtatggtggccacatcata

SEQ ID NO: 295145 - DNA, 20 bp, Artificial Sequence
  Description of Artificial Sequence: Synthetic oligonucleotide
  Target: ATXN1; (+) strand; PAM type: YTN; PAM sequence: CTT
gtaaccctaaactccataaa

SEQ ID NO: 295146 - DNA, 20 bp, Artificial Sequence
  Description of Artificial Sequence: Synthetic oligonucleotide
  Target: ATXN1; (+) strand; PAM type: YTN; PAM sequence: TTG
taaccctaaactccataaat

SEQ ID NO: 295147 - DNA, 20 bp, Artificial Sequence
  Description of Artificial Sequence: Synthetic oligonucleotide
  Target: ATXN1; (+) strand; PAM type: YTN; PAM sequence: CTA
aactccataaatctccaaag

SEQ ID NO: 295148 - DNA, 20 bp, Artificial Sequence
  Description of Artificial Sequence: Synthetic oligonucleotide
  Target: ATXN1; (+) strand; PAM type: YTN; PAM sequence: CTC
cataaatctccaaaggtccc

SEQ ID NO: 295149 - DNA, 20 bp, Artificial Sequence
  Description of Artificial Sequence: Synthetic oligonucleotide
  Target: ATXN1; (+) strand; PAM type: YTN; PAM sequence: CTC
caaaggtcccacggtgatca

SEQ ID NO: 295150 - DNA, 20 bp, Artificial Sequence
  Description of Artificial Sequence: Synthetic oligonucleotide
  Target: ATXN1; (+) strand; PAM type: YTN; PAM sequence: TTG
gatcaagtgaccaagttgta

SEQ ID NO: 295151 - DNA, 20 bp, Artificial Sequence
  Description of Artificial Sequence: Synthetic oligonucleotide
  Target: ATXN1; (+) strand; PAM type: YTN; PAM sequence: TTG
taagaaagaggatatgctcg

SEQ ID NO: 295152 - DNA, 20 bp, Artificial Sequence
  Description of Artificial Sequence: Synthetic oligonucleotide
  Target: ATXN1; (+) strand; PAM type: YTN; PAM sequence: CTC
gtatgcctcagaagcttact

SEQ ID NO: 295153 - DNA, 20 bp, Artificial Sequence
  Description of Artificial Sequence: Synthetic oligonucleotide
  Target: ATXN1; (+) strand; PAM type: YTN; PAM sequence: CTC
agaagcttactgtgtgaata

SEQ ID NO: 295154 - DNA, 20 bp, Artificial Sequence
  Description of Artificial Sequence: Synthetic oligonucleotide
  Target: ATXN1; (+) strand; PAM type: YTN; PAM sequence: CTT
actgtgtgaataactaattc

SEQ ID NO: 295155 - DNA, 20 bp, Artificial Sequence
  Description of Artificial Sequence: Synthetic oligonucleotide
  Target: ATXN1; (+) strand; PAM type: YTN; PAM sequence: TTA
ctgtgtgaataactaattcc

SEQ ID NO: 295156 - DNA, 20 bp, Artificial Sequence
  Description of Artificial Sequence: Synthetic oligonucleotide
  Target: ATXN1; (+) strand; PAM type: YTN; PAM sequence: CTG
tgtgaataactaattccttg

SEQ ID NO: 295157 - DNA, 20 bp, Artificial Sequence
  Description of Artificial Sequence: Synthetic oligonucleotide
  Target: ATXN1; (+) strand; PAM type: YTN; PAM sequence: CTA
attccttgaaagccttctgt

SEQ ID NO: 295158 - DNA, 20 bp, Artificial Sequence
  Description of Artificial Sequence: Synthetic oligonucleotide
  Target: ATXN1; (+) strand; PAM type: YTN; PAM sequence: TTC
cttgaaagccttctgtaact

SEQ ID NO: 295159 - DNA, 20 bp, Artificial Sequence
  Description of Artificial Sequence: Synthetic oligonucleotide
  Target: ATXN1; (+) strand; PAM type: YTN; PAM sequence: CTT
gaaagccttctgtaactatt

SEQ ID NO: 295160 - DNA, 20 bp, Artificial Sequence
  Description of Artificial Sequence: Synthetic oligonucleotide
  Target: ATXN1; (+) strand; PAM type: YTN; PAM sequence: TTG
aaagccttctgtaactatta

SEQ ID NO: 295161 - DNA, 20 bp, Artificial Sequence
  Description of Artificial Sequence: Synthetic oligonucleotide
  Target: ATXN1; (+) strand; PAM type: YTN; PAM sequence: CTT
ctgtaactattactttatgg

SEQ ID NO: 295162 - DNA, 20 bp, Artificial Sequence
  Description of Artificial Sequence: Synthetic oligonucleotide
  Target: ATXN1; (+) strand; PAM type: YTN; PAM sequence: TTC
tgtaactattactttatgga

SEQ ID NO: 295163 - DNA, 20 bp, Artificial Sequence
  Description of Artificial Sequence: Synthetic oligonucleotide
  Target: ATXN1; (+) strand; PAM type: YTN; PAM sequence: CTG
taactattactttatggaat

SEQ ID NO: 295164 - DNA, 20 bp, Artificial Sequence
  Description of Artificial Sequence: Synthetic oligonucleotide
  Target: ATXN1; (+) strand; PAM type: YTN; PAM sequence: CTA
ttactttatggaatagtcaa

SEQ ID NO: 295165 - DNA, 20 bp, Artificial Sequence
  Description of Artificial Sequence: Synthetic oligonucleotide
  Target: ATXN1; (+) strand; PAM type: YTN; PAM sequence: TTA
ctttatggaatagtcaacct

SEQ ID NO: 295166 - DNA, 20 bp, Artificial Sequence
  Description of Artificial Sequence: Synthetic oligonucleotide
  Target: ATXN1; (+) strand; PAM type: YTN; PAM sequence: CTT
tatggaatagtcaacctttt

SEQ ID NO: 295167 - DNA, 20 bp, Artificial Sequence
  Description of Artificial Sequence: Synthetic oligonucleotide
  Target: ATXN1; (+) strand; PAM type: YTN; PAM sequence: TTT
atggaatagtcaaccttttt

SEQ ID NO: 295168 - DNA, 20 bp, Artificial Sequence
  Description of Artificial Sequence: Synthetic oligonucleotide
  Target: ATXN1; (+) strand; PAM type: YTN; PAM sequence: TTA
tggaatagtcaacctttttt

SEQ ID NO: 295169 - DNA, 20 bp, Artificial Sequence
  Description of Artificial Sequence: Synthetic oligonucleotide
  Target: ATXN1; (+) strand; PAM type: YTN; PAM sequence: CTT
tttttcgggacgtttgagga

SEQ ID NO: 295170 - DNA, 20 bp, Artificial Sequence
  Description of Artificial Sequence: Synthetic oligonucleotide
  Target: ATXN1; (+) strand; PAM type: YTN; PAM sequence: TTT
ttttcgggacgtttgaggag

SEQ ID NO: 295171 - DNA, 20 bp, Artificial Sequence
  Description of Artificial Sequence: Synthetic oligonucleotide
  Target: ATXN1; (+) strand; PAM type: YTN; PAM sequence: TTT
tttcgggacgtttgaggagt

SEQ ID NO: 295172 - DNA, 20 bp, Artificial Sequence
  Description of Artificial Sequence: Synthetic oligonucleotide
  Target: ATXN1; (+) strand; PAM type: YTN; PAM sequence: TTT
ttcgggacgtttgaggagtt

SEQ ID NO: 295173 - DNA, 20 bp, Artificial Sequence
  Description of Artificial Sequence: Synthetic oligonucleotide
  Target: ATXN1; (+) strand; PAM type: YTN; PAM sequence: TTT
tcgggacgtttgaggagttg

SEQ ID NO: 295174 - DNA, 20 bp, Artificial Sequence
  Description of Artificial Sequence: Synthetic oligonucleotide
  Target: ATXN1; (+) strand; PAM type: YTN; PAM sequence: TTT
cgggacgtttgaggagttgt

SEQ ID NO: 295175 - DNA, 20 bp, Artificial Sequence
  Description of Artificial Sequence: Synthetic oligonucleotide
  Target: ATXN1; (+) strand; PAM type: YTN; PAM sequence: TTC
gggacgtttgaggagttgtg

SEQ ID NO: 295176 - DNA, 20 bp, Artificial Sequence
  Description of Artificial Sequence: Synthetic oligonucleotide
  Target: ATXN1; (+) strand; PAM type: YTN; PAM sequence: TTT
gaggagttgtgtctatctgt

SEQ ID NO: 295177 - DNA, 20 bp, Artificial Sequence
  Description of Artificial Sequence: Synthetic oligonucleotide
  Target: ATXN1; (+) strand; PAM type: YTN; PAM sequence: TTG
aggagttgtgtctatctgtg

SEQ ID NO: 295178 - DNA, 20 bp, Artificial Sequence
  Description of Artificial Sequence: Synthetic oligonucleotide
  Target: ATXN1; (+) strand; PAM type: YTN; PAM sequence: TTG
tgtctatctgtggttaaatt

SEQ ID NO: 295179 - DNA, 20 bp, Artificial Sequence
  Description of Artificial Sequence: Synthetic oligonucleotide
  Target: ATXN1; (+) strand; PAM type: YTN; PAM sequence: CTA
tctgtggttaaattcctggg

SEQ ID NO: 295180 - DNA, 20 bp, Artificial Sequence
  Description of Artificial Sequence: Synthetic oligonucleotide
  Target: ATXN1; (+) strand; PAM type: YTN; PAM sequence: CTG
tggttaaattcctgggaaca

SEQ ID NO: 295181 - DNA, 20 bp, Artificial Sequence
  Description of Artificial Sequence: Synthetic oligonucleotide
  Target: ATXN1; (+) strand; PAM type: YTN; PAM sequence: TTA
aattcctgggaacactaaaa

SEQ ID NO: 295182 - DNA, 20 bp, Artificial Sequence
  Description of Artificial Sequence: Synthetic oligonucleotide
  Target: ATXN1; (+) strand; PAM type: YTN; PAM sequence: TTC
ctgggaacactaaaaacttt

SEQ ID NO: 295183 - DNA, 20 bp, Artificial Sequence
  Description of Artificial Sequence: Synthetic oligonucleotide
  Target: ATXN1; (+) strand; PAM type: YTN; PAM sequence: CTG
ggaacactaaaaacttttga

SEQ ID NO: 295184 - DNA, 20 bp, Artificial Sequence
  Description of Artificial Sequence: Synthetic oligonucleotide
  Target: ATXN1; (+) strand; PAM type: YTN; PAM sequence: CTA
aaaacttttgaggaggagaa

SEQ ID NO: 295185 - DNA, 20 bp, Artificial Sequence
  Description of Artificial Sequence: Synthetic oligonucleotide
  Target: ATXN1; (+) strand; PAM type: YTN; PAM sequence: CTT
ttgaggaggagaaagtgtct

SEQ ID NO: 295186 - DNA, 20 bp, Artificial Sequence
  Description of Artificial Sequence: Synthetic oligonucleotide
  Target: ATXN1; (+) strand; PAM type: YTN; PAM sequence: TTT
tgaggaggagaaagtgtctc

SEQ ID NO: 295187 - DNA, 20 bp, Artificial Sequence
  Description of Artificial Sequence: Synthetic oligonucleotide
  Target: ATXN1; (+) strand; PAM type: YTN; PAM sequence: TTT
gaggaggagaaagtgtctct

SEQ ID NO: 295188 - DNA, 20 bp, Artificial Sequence
  Description of Artificial Sequence: Synthetic oligonucleotide
  Target: ATXN1; (+) strand; PAM type: YTN; PAM sequence: TTG
aggaggagaaagtgtctctc

SEQ ID NO: 295189 - DNA, 20 bp, Artificial Sequence
  Description of Artificial Sequence: Synthetic oligonucleotide
  Target: ATXN1; (+) strand; PAM type: YTN; PAM sequence: CTC
tccgttaatgtttaaacatg

SEQ ID NO: 295190 - DNA, 20 bp, Artificial Sequence
  Description of Artificial Sequence: Synthetic oligonucleotide
  Target: ATXN1; (+) strand; PAM type: YTN; PAM sequence: CTC
cgttaatgtttaaacatgtg

SEQ ID NO: 295191 - DNA, 20 bp, Artificial Sequence
  Description of Artificial Sequence: Synthetic oligonucleotide
  Target: ATXN1; (+) strand; PAM type: YTN; PAM sequence: TTA
atgtttaaacatgtgagttg

SEQ ID NO: 295192 - DNA, 20 bp, Artificial Sequence
  Description of Artificial Sequence: Synthetic oligonucleotide
  Target: ATXN1; (+) strand; PAM type: YTN; PAM sequence: TTT
aaacatgtgagttgagataa

SEQ ID NO: 295193 - DNA, 20 bp, Artificial Sequence
  Description of Artificial Sequence: Synthetic oligonucleotide
  Target: ATXN1; (+) strand; PAM type: YTN; PAM sequence: TTA
aacatgtgagttgagataat

SEQ ID NO: 295194 - DNA, 20 bp, Artificial Sequence
  Description of Artificial Sequence: Synthetic oligonucleotide
  Target: ATXN1; (+) strand; PAM type: YTN; PAM sequence: TTG
agataatgccattcaatttt

SEQ ID NO: 295195 - DNA, 20 bp, Artificial Sequence
  Description of Artificial Sequence: Synthetic oligonucleotide
  Target: ATXN1; (+) strand; PAM type: YTN; PAM sequence: TTC
aattttccatctagccggag

SEQ ID NO: 295196 - DNA, 20 bp, Artificial Sequence
  Description of Artificial Sequence: Synthetic oligonucleotide
  Target: ATXN1; (+) strand; PAM type: YTN; PAM sequence: TTT
tccatctagccggaggaaca

SEQ ID NO: 295197 - DNA, 20 bp, Artificial Sequence
  Description of Artificial Sequence: Synthetic oligonucleotide
  Target: ATXN1; (+) strand; PAM type: YTN; PAM sequence: TTT
ccatctagccggaggaacaa

SEQ ID NO: 295198 - DNA, 20 bp, Artificial Sequence
  Description of Artificial Sequence: Synthetic oligonucleotide
  Target: ATXN1; (+) strand; PAM type: YTN; PAM sequence: TTC
catctagccggaggaacaac

SEQ ID NO: 295199 - DNA, 20 bp, Artificial Sequence
  Description of Artificial Sequence: Synthetic oligonucleotide
  Target: ATXN1; (+) strand; PAM type: YTN; PAM sequence: CTA
gccggaggaacaactgcctg

SEQ ID NO: 295200 - DNA, 20 bp, Artificial Sequence
  Description of Artificial Sequence: Synthetic oligonucleotide
  Target: ATXN1; (+) strand; PAM type: YTN; PAM sequence: CTG
cctgaaaatggcaaaagcct

SEQ ID NO: 295201 - DNA, 20 bp, Artificial Sequence
  Description of Artificial Sequence: Synthetic oligonucleotide
  Target: ATXN1; (+) strand; PAM type: YTN; PAM sequence: CTG
aaaatggcaaaagccttttt

SEQ ID NO: 295202 - DNA, 20 bp, Artificial Sequence
  Description of Artificial Sequence: Synthetic oligonucleotide
  Target: ATXN1; (+) strand; PAM type: YTN; PAM sequence: CTT
ttttattttttggatgctat

SEQ ID NO: 295203 - DNA, 20 bp, Artificial Sequence
  Description of Artificial Sequence: Synthetic oligonucleotide
  Target: ATXN1; (+) strand; PAM type: YTN; PAM sequence: TTT
tttattttttggatgctatc

SEQ ID NO: 295204 - DNA, 20 bp, Artificial Sequence
  Description of Artificial Sequence: Synthetic oligonucleotide
  Target: ATXN1; (+) strand; PAM type: YTN; PAM sequence: TTT
ttattttttggatgctatca

SEQ ID NO: 295205 - DNA, 20 bp, Artificial Sequence
  Description of Artificial Sequence: Synthetic oligonucleotide
  Target: ATXN1; (+) strand; PAM type: YTN; PAM sequence: TTT
tattttttggatgctatcag

SEQ ID NO: 295206 - DNA, 20 bp, Artificial Sequence
  Description of Artificial Sequence: Synthetic oligonucleotide
  Target: ATXN1; (+) strand; PAM type: YTN; PAM sequence: TTT
attttttggatgctatcagt

SEQ ID NO: 295207 - DNA, 20 bp, Artificial Sequence
  Description of Artificial Sequence: Synthetic oligonucleotide
  Target: ATXN1; (+) strand; PAM type: YTN; PAM sequence: TTA
ttttttggatgctatcagta

SEQ ID NO: 295208 - DNA, 20 bp, Artificial Sequence
  Description of Artificial Sequence: Synthetic oligonucleotide
  Target: ATXN1; (+) strand; PAM type: YTN; PAM sequence: TTT
tttggatgctatcagtaccc

SEQ ID NO: 295209 - DNA, 20 bp, Artificial Sequence
  Description of Artificial Sequence: Synthetic oligonucleotide
  Target: ATXN1; (+) strand; PAM type: YTN; PAM sequence: TTT
ttggatgctatcagtaccca

SEQ ID NO: 295210 - DNA, 20 bp, Artificial Sequence
  Description of Artificial Sequence: Synthetic oligonucleotide
  Target: ATXN1; (+) strand; PAM type: YTN; PAM sequence: TTT
tggatgctatcagtacccac

SEQ ID NO: 295211 - DNA, 20 bp, Artificial Sequence
  Description of Artificial Sequence: Synthetic oligonucleotide
  Target: ATXN1; (+) strand; PAM type: YTN; PAM sequence: TTT
ggatgctatcagtacccaca

SEQ ID NO: 295212 - DNA, 20 bp, Artificial Sequence
  Description of Artificial Sequence: Synthetic oligonucleotide
  Target: ATXN1; (+) strand; PAM type: YTN; PAM sequence: TTG
gatgctatcagtacccacag

SEQ ID NO: 295213 - DNA, 20 bp, Artificial Sequence
  Description of Artificial Sequence: Synthetic oligonucleotide
  Target: ATXN1; (+) strand; PAM type: YTN; PAM sequence: CTA
tcagtacccacagaaaatgg

SEQ ID NO: 295214 - DNA, 20 bp, Artificial Sequence
  Description of Artificial Sequence: Synthetic oligonucleotide
  Target: ATXN1; (+) strand; PAM type: YTN; PAM sequence: TTG
taaggattttattagtttta

SEQ ID NO: 295215 - DNA, 20 bp, Artificial Sequence
  Description of Artificial Sequence: Synthetic oligonucleotide
  Target: ATXN1; (+) strand; PAM type: YTN; PAM sequence: TTT
tattagttttatgtaactca

SEQ ID NO: 295216 - DNA, 20 bp, Artificial Sequence
  Description of Artificial Sequence: Synthetic oligonucleotide
  Target: ATXN1; (+) strand; PAM type: YTN; PAM sequence: TTT
attagttttatgtaactcag

SEQ ID NO: 295217 - DNA, 20 bp, Artificial Sequence
  Description of Artificial Sequence: Synthetic oligonucleotide
  Target: ATXN1; (+) strand; PAM type: YTN; PAM sequence: TTA
ttagttttatgtaactcagc

SEQ ID NO: 295218 - DNA, 20 bp, Artificial Sequence
  Description of Artificial Sequence: Synthetic oligonucleotide
  Target: ATXN1; (+) strand; PAM type: YTN; PAM sequence: TTA
gttttatgtaactcagctcc

SEQ ID NO: 295219 - DNA, 20 bp, Artificial Sequence
  Description of Artificial Sequence: Synthetic oligonucleotide
  Target: ATXN1; (+) strand; PAM type: YTN; PAM sequence: TTT
tatgtaactcagctcccact

SEQ ID NO: 295220 - DNA, 20 bp, Artificial Sequence
  Description of Artificial Sequence: Synthetic oligonucleotide
  Target: ATXN1; (+) strand; PAM type: YTN; PAM sequence: TTT
atgtaactcagctcccactc

SEQ ID NO: 295221 - DNA, 20 bp, Artificial Sequence
  Description of Artificial Sequence: Synthetic oligonucleotide
  Target: ATXN1; (+) strand; PAM type: YTN; PAM sequence: TTA
tgtaactcagctcccactca

SEQ ID NO: 295222 - DNA, 20 bp, Artificial Sequence
  Description of Artificial Sequence: Synthetic oligonucleotide
  Target: ATXN1; (+) strand; PAM type: YTN; PAM sequence: CTC
agctcccactcaaatgtgta

SEQ ID NO: 295223 - DNA, 20 bp, Artificial Sequence
  Description of Artificial Sequence: Synthetic oligonucleotide
  Target: ATXN1; (+) strand; PAM type: YTN; PAM sequence: CTC
ccactcaaatgtgtaaggca

SEQ ID NO: 295224 - DNA, 20 bp, Artificial Sequence
  Description of Artificial Sequence: Synthetic oligonucleotide
  Target: ATXN1; (+) strand; PAM type: YTN; PAM sequence: CTC
aaatgtgtaaggcaacatac

SEQ ID NO: 295225 - DNA, 20 bp, Artificial Sequence
  Description of Artificial Sequence: Synthetic oligonucleotide
  Target: ATXN1; (+) strand; PAM type: YTN; PAM sequence: CTG
atagaaatcaacataagcca

SEQ ID NO: 295226 - DNA, 20 bp, Artificial Sequence
  Description of Artificial Sequence: Synthetic oligonucleotide
  Target: ATXN1; (+) strand; PAM type: YTN; PAM sequence: TTC
aaagcatgacaaactgtctt

SEQ ID NO: 295227 - DNA, 20 bp, Artificial Sequence
  Description of Artificial Sequence: Synthetic oligonucleotide
  Target: ATXN1; (+) strand; PAM type: YTN; PAM sequence: CTG
tctttactttaccggcttgg

SEQ ID NO: 295228 - DNA, 20 bp, Artificial Sequence
  Description of Artificial Sequence: Synthetic oligonucleotide
  Target: ATXN1; (+) strand; PAM type: YTN; PAM sequence: CTT
tactttaccggcttggtaaa

SEQ ID NO: 295229 - DNA, 20 bp, Artificial Sequence
  Description of Artificial Sequence: Synthetic oligonucleotide
  Target: ATXN1; (+) strand; PAM type: YTN; PAM sequence: TTT
actttaccggcttggtaaaa

SEQ ID NO: 295230 - DNA, 20 bp, Artificial Sequence
  Description of Artificial Sequence: Synthetic oligonucleotide
  Target: ATXN1; (+) strand; PAM type: YTN; PAM sequence: TTA
ctttaccggcttggtaaaaa

SEQ ID NO: 295231 - DNA, 20 bp, Artificial Sequence
  Description of Artificial Sequence: Synthetic oligonucleotide
  Target: ATXN1; (+) strand; PAM type: YTN; PAM sequence: CTT
taccggcttggtaaaaacag

SEQ ID NO: 295232 - DNA, 20 bp, Artificial Sequence
  Description of Artificial Sequence: Synthetic oligonucleotide
  Target: ATXN1; (+) strand; PAM type: YTN; PAM sequence: TTT
accggcttggtaaaaacaga

SEQ ID NO: 295233 - DNA, 20 bp, Artificial Sequence
  Description of Artificial Sequence: Synthetic oligonucleotide
  Target: ATXN1; (+) strand; PAM type: YTN; PAM sequence: TTA
ccggcttggtaaaaacagaa

SEQ ID NO: 295234 - DNA, 20 bp, Artificial Sequence
  Description of Artificial Sequence: Synthetic oligonucleotide
  Target: ATXN1; (+) strand; PAM type: YTN; PAM sequence: CTT
ggtaaaaacagaatttggag

SEQ ID NO: 295235 - DNA, 20 bp, Artificial Sequence
  Description of Artificial Sequence: Synthetic oligonucleotide
  Target: ATXN1; (+) strand; PAM type: YTN; PAM sequence: TTG
gtaaaaacagaatttggaga

SEQ ID NO: 295236 - DNA, 20 bp, Artificial Sequence
  Description of Artificial Sequence: Synthetic oligonucleotide
  Target: ATXN1; (+) strand; PAM type: YTN; PAM sequence: TTT
ggagagaggaggaggattta

SEQ ID NO: 295237 - DNA, 20 bp, Artificial Sequence
  Description of Artificial Sequence: Synthetic oligonucleotide
  Target: ATXN1; (+) strand; PAM type: YTN; PAM sequence: TTG
gagagaggaggaggatttaa

SEQ ID NO: 295238 - DNA, 20 bp, Artificial Sequence
  Description of Artificial Sequence: Synthetic oligonucleotide
  Target: ATXN1; (+) strand; PAM type: YTN; PAM sequence: TTT
aaacaagttcactgcaagtt

SEQ ID NO: 295239 - DNA, 20 bp, Artificial Sequence
  Description of Artificial Sequence: Synthetic oligonucleotide
  Target: ATXN1; (+) strand; PAM type: YTN; PAM sequence: TTA
aacaagttcactgcaagtta

SEQ ID NO: 295240 - DNA, 20 bp, Artificial Sequence
  Description of Artificial Sequence: Synthetic oligonucleotide
  Target: ATXN1; (+) strand; PAM type: YTN; PAM sequence: TTC
actgcaagttactggcttgt

SEQ ID NO: 295241 - DNA, 20 bp, Artificial Sequence
  Description of Artificial Sequence: Synthetic oligonucleotide
  Target: ATXN1; (+) strand; PAM type: YTN; PAM sequence: CTG
caagttactggcttgtatca

SEQ ID NO: 295242 - DNA, 20 bp, Artificial Sequence
  Description of Artificial Sequence: Synthetic oligonucleotide
  Target: ATXN1; (+) strand; PAM type: YTN; PAM sequence: TTA
ctggcttgtatcaatctttt

SEQ ID NO: 295243 - DNA, 20 bp, Artificial Sequence
  Description of Artificial Sequence: Synthetic oligonucleotide
  Target: ATXN1; (+) strand; PAM type: YTN; PAM sequence: CTG
gcttgtatcaatcttttctt

SEQ ID NO: 295244 - DNA, 20 bp, Artificial Sequence
  Description of Artificial Sequence: Synthetic oligonucleotide
  Target: ATXN1; (+) strand; PAM type: YTN; PAM sequence: CTT
gtatcaatcttttctttttt

SEQ ID NO: 295245 - DNA, 20 bp, Artificial Sequence
  Description of Artificial Sequence: Synthetic oligonucleotide
  Target: ATXN1; (+) strand; PAM type: YTN; PAM sequence: TTG
tatcaatcttttctttttta

SEQ ID NO: 295246 - DNA, 20 bp, Artificial Sequence
  Description of Artificial Sequence: Synthetic oligonucleotide
  Target: ATXN1; (+) strand; PAM type: YTN; PAM sequence: CTT
ttcttttttaactaaaaata

SEQ ID NO: 295247 - DNA, 20 bp, Artificial Sequence
  Description of Artificial Sequence: Synthetic oligonucleotide
  Target: ATXN1; (+) strand; PAM type: YTN; PAM sequence: TTT
tcttttttaactaaaaatat

SEQ ID NO: 295248 - DNA, 20 bp, Artificial Sequence
  Description of Artificial Sequence: Synthetic oligonucleotide
  Target: ATXN1; (+) strand; PAM type: YTN; PAM sequence: TTT
cttttttaactaaaaatatc

SEQ ID NO: 295249 - DNA, 20 bp, Artificial Sequence
  Description of Artificial Sequence: Synthetic oligonucleotide
  Target: ATXN1; (+) strand; PAM type: YTN; PAM sequence: TTC
ttttttaactaaaaatatct

SEQ ID NO: 295250 - DNA, 20 bp, Artificial Sequence
  Description of Artificial Sequence: Synthetic oligonucleotide
  Target: ATXN1; (+) strand; PAM type: YTN; PAM sequence: CTT
ttttaactaaaaatatcttg

SEQ ID NO: 295251 - DNA, 20 bp, Artificial Sequence
  Description of Artificial Sequence: Synthetic oligonucleotide
  Target: ATXN1; (+) strand; PAM type: YTN; PAM sequence: TTT
tttaactaaaaatatcttgc

SEQ ID NO: 295252 - DNA, 20 bp, Artificial Sequence
  Description of Artificial Sequence: Synthetic oligonucleotide
  Target: ATXN1; (+) strand; PAM type: YTN; PAM sequence: TTT
ttaactaaaaatatcttgct

SEQ ID NO: 295253 - DNA, 20 bp, Artificial Sequence
  Description of Artificial Sequence: Synthetic oligonucleotide
  Target: ATXN1; (+) strand; PAM type: YTN; PAM sequence: TTT
taactaaaaatatcttgctg

SEQ ID NO: 295254 - DNA, 20 bp, Artificial Sequence
  Description of Artificial Sequence: Synthetic oligonucleotide
  Target: ATXN1; (+) strand; PAM type: YTN; PAM sequence: TTT
aactaaaaatatcttgctgc

SEQ ID NO: 295255 - DNA, 20 bp, Artificial Sequence
  Description of Artificial Sequence: Synthetic oligonucleotide
  Target: ATXN1; (+) strand; PAM type: YTN; PAM sequence: TTA
actaaaaatatcttgctgca

SEQ ID NO: 295256 - DNA, 20 bp, Artificial Sequence
  Description of Artificial Sequence: Synthetic oligonucleotide
  Target: ATXN1; (+) strand; PAM type: YTN; PAM sequence: CTA
aaaatatcttgctgcatttc

SEQ ID NO: 295257 - DNA, 20 bp, Artificial Sequence
  Description of Artificial Sequence: Synthetic oligonucleotide
  Target: ATXN1; (+) strand; PAM type: YTN; PAM sequence: CTT
gctgcatttctcttatttgt

SEQ ID NO: 295258 - DNA, 20 bp, Artificial Sequence
  Description of Artificial Sequence: Synthetic oligonucleotide
  Target: ATXN1; (+) strand; PAM type: YTN; PAM sequence: TTG
ctgcatttctcttatttgtt

SEQ ID NO: 295259 - DNA, 20 bp, Artificial Sequence
  Description of Artificial Sequence: Synthetic oligonucleotide
  Target: ATXN1; (+) strand; PAM type: YTN; PAM sequence: CTG
catttctcttatttgttacc

SEQ ID NO: 295260 - DNA, 20 bp, Artificial Sequence
  Description of Artificial Sequence: Synthetic oligonucleotide
  Target: ATXN1; (+) strand; PAM type: YTN; PAM sequence: TTT
ctcttatttgttaccaactt

SEQ ID NO: 295261 - DNA, 20 bp, Artificial Sequence
  Description of Artificial Sequence: Synthetic oligonucleotide
  Target: ATXN1; (+) strand; PAM type: YTN; PAM sequence: TTC
tcttatttgttaccaacttc

SEQ ID NO: 295262 - DNA, 20 bp, Artificial Sequence
  Description of Artificial Sequence: Synthetic oligonucleotide
  Target: ATXN1; (+) strand; PAM type: YTN; PAM sequence: CTC
ttatttgttaccaacttcat

SEQ ID NO: 295263 - DNA, 20 bp, Artificial Sequence
  Description of Artificial Sequence: Synthetic oligonucleotide
  Target: ATXN1; (+) strand; PAM type: YTN; PAM sequence: CTT
atttgttaccaacttcatat

SEQ ID NO: 295264 - DNA, 20 bp, Artificial Sequence
  Description of Artificial Sequence: Synthetic oligonucleotide
  Target: ATXN1; (+) strand; PAM type: YTN; PAM sequence: TTA
tttgttaccaacttcatatc

SEQ ID NO: 295265 - DNA, 20 bp, Artificial Sequence
  Description of Artificial Sequence: Synthetic oligonucleotide
  Target: ATXN1; (+) strand; PAM type: YTN; PAM sequence: TTT
gttaccaacttcatatctcg

SEQ ID NO: 295266 - DNA, 20 bp, Artificial Sequence
  Description of Artificial Sequence: Synthetic oligonucleotide
  Target: ATXN1; (+) strand; PAM type: YTN; PAM sequence: TTG
ttaccaacttcatatctcga

SEQ ID NO: 295267 - DNA, 20 bp, Artificial Sequence
  Description of Artificial Sequence: Synthetic oligonucleotide
  Target: ATXN1; (+) strand; PAM type: YTN; PAM sequence: TTA
ccaacttcatatctcgaggt

SEQ ID NO: 295268 - DNA, 20 bp, Artificial Sequence
  Description of Artificial Sequence: Synthetic oligonucleotide
  Target: ATXN1; (+) strand; PAM type: YTN; PAM sequence: CTT
catatctcgaggtattctat

SEQ ID NO: 295269 - DNA, 20 bp, Artificial Sequence
  Description of Artificial Sequence: Synthetic oligonucleotide
  Target: ATXN1; (+) strand; PAM type: YTN; PAM sequence: TTC
atatctcgaggtattctata

SEQ ID NO: 295270 - DNA, 20 bp, Artificial Sequence
  Description of Artificial Sequence: Synthetic oligonucleotide
  Target: ATXN1; (+) strand; PAM type: YTN; PAM sequence: CTC
gaggtattctataattggaa

SEQ ID NO: 295271 - DNA, 20 bp, Artificial Sequence
  Description of Artificial Sequence: Synthetic oligonucleotide
  Target: ATXN1; (+) strand; PAM type: YTN; PAM sequence: TTC
tataattggaagaggtcctt

SEQ ID NO: 295272 - DNA, 20 bp, Artificial Sequence
  Description of Artificial Sequence: Synthetic oligonucleotide
  Target: ATXN1; (+) strand; PAM type: YTN; PAM sequence: CTA
taattggaagaggtccttga

SEQ ID NO: 295273 - DNA, 20 bp, Artificial Sequence
  Description of Artificial Sequence: Synthetic oligonucleotide
  Target: ATXN1; (+) strand; PAM type: YTN; PAM sequence: TTG
gaagaggtccttgacgtttc

SEQ ID NO: 295274 - DNA, 20 bp, Artificial Sequence
  Description of Artificial Sequence: Synthetic oligonucleotide
  Target: ATXN1; (+) strand; PAM type: YTN; PAM sequence: CTT
gacgtttcattccaatgtct

SEQ ID NO: 295275 - DNA, 20 bp, Artificial Sequence
  Description of Artificial Sequence: Synthetic oligonucleotide
  Target: ATXN1; (+) strand; PAM type: YTN; PAM sequence: TTG
acgtttcattccaatgtctt

SEQ ID NO: 295276 - DNA, 20 bp, Artificial Sequence
  Description of Artificial Sequence: Synthetic oligonucleotide
  Target: ATXN1; (+) strand; PAM type: YTN; PAM sequence: TTT
cattccaatgtcttctgcaa

SEQ ID NO: 295277 - DNA, 20 bp, Artificial Sequence
  Description of Artificial Sequence: Synthetic oligonucleotide
  Target: ATXN1; (+) strand; PAM type: YTN; PAM sequence: TTC
attccaatgtcttctgcaaa

SEQ ID NO: 295278 - DNA, 20 bp, Artificial Sequence
  Description of Artificial Sequence: Synthetic oligonucleotide
  Target: ATXN1; (+) strand; PAM type: YTN; PAM sequence: TTC
caatgtcttctgcaaaggaa

SEQ ID NO: 295279 - DNA, 20 bp, Artificial Sequence
  Description of Artificial Sequence: Synthetic oligonucleotide
  Target: ATXN1; (+) strand; PAM type: YTN; PAM sequence: CTT
ctgcaaaggaacctgctgac

SEQ ID NO: 295280 - DNA, 20 bp, Artificial Sequence
  Description of Artificial Sequence: Synthetic oligonucleotide
  Target: ATXN1; (+) strand; PAM type: YTN; PAM sequence: TTC
tgcaaaggaacctgctgacc

SEQ ID NO: 295281 - DNA, 20 bp, Artificial Sequence
  Description of Artificial Sequence: Synthetic oligonucleotide
  Target: ATXN1; (+) strand; PAM type: YTN; PAM sequence: CTG
caaaggaacctgctgaccca

SEQ ID NO: 295282 - DNA, 20 bp, Artificial Sequence
  Description of Artificial Sequence: Synthetic oligonucleotide
  Target: ATXN1; (+) strand; PAM type: YTN; PAM sequence: CTG
ctgacccagggaggttgaca

SEQ ID NO: 295283 - DNA, 20 bp, Artificial Sequence
  Description of Artificial Sequence: Synthetic oligonucleotide
  Target: ATXN1; (+) strand; PAM type: YTN; PAM sequence: CTG
acccagggaggttgacatac

SEQ ID NO: 295284 - DNA, 20 bp, Artificial Sequence
  Description of Artificial Sequence: Synthetic oligonucleotide
  Target: ATXN1; (+) strand; PAM type: YTN; PAM sequence: TTG
acatacctctttttaaagtc

SEQ ID NO: 295285 - DNA, 20 bp, Artificial Sequence
  Description of Artificial Sequence: Synthetic oligonucleotide
  Target: ATXN1; (+) strand; PAM type: YTN; PAM sequence: CTC
tttttaaagtcatacagaaa

SEQ ID NO: 295286 - DNA, 20 bp, Artificial Sequence
  Description of Artificial Sequence: Synthetic oligonucleotide
  Target: ATXN1; (+) strand; PAM type: YTN; PAM sequence: CTT
tttaaagtcatacagaaagt

SEQ ID NO: 295287 - DNA, 20 bp, Artificial Sequence
  Description of Artificial Sequence: Synthetic oligonucleotide
  Target: ATXN1; (+) strand; PAM type: YTN; PAM sequence: TTT
ttaaagtcatacagaaagtt

SEQ ID NO: 295288 - DNA, 20 bp, Artificial Sequence
  Description of Artificial Sequence: Synthetic oligonucleotide
  Target: ATXN1; (+) strand; PAM type: YTN; PAM sequence: TTT
taaagtcatacagaaagtta

SEQ ID NO: 295289 - DNA, 20 bp, Artificial Sequence
  Description of Artificial Sequence: Synthetic oligonucleotide
  Target: ATXN1; (+) strand; PAM type: YTN; PAM sequence: TTT
aaagtcatacagaaagttaa

SEQ ID NO: 295290 - DNA, 20 bp, Artificial Sequence
  Description of Artificial Sequence: Synthetic oligonucleotide
  Target: ATXN1; (+) strand; PAM type: YTN; PAM sequence: TTA
aagtcatacagaaagttaat

SEQ ID NO: 295291 - DNA, 20 bp, Artificial Sequence
  Description of Artificial Sequence: Synthetic oligonucleotide
  Target: ATXN1; (+) strand; PAM type: YTN; PAM sequence: TTA
atatgtactttgactggatt

SEQ ID NO: 295292 - DNA, 20 bp, Artificial Sequence
  Description of Artificial Sequence: Synthetic oligonucleotide
  Target: ATXN1; (+) strand; PAM type: YTN; PAM sequence: CTT
tgactggattctgggttcaa

SEQ ID NO: 295293 - DNA, 20 bp, Artificial Sequence
  Description of Artificial Sequence: Synthetic oligonucleotide
  Target: ATXN1; (+) strand; PAM type: YTN; PAM sequence: TTT
gactggattctgggttcaac

SEQ ID NO: 295294 - DNA, 20 bp, Artificial Sequence
  Description of Artificial Sequence: Synthetic oligonucleotide
  Target: ATXN1; (+) strand; PAM type: YTN; PAM sequence: TTG
actggattctgggttcaacc

SEQ ID NO: 295295 - DNA, 20 bp, Artificial Sequence
  Description of Artificial Sequence: Synthetic oligonucleotide
  Target: ATXN1; (+) strand; PAM type: YTN; PAM sequence: CTG
gattctgggttcaaccactc

SEQ ID NO: 295296 - DNA, 20 bp, Artificial Sequence
  Description of Artificial Sequence: Synthetic oligonucleotide
  Target: ATXN1; (+) strand; PAM type: YTN; PAM sequence: TTC
tgggttcaaccactcatgct

SEQ ID NO: 295297 - DNA, 20 bp, Artificial Sequence
  Description of Artificial Sequence: Synthetic oligonucleotide
  Target: ATXN1; (+) strand; PAM type: YTN; PAM sequence: CTG
ggttcaaccactcatgctca

SEQ ID NO: 295298 - DNA, 20 bp, Artificial Sequence
  Description of Artificial Sequence: Synthetic oligonucleotide
  Target: ATXN1; (+) strand; PAM type: YTN; PAM sequence: TTC
aaccactcatgctcattgac

SEQ ID NO: 295299 - DNA, 20 bp, Artificial Sequence
  Description of Artificial Sequence: Synthetic oligonucleotide
  Target: ATXN1; (+) strand; PAM type: YTN; PAM sequence: CTC
atgctcattgacgcttaatg

SEQ ID NO: 295300 - DNA, 20 bp, Artificial Sequence
  Description of Artificial Sequence: Synthetic oligonucleotide
  Target: ATXN1; (+) strand; PAM type: YTN; PAM sequence: CTC
attgacgcttaatggacata

SEQ ID NO: 295301 - DNA, 20 bp, Artificial Sequence
  Description of Artificial Sequence: Synthetic oligonucleotide
  Target: ATXN1; (+) strand; PAM type: YTN; PAM sequence: TTG
acgcttaatggacataaact

SEQ ID NO: 295302 - DNA, 20 bp, Artificial Sequence
  Description of Artificial Sequence: Synthetic oligonucleotide
  Target: ATXN1; (+) strand; PAM type: YTN; PAM sequence: CTT
aatggacataaactcattta

SEQ ID NO: 295303 - DNA, 20 bp, Artificial Sequence
  Description of Artificial Sequence: Synthetic oligonucleotide
  Target: ATXN1; (+) strand; PAM type: YTN; PAM sequence: TTA
atggacataaactcatttaa

SEQ ID NO: 295304 - DNA, 20 bp, Artificial Sequence
  Description of Artificial Sequence: Synthetic oligonucleotide
  Target: ATXN1; (+) strand; PAM type: YTN; PAM sequence: CTC
atttaatgaaatgtaatgcg

SEQ ID NO: 295305 - DNA, 20 bp, Artificial Sequence
  Description of Artificial Sequence: Synthetic oligonucleotide
  Target: ATXN1; (+) strand; PAM type: YTN; PAM sequence: TTT
aatgaaatgtaatgcggttt

SEQ ID NO: 295306 - DNA, 20 bp, Artificial Sequence
  Description of Artificial Sequence: Synthetic oligonucleotide
  Target: ATXN1; (+) strand; PAM type: YTN; PAM sequence: TTA
atgaaatgtaatgcggtttt

SEQ ID NO: 295307 - DNA, 20 bp, Artificial Sequence
  Description of Artificial Sequence: Synthetic oligonucleotide
  Target: ATXN1; (+) strand; PAM type: YTN; PAM sequence: TTT
tagtttgaaaaatttaccag

SEQ ID NO: 295308 - DNA, 20 bp, Artificial Sequence
  Description of Artificial Sequence: Synthetic oligonucleotide
  Target: ATXN1; (+) strand; PAM type: YTN; PAM sequence: TTT
agtttgaaaaatttaccagt

SEQ ID NO: 295309 - DNA, 20 bp, Artificial Sequence
  Description of Artificial Sequence: Synthetic oligonucleotide
  Target: ATXN1; (+) strand; PAM type: YTN; PAM sequence: TTA
gtttgaaaaatttaccagta

SEQ ID NO: 295310 - DNA, 20 bp, Artificial Sequence
  Description of Artificial Sequence: Synthetic oligonucleotide
  Target: ATXN1; (+) strand; PAM type: YTN; PAM sequence: TTT
gaaaaatttaccagtagcat

SEQ ID NO: 295311 - DNA, 20 bp, Artificial Sequence
  Description of Artificial Sequence: Synthetic oligonucleotide
  Target: ATXN1; (+) strand; PAM type: YTN; PAM sequence: TTG
aaaaatttaccagtagcatg

SEQ ID NO: 295312 - DNA, 20 bp, Artificial Sequence
  Description of Artificial Sequence: Synthetic oligonucleotide
  Target: ATXN1; (+) strand; PAM type: YTN; PAM sequence: TTT
accagtagcatgatacttcc

SEQ ID NO: 295313 - DNA, 20 bp, Artificial Sequence
  Description of Artificial Sequence: Synthetic oligonucleotide
  Target: ATXN1; (+) strand; PAM type: YTN; PAM sequence: TTA
ccagtagcatgatacttcct

SEQ ID NO: 295314 - DNA, 20 bp, Artificial Sequence
  Description of Artificial Sequence: Synthetic oligonucleotide
  Target: ATXN1; (+) strand; PAM type: YTN; PAM sequence: CTT
cctcatagtactctctttct

SEQ ID NO: 295315 - DNA, 20 bp, Artificial Sequence
  Description of Artificial Sequence: Synthetic oligonucleotide
  Target: ATXN1; (+) strand; PAM type: YTN; PAM sequence: TTC
ctcatagtactctctttctg

SEQ ID NO: 295316 - DNA, 20 bp, Artificial Sequence
  Description of Artificial Sequence: Synthetic oligonucleotide
  Target: ATXN1; (+) strand; PAM type: YTN; PAM sequence: CTC
atagtactctctttctgttt

SEQ ID NO: 295317 - DNA, 20 bp, Artificial Sequence
  Description of Artificial Sequence: Synthetic oligonucleotide
  Target: ATXN1; (+) strand; PAM type: YTN; PAM sequence: CTC
tctttctgttttgtttttgc

SEQ ID NO: 295318 - DNA, 20 bp, Artificial Sequence
  Description of Artificial Sequence: Synthetic oligonucleotide
  Target: ATXN1; (+) strand; PAM type: YTN; PAM sequence: CTC
tttctgttttgtttttgcca

SEQ ID NO: 295319 - DNA, 20 bp, Artificial Sequence
  Description of Artificial Sequence: Synthetic oligonucleotide
  Target: ATXN1; (+) strand; PAM type: YTN; PAM sequence: CTT
tctgttttgtttttgccata

SEQ ID NO: 295320 - DNA, 20 bp, Artificial Sequence
  Description of Artificial Sequence: Synthetic oligonucleotide
  Target: ATXN1; (+) strand; PAM type: YTN; PAM sequence: TTT
ctgttttgtttttgccataa

SEQ ID NO: 295321 - DNA, 20 bp, Artificial Sequence
  Description of Artificial Sequence: Synthetic oligonucleotide
  Target: ATXN1; (+) strand; PAM type: YTN; PAM sequence: TTC
tgttttgtttttgccataag

SEQ ID NO: 295322 - DNA, 20 bp, Artificial Sequence
  Description of Artificial Sequence: Synthetic oligonucleotide
  Target: ATXN1; (+) strand; PAM type: YTN; PAM sequence: CTG
ttttgtttttgccataagaa

SEQ ID NO: 295323 - DNA, 20 bp, Artificial Sequence
  Description of Artificial Sequence: Synthetic oligonucleotide
  Target: ATXN1; (+) strand; PAM type: YTN; PAM sequence: TTT
tgtttttgccataagaaaat

SEQ ID NO: 295324 - DNA, 20 bp, Artificial Sequence
  Description of Artificial Sequence: Synthetic oligonucleotide
  Target: ATXN1; (+) strand; PAM type: YTN; PAM sequence: TTT
gtttttgccataagaaaata

SEQ ID NO: 295325 - DNA, 20 bp, Artificial Sequence
  Description of Artificial Sequence: Synthetic oligonucleotide
  Target: ATXN1; (+) strand; PAM type: YTN; PAM sequence: TTG
tttttgccataagaaaataa

SEQ ID NO: 295326 - DNA, 20 bp, Artificial Sequence
  Description of Artificial Sequence: Synthetic oligonucleotide
  Target: ATXN1; (+) strand; PAM type: YTN; PAM sequence: TTT
ttgccataagaaaataaatt

SEQ ID NO: 295327 - DNA, 20 bp, Artificial Sequence
  Description of Artificial Sequence: Synthetic oligonucleotide
  Target: ATXN1; (+) strand; PAM type: YTN; PAM sequence: TTT
tgccataagaaaataaattc

SEQ ID NO: 295328 - DNA, 20 bp, Artificial Sequence
  Description of Artificial Sequence: Synthetic oligonucleotide
  Target: ATXN1; (+) strand; PAM type: YTN; PAM sequence: TTT
gccataagaaaataaattca

SEQ ID NO: 295329 - DNA, 20 bp, Artificial Sequence
  Description of Artificial Sequence: Synthetic oligonucleotide
  Target: ATXN1; (+) strand; PAM type: YTN; PAM sequence: TTG
ccataagaaaataaattcat

SEQ ID NO: 295330 - DNA, 20 bp, Artificial Sequence
  Description of Artificial Sequence: Synthetic oligonucleotide
  Target: ATXN1; (+) strand; PAM type: YTN; PAM sequence: TTC
atttctggattatattattt

SEQ ID NO: 295331 - DNA, 20 bp, Artificial Sequence
  Description of Artificial Sequence: Synthetic oligonucleotide
  Target: ATXN1; (+) strand; PAM type: YTN; PAM sequence: TTT
ctggattatattattttcaa

SEQ ID NO: 295332 - DNA, 20 bp, Artificial Sequence
  Description of Artificial Sequence: Synthetic oligonucleotide
  Target: ATXN1; (+) strand; PAM type: YTN; PAM sequence: TTC
tggattatattattttcaac

SEQ ID NO: 295333 - DNA, 20 bp, Artificial Sequence
  Description of Artificial Sequence: Synthetic oligonucleotide
  Target: ATXN1; (+) strand; PAM type: YTN; PAM sequence: CTG
gattatattattttcaacta

SEQ ID NO: 295334 - DNA, 20 bp, Artificial Sequence
  Description of Artificial Sequence: Synthetic oligonucleotide
  Target: ATXN1; (+) strand; PAM type: YTN; PAM sequence: TTA
tattattttcaactatcttg

SEQ ID NO: 295335 - DNA, 20 bp, Artificial Sequence
  Description of Artificial Sequence: Synthetic oligonucleotide
  Target: ATXN1; (+) strand; PAM type: YTN; PAM sequence: TTA
ttttcaactatcttgcagca

SEQ ID NO: 295336 - DNA, 20 bp, Artificial Sequence
  Description of Artificial Sequence: Synthetic oligonucleotide
  Target: ATXN1; (+) strand; PAM type: YTN; PAM sequence: TTT
tcaactatcttgcagcaaaa

SEQ ID NO: 295337 - DNA, 20 bp, Artificial Sequence
  Description of Artificial Sequence: Synthetic oligonucleotide
  Target: ATXN1; (+) strand; PAM type: YTN; PAM sequence: TTT
caactatcttgcagcaaaat

SEQ ID NO: 295338 - DNA, 20 bp, Artificial Sequence
  Description of Artificial Sequence: Synthetic oligonucleotide
  Target: ATXN1; (+) strand; PAM type: YTN; PAM sequence: TTC
aactatcttgcagcaaaatc

SEQ ID NO: 295339 - DNA, 20 bp, Artificial Sequence
  Description of Artificial Sequence: Synthetic oligonucleotide
  Target: ATXN1; (+) strand; PAM type: YTN; PAM sequence: CTA
tcttgcagcaaaatcgatct

SEQ ID NO: 295340 - DNA, 20 bp, Artificial Sequence
  Description of Artificial Sequence: Synthetic oligonucleotide
  Target: ATXN1; (+) strand; PAM type: YTN; PAM sequence: CTT
gcagcaaaatcgatctggga

SEQ ID NO: 295341 - DNA, 20 bp, Artificial Sequence
  Description of Artificial Sequence: Synthetic oligonucleotide
  Target: ATXN1; (+) strand; PAM type: YTN; PAM sequence: TTG
cagcaaaatcgatctgggag

SEQ ID NO: 295342 - DNA, 20 bp, Artificial Sequence
  Description of Artificial Sequence: Synthetic oligonucleotide
  Target: ATXN1; (+) strand; PAM type: YTN; PAM sequence: CTG
ggagaggcagaatggtccca

SEQ ID NO: 295343 - DNA, 20 bp, Artificial Sequence
  Description of Artificial Sequence: Synthetic oligonucleotide
  Target: ATXN1; (+) strand; PAM type: YTN; PAM sequence: TTT
gttactttaacaaccttcac

SEQ ID NO: 295344 - DNA, 20 bp, Artificial Sequence
  Description of Artificial Sequence: Synthetic oligonucleotide
  Target: ATXN1; (+) strand; PAM type: YTN; PAM sequence: TTG
ttactttaacaaccttcacc

SEQ ID NO: 295345 - DNA, 20 bp, Artificial Sequence
  Description of Artificial Sequence: Synthetic oligonucleotide
  Target: ATXN1; (+) strand; PAM type: YTN; PAM sequence: TTA
ctttaacaaccttcaccagc

SEQ ID NO: 295346 - DNA, 20 bp, Artificial Sequence
  Description of Artificial Sequence: Synthetic oligonucleotide
  Target: ATXN1; (+) strand; PAM type: YTN; PAM sequence: CTT
taacaaccttcaccagctgc

SEQ ID NO: 295347 - DNA, 20 bp, Artificial Sequence
  Description of Artificial Sequence: Synthetic oligonucleotide
  Target: ATXN1; (+) strand; PAM type: YTN; PAM sequence: TTT
aacaaccttcaccagctgcc

SEQ ID NO: 295348 - DNA, 20 bp, Artificial Sequence
  Description of Artificial Sequence: Synthetic oligonucleotide
  Target: ATXN1; (+) strand; PAM type: YTN; PAM sequence: TTA
acaaccttcaccagctgcca

SEQ ID NO: 295349 - DNA, 20 bp, Artificial Sequence
  Description of Artificial Sequence: Synthetic oligonucleotide
  Target: ATXN1; (+) strand; PAM type: YTN; PAM sequence: CTT
caccagctgccaaagctagg

SEQ ID NO: 295350 - DNA, 20 bp, Artificial Sequence
  Description of Artificial Sequence: Synthetic oligonucleotide
  Target: ATXN1; (+) strand; PAM type: YTN; PAM sequence: TTC
accagctgccaaagctaggt

SEQ ID NO: 295351 - DNA, 20 bp, Artificial Sequence
  Description of Artificial Sequence: Synthetic oligonucleotide
  Target: ATXN1; (+) strand; PAM type: YTN; PAM sequence: CTG
ccaaagctaggtgtccagaa

SEQ ID NO: 295352 - DNA, 20 bp, Artificial Sequence
  Description of Artificial Sequence: Synthetic oligonucleotide
  Target: ATXN1; (+) strand; PAM type: YTN; PAM sequence: CTA
ggtgtccagaaaagtaaggt

SEQ ID NO: 295353 - DNA, 20 bp, Artificial Sequence
  Description of Artificial Sequence: Synthetic oligonucleotide
  Target: ATXN1; (+) strand; PAM type: YTN; PAM sequence: TTT
atactattcatacagaaaaa

SEQ ID NO: 295354 - DNA, 20 bp, Artificial Sequence
  Description of Artificial Sequence: Synthetic oligonucleotide
  Target: ATXN1; (+) strand; PAM type: YTN; PAM sequence: TTA
tactattcatacagaaaaaa

SEQ ID NO: 295355 - DNA, 20 bp, Artificial Sequence
  Description of Artificial Sequence: Synthetic oligonucleotide
  Target: ATXN1; (+) strand; PAM type: YTN; PAM sequence: CTA
ttcatacagaaaaaaaaaat

SEQ ID NO: 295356 - DNA, 20 bp, Artificial Sequence
  Description of Artificial Sequence: Synthetic oligonucleotide
  Target: ATXN1; (+) strand; PAM type: YTN; PAM sequence: TTC
atacagaaaaaaaaaataag

SEQ ID NO: 295357 - DNA, 20 bp, Artificial Sequence
  Description of Artificial Sequence: Synthetic oligonucleotide
  Target: ATXN1; (+) strand; PAM type: YTN; PAM sequence: CTC
atctaagtgacaatattttc

SEQ ID NO: 295358 - DNA, 20 bp, Artificial Sequence
  Description of Artificial Sequence: Synthetic oligonucleotide
  Target: ATXN1; (+) strand; PAM type: YTN; PAM sequence: CTA
agtgacaatattttccattc

SEQ ID NO: 295359 - DNA, 20 bp, Artificial Sequence
  Description of Artificial Sequence: Synthetic oligonucleotide
  Target: ATXN1; (+) strand; PAM type: YTN; PAM sequence: TTT
tccattcttacttatatctg

SEQ ID NO: 295360 - DNA, 20 bp, Artificial Sequence
  Description of Artificial Sequence: Synthetic oligonucleotide
  Target: ATXN1; (+) strand; PAM type: YTN; PAM sequence: TTT
ccattcttacttatatctgt

SEQ ID NO: 295361 - DNA, 20 bp, Artificial Sequence
  Description of Artificial Sequence: Synthetic oligonucleotide
  Target: ATXN1; (+) strand; PAM type: YTN; PAM sequence: TTC
cattcttacttatatctgta

SEQ ID NO: 295362 - DNA, 20 bp, Artificial Sequence
  Description of Artificial Sequence: Synthetic oligonucleotide
  Target: ATXN1; (+) strand; PAM type: YTN; PAM sequence: TTC
ttacttatatctgtagatgt

SEQ ID NO: 295363 - DNA, 20 bp, Artificial Sequence
  Description of Artificial Sequence: Synthetic oligonucleotide
  Target: ATXN1; (+) strand; PAM type: YTN; PAM sequence: CTT
acttatatctgtagatgtga

SEQ ID NO: 295364 - DNA, 20 bp, Artificial Sequence
  Description of Artificial Sequence: Synthetic oligonucleotide
  Target: ATXN1; (+) strand; PAM type: YTN; PAM sequence: TTA
cttatatctgtagatgtgaa

SEQ ID NO: 295365 - DNA, 20 bp, Artificial Sequence
  Description of Artificial Sequence: Synthetic oligonucleotide
  Target: ATXN1; (+) strand; PAM type: YTN; PAM sequence: CTT
atatctgtagatgtgaagga

SEQ ID NO: 295366 - DNA, 20 bp, Artificial Sequence
  Description of Artificial Sequence: Synthetic oligonucleotide
  Target: ATXN1; (+) strand; PAM type: YTN; PAM sequence: TTA
tatctgtagatgtgaaggag

SEQ ID NO: 295367 - DNA, 20 bp, Artificial Sequence
  Description of Artificial Sequence: Synthetic oligonucleotide
  Target: ATXN1; (+) strand; PAM type: YTN; PAM sequence: CTG
tagatgtgaaggagttggaa

SEQ ID NO: 295368 - DNA, 20 bp, Artificial Sequence
  Description of Artificial Sequence: Synthetic oligonucleotide
  Target: ATXN1; (+) strand; PAM type: YTN; PAM sequence: TTG
gaagtgattcattctgtgat

SEQ ID NO: 295369 - DNA, 20 bp, Artificial Sequence
  Description of Artificial Sequence: Synthetic oligonucleotide
  Target: ATXN1; (+) strand; PAM type: YTN; PAM sequence: TTC
attctgtgatttatcgctga

SEQ ID NO: 295370 - DNA, 20 bp, Artificial Sequence
  Description of Artificial Sequence: Synthetic oligonucleotide
  Target: ATXN1; (+) strand; PAM type: YTN; PAM sequence: TTC
tgtgatttatcgctgacctt

SEQ ID NO: 295371 - DNA, 20 bp, Artificial Sequence
  Description of Artificial Sequence: Synthetic oligonucleotide
  Target: ATXN1; (+) strand; PAM type: YTN; PAM sequence: CTG
tgatttatcgctgaccttca

SEQ ID NO: 295372 - DNA, 20 bp, Artificial Sequence
  Description of Artificial Sequence: Synthetic oligonucleotide
  Target: ATXN1; (+) strand; PAM type: YTN; PAM sequence: TTT
atcgctgaccttcatttgca

SEQ ID NO: 295373 - DNA, 20 bp, Artificial Sequence
  Description of Artificial Sequence: Synthetic oligonucleotide
  Target: ATXN1; (+) strand; PAM type: YTN; PAM sequence: TTA
tcgctgaccttcatttgcac

SEQ ID NO: 295374 - DNA, 20 bp, Artificial Sequence
  Description of Artificial Sequence: Synthetic oligonucleotide
  Target: ATXN1; (+) strand; PAM type: YTN; PAM sequence: CTG
accttcatttgcacatacta

SEQ ID NO: 295375 - DNA, 20 bp, Artificial Sequence
  Description of Artificial Sequence: Synthetic oligonucleotide
  Target: ATXN1; (+) strand; PAM type: YTN; PAM sequence: CTT
catttgcacatactacaaca

SEQ ID NO: 295376 - DNA, 20 bp, Artificial Sequence
  Description of Artificial Sequence: Synthetic oligonucleotide
  Target: ATXN1; (+) strand; PAM type: YTN; PAM sequence: TTC
atttgcacatactacaacag

SEQ ID NO: 295377 - DNA, 20 bp, Artificial Sequence
  Description of Artificial Sequence: Synthetic oligonucleotide
  Target: ATXN1; (+) strand; PAM type: YTN; PAM sequence: TTT
gcacatactacaacagctat

SEQ ID NO: 295378 - DNA, 20 bp, Artificial Sequence
  Description of Artificial Sequence: Synthetic oligonucleotide
  Target: ATXN1; (+) strand; PAM type: YTN; PAM sequence: TTG
cacatactacaacagctatg

SEQ ID NO: 295379 - DNA, 20 bp, Artificial Sequence
  Description of Artificial Sequence: Synthetic oligonucleotide
  Target: ATXN1; (+) strand; PAM type: YTN; PAM sequence: CTA
caacagctatgaggcaactc

SEQ ID NO: 295380 - DNA, 20 bp, Artificial Sequence
  Description of Artificial Sequence: Synthetic oligonucleotide
  Target: ATXN1; (+) strand; PAM type: YTN; PAM sequence: CTA
tgaggcaactcttatcaaaa

SEQ ID NO: 295381 - DNA, 20 bp, Artificial Sequence
  Description of Artificial Sequence: Synthetic oligonucleotide
  Target: ATXN1; (+) strand; PAM type: YTN; PAM sequence: CTC
ttatcaaaagaaaacaactg

SEQ ID NO: 295382 - DNA, 20 bp, Artificial Sequence
  Description of Artificial Sequence: Synthetic oligonucleotide
  Target: ATXN1; (+) strand; PAM type: YTN; PAM sequence: CTT
atcaaaagaaaacaactgaa

SEQ ID NO: 295383 - DNA, 20 bp, Artificial Sequence
  Description of Artificial Sequence: Synthetic oligonucleotide
  Target: ATXN1; (+) strand; PAM type: YTN; PAM sequence: TTA
tcaaaagaaaacaactgaaa

SEQ ID NO: 295384 - DNA, 20 bp, Artificial Sequence
  Description of Artificial Sequence: Synthetic oligonucleotide
  Target: ATXN1; (+) strand; PAM type: YTN; PAM sequence: CTG
aaaattctacacacttcttt

SEQ ID NO: 295385 - DNA, 20 bp, Artificial Sequence
  Description of Artificial Sequence: Synthetic oligonucleotide
  Target: ATXN1; (+) strand; PAM type: YTN; PAM sequence: TTC
tacacacttctttttaagca

SEQ ID NO: 295386 - DNA, 20 bp, Artificial Sequence
  Description of Artificial Sequence: Synthetic oligonucleotide
  Target: ATXN1; (+) strand; PAM type: YTN; PAM sequence: CTA
cacacttctttttaagcaat

SEQ ID NO: 295387 - DNA, 20 bp, Artificial Sequence
  Description of Artificial Sequence: Synthetic oligonucleotide
  Target: ATXN1; (+) strand; PAM type: YTN; PAM sequence: CTT
ctttttaagcaataatttca

SEQ ID NO: 295388 - DNA, 20 bp, Artificial Sequence
  Description of Artificial Sequence: Synthetic oligonucleotide
  Target: ATXN1; (+) strand; PAM type: YTN; PAM sequence: TTC
tttttaagcaataatttcaa

SEQ ID NO: 295389 - DNA, 20 bp, Artificial Sequence
  Description of Artificial Sequence: Synthetic oligonucleotide
  Target: ATXN1; (+) strand; PAM type: YTN; PAM sequence: CTT
tttaagcaataatttcaata

SEQ ID NO: 295390 - DNA, 20 bp, Artificial Sequence
  Description of Artificial Sequence: Synthetic oligonucleotide
  Target: ATXN1; (+) strand; PAM type: YTN; PAM sequence: TTT
ttaagcaataatttcaatat

SEQ ID NO: 295391 - DNA, 20 bp, Artificial Sequence
  Description of Artificial Sequence: Synthetic oligonucleotide
  Target: ATXN1; (+) strand; PAM type: YTN; PAM sequence: TTT
taagcaataatttcaatatg

SEQ ID NO: 295392 - DNA, 20 bp, Artificial Sequence
  Description of Artificial Sequence: Synthetic oligonucleotide
  Target: ATXN1; (+) strand; PAM type: YTN; PAM sequence: TTT
aagcaataatttcaatatgc

SEQ ID NO: 295393 - DNA, 20 bp, Artificial Sequence
  Description of Artificial Sequence: Synthetic oligonucleotide
  Target: ATXN1; (+) strand; PAM type: YTN; PAM sequence: TTA
agcaataatttcaatatgct

SEQ ID NO: 295394 - DNA, 20 bp, Artificial Sequence
  Description of Artificial Sequence: Synthetic oligonucleotide
  Target: ATXN1; (+) strand; PAM type: YTN; PAM sequence: TTT
caatatgcttccctctttca

SEQ ID NO: 295395 - DNA, 20 bp, Artificial Sequence
  Description of Artificial Sequence: Synthetic oligonucleotide
  Target: ATXN1; (+) strand; PAM type: YTN; PAM sequence: TTC
aatatgcttccctctttcag

SEQ ID NO: 295396 - DNA, 20 bp, Artificial Sequence
  Description of Artificial Sequence: Synthetic oligonucleotide
  Target: ATXN1; (+) strand; PAM type: YTN; PAM sequence: CTT
ccctctttcagcaaactctt

SEQ ID NO: 295397 - DNA, 20 bp, Artificial Sequence
  Description of Artificial Sequence: Synthetic oligonucleotide
  Target: ATXN1; (+) strand; PAM type: YTN; PAM sequence: TTC
cctctttcagcaaactcttt

SEQ ID NO: 295398 - DNA, 20 bp, Artificial Sequence
  Description of Artificial Sequence: Synthetic oligonucleotide
  Target: ATXN1; (+) strand; PAM type: YTN; PAM sequence: CTC
tttcagcaaactctttatca

SEQ ID NO: 295399 - DNA, 20 bp, Artificial Sequence
  Description of Artificial Sequence: Synthetic oligonucleotide
  Target: ATXN1; (+) strand; PAM type: YTN; PAM sequence: CTT
tcagcaaactctttatcaat

SEQ ID NO: 295400 - DNA, 20 bp, Artificial Sequence
  Description of Artificial Sequence: Synthetic oligonucleotide
  Target: ATXN1; (+) strand; PAM type: YTN; PAM sequence: TTT
cagcaaactctttatcaata

SEQ ID NO: 295401 - DNA, 20 bp, Artificial Sequence
  Description of Artificial Sequence: Synthetic oligonucleotide
  Target: ATXN1; (+) strand; PAM type: YTN; PAM sequence: TTC
agcaaactctttatcaatac

SEQ ID NO: 295402 - DNA, 20 bp, Artificial Sequence
  Description of Artificial Sequence: Synthetic oligonucleotide
  Target: ATXN1; (+) strand; PAM type: YTN; PAM sequence: CTC
tttatcaataccgttaataa

SEQ ID NO: 295403 - DNA, 20 bp, Artificial Sequence
  Description of Artificial Sequence: Synthetic oligonucleotide
  Target: ATXN1; (+) strand; PAM type: YTN; PAM sequence: CTT
tatcaataccgttaataata

SEQ ID NO: 295404 - DNA, 20 bp, Artificial Sequence
  Description of Artificial Sequence: Synthetic oligonucleotide
  Target: ATXN1; (+) strand; PAM type: YTN; PAM sequence: TTT
atcaataccgttaataataa

SEQ ID NO: 295405 - DNA, 20 bp, Artificial Sequence
  Description of Artificial Sequence: Synthetic oligonucleotide
  Target: ATXN1; (+) strand; PAM type: YTN; PAM sequence: TTA
tcaataccgttaataataat

SEQ ID NO: 295406 - DNA, 20 bp, Artificial Sequence
  Description of Artificial Sequence: Synthetic oligonucleotide
  Target: ATXN1; (+) strand; PAM type: YTN; PAM sequence: TTA
ataataatcaacaaaacaaa

SEQ ID NO: 295407 - DNA, 20 bp, Artificial Sequence
  Description of Artificial Sequence: Synthetic oligonucleotide
  Target: ATXN1; (+) strand; PAM type: YTN; PAM sequence: CTG
gcttgggtttaatctctgtc

SEQ ID NO: 295408 - DNA, 20 bp, Artificial Sequence
  Description of Artificial Sequence: Synthetic oligonucleotide
  Target: ATXN1; (+) strand; PAM type: YTN; PAM sequence: CTT
gggtttaatctctgtcacct

SEQ ID NO: 295409 - DNA, 20 bp, Artificial Sequence
  Description of Artificial Sequence: Synthetic oligonucleotide
  Target: ATXN1; (+) strand; PAM type: YTN; PAM sequence: TTG
ggtttaatctctgtcaccta

SEQ ID NO: 295410 - DNA, 20 bp, Artificial Sequence
  Description of Artificial Sequence: Synthetic oligonucleotide
  Target: ATXN1; (+) strand; PAM type: YTN; PAM sequence: TTT
aatctctgtcacctatccct

SEQ ID NO: 295411 - DNA, 20 bp, Artificial Sequence
  Description of Artificial Sequence: Synthetic oligonucleotide
  Target: ATXN1; (+) strand; PAM type: YTN; PAM sequence: TTA
atctctgtcacctatccctt

SEQ ID NO: 295412 - DNA, 20 bp, Artificial Sequence
  Description of Artificial Sequence: Synthetic oligonucleotide
  Target: ATXN1; (+) strand; PAM type: YTN; PAM sequence: CTC
tgtcacctatcccttcttgt

SEQ ID NO: 295413 - DNA, 20 bp, Artificial Sequence
  Description of Artificial Sequence: Synthetic oligonucleotide
  Target: ATXN1; (+) strand; PAM type: YTN; PAM sequence: CTG
tcacctatcccttcttgttt

SEQ ID NO: 295414 - DNA, 20 bp, Artificial Sequence
  Description of Artificial Sequence: Synthetic oligonucleotide
  Target: ATXN1; (+) strand; PAM type: YTN; PAM sequence: CTA
tcccttcttgtttaccattt

SEQ ID NO: 295415 - DNA, 20 bp, Artificial Sequence
  Description of Artificial Sequence: Synthetic oligonucleotide
  Target: ATXN1; (+) strand; PAM type: YTN; PAM sequence: CTT
cttgtttaccatttgaagtt

SEQ ID NO: 295416 - DNA, 20 bp, Artificial Sequence
  Description of Artificial Sequence: Synthetic oligonucleotide
  Target: ATXN1; (+) strand; PAM type: YTN; PAM sequence: TTC
ttgtttaccatttgaagtta

SEQ ID NO: 295417 - DNA, 20 bp, Artificial Sequence
  Description of Artificial Sequence: Synthetic oligonucleotide
  Target: ATXN1; (+) strand; PAM type: YTN; PAM sequence: CTT
gtttaccatttgaagttatc

SEQ ID NO: 295418 - DNA, 20 bp, Artificial Sequence
  Description of Artificial Sequence: Synthetic oligonucleotide
  Target: ATXN1; (+) strand; PAM type: YTN; PAM sequence: TTG
tttaccatttgaagttatca

SEQ ID NO: 295419 - DNA, 20 bp, Artificial Sequence
  Description of Artificial Sequence: Synthetic oligonucleotide
  Target: ATXN1; (+) strand; PAM type: YTN; PAM sequence: TTT
accatttgaagttatcataa

SEQ ID NO: 295420 - DNA, 20 bp, Artificial Sequence
  Description of Artificial Sequence: Synthetic oligonucleotide
  Target: ATXN1; (+) strand; PAM type: YTN; PAM sequence: TTA
ccatttgaagttatcataag

SEQ ID NO: 295421 - DNA, 20 bp, Artificial Sequence
  Description of Artificial Sequence: Synthetic oligonucleotide
  Target: ATXN1; (+) strand; PAM type: YTN; PAM sequence: TTT
gaagttatcataagcaaaga

SEQ ID NO: 295422 - DNA, 20 bp, Artificial Sequence
  Description of Artificial Sequence: Synthetic oligonucleotide
  Target: ATXN1; (+) strand; PAM type: YTN; PAM sequence: TTG
aagttatcataagcaaagat

SEQ ID NO: 295423 - DNA, 20 bp, Artificial Sequence
  Description of Artificial Sequence: Synthetic oligonucleotide
  Target: ATXN1; (+) strand; PAM type: YTN; PAM sequence: TTA
tcataagcaaagataaggcc

SEQ ID NO: 295424 - DNA, 20 bp, Artificial Sequence
  Description of Artificial Sequence: Synthetic oligonucleotide
  Target: ATXN1; (+) strand; PAM type: YTN; PAM sequence: CTA
gggcattcacagatatgcct

SEQ ID NO: 295425 - DNA, 20 bp, Artificial Sequence
  Description of Artificial Sequence: Synthetic oligonucleotide
  Target: ATXN1; (+) strand; PAM type: YTN; PAM sequence: TTC
acagatatgcctgcatatgt

SEQ ID NO: 295426 - DNA, 20 bp, Artificial Sequence
  Description of Artificial Sequence: Synthetic oligonucleotide
  Target: ATXN1; (+) strand; PAM type: YTN; PAM sequence: CTG
catatgtgaaagttggctat

SEQ ID NO: 295427 - DNA, 20 bp, Artificial Sequence
  Description of Artificial Sequence: Synthetic oligonucleotide
  Target: ATXN1; (+) strand; PAM type: YTN; PAM sequence: TTG
gctatattttaaaaaggatc

SEQ ID NO: 295428 - DNA, 20 bp, Artificial Sequence
  Description of Artificial Sequence: Synthetic oligonucleotide
  Target: ATXN1; (+) strand; PAM type: YTN; PAM sequence: CTA
tattttaaaaaggatctcac

SEQ ID NO: 295429 - DNA, 20 bp, Artificial Sequence
  Description of Artificial Sequence: Synthetic oligonucleotide
  Target: ATXN1; (+) strand; PAM type: YTN; PAM sequence: TTT
taaaaaggatctcactccag

SEQ ID NO: 295430 - DNA, 20 bp, Artificial Sequence
  Description of Artificial Sequence: Synthetic oligonucleotide
  Target: ATXN1; (+) strand; PAM type: YTN; PAM sequence: TTT
aaaaaggatctcactccaga

SEQ ID NO: 295431 - DNA, 20 bp, Artificial Sequence
  Description of Artificial Sequence: Synthetic oligonucleotide
  Target: ATXN1; (+) strand; PAM type: YTN; PAM sequence: TTA
aaaaggatctcactccagag

SEQ ID NO: 295432 - DNA, 20 bp, Artificial Sequence
  Description of Artificial Sequence: Synthetic oligonucleotide
  Target: ATXN1; (+) strand; PAM type: YTN; PAM sequence: CTC
actccagagggttttccaat

SEQ ID NO: 295433 - DNA, 20 bp, Artificial Sequence
  Description of Artificial Sequence: Synthetic oligonucleotide
  Target: ATXN1; (+) strand; PAM type: YTN; PAM sequence: CTC
cagagggttttccaatttga

SEQ ID NO: 295434 - DNA, 20 bp, Artificial Sequence
  Description of Artificial Sequence: Synthetic oligonucleotide
  Target: ATXN1; (+) strand; PAM type: YTN; PAM sequence: TTT
tccaatttgatagacatttt

SEQ ID NO: 295435 - DNA, 20 bp, Artificial Sequence
  Description of Artificial Sequence: Synthetic oligonucleotide
  Target: ATXN1; (+) strand; PAM type: YTN; PAM sequence: TTT
ccaatttgatagacattttg

SEQ ID NO: 295436 - DNA, 20 bp, Artificial Sequence
  Description of Artificial Sequence: Synthetic oligonucleotide
  Target: ATXN1; (+) strand; PAM type: YTN; PAM sequence: TTC
caatttgatagacattttgg

SEQ ID NO: 295437 - DNA, 20 bp, Artificial Sequence
  Description of Artificial Sequence: Synthetic oligonucleotide
  Target: ATXN1; (+) strand; PAM type: YTN; PAM sequence: TTT
gatagacattttggtgaaaa

SEQ ID NO: 295438 - DNA, 20 bp, Artificial Sequence
  Description of Artificial Sequence: Synthetic oligonucleotide
  Target: ATXN1; (+) strand; PAM type: YTN; PAM sequence: TTG
atagacattttggtgaaaat

SEQ ID NO: 295439 - DNA, 20 bp, Artificial Sequence
  Description of Artificial Sequence: Synthetic oligonucleotide
  Target: ATXN1; (+) strand; PAM type: YTN; PAM sequence: TTT
tggtgaaaattttctgaaca

SEQ ID NO: 295440 - DNA, 20 bp, Artificial Sequence
  Description of Artificial Sequence: Synthetic oligonucleotide
  Target: ATXN1; (+) strand; PAM type: YTN; PAM sequence: TTT
ggtgaaaattttctgaacag

SEQ ID NO: 295441 - DNA, 20 bp, Artificial Sequence
  Description of Artificial Sequence: Synthetic oligonucleotide
  Target: ATXN1; (+) strand; PAM type: YTN; PAM sequence: TTG
gtgaaaattttctgaacagt

SEQ ID NO: 295442 - DNA, 20 bp, Artificial Sequence
  Description of Artificial Sequence: Synthetic oligonucleotide
  Target: ATXN1; (+) strand; PAM type: YTN; PAM sequence: TTT
tctgaacagttataagcaac

SEQ ID NO: 295443 - DNA, 20 bp, Artificial Sequence
  Description of Artificial Sequence: Synthetic oligonucleotide
  Target: ATXN1; (+) strand; PAM type: YTN; PAM sequence: TTT
ctgaacagttataagcaaca

SEQ ID NO: 295444 - DNA, 20 bp, Artificial Sequence
  Description of Artificial Sequence: Synthetic oligonucleotide
  Target: ATXN1; (+) strand; PAM type: YTN; PAM sequence: TTC
tgaacagttataagcaacag

SEQ ID NO: 295445 - DNA, 20 bp, Artificial Sequence
  Description of Artificial Sequence: Synthetic oligonucleotide
  Target: ATXN1; (+) strand; PAM type: YTN; PAM sequence: CTG
aacagttataagcaacagca

SEQ ID NO: 295446 - DNA, 20 bp, Artificial Sequence
  Description of Artificial Sequence: Synthetic oligonucleotide
  Target: ATXN1; (+) strand; PAM type: YTN; PAM sequence: TTA
taagcaacagcagcagcagc

SEQ ID NO: 295447 - DNA, 20 bp, Artificial Sequence
  Description of Artificial Sequence: Synthetic oligonucleotide
  Target: ATXN1; (+) strand; PAM type: YTN; PAM sequence: CTA
taaacagtgacctgggagtc

SEQ ID NO: 295448 - DNA, 20 bp, Artificial Sequence
  Description of Artificial Sequence: Synthetic oligonucleotide
  Target: ATXN1; (+) strand; PAM type: YTN; PAM sequence: CTG
ggagtcatgaaatatacttt

SEQ ID NO: 295449 - DNA, 20 bp, Artificial Sequence
  Description of Artificial Sequence: Synthetic oligonucleotide
  Target: ATXN1; (+) strand; PAM type: YTN; PAM sequence: CTT
tttagtcttaatgttgtagc

SEQ ID NO: 295450 - DNA, 20 bp, Artificial Sequence
  Description of Artificial Sequence: Synthetic oligonucleotide
  Target: ATXN1; (+) strand; PAM type: YTN; PAM sequence: TTT
ttagtcttaatgttgtagct

SEQ ID NO: 295451 - DNA, 20 bp, Artificial Sequence
  Description of Artificial Sequence: Synthetic oligonucleotide
  Target: ATXN1; (+) strand; PAM type: YTN; PAM sequence: TTT
tagtcttaatgttgtagcta

SEQ ID NO: 295452 - DNA, 20 bp, Artificial Sequence
  Description of Artificial Sequence: Synthetic oligonucleotide
  Target: ATXN1; (+) strand; PAM type: YTN; PAM sequence: TTT
agtcttaatgttgtagctaa

SEQ ID NO: 295453 - DNA, 20 bp, Artificial Sequence
  Description of Artificial Sequence: Synthetic oligonucleotide
  Target: ATXN1; (+) strand; PAM type: YTN; PAM sequence: TTA
gtcttaatgttgtagctaat

SEQ ID NO: 295454 - DNA, 20 bp, Artificial Sequence
  Description of Artificial Sequence: Synthetic oligonucleotide
  Target: ATXN1; (+) strand; PAM type: YTN; PAM sequence: CTT
aatgttgtagctaattggac

SEQ ID NO: 295455 - DNA, 20 bp, Artificial Sequence
  Description of Artificial Sequence: Synthetic oligonucleotide
  Target: ATXN1; (+) strand; PAM type: YTN; PAM sequence: TTA
atgttgtagctaattggact

SEQ ID NO: 295456 - DNA, 20 bp, Artificial Sequence
  Description of Artificial Sequence: Synthetic oligonucleotide
  Target: ATXN1; (+) strand; PAM type: YTN; PAM sequence: TTG
tagctaattggacttttaaa

SEQ ID NO: 295457 - DNA, 20 bp, Artificial Sequence
  Description of Artificial Sequence: Synthetic oligonucleotide
  Target: ATXN1; (+) strand; PAM type: YTN; PAM sequence: CTA
attggacttttaaatgtaag

SEQ ID NO: 295458 - DNA, 20 bp, Artificial Sequence
  Description of Artificial Sequence: Synthetic oligonucleotide
  Target: ATXN1; (+) strand; PAM type: YTN; PAM sequence: TTG
gacttttaaatgtaagtcac

SEQ ID NO: 295459 - DNA, 20 bp, Artificial Sequence
  Description of Artificial Sequence: Synthetic oligonucleotide
  Target: ATXN1; (+) strand; PAM type: YTN; PAM sequence: CTT
ttaaatgtaagtcacggcct

SEQ ID NO: 295460 - DNA, 20 bp, Artificial Sequence
  Description of Artificial Sequence: Synthetic oligonucleotide
  Target: ATXN1; (+) strand; PAM type: YTN; PAM sequence: TTT
taaatgtaagtcacggcctt

SEQ ID NO: 295461 - DNA, 20 bp, Artificial Sequence
  Description of Artificial Sequence: Synthetic oligonucleotide
  Target: ATXN1; (+) strand; PAM type: YTN; PAM sequence: TTT
aaatgtaagtcacggccttt

SEQ ID NO: 295462 - DNA, 20 bp, Artificial Sequence
  Description of Artificial Sequence: Synthetic oligonucleotide
  Target: ATXN1; (+) strand; PAM type: YTN; PAM sequence: TTA
aatgtaagtcacggcctttt

SEQ ID NO: 295463 - DNA, 20 bp, Artificial Sequence
  Description of Artificial Sequence: Synthetic oligonucleotide
  Target: ATXN1; (+) strand; PAM type: YTN; PAM sequence: CTT
ttaaataaaattagttccta

SEQ ID NO: 295464 - DNA, 20 bp, Artificial Sequence
  Description of Artificial Sequence: Synthetic oligonucleotide
  Target: ATXN1; (+) strand; PAM type: YTN; PAM sequence: TTT
taaataaaattagttcctaa

SEQ ID NO: 295465 - DNA, 20 bp, Artificial Sequence
  Description of Artificial Sequence: Synthetic oligonucleotide
  Target: ATXN1; (+) strand; PAM type: YTN; PAM sequence: TTT
aaataaaattagttcctaat

SEQ ID NO: 295466 - DNA, 20 bp, Artificial Sequence
  Description of Artificial Sequence: Synthetic oligonucleotide
  Target: ATXN1; (+) strand; PAM type: YTN; PAM sequence: TTA
aataaaattagttcctaatc

SEQ ID NO: 295467 - DNA, 20 bp, Artificial Sequence
  Description of Artificial Sequence: Synthetic oligonucleotide
  Target: ATXN1; (+) strand; PAM type: YTN; PAM sequence: TTA
gttcctaatctatcaaataa

SEQ ID NO: 295468 - DNA, 20 bp, Artificial Sequence
  Description of Artificial Sequence: Synthetic oligonucleotide
  Target: ATXN1; (+) strand; PAM type: YTN; PAM sequence: TTC
ctaatctatcaaataaagga

SEQ ID NO: 295469 - DNA, 20 bp, Artificial Sequence
  Description of Artificial Sequence: Synthetic oligonucleotide
  Target: ATXN1; (+) strand; PAM type: YTN; PAM sequence: CTA
atctatcaaataaaggaact

SEQ ID NO: 295470 - DNA, 20 bp, Artificial Sequence
  Description of Artificial Sequence: Synthetic oligonucleotide
  Target: ATXN1; (+) strand; PAM type: YTN; PAM sequence: CTA
tcaaataaaggaacttatta

SEQ ID NO: 295471 - DNA, 20 bp, Artificial Sequence
  Description of Artificial Sequence: Synthetic oligonucleotide
  Target: ATXN1; (+) strand; PAM type: YTN; PAM sequence: CTT
attaaatgtttgccataatt

SEQ ID NO: 295472 - DNA, 20 bp, Artificial Sequence
  Description of Artificial Sequence: Synthetic oligonucleotide
  Target: ATXN1; (+) strand; PAM type: YTN; PAM sequence: TTA
ttaaatgtttgccataatta

SEQ ID NO: 295473 - DNA, 20 bp, Artificial Sequence
  Description of Artificial Sequence: Synthetic oligonucleotide
  Target: ATXN1; (+) strand; PAM type: YTN; PAM sequence: TTA
aatgtttgccataattaatt

SEQ ID NO: 295474 - DNA, 20 bp, Artificial Sequence
  Description of Artificial Sequence: Synthetic oligonucleotide
  Target: ATXN1; (+) strand; PAM type: YTN; PAM sequence: TTT
gccataattaattctcaatt

SEQ ID NO: 295475 - DNA, 20 bp, Artificial Sequence
  Description of Artificial Sequence: Synthetic oligonucleotide
  Target: ATXN1; (+) strand; PAM type: YTN; PAM sequence: TTG
ccataattaattctcaatta

SEQ ID NO: 295476 - DNA, 20 bp, Artificial Sequence
  Description of Artificial Sequence: Synthetic oligonucleotide
  Target: ATXN1; (+) strand; PAM type: YTN; PAM sequence: TTA
attctcaattataatttgtt

SEQ ID NO: 295477 - DNA, 20 bp, Artificial Sequence
  Description of Artificial Sequence: Synthetic oligonucleotide
  Target: ATXN1; (+) strand; PAM type: YTN; PAM sequence: TTC
tcaattataatttgttttta

SEQ ID NO: 295478 - DNA, 20 bp, Artificial Sequence
  Description of Artificial Sequence: Synthetic oligonucleotide
  Target: ATXN1; (+) strand; PAM type: YTN; PAM sequence: CTC
aattataatttgtttttaca

SEQ ID NO: 295479 - DNA, 20 bp, Artificial Sequence
  Description of Artificial Sequence: Synthetic oligonucleotide
  Target: ATXN1; (+) strand; PAM type: YTN; PAM sequence: TTA
taatttgtttttacatgtat

SEQ ID NO: 295480 - DNA, 20 bp, Artificial Sequence
  Description of Artificial Sequence: Synthetic oligonucleotide
  Target: ATXN1; (+) strand; PAM type: YTN; PAM sequence: TTT
gtttttacatgtatttgaat

SEQ ID NO: 295481 - DNA, 20 bp, Artificial Sequence
  Description of Artificial Sequence: Synthetic oligonucleotide
  Target: ATXN1; (+) strand; PAM type: YTN; PAM sequence: TTG
tttttacatgtatttgaatg

SEQ ID NO: 295482 - DNA, 20 bp, Artificial Sequence
  Description of Artificial Sequence: Synthetic oligonucleotide
  Target: ATXN1; (+) strand; PAM type: YTN; PAM sequence: TTT
ttacatgtatttgaatgttt

SEQ ID NO: 295483 - DNA, 20 bp, Artificial Sequence
  Description of Artificial Sequence: Synthetic oligonucleotide
  Target: ATXN1; (+) strand; PAM type: YTN; PAM sequence: TTT
tacatgtatttgaatgtttc

SEQ ID NO: 295484 - DNA, 20 bp, Artificial Sequence
  Description of Artificial Sequence: Synthetic oligonucleotide
  Target: ATXN1; (+) strand; PAM type: YTN; PAM sequence: TTT
acatgtatttgaatgtttca

SEQ ID NO: 295485 - DNA, 20 bp, Artificial Sequence
  Description of Artificial Sequence: Synthetic oligonucleotide
  Target: ATXN1; (+) strand; PAM type: YTN; PAM sequence: TTA
catgtatttgaatgtttcaa

SEQ ID NO: 295486 - DNA, 20 bp, Artificial Sequence
  Description of Artificial Sequence: Synthetic oligonucleotide
  Target: ATXN1; (+) strand; PAM type: YTN; PAM sequence: TTT
gaatgtttcaaatcaaataa

SEQ ID NO: 295487 - DNA, 20 bp, Artificial Sequence
  Description of Artificial Sequence: Synthetic oligonucleotide
  Target: ATXN1; (+) strand; PAM type: YTN; PAM sequence: TTG
aatgtttcaaatcaaataaa

SEQ ID NO: 295488 - DNA, 20 bp, Artificial Sequence
  Description of Artificial Sequence: Synthetic oligonucleotide
  Target: ATXN1; (+) strand; PAM type: YTN; PAM sequence: TTT
caaatcaaataaaatcataa

SEQ ID NO: 295489 - DNA, 20 bp, Artificial Sequence
  Description of Artificial Sequence: Synthetic oligonucleotide
  Target: ATXN1; (+) strand; PAM type: YTN; PAM sequence: TTC
aaatcaaataaaatcataac

SEQ ID NO: 295490 - DNA, 20 bp, Artificial Sequence
  Description of Artificial Sequence: Synthetic oligonucleotide
  Target: ATXN1; (+) strand; PAM type: YTN; PAM sequence: CTA
tcttatatgatttactagac

SEQ ID NO: 295491 - DNA, 20 bp, Artificial Sequence
  Description of Artificial Sequence: Synthetic oligonucleotide
  Target: ATXN1; (+) strand; PAM type: YTN; PAM sequence: CTT
atatgatttactagacccac

SEQ ID NO: 295492 - DNA, 20 bp, Artificial Sequence
  Description of Artificial Sequence: Synthetic oligonucleotide
  Target: ATXN1; (+) strand; PAM type: YTN; PAM sequence: TTA
tatgatttactagacccact

SEQ ID NO: 295493 - DNA, 20 bp, Artificial Sequence
  Description of Artificial Sequence: Synthetic oligonucleotide
  Target: ATXN1; (+) strand; PAM type: YTN; PAM sequence: TTT
actagacccactaagtatat

SEQ ID NO: 295494 - DNA, 20 bp, Artificial Sequence
  Description of Artificial Sequence: Synthetic oligonucleotide
  Target: ATXN1; (+) strand; PAM type: YTN; PAM sequence: TTA
ctagacccactaagtatatc

SEQ ID NO: 295495 - DNA, 20 bp, Artificial Sequence
  Description of Artificial Sequence: Synthetic oligonucleotide
  Target: ATXN1; (+) strand; PAM type: YTN; PAM sequence: CTA
gacccactaagtatatcttt

SEQ ID NO: 295496 - DNA, 20 bp, Artificial Sequence
  Description of Artificial Sequence: Synthetic oligonucleotide
  Target: ATXN1; (+) strand; PAM type: YTN; PAM sequence: CTA
agtatatctttattcaaaaa

SEQ ID NO: 295497 - DNA, 20 bp, Artificial Sequence
  Description of Artificial Sequence: Synthetic oligonucleotide
  Target: ATXN1; (+) strand; PAM type: YTN; PAM sequence: CTT
tattcaaaaatgcaacaatt

SEQ ID NO: 295498 - DNA, 20 bp, Artificial Sequence
  Description of Artificial Sequence: Synthetic oligonucleotide
  Target: ATXN1; (+) strand; PAM type: YTN; PAM sequence: TTT
attcaaaaatgcaacaatta

SEQ ID NO: 295499 - DNA, 20 bp, Artificial Sequence
  Description of Artificial Sequence: Synthetic oligonucleotide
  Target: ATXN1; (+) strand; PAM type: YTN; PAM sequence: TTA
ttcaaaaatgcaacaattag

SEQ ID NO: 295500 - DNA, 20 bp, Artificial Sequence
  Description of Artificial Sequence: Synthetic oligonucleotide
  Target: ATXN1; (+) strand; PAM type: YTN; PAM sequence: TTC
aaaaatgcaacaattagaca

SEQ ID NO: 295501 - DNA, 20 bp, Artificial Sequence
  Description of Artificial Sequence: Synthetic oligonucleotide
  Target: ATXN1; (+) strand; PAM type: YTN; PAM sequence: TTA
gacacagattgcataataag

SEQ ID NO: 295502 - DNA, 20 bp, Artificial Sequence
  Description of Artificial Sequence: Synthetic oligonucleotide
  Target: ATXN1; (+) strand; PAM type: YTN; PAM sequence: TTG
cataataagagacaaacagg

SEQ ID NO: 295503 - DNA, 20 bp, Artificial Sequence
  Description of Artificial Sequence: Synthetic oligonucleotide
  Target: ATXN1; (+) strand; PAM type: YTN; PAM sequence: TTC
tcagtagaatatcaactcag

SEQ ID NO: 295504 - DNA, 20 bp, Artificial Sequence
  Description of Artificial Sequence: Synthetic oligonucleotide
  Target: ATXN1; (+) strand; PAM type: YTN; PAM sequence: CTC
agtagaatatcaactcaggg

SEQ ID NO: 295505 - DNA, 20 bp, Artificial Sequence
  Description of Artificial Sequence: Synthetic oligonucleotide
  Target: ATXN1; (+) strand; PAM type: YTN; PAM sequence: CTC
agggaaaaaagaggtttatt

SEQ ID NO: 295506 - DNA, 20 bp, Artificial Sequence
  Description of Artificial Sequence: Synthetic oligonucleotide
  Target: ATXN1; (+) strand; PAM type: YTN; PAM sequence: TTT
attttgttttggtttttttt

SEQ ID NO: 295507 - DNA, 20 bp, Artificial Sequence
  Description of Artificial Sequence: Synthetic oligonucleotide
  Target: ATXN1; (+) strand; PAM type: YTN; PAM sequence: TTA
ttttgttttggttttttttt

SEQ ID NO: 295508 - DNA, 20 bp, Artificial Sequence
  Description of Artificial Sequence: Synthetic oligonucleotide
  Target: ATXN1; (+) strand; PAM type: YTN; PAM sequence: TTT
tgttttggtttttttttttt

SEQ ID NO: 295509 - DNA, 20 bp, Artificial Sequence
  Description of Artificial Sequence: Synthetic oligonucleotide
  Target: ATXN1; (+) strand; PAM type: YTN; PAM sequence: TTT
gttttggttttttttttttt

SEQ ID NO: 295510 - DNA, 20 bp, Artificial Sequence
  Description of Artificial Sequence: Synthetic oligonucleotide
  Target: ATXN1; (+) strand; PAM type: YTN; PAM sequence: TTG
ttttggtttttttttttttt

SEQ ID NO: 295511 - DNA, 20 bp, Artificial Sequence
  Description of Artificial Sequence: Synthetic oligonucleotide
  Target: ATXN1; (+) strand; PAM type: YTN; PAM sequence: TTT
tggttttttttttttttttt

SEQ ID NO: 295512 - DNA, 20 bp, Artificial Sequence
  Description of Artificial Sequence: Synthetic oligonucleotide
  Target: ATXN1; (+) strand; PAM type: YTN; PAM sequence: TTT
ggtttttttttttttttttt

SEQ ID NO: 295513 - DNA, 20 bp, Artificial Sequence
  Description of Artificial Sequence: Synthetic oligonucleotide
  Target: ATXN1; (+) strand; PAM type: YTN; PAM sequence: TTG
gttttttttttttttttttt

SEQ ID NO: 295514 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 295515 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 295516 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttg

SEQ ID NO: 295517 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttttga

SEQ ID NO: 295518 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttgag

SEQ ID NO: 295519 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttgaga

SEQ ID NO: 295520 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttgagac

SEQ ID NO: 295521 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttgagaca

SEQ ID NO: 295522 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgagacag

SEQ ID NO: 295523 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgagacaga

SEQ ID NO: 295524 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgagacagag

SEQ ID NO: 295525 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgagacagagt

SEQ ID NO: 295526 - DNA, 20 bp, Artificial Sequence
  Description of Artificial Sequence: Synthetic oligonucleotide
  Target: ATXN1; (+) strand; PAM type: YTN; PAM sequence: TTT
tttttttttgagacagagtt

SEQ ID NO: 295527 - DNA, 20 bp, Artificial Sequence
  Description of Artificial Sequence: Synthetic oligonucleotide
  Target: ATXN1; (+) strand; PAM type: YTN; PAM sequence: TTT
ttttttttgagacagagttt

SEQ ID NO: 295528 - DNA, 20 bp, Artificial Sequence
  Description of Artificial Sequence: Synthetic oligonucleotide
  Target: ATXN1; (+) strand; PAM type: YTN; PAM sequence: TTT
tttttttgagacagagtttt

SEQ ID NO: 295529 - DNA, 20 bp, Artificial Sequence
  Description of Artificial Sequence: Synthetic oligonucleotide
  Target: ATXN1; (+) strand; PAM type: YTN; PAM sequence: TTT
ttttttgagacagagttttg

SEQ ID NO: 295530 - DNA, 20 bp, Artificial Sequence
  Description of Artificial Sequence: Synthetic oligonucleotide
  Target: ATXN1; (+) strand; PAM type: YTN; PAM sequence: TTT
tttttgagacagagttttgc

SEQ ID NO: 295531 - DNA, 20 bp, Artificial Sequence
  Description of Artificial Sequence: Synthetic oligonucleotide
  Target: ATXN1; (+) strand; PAM type: YTN; PAM sequence: TTT
ttttgagacagagttttgct

SEQ ID NO: 295532 - DNA, 20 bp, Artificial Sequence
  Description of Artificial Sequence: Synthetic oligonucleotide
  Target: ATXN1; (+) strand; PAM type: YTN; PAM sequence: TTT
tttgagacagagttttgctc

SEQ ID NO: 295533 - DNA, 20 bp, Artificial Sequence
  Description of Artificial Sequence: Synthetic oligonucleotide
  Target: ATXN1; (+) strand; PAM type: YTN; PAM sequence: TTT
ttgagacagagttttgctct

SEQ ID NO: 295534 - DNA, 20 bp, Artificial Sequence
  Description of Artificial Sequence: Synthetic oligonucleotide
  Target: ATXN1; (+) strand; PAM type: YTN; PAM sequence: TTT
tgagacagagttttgctctt

SEQ ID NO: 295535 - DNA, 20 bp, Artificial Sequence
  Description of Artificial Sequence: Synthetic oligonucleotide
  Target: ATXN1; (+) strand; PAM type: YTN; PAM sequence: TTT
gagacagagttttgctcttt

SEQ ID NO: 295536 - DNA, 20 bp, Artificial Sequence
  Description of Artificial Sequence: Synthetic oligonucleotide
  Target: ATXN1; (+) strand; PAM type: YTN; PAM sequence: TTG
agacagagttttgctctttc

SEQ ID NO: 295537 - DNA, 20 bp, Artificial Sequence
  Description of Artificial Sequence: Synthetic oligonucleotide
  Target: ATXN1; (+) strand; PAM type: YTN; PAM sequence: TTT
tgctctttcacccaggctgg

SEQ ID NO: 295538 - DNA, 20 bp, Artificial Sequence
  Description of Artificial Sequence: Synthetic oligonucleotide
  Target: ATXN1; (+) strand; PAM type: YTN; PAM sequence: TTT
gctctttcacccaggctgga

SEQ ID NO: 295539 - DNA, 20 bp, Artificial Sequence
  Description of Artificial Sequence: Synthetic oligonucleotide
  Target: ATXN1; (+) strand; PAM type: YTN; PAM sequence: TTG
ctctttcacccaggctggag

SEQ ID NO: 295540 - DNA, 20 bp, Artificial Sequence
  Description of Artificial Sequence: Synthetic oligonucleotide
  Target: ATXN1; (+) strand; PAM type: YTN; PAM sequence: CTC
tttcacccaggctggagtgc

SEQ ID NO: 295541 - DNA, 20 bp, Artificial Sequence
  Description of Artificial Sequence: Synthetic oligonucleotide
  Target: ATXN1; (+) strand; PAM type: YTN; PAM sequence: CTT
tcacccaggctggagtgcag

SEQ ID NO: 295542 - DNA, 20 bp, Artificial Sequence
  Description of Artificial Sequence: Synthetic oligonucleotide
  Target: ATXN1; (+) strand; PAM type: YTN; PAM sequence: TTT
cacccaggctggagtgcagt

SEQ ID NO: 295543 - DNA, 20 bp, Artificial Sequence
  Description of Artificial Sequence: Synthetic oligonucleotide
  Target: ATXN1; (+) strand; PAM type: YTN; PAM sequence: TTC
acccaggctggagtgcagtg

SEQ ID NO: 295544 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggagtgatctc

SEQ ID NO: 295545 - DNA, 20 bp, Artificial Sequence
  Description of Artificial Sequence: Synthetic oligonucleotide
  Target: ATXN1; (+) strand; PAM type: YTN; PAM sequence: CTC
agctcactgcaacctctgcc

SEQ ID NO: 295546 - DNA, 20 bp, Artificial Sequence
  Description of Artificial Sequence: Synthetic oligonucleotide
  Target: ATXN1; (+) strand; PAM type: YTN; PAM sequence: CTC
actgcaacctctgccttctg

SEQ ID NO: 295547 - DNA, 20 bp, Artificial Sequence
  Description of Artificial Sequence: Synthetic oligonucleotide
  Target: ATXN1; (+) strand; PAM type: YTN; PAM sequence: CTG
caacctctgccttctggttt

SEQ ID NO: 295548 - DNA, 20 bp, Artificial Sequence
  Description of Artificial Sequence: Synthetic oligonucleotide
  Target: ATXN1; (+) strand; PAM type: YTN; PAM sequence: CTC
tgccttctggtttcaagcaa

SEQ ID NO: 295549 - DNA, 20 bp, Artificial Sequence
  Description of Artificial Sequence: Synthetic oligonucleotide
  Target: ATXN1; (+) strand; PAM type: YTN; PAM sequence: CTG
ccttctggtttcaagcaatt

SEQ ID NO: 295550 - DNA, 20 bp, Artificial Sequence
  Description of Artificial Sequence: Synthetic oligonucleotide
  Target: ATXN1; (+) strand; PAM type: YTN; PAM sequence: CTT
ctggtttcaagcaattctcc

SEQ ID NO: 295551 - DNA, 20 bp, Artificial Sequence
  Description of Artificial Sequence: Synthetic oligonucleotide
  Target: ATXN1; (+) strand; PAM type: YTN; PAM sequence: TTC
tggtttcaagcaattctcct

SEQ ID NO: 295552 - DNA, 20 bp, Artificial Sequence
  Description of Artificial Sequence: Synthetic oligonucleotide
  Target: ATXN1; (+) strand; PAM type: YTN; PAM sequence: CTG
gtttcaagcaattctcctgc

SEQ ID NO: 295553 - DNA, 20 bp, Artificial Sequence
  Description of Artificial Sequence: Synthetic oligonucleotide
  Target: ATXN1; (+) strand; PAM type: YTN; PAM sequence: TTT
caagcaattctcctgcctca

SEQ ID NO: 295554 - DNA, 20 bp, Artificial Sequence
  Description of Artificial Sequence: Synthetic oligonucleotide
  Target: ATXN1; (+) strand; PAM type: YTN; PAM sequence: TTC
aagcaattctcctgcctcag

SEQ ID NO: 295555 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcaggctcccaag

SEQ ID NO: 295556 - DNA, 20 bp, Artificial Sequence
  Description of Artificial Sequence: Synthetic oligonucleotide
  Target: ATXN1; (+) strand; PAM type: YTN; PAM sequence: CTC
ctgcctcaggctcccaagta

SEQ ID NO: 295557 - DNA, 20 bp, Artificial Sequence
  Description of Artificial Sequence: Synthetic oligonucleotide
  Target: ATXN1; (+) strand; PAM type: YTN; PAM sequence: CTG
cctcaggctcccaagtagct

SEQ ID NO: 295558 - DNA, 20 bp, Artificial Sequence
  Description of Artificial Sequence: Synthetic oligonucleotide
  Target: ATXN1; (+) strand; PAM type: YTN; PAM sequence: CTC
aggctcccaagtagctagga

SEQ ID NO: 295559 - DNA, 20 bp, Artificial Sequence
  Description of Artificial Sequence: Synthetic oligonucleotide
  Target: ATXN1; (+) strand; PAM type: YTN; PAM sequence: CTC
ccaagtagctaggatcatag

SEQ ID NO: 295560 - DNA, 20 bp, Artificial Sequence
  Description of Artificial Sequence: Synthetic oligonucleotide
  Target: ATXN1; (+) strand; PAM type: YTN; PAM sequence: CTA
ggatcataggtgcccaccac

SEQ ID NO: 295561 - DNA, 20 bp, Artificial Sequence
  Description of Artificial Sequence: Synthetic oligonucleotide
  Target: ATXN1; (+) strand; PAM type: YTN; PAM sequence: CTA
atttttgtatttttagtgga

SEQ ID NO: 295562 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtggagacg

SEQ ID NO: 295563 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtggagacgg

SEQ ID NO: 295564 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtggagacggg

SEQ ID NO: 295565 - DNA, 20 bp, Artificial Sequence
  Description of Artificial Sequence: Synthetic oligonucleotide
  Target: ATXN1; (+) strand; PAM type: YTN; PAM sequence: TTG
tatttttagtggagacggga

SEQ ID NO: 295566 - DNA, 20 bp, Artificial Sequence
  Description of Artificial Sequence: Synthetic oligonucleotide
  Target: ATXN1; (+) strand; PAM type: YTN; PAM sequence: TTT
ttagtggagacgggatttca

SEQ ID NO: 295567 - DNA, 20 bp, Artificial Sequence
  Description of Artificial Sequence: Synthetic oligonucleotide
  Target: ATXN1; (+) strand; PAM type: YTN; PAM sequence: TTT
tagtggagacgggatttcac

SEQ ID NO: 295568 - DNA, 20 bp, Artificial Sequence
  Description of Artificial Sequence: Synthetic oligonucleotide
  Target: ATXN1; (+) strand; PAM type: YTN; PAM sequence: TTT
agtggagacgggatttcacc

SEQ ID NO: 295569 - DNA, 20 bp, Artificial Sequence
  Description of Artificial Sequence: Synthetic oligonucleotide
  Target: ATXN1; (+) strand; PAM type: YTN; PAM sequence: TTA
gtggagacgggatttcacca

SEQ ID NO: 295570 - DNA, 20 bp, Artificial Sequence
  Description of Artificial Sequence: Synthetic oligonucleotide
  Target: ATXN1; (+) strand; PAM type: YTN; PAM sequence: TTT
caccatgttggccaggctgg

SEQ ID NO: 295571 - DNA, 20 bp, Artificial Sequence
  Description of Artificial Sequence: Synthetic oligonucleotide
  Target: ATXN1; (+) strand; PAM type: YTN; PAM sequence: TTC
accatgttggccaggctggt

SEQ ID NO: 295572 - DNA, 20 bp, Artificial Sequence
  Description of Artificial Sequence: Synthetic oligonucleotide
  Target: ATXN1; (+) strand; PAM type: YTN; PAM sequence: TTG
gccaggctggtcttgaactc

SEQ ID NO: 295573 - DNA, 20 bp, Artificial Sequence
  Description of Artificial Sequence: Synthetic oligonucleotide
  Target: ATXN1; (+) strand; PAM type: YTN; PAM sequence: CTG
gtcttgaactcctgacctcg

SEQ ID NO: 295574 - DNA, 20 bp, Artificial Sequence
  Description of Artificial Sequence: Synthetic oligonucleotide
  Target: ATXN1; (+) strand; PAM type: YTN; PAM sequence: CTT
gaactcctgacctcgtgatt

SEQ ID NO: 295575 - DNA, 20 bp, Artificial Sequence
  Description of Artificial Sequence: Synthetic oligonucleotide
  Target: ATXN1; (+) strand; PAM type: YTN; PAM sequence: TTG
aactcctgacctcgtgattc

SEQ ID NO: 295576 - DNA, 20 bp, Artificial Sequence
  Description of Artificial Sequence: Synthetic oligonucleotide
  Target: ATXN1; (+) strand; PAM type: YTN; PAM sequence: CTC
ctgacctcgtgattcacccg

SEQ ID NO: 295577 - DNA, 20 bp, Artificial Sequence
  Description of Artificial Sequence: Synthetic oligonucleotide
  Target: ATXN1; (+) strand; PAM type: YTN; PAM sequence: CTG
acctcgtgattcacccgctt

SEQ ID NO: 295578 - DNA, 20 bp, Artificial Sequence
  Description of Artificial Sequence: Synthetic oligonucleotide
  Target: ATXN1; (+) strand; PAM type: YTN; PAM sequence: CTC
gtgattcacccgctttgacc

SEQ ID NO: 295579 - DNA, 20 bp, Artificial Sequence
  Description of Artificial Sequence: Synthetic oligonucleotide
  Target: ATXN1; (+) strand; PAM type: YTN; PAM sequence: TTC
acccgctttgacctcccaaa

SEQ ID NO: 295580 - DNA, 20 bp, Artificial Sequence
  Description of Artificial Sequence: Synthetic oligonucleotide
  Target: ATXN1; (+) strand; PAM type: YTN; PAM sequence: CTT
tgacctcccaaagtgctggg

SEQ ID NO: 295581 - DNA, 20 bp, Artificial Sequence
  Description of Artificial Sequence: Synthetic oligonucleotide
  Target: ATXN1; (+) strand; PAM type: YTN; PAM sequence: TTT
gacctcccaaagtgctggga

SEQ ID NO: 295582 - DNA, 20 bp, Artificial Sequence
  Description of Artificial Sequence: Synthetic oligonucleotide
  Target: ATXN1; (+) strand; PAM type: YTN; PAM sequence: TTG
acctcccaaagtgctgggat

SEQ ID NO: 295583 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattacag

SEQ ID NO: 295584 - DNA, 20 bp, Artificial Sequence
  Description of Artificial Sequence: Synthetic oligonucleotide
  Target: ATXN1; (+) strand; PAM type: YTN; PAM sequence: CTG
ggattacagatgtgagccac

SEQ ID NO: 295585 - DNA, 20 bp, Artificial Sequence
  Description of Artificial Sequence: Synthetic oligonucleotide
  Target: ATXN1; (+) strand; PAM type: YTN; PAM sequence: TTA
cagatgtgagccaccgcacc

SEQ ID NO: 295586 - DNA, 20 bp, Artificial Sequence
  Description of Artificial Sequence: Synthetic oligonucleotide
  Target: ATXN1; (+) strand; PAM type: YTN; PAM sequence: CTG
gcccaggaaaagggtattgt

SEQ ID NO: 295587 - DNA, 20 bp, Artificial Sequence
  Description of Artificial Sequence: Synthetic oligonucleotide
  Target: ATXN1; (+) strand; PAM type: YTN; PAM sequence: TTG
taatcaataaatagtgctgg

SEQ ID NO: 295588 - DNA, 20 bp, Artificial Sequence
  Description of Artificial Sequence: Synthetic oligonucleotide
  Target: ATXN1; (+) strand; PAM type: YTN; PAM sequence: CTG
ggaaacctggctcttcgttt

SEQ ID NO: 295589 - DNA, 20 bp, Artificial Sequence
  Description of Artificial Sequence: Synthetic oligonucleotide
  Target: ATXN1; (+) strand; PAM type: YTN; PAM sequence: CTG
gctcttcgtttcgaaagaga

SEQ ID NO: 295590 - DNA, 20 bp, Artificial Sequence
  Description of Artificial Sequence: Synthetic oligonucleotide
  Target: ATXN1; (+) strand; PAM type: YTN; PAM sequence: CTC
ttcgtttcgaaagagattgc

SEQ ID NO: 295591 - DNA, 20 bp, Artificial Sequence
  Description of Artificial Sequence: Synthetic oligonucleotide
  Target: ATXN1; (+) strand; PAM type: YTN; PAM sequence: CTT
cgtttcgaaagagattgcta

SEQ ID NO: 295592 - DNA, 20 bp, Artificial Sequence
  Description of Artificial Sequence: Synthetic oligonucleotide
  Target: ATXN1; (+) strand; PAM type: YTN; PAM sequence: TTC
gtttcgaaagagattgctat

SEQ ID NO: 295593 - DNA, 20 bp, Artificial Sequence
  Description of Artificial Sequence: Synthetic oligonucleotide
  Target: ATXN1; (+) strand; PAM type: YTN; PAM sequence: TTT
cgaaagagattgctatctta

SEQ ID NO: 295594 - DNA, 20 bp, Artificial Sequence
  Description of Artificial Sequence: Synthetic oligonucleotide
  Target: ATXN1; (+) strand; PAM type: YTN; PAM sequence: TTC
gaaagagattgctatcttac

SEQ ID NO: 295595 - DNA, 20 bp, Artificial Sequence
  Description of Artificial Sequence: Synthetic oligonucleotide
  Target: ATXN1; (+) strand; PAM type: YTN; PAM sequence: TTG
ctatcttacaccatatggaa

SEQ ID NO: 295596 - DNA, 20 bp, Artificial Sequence
  Description of Artificial Sequence: Synthetic oligonucleotide
  Target: ATXN1; (+) strand; PAM type: YTN; PAM sequence: CTA
tcttacaccatatggaaaat

SEQ ID NO: 295597 - DNA, 20 bp, Artificial Sequence
  Description of Artificial Sequence: Synthetic oligonucleotide
  Target: ATXN1; (+) strand; PAM type: YTN; PAM sequence: CTT
acaccatatggaaaataaat

SEQ ID NO: 295598 - DNA, 20 bp, Artificial Sequence
  Description of Artificial Sequence: Synthetic oligonucleotide
  Target: ATXN1; (+) strand; PAM type: YTN; PAM sequence: TTA
caccatatggaaaataaatt

SEQ ID NO: 295599 - DNA, 20 bp, Artificial Sequence
  Description of Artificial Sequence: Synthetic oligonucleotide
  Target: ATXN1; (+) strand; PAM type: YTN; PAM sequence: TTC
tagatatataactaaacata

SEQ ID NO: 295600 - DNA, 20 bp, Artificial Sequence
  Description of Artificial Sequence: Synthetic oligonucleotide
  Target: ATXN1; (+) strand; PAM type: YTN; PAM sequence: CTA
gatatataactaaacatata

SEQ ID NO: 295601 - DNA, 20 bp, Artificial Sequence
  Description of Artificial Sequence: Synthetic oligonucleotide
  Target: ATXN1; (+) strand; PAM type: YTN; PAM sequence: CTA
aacatataaacatgtgttta

SEQ ID NO: 295602 - DNA, 20 bp, Artificial Sequence
  Description of Artificial Sequence: Synthetic oligonucleotide
  Target: ATXN1; (+) strand; PAM type: YTN; PAM sequence: TTT
atacaaatatacatatatag

SEQ ID NO: 295603 - DNA, 20 bp, Artificial Sequence
  Description of Artificial Sequence: Synthetic oligonucleotide
  Target: ATXN1; (+) strand; PAM type: YTN; PAM sequence: TTA
tacaaatatacatatatagc

SEQ ID NO: 295604 - DNA, 20 bp, Artificial Sequence
  Description of Artificial Sequence: Synthetic oligonucleotide
  Target: ATXN1; (+) strand; PAM type: YTN; PAM sequence: TTT
attatacatatatattattt

SEQ ID NO: 295605 - DNA, 20 bp, Artificial Sequence
  Description of Artificial Sequence: Synthetic oligonucleotide
  Target: ATXN1; (+) strand; PAM type: YTN; PAM sequence: TTA
ttatacatatatattatttt

SEQ ID NO: 295606 - DNA, 20 bp, Artificial Sequence
  Description of Artificial Sequence: Synthetic oligonucleotide
  Target: ATXN1; (+) strand; PAM type: YTN; PAM sequence: TTA
tacatatatattattttaca

SEQ ID NO: 295607 - DNA, 20 bp, Artificial Sequence
  Description of Artificial Sequence: Synthetic oligonucleotide
  Target: ATXN1; (+) strand; PAM type: YTN; PAM sequence: TTA
ttttacaaaatatagaaaaa

SEQ ID NO: 295608 - DNA, 20 bp, Artificial Sequence
  Description of Artificial Sequence: Synthetic oligonucleotide
  Target: ATXN1; (+) strand; PAM type: YTN; PAM sequence: TTT
tacaaaatatagaaaaataa

SEQ ID NO: 295609 - DNA, 20 bp, Artificial Sequence
  Description of Artificial Sequence: Synthetic oligonucleotide
  Target: ATXN1; (+) strand; PAM type: YTN; PAM sequence: TTT
acaaaatatagaaaaataat

SEQ ID NO: 295610 - DNA, 20 bp, Artificial Sequence
  Description of Artificial Sequence: Synthetic oligonucleotide
  Target: ATXN1; (+) strand; PAM type: YTN; PAM sequence: TTA
caaaatatagaaaaataatt

SEQ ID NO: 295611 - DNA, 20 bp, Artificial Sequence
  Description of Artificial Sequence: Synthetic oligonucleotide
  Target: ATXN1; (+) strand; PAM type: YTN; PAM sequence: TTT
tataagcatgaaaggccttg

SEQ ID NO: 295612 - DNA, 20 bp, Artificial Sequence
  Description of Artificial Sequence: Synthetic oligonucleotide
  Target: ATXN1; (+) strand; PAM type: YTN; PAM sequence: TTT
ataagcatgaaaggccttgt

SEQ ID NO: 295613 - DNA, 20 bp, Artificial Sequence
  Description of Artificial Sequence: Synthetic oligonucleotide
  Target: ATXN1; (+) strand; PAM type: YTN; PAM sequence: TTA
taagcatgaaaggccttgta

SEQ ID NO: 295614 - DNA, 20 bp, Artificial Sequence
  Description of Artificial Sequence: Synthetic oligonucleotide
  Target: ATXN1; (+) strand; PAM type: YTN; PAM sequence: CTT
gtaggccattgtaaagatac

SEQ ID NO: 295615 - DNA, 20 bp, Artificial Sequence
  Description of Artificial Sequence: Synthetic oligonucleotide
  Target: ATXN1; (+) strand; PAM type: YTN; PAM sequence: TTG
taggccattgtaaagatacc

SEQ ID NO: 295616 - DNA, 20 bp, Artificial Sequence
  Description of Artificial Sequence: Synthetic oligonucleotide
  Target: ATXN1; (+) strand; PAM type: YTN; PAM sequence: TTG
taaagataccgacttttaag

SEQ ID NO: 295617 - DNA, 20 bp, Artificial Sequence
  Description of Artificial Sequence: Synthetic oligonucleotide
  Target: ATXN1; (+) strand; PAM type: YTN; PAM sequence: CTT
ttaagtaaaatgggaagacc

SEQ ID NO: 295618 - DNA, 20 bp, Artificial Sequence
  Description of Artificial Sequence: Synthetic oligonucleotide
  Target: ATXN1; (+) strand; PAM type: YTN; PAM sequence: TTT
taagtaaaatgggaagacca

SEQ ID NO: 295619 - DNA, 20 bp, Artificial Sequence
  Description of Artificial Sequence: Synthetic oligonucleotide
  Target: ATXN1; (+) strand; PAM type: YTN; PAM sequence: TTT
aagtaaaatgggaagaccag

SEQ ID NO: 295620 - DNA, 20 bp, Artificial Sequence
  Description of Artificial Sequence: Synthetic oligonucleotide
  Target: ATXN1; (+) strand; PAM type: YTN; PAM sequence: TTA
agtaaaatgggaagaccaga

SEQ ID NO: 295621 - DNA, 20 bp, Artificial Sequence
  Description of Artificial Sequence: Synthetic oligonucleotide
  Target: ATXN1; (+) strand; PAM type: YTN; PAM sequence: TTT
ttaatgcagtagtatcatga

SEQ ID NO: 295622 - DNA, 20 bp, Artificial Sequence
  Description of Artificial Sequence: Synthetic oligonucleotide
  Target: ATXN1; (+) strand; PAM type: YTN; PAM sequence: TTT
taatgcagtagtatcatgat

SEQ ID NO: 295623 - DNA, 20 bp, Artificial Sequence
  Description of Artificial Sequence: Synthetic oligonucleotide
  Target: ATXN1; (+) strand; PAM type: YTN; PAM sequence: TTT
aatgcagtagtatcatgatc

SEQ ID NO: 295624 - DNA, 20 bp, Artificial Sequence
  Description of Artificial Sequence: Synthetic oligonucleotide
  Target: ATXN1; (+) strand; PAM type: YTN; PAM sequence: TTA
atgcagtagtatcatgatct

SEQ ID NO: 295625 - DNA, 20 bp, Artificial Sequence
  Description of Artificial Sequence: Synthetic oligonucleotide
  Target: ATXN1; (+) strand; PAM type: YTN; PAM sequence: CTG
ccttacattttaagggctca

SEQ ID NO: 295626 - DNA, 20 bp, Artificial Sequence
  Description of Artificial Sequence: Synthetic oligonucleotide
  Target: ATXN1; (+) strand; PAM type: YTN; PAM sequence: CTT
acattttaagggctcatttg

SEQ ID NO: 295627 - DNA, 20 bp, Artificial Sequence
  Description of Artificial Sequence: Synthetic oligonucleotide
  Target: ATXN1; (+) strand; PAM type: YTN; PAM sequence: TTA
cattttaagggctcatttgg

SEQ ID NO: 295628 - DNA, 20 bp, Artificial Sequence
  Description of Artificial Sequence: Synthetic oligonucleotide
  Target: ATXN1; (+) strand; PAM type: YTN; PAM sequence: TTT
taagggctcatttggtctga

SEQ ID NO: 295629 - DNA, 20 bp, Artificial Sequence
  Description of Artificial Sequence: Synthetic oligonucleotide
  Target: ATXN1; (+) strand; PAM type: YTN; PAM sequence: TTT
aagggctcatttggtctgat

SEQ ID NO: 295630 - DNA, 20 bp, Artificial Sequence
  Description of Artificial Sequence: Synthetic oligonucleotide
  Target: ATXN1; (+) strand; PAM type: YTN; PAM sequence: TTA
agggctcatttggtctgatt

SEQ ID NO: 295631 - DNA, 20 bp, Artificial Sequence
  Description of Artificial Sequence: Synthetic oligonucleotide
  Target: ATXN1; (+) strand; PAM type: YTN; PAM sequence: CTC
atttggtctgattgtcagga

SEQ ID NO: 295632 - DNA, 20 bp, Artificial Sequence
  Description of Artificial Sequence: Synthetic oligonucleotide
  Target: ATXN1; (+) strand; PAM type: YTN; PAM sequence: TTT
ggtctgattgtcaggaatag

SEQ ID NO: 295633 - DNA, 20 bp, Artificial Sequence
  Description of Artificial Sequence: Synthetic oligonucleotide
  Target: ATXN1; (+) strand; PAM type: YTN; PAM sequence: TTG
gtctgattgtcaggaataga

SEQ ID NO: 295634 - DNA, 20 bp, Artificial Sequence
  Description of Artificial Sequence: Synthetic oligonucleotide
  Target: ATXN1; (+) strand; PAM type: YTN; PAM sequence: CTG
attgtcaggaatagaccata

SEQ ID NO: 295635 - DNA, 20 bp, Artificial Sequence
  Description of Artificial Sequence: Synthetic oligonucleotide
  Target: ATXN1; (+) strand; PAM type: YTN; PAM sequence: TTG
tcaggaatagaccataaggg

SEQ ID NO: 295636 - DNA, 20 bp, Artificial Sequence
  Description of Artificial Sequence: Synthetic oligonucleotide
  Target: ATXN1; (+) strand; PAM type: YTN; PAM sequence: TTA
aagcacaagttactgttata

SEQ ID NO: 295637 - DNA, 20 bp, Artificial Sequence
  Description of Artificial Sequence: Synthetic oligonucleotide
  Target: ATXN1; (+) strand; PAM type: YTN; PAM sequence: TTA
ctgttataagcagcctgcag

SEQ ID NO: 295638 - DNA, 20 bp, Artificial Sequence
  Description of Artificial Sequence: Synthetic oligonucleotide
  Target: ATXN1; (+) strand; PAM type: YTN; PAM sequence: CTG
ttataagcagcctgcaggat

SEQ ID NO: 295639 - DNA, 20 bp, Artificial Sequence
  Description of Artificial Sequence: Synthetic oligonucleotide
  Target: ATXN1; (+) strand; PAM type: YTN; PAM sequence: TTA
taagcagcctgcaggatggc

SEQ ID NO: 295640 - DNA, 20 bp, Artificial Sequence
  Description of Artificial Sequence: Synthetic oligonucleotide
  Target: ATXN1; (+) strand; PAM type: YTN; PAM sequence: CTG
caggatggcttccagtgatc

SEQ ID NO: 295641 - DNA, 20 bp, Artificial Sequence
  Description of Artificial Sequence: Synthetic oligonucleotide
  Target: ATXN1; (+) strand; PAM type: YTN; PAM sequence: CTT
ccagtgatcccacctcttgg

SEQ ID NO: 295642 - DNA, 20 bp, Artificial Sequence
  Description of Artificial Sequence: Synthetic oligonucleotide
  Target: ATXN1; (+) strand; PAM type: YTN; PAM sequence: TTC
cagtgatcccacctcttgga

SEQ ID NO: 295643 - DNA, 20 bp, Artificial Sequence
  Description of Artificial Sequence: Synthetic oligonucleotide
  Target: ATXN1; (+) strand; PAM type: YTN; PAM sequence: CTC
ttggaattcatgcccttgta

SEQ ID NO: 295644 - DNA, 20 bp, Artificial Sequence
  Description of Artificial Sequence: Synthetic oligonucleotide
  Target: ATXN1; (+) strand; PAM type: YTN; PAM sequence: CTT
ggaattcatgcccttgtaaa

SEQ ID NO: 295645 - DNA, 20 bp, Artificial Sequence
  Description of Artificial Sequence: Synthetic oligonucleotide
  Target: ATXN1; (+) strand; PAM type: YTN; PAM sequence: TTG
gaattcatgcccttgtaaag

SEQ ID NO: 295646 - DNA, 20 bp, Artificial Sequence
  Description of Artificial Sequence: Synthetic oligonucleotide
  Target: ATXN1; (+) strand; PAM type: YTN; PAM sequence: TTC
atgcccttgtaaagccttct

SEQ ID NO: 295647 - DNA, 20 bp, Artificial Sequence
  Description of Artificial Sequence: Synthetic oligonucleotide
  Target: ATXN1; (+) strand; PAM type: YTN; PAM sequence: CTT
gtaaagccttcttgagtgtg

SEQ ID NO: 295648 - DNA, 20 bp, Artificial Sequence
  Description of Artificial Sequence: Synthetic oligonucleotide
  Target: ATXN1; (+) strand; PAM type: YTN; PAM sequence: TTG
taaagccttcttgagtgtgg

SEQ ID NO: 295649 - DNA, 20 bp, Artificial Sequence
  Description of Artificial Sequence: Synthetic oligonucleotide
  Target: ATXN1; (+) strand; PAM type: YTN; PAM sequence: CTT
cttgagtgtggactggattt

SEQ ID NO: 295650 - DNA, 20 bp, Artificial Sequence
  Description of Artificial Sequence: Synthetic oligonucleotide
  Target: ATXN1; (+) strand; PAM type: YTN; PAM sequence: TTC
ttgagtgtggactggattta

SEQ ID NO: 295651 - DNA, 20 bp, Artificial Sequence
  Description of Artificial Sequence: Synthetic oligonucleotide
  Target: ATXN1; (+) strand; PAM type: YTN; PAM sequence: CTT
gagtgtggactggatttagt

SEQ ID NO: 295652 - DNA, 20 bp, Artificial Sequence
  Description of Artificial Sequence: Synthetic oligonucleotide
  Target: ATXN1; (+) strand; PAM type: YTN; PAM sequence: TTG
agtgtggactggatttagtg

SEQ ID NO: 295653 - DNA, 20 bp, Artificial Sequence
  Description of Artificial Sequence: Synthetic oligonucleotide
  Target: ATXN1; (+) strand; PAM type: YTN; PAM sequence: CTG
gatttagtgactcaattcta

SEQ ID NO: 295654 - DNA, 20 bp, Artificial Sequence
  Description of Artificial Sequence: Synthetic oligonucleotide
  Target: ATXN1; (+) strand; PAM type: YTN; PAM sequence: TTT
agtgactcaattctagcaaa

SEQ ID NO: 295655 - DNA, 20 bp, Artificial Sequence
  Description of Artificial Sequence: Synthetic oligonucleotide
  Target: ATXN1; (+) strand; PAM type: YTN; PAM sequence: TTA
gtgactcaattctagcaaac

SEQ ID NO: 295656 - DNA, 20 bp, Artificial Sequence
  Description of Artificial Sequence: Synthetic oligonucleotide
  Target: ATXN1; (+) strand; PAM type: YTN; PAM sequence: CTC
aattctagcaaacagactgt

SEQ ID NO: 295657 - DNA, 20 bp, Artificial Sequence
  Description of Artificial Sequence: Synthetic oligonucleotide
  Target: ATXN1; (+) strand; PAM type: YTN; PAM sequence: TTC
tagcaaacagactgtggcaa

SEQ ID NO: 295658 - DNA, 20 bp, Artificial Sequence
  Description of Artificial Sequence: Synthetic oligonucleotide
  Target: ATXN1; (+) strand; PAM type: YTN; PAM sequence: CTA
gcaaacagactgtggcaaag

SEQ ID NO: 295659 - DNA, 20 bp, Artificial Sequence
  Description of Artificial Sequence: Synthetic oligonucleotide
  Target: ATXN1; (+) strand; PAM type: YTN; PAM sequence: CTG
tggcaaaggtaatgggagat

SEQ ID NO: 295660 - DNA, 20 bp, Artificial Sequence
  Description of Artificial Sequence: Synthetic oligonucleotide
  Target: ATXN1; (+) strand; PAM type: YTN; PAM sequence: TTT
ccaagactgggttacatgaa

SEQ ID NO: 295661 - DNA, 20 bp, Artificial Sequence
  Description of Artificial Sequence: Synthetic oligonucleotide
  Target: ATXN1; (+) strand; PAM type: YTN; PAM sequence: TTC
caagactgggttacatgaag

SEQ ID NO: 295662 - DNA, 20 bp, Artificial Sequence
  Description of Artificial Sequence: Synthetic oligonucleotide
  Target: ATXN1; (+) strand; PAM type: YTN; PAM sequence: CTG
ggttacatgaagatggtggc

SEQ ID NO: 295663 - DNA, 20 bp, Artificial Sequence
  Description of Artificial Sequence: Synthetic oligonucleotide
  Target: ATXN1; (+) strand; PAM type: YTN; PAM sequence: TTA
catgaagatggtggcttcca

SEQ ID NO: 295664 - DNA, 20 bp, Artificial Sequence
  Description of Artificial Sequence: Synthetic oligonucleotide
  Target: ATXN1; (+) strand; PAM type: YTN; PAM sequence: CTT
ccatcttgggatcttgcatc

SEQ ID NO: 295665 - DNA, 20 bp, Artificial Sequence
  Description of Artificial Sequence: Synthetic oligonucleotide
  Target: ATXN1; (+) strand; PAM type: YTN; PAM sequence: TTC
catcttgggatcttgcatcc

SEQ ID NO: 295666 - DNA, 20 bp, Artificial Sequence
  Description of Artificial Sequence: Synthetic oligonucleotide
  Target: ATXN1; (+) strand; PAM type: YTN; PAM sequence: CTT
gggatcttgcatcctcttct

SEQ ID NO: 295667 - DNA, 20 bp, Artificial Sequence
  Description of Artificial Sequence: Synthetic oligonucleotide
  Target: ATXN1; (+) strand; PAM type: YTN; PAM sequence: TTG
ggatcttgcatcctcttctg

SEQ ID NO: 295668 - DNA, 20 bp, Artificial Sequence
  Description of Artificial Sequence: Synthetic oligonucleotide
  Target: ATXN1; (+) strand; PAM type: YTN; PAM sequence: CTT
gcatcctcttctgggttact

SEQ ID NO: 295669 - DNA, 20 bp, Artificial Sequence
  Description of Artificial Sequence: Synthetic oligonucleotide
  Target: ATXN1; (+) strand; PAM type: YTN; PAM sequence: TTG
catcctcttctgggttactc

SEQ ID NO: 295670 - DNA, 20 bp, Artificial Sequence
  Description of Artificial Sequence: Synthetic oligonucleotide
  Target: ATXN1; (+) strand; PAM type: YTN; PAM sequence: CTC
ttctgggttactcacctggg

SEQ ID NO: 295671 - DNA, 20 bp, Artificial Sequence
  Description of Artificial Sequence: Synthetic oligonucleotide
  Target: ATXN1; (+) strand; PAM type: YTN; PAM sequence: CTT
ctgggttactcacctggggg

SEQ ID NO: 295672 - DNA, 20 bp, Artificial Sequence
  Description of Artificial Sequence: Synthetic oligonucleotide
  Target: ATXN1; (+) strand; PAM type: YTN; PAM sequence: TTC
tgggttactcacctggggga

SEQ ID NO: 295673 - DNA, 20 bp, Artificial Sequence
  Description of Artificial Sequence: Synthetic oligonucleotide
  Target: ATXN1; (+) strand; PAM type: YTN; PAM sequence: CTG
ggttactcacctgggggagg

SEQ ID NO: 295674 - DNA, 20 bp, Artificial Sequence
  Description of Artificial Sequence: Synthetic oligonucleotide
  Target: ATXN1; (+) strand; PAM type: YTN; PAM sequence: TTA
ctcacctgggggaggctgac

SEQ ID NO: 295675 - DNA, 20 bp, Artificial Sequence
  Description of Artificial Sequence: Synthetic oligonucleotide
  Target: ATXN1; (+) strand; PAM type: YTN; PAM sequence: CTC
acctgggggaggctgactgc

SEQ ID NO: 295676 - DNA, 20 bp, Artificial Sequence
  Description of Artificial Sequence: Synthetic oligonucleotide
  Target: ATXN1; (+) strand; PAM type: YTN; PAM sequence: CTG
ggggaggctgactgccaggc

SEQ ID NO: 295677 - DNA, 20 bp, Artificial Sequence
  Description of Artificial Sequence: Synthetic oligonucleotide
  Target: ATXN1; (+) strand; PAM type: YTN; PAM sequence: CTG
actgccaggctgtgatgcag

SEQ ID NO: 295678 - DNA, 20 bp, Artificial Sequence
  Description of Artificial Sequence: Synthetic oligonucleotide
  Target: ATXN1; (+) strand; PAM type: YTN; PAM sequence: CTG
ccaggctgtgatgcagtcct

SEQ ID NO: 295679 - DNA, 20 bp, Artificial Sequence
  Description of Artificial Sequence: Synthetic oligonucleotide
  Target: ATXN1; (+) strand; PAM type: YTN; PAM sequence: CTG
tgatgcagtcctgtggaagg

SEQ ID NO: 295680 - DNA, 20 bp, Artificial Sequence
  Description of Artificial Sequence: Synthetic oligonucleotide
  Target: ATXN1; (+) strand; PAM type: YTN; PAM sequence: CTG
tggaagggcccacatggcat

SEQ ID NO: 295681 - DNA, 20 bp, Artificial Sequence
  Description of Artificial Sequence: Synthetic oligonucleotide
  Target: ATXN1; (+) strand; PAM type: YTN; PAM sequence: CTG
aggcctgctagcatctatgt

SEQ ID NO: 295682 - DNA, 20 bp, Artificial Sequence
  Description of Artificial Sequence: Synthetic oligonucleotide
  Target: ATXN1; (+) strand; PAM type: YTN; PAM sequence: CTG
ctagcatctatgtgagtgga

SEQ ID NO: 295683 - DNA, 20 bp, Artificial Sequence
  Description of Artificial Sequence: Synthetic oligonucleotide
  Target: ATXN1; (+) strand; PAM type: YTN; PAM sequence: CTA
gcatctatgtgagtggattt

SEQ ID NO: 295684 - DNA, 20 bp, Artificial Sequence
  Description of Artificial Sequence: Synthetic oligonucleotide
  Target: ATXN1; (+) strand; PAM type: YTN; PAM sequence: CTA
tgtgagtggatttggaagca

SEQ ID NO: 295685 - DNA, 20 bp, Artificial Sequence
  Description of Artificial Sequence: Synthetic oligonucleotide
  Target: ATXN1; (+) strand; PAM type: YTN; PAM sequence: TTT
ggaagcagatccctaccgcc

SEQ ID NO: 295686 - DNA, 20 bp, Artificial Sequence
  Description of Artificial Sequence: Synthetic oligonucleotide
  Target: ATXN1; (+) strand; PAM type: YTN; PAM sequence: TTG
gaagcagatccctaccgccc

SEQ ID NO: 295687 - DNA, 20 bp, Artificial Sequence
  Description of Artificial Sequence: Synthetic oligonucleotide
  Target: ATXN1; (+) strand; PAM type: YTN; PAM sequence: CTA
ccgcccccaccctatccttc

SEQ ID NO: 295688 - DNA, 20 bp, Artificial Sequence
  Description of Artificial Sequence: Synthetic oligonucleotide
  Target: ATXN1; (+) strand; PAM type: YTN; PAM sequence: CTA
tccttcagatgaaacgtcag

SEQ ID NO: 295689 - DNA, 20 bp, Artificial Sequence
  Description of Artificial Sequence: Synthetic oligonucleotide
  Target: ATXN1; (+) strand; PAM type: YTN; PAM sequence: CTT
cagatgaaacgtcagcccag

SEQ ID NO: 295690 - DNA, 20 bp, Artificial Sequence
  Description of Artificial Sequence: Synthetic oligonucleotide
  Target: ATXN1; (+) strand; PAM type: YTN; PAM sequence: TTC
agatgaaacgtcagcccagg

SEQ ID NO: 295691 - DNA, 20 bp, Artificial Sequence
  Description of Artificial Sequence: Synthetic oligonucleotide
  Target: ATXN1; (+) strand; PAM type: YTN; PAM sequence: TTA
acaacttgactacaacctca

SEQ ID NO: 295692 - DNA, 20 bp, Artificial Sequence
  Description of Artificial Sequence: Synthetic oligonucleotide
  Target: ATXN1; (+) strand; PAM type: YTN; PAM sequence: CTT
gactacaacctcatgaaaga

SEQ ID NO: 295693 - DNA, 20 bp, Artificial Sequence
  Description of Artificial Sequence: Synthetic oligonucleotide
  Target: ATXN1; (+) strand; PAM type: YTN; PAM sequence: TTG
actacaacctcatgaaagac

SEQ ID NO: 295694 - DNA, 20 bp, Artificial Sequence
  Description of Artificial Sequence: Synthetic oligonucleotide
  Target: ATXN1; (+) strand; PAM type: YTN; PAM sequence: CTA
caacctcatgaaagacttgg

SEQ ID NO: 295695 - DNA, 20 bp, Artificial Sequence
  Description of Artificial Sequence: Synthetic oligonucleotide
  Target: ATXN1; (+) strand; PAM type: YTN; PAM sequence: CTC
atgaaagacttggagctaga

SEQ ID NO: 295696 - DNA, 20 bp, Artificial Sequence
  Description of Artificial Sequence: Synthetic oligonucleotide
  Target: ATXN1; (+) strand; PAM type: YTN; PAM sequence: CTT
ggagctagagacacccagct

SEQ ID NO: 295697 - DNA, 20 bp, Artificial Sequence
  Description of Artificial Sequence: Synthetic oligonucleotide
  Target: ATXN1; (+) strand; PAM type: YTN; PAM sequence: TTG
gagctagagacacccagcta

SEQ ID NO: 295698 - DNA, 20 bp, Artificial Sequence
  Description of Artificial Sequence: Synthetic oligonucleotide
  Target: ATXN1; (+) strand; PAM type: YTN; PAM sequence: CTA
gagacacccagctatgatat

SEQ ID NO: 295699 - DNA, 20 bp, Artificial Sequence
  Description of Artificial Sequence: Synthetic oligonucleotide
  Target: ATXN1; (+) strand; PAM type: YTN; PAM sequence: CTA
tgatatgcagtgattcacac

SEQ ID NO: 295700 - DNA, 20 bp, Artificial Sequence
  Description of Artificial Sequence: Synthetic oligonucleotide
  Target: ATXN1; (+) strand; PAM type: YTN; PAM sequence: TTC
acacttagaaaaactgagag

SEQ ID NO: 295701 - DNA, 20 bp, Artificial Sequence
  Description of Artificial Sequence: Synthetic oligonucleotide
  Target: ATXN1; (+) strand; PAM type: YTN; PAM sequence: CTT
agaaaaactgagagataata

SEQ ID NO: 295702 - DNA, 20 bp, Artificial Sequence
  Description of Artificial Sequence: Synthetic oligonucleotide
  Target: ATXN1; (+) strand; PAM type: YTN; PAM sequence: TTA
gaaaaactgagagataataa

SEQ ID NO: 295703 - DNA, 20 bp, Artificial Sequence
  Description of Artificial Sequence: Synthetic oligonucleotide
  Target: ATXN1; (+) strand; PAM type: YTN; PAM sequence: CTG
agagataataaacacttgtt

SEQ ID NO: 295704 - DNA, 20 bp, Artificial Sequence
  Description of Artificial Sequence: Synthetic oligonucleotide
  Target: ATXN1; (+) strand; PAM type: YTN; PAM sequence: CTT
gttgttttaagccactaaga

SEQ ID NO: 295705 - DNA, 20 bp, Artificial Sequence
  Description of Artificial Sequence: Synthetic oligonucleotide
  Target: ATXN1; (+) strand; PAM type: YTN; PAM sequence: TTG
ttgttttaagccactaagat

SEQ ID NO: 295706 - DNA, 20 bp, Artificial Sequence
  Description of Artificial Sequence: Synthetic oligonucleotide
  Target: ATXN1; (+) strand; PAM type: YTN; PAM sequence: TTG
ttttaagccactaagatttg

SEQ ID NO: 295707 - DNA, 20 bp, Artificial Sequence
  Description of Artificial Sequence: Synthetic oligonucleotide
  Target: ATXN1; (+) strand; PAM type: YTN; PAM sequence: TTT
taagccactaagatttggag

SEQ ID NO: 295708 - DNA, 20 bp, Artificial Sequence
  Description of Artificial Sequence: Synthetic oligonucleotide
  Target: ATXN1; (+) strand; PAM type: YTN; PAM sequence: TTT
aagccactaagatttggagt

SEQ ID NO: 295709 - DNA, 20 bp, Artificial Sequence
  Description of Artificial Sequence: Synthetic oligonucleotide
  Target: ATXN1; (+) strand; PAM type: YTN; PAM sequence: TTA
agccactaagatttggagta

SEQ ID NO: 295710 - DNA, 20 bp, Artificial Sequence
  Description of Artificial Sequence: Synthetic oligonucleotide
  Target: ATXN1; (+) strand; PAM type: YTN; PAM sequence: CTA
agatttggagtaattactta

SEQ ID NO: 295711 - DNA, 20 bp, Artificial Sequence
  Description of Artificial Sequence: Synthetic oligonucleotide
  Target: ATXN1; (+) strand; PAM type: YTN; PAM sequence: TTT
ggagtaattacttacacagc

SEQ ID NO: 295712 - DNA, 20 bp, Artificial Sequence
  Description of Artificial Sequence: Synthetic oligonucleotide
  Target: ATXN1; (+) strand; PAM type: YTN; PAM sequence: TTG
gagtaattacttacacagca

SEQ ID NO: 295713 - DNA, 20 bp, Artificial Sequence
  Description of Artificial Sequence: Synthetic oligonucleotide
  Target: ATXN1; (+) strand; PAM type: YTN; PAM sequence: TTA
cttacacagcagtagataac

SEQ ID NO: 295714 - DNA, 20 bp, Artificial Sequence
  Description of Artificial Sequence: Synthetic oligonucleotide
  Target: ATXN1; (+) strand; PAM type: YTN; PAM sequence: CTT
acacagcagtagataactac

SEQ ID NO: 295715 - DNA, 20 bp, Artificial Sequence
  Description of Artificial Sequence: Synthetic oligonucleotide
  Target: ATXN1; (+) strand; PAM type: YTN; PAM sequence: TTA
cacagcagtagataactact

SEQ ID NO: 295716 - DNA, 20 bp, Artificial Sequence
  Description of Artificial Sequence: Synthetic oligonucleotide
  Target: ATXN1; (+) strand; PAM type: YTN; PAM sequence: CTA
ctacagttacaatgtatgaa

SEQ ID NO: 295717 - DNA, 20 bp, Artificial Sequence
  Description of Artificial Sequence: Synthetic oligonucleotide
  Target: ATXN1; (+) strand; PAM type: YTN; PAM sequence: CTA
cagttacaatgtatgaaaca

SEQ ID NO: 295718 - DNA, 20 bp, Artificial Sequence
  Description of Artificial Sequence: Synthetic oligonucleotide
  Target: ATXN1; (+) strand; PAM type: YTN; PAM sequence: TTA
caatgtatgaaacactcttc

SEQ ID NO: 295719 - DNA, 20 bp, Artificial Sequence
  Description of Artificial Sequence: Synthetic oligonucleotide
  Target: ATXN1; (+) strand; PAM type: YTN; PAM sequence: CTC
ttctgggaactttacatgac

SEQ ID NO: 295720 - DNA, 20 bp, Artificial Sequence
  Description of Artificial Sequence: Synthetic oligonucleotide
  Target: ATXN1; (+) strand; PAM type: YTN; PAM sequence: CTT
ctgggaactttacatgactt

SEQ ID NO: 295721 - DNA, 20 bp, Artificial Sequence
  Description of Artificial Sequence: Synthetic oligonucleotide
  Target: ATXN1; (+) strand; PAM type: YTN; PAM sequence: TTC
tgggaactttacatgacttt

SEQ ID NO: 295722 - DNA, 20 bp, Artificial Sequence
  Description of Artificial Sequence: Synthetic oligonucleotide
  Target: ATXN1; (+) strand; PAM type: YTN; PAM sequence: CTG
ggaactttacatgacttttt

SEQ ID NO: 295723 - DNA, 20 bp, Artificial Sequence
  Description of Artificial Sequence: Synthetic oligonucleotide
  Target: ATXN1; (+) strand; PAM type: YTN; PAM sequence: CTT
tacatgactttttacagtgg

SEQ ID NO: 295724 - DNA, 20 bp, Artificial Sequence
  Description of Artificial Sequence: Synthetic oligonucleotide
  Target: ATXN1; (+) strand; PAM type: YTN; PAM sequence: TTT
acatgactttttacagtggg

SEQ ID NO: 295725 - DNA, 20 bp, Artificial Sequence
  Description of Artificial Sequence: Synthetic oligonucleotide
  Target: ATXN1; (+) strand; PAM type: YTN; PAM sequence: TTA
catgactttttacagtggga

SEQ ID NO: 295726 - DNA, 20 bp, Artificial Sequence
  Description of Artificial Sequence: Synthetic oligonucleotide
  Target: ATXN1; (+) strand; PAM type: YTN; PAM sequence: CTT
tttacagtgggagaaactga

SEQ ID NO: 295727 - DNA, 20 bp, Artificial Sequence
  Description of Artificial Sequence: Synthetic oligonucleotide
  Target: ATXN1; (+) strand; PAM type: YTN; PAM sequence: TTT
ttacagtgggagaaactgag

SEQ ID NO: 295728 - DNA, 20 bp, Artificial Sequence
  Description of Artificial Sequence: Synthetic oligonucleotide
  Target: ATXN1; (+) strand; PAM type: YTN; PAM sequence: TTT
tacagtgggagaaactgagc

SEQ ID NO: 295729 - DNA, 20 bp, Artificial Sequence
  Description of Artificial Sequence: Synthetic oligonucleotide
  Target: ATXN1; (+) strand; PAM type: YTN; PAM sequence: TTT
acagtgggagaaactgagcc

SEQ ID NO: 295730 - DNA, 20 bp, Artificial Sequence
  Description of Artificial Sequence: Synthetic oligonucleotide
  Target: ATXN1; (+) strand; PAM type: YTN; PAM sequence: TTA
cagtgggagaaactgagccc

SEQ ID NO: 295731 - DNA, 20 bp, Artificial Sequence
  Description of Artificial Sequence: Synthetic oligonucleotide
  Target: ATXN1; (+) strand; PAM type: YTN; PAM sequence: CTG
agccccaaagaagttaaatc

SEQ ID NO: 295732 - DNA, 20 bp, Artificial Sequence
  Description of Artificial Sequence: Synthetic oligonucleotide
  Target: ATXN1; (+) strand; PAM type: YTN; PAM sequence: TTA
aatcacctgttcaacagcac

SEQ ID NO: 295733 - DNA, 20 bp, Artificial Sequence
  Description of Artificial Sequence: Synthetic oligonucleotide
  Target: ATXN1; (+) strand; PAM type: YTN; PAM sequence: CTG
ttcaacagcacacatacatg

SEQ ID NO: 295734 - DNA, 20 bp, Artificial Sequence
  Description of Artificial Sequence: Synthetic oligonucleotide
  Target: ATXN1; (+) strand; PAM type: YTN; PAM sequence: TTC
aacagcacacatacatggta

SEQ ID NO: 295735 - DNA, 20 bp, Artificial Sequence
  Description of Artificial Sequence: Synthetic oligonucleotide
  Target: ATXN1; (+) strand; PAM type: YTN; PAM sequence: CTC
aaactcaggccatctgactc

SEQ ID NO: 295736 - DNA, 20 bp, Artificial Sequence
  Description of Artificial Sequence: Synthetic oligonucleotide
  Target: ATXN1; (+) strand; PAM type: YTN; PAM sequence: CTC
aggccatctgactccagaaa

SEQ ID NO: 295737 - DNA, 20 bp, Artificial Sequence
  Description of Artificial Sequence: Synthetic oligonucleotide
  Target: ATXN1; (+) strand; PAM type: YTN; PAM sequence: CTG
actccagaaaccaggttctt

SEQ ID NO: 295738 - DNA, 20 bp, Artificial Sequence
  Description of Artificial Sequence: Synthetic oligonucleotide
  Target: ATXN1; (+) strand; PAM type: YTN; PAM sequence: CTC
cagaaaccaggttcttaatc

SEQ ID NO: 295739 - DNA, 20 bp, Artificial Sequence
  Description of Artificial Sequence: Synthetic oligonucleotide
  Target: ATXN1; (+) strand; PAM type: YTN; PAM sequence: TTC
ttaatccctgcatcacacta

SEQ ID NO: 295740 - DNA, 20 bp, Artificial Sequence
  Description of Artificial Sequence: Synthetic oligonucleotide
  Target: ATXN1; (+) strand; PAM type: YTN; PAM sequence: CTT
aatccctgcatcacactacc

SEQ ID NO: 295741 - DNA, 20 bp, Artificial Sequence
  Description of Artificial Sequence: Synthetic oligonucleotide
  Target: ATXN1; (+) strand; PAM type: YTN; PAM sequence: TTA
atccctgcatcacactaccc

SEQ ID NO: 295742 - DNA, 20 bp, Artificial Sequence
  Description of Artificial Sequence: Synthetic oligonucleotide
  Target: ATXN1; (+) strand; PAM type: YTN; PAM sequence: CTG
catcacactacccctttaag

SEQ ID NO: 295743 - DNA, 20 bp, Artificial Sequence
  Description of Artificial Sequence: Synthetic oligonucleotide
  Target: ATXN1; (+) strand; PAM type: YTN; PAM sequence: CTA
cccctttaagaaccattttt

SEQ ID NO: 295744 - DNA, 20 bp, Artificial Sequence
  Description of Artificial Sequence: Synthetic oligonucleotide
  Target: ATXN1; (+) strand; PAM type: YTN; PAM sequence: CTT
taagaaccatttttcctact

SEQ ID NO: 295745 - DNA, 20 bp, Artificial Sequence
  Description of Artificial Sequence: Synthetic oligonucleotide
  Target: ATXN1; (+) strand; PAM type: YTN; PAM sequence: TTT
aagaaccatttttcctactt

SEQ ID NO: 295746 - DNA, 20 bp, Artificial Sequence
  Description of Artificial Sequence: Synthetic oligonucleotide
  Target: ATXN1; (+) strand; PAM type: YTN; PAM sequence: TTA
agaaccatttttcctacttt

SEQ ID NO: 295747 - DNA, 20 bp, Artificial Sequence
  Description of Artificial Sequence: Synthetic oligonucleotide
  Target: ATXN1; (+) strand; PAM type: YTN; PAM sequence: TTT
ttcctactttaggtgtgcat

SEQ ID NO: 295748 - DNA, 20 bp, Artificial Sequence
  Description of Artificial Sequence: Synthetic oligonucleotide
  Target: ATXN1; (+) strand; PAM type: YTN; PAM sequence: TTT
tcctactttaggtgtgcatg

SEQ ID NO: 295749 - DNA, 20 bp, Artificial Sequence
  Description of Artificial Sequence: Synthetic oligonucleotide
  Target: ATXN1; (+) strand; PAM type: YTN; PAM sequence: TTT
cctactttaggtgtgcatgc

SEQ ID NO: 295750 - DNA, 20 bp, Artificial Sequence
  Description of Artificial Sequence: Synthetic oligonucleotide
  Target: ATXN1; (+) strand; PAM type: YTN; PAM sequence: TTC
ctactttaggtgtgcatgcc

SEQ ID NO: 295751 - DNA, 20 bp, Artificial Sequence
  Description of Artificial Sequence: Synthetic oligonucleotide
  Target: ATXN1; (+) strand; PAM type: YTN; PAM sequence: CTA
ctttaggtgtgcatgcctga

SEQ ID NO: 295752 - DNA, 20 bp, Artificial Sequence
  Description of Artificial Sequence: Synthetic oligonucleotide
  Target: ATXN1; (+) strand; PAM type: YTN; PAM sequence: CTT
taggtgtgcatgcctgaaat

SEQ ID NO: 295753 - DNA, 20 bp, Artificial Sequence
  Description of Artificial Sequence: Synthetic oligonucleotide
  Target: ATXN1; (+) strand; PAM type: YTN; PAM sequence: TTT
aggtgtgcatgcctgaaatt

SEQ ID NO: 295754 - DNA, 20 bp, Artificial Sequence
  Description of Artificial Sequence: Synthetic oligonucleotide
  Target: ATXN1; (+) strand; PAM type: YTN; PAM sequence: TTA
ggtgtgcatgcctgaaattt

SEQ ID NO: 295755 - DNA, 20 bp, Artificial Sequence
  Description of Artificial Sequence: Synthetic oligonucleotide
  Target: ATXN1; (+) strand; PAM type: YTN; PAM sequence: CTG
aaatttgactttccactgta

SEQ ID NO: 295756 - DNA, 20 bp, Artificial Sequence
  Description of Artificial Sequence: Synthetic oligonucleotide
  Target: ATXN1; (+) strand; PAM type: YTN; PAM sequence: TTT
gactttccactgtagaatat

SEQ ID NO: 295757 - DNA, 20 bp, Artificial Sequence
  Description of Artificial Sequence: Synthetic oligonucleotide
  Target: ATXN1; (+) strand; PAM type: YTN; PAM sequence: TTG
actttccactgtagaatatg

SEQ ID NO: 295758 - DNA, 20 bp, Artificial Sequence
  Description of Artificial Sequence: Synthetic oligonucleotide
  Target: ATXN1; (+) strand; PAM type: YTN; PAM sequence: CTT
tccactgtagaatatgctaa

SEQ ID NO: 295759 - DNA, 20 bp, Artificial Sequence
  Description of Artificial Sequence: Synthetic oligonucleotide
  Target: ATXN1; (+) strand; PAM type: YTN; PAM sequence: TTT
ccactgtagaatatgctaaa

SEQ ID NO: 295760 - DNA, 20 bp, Artificial Sequence
  Description of Artificial Sequence: Synthetic oligonucleotide
  Target: ATXN1; (+) strand; PAM type: YTN; PAM sequence: TTC
cactgtagaatatgctaaaa

SEQ ID NO: 295761 - DNA, 20 bp, Artificial Sequence
  Description of Artificial Sequence: Synthetic oligonucleotide
  Target: ATXN1; (+) strand; PAM type: YTN; PAM sequence: CTG
tagaatatgctaaaatcaca

SEQ ID NO: 295762 - DNA, 20 bp, Artificial Sequence
  Description of Artificial Sequence: Synthetic oligonucleotide
  Target: ATXN1; (+) strand; PAM type: YTN; PAM sequence: CTA
aaatcacacaatttgcacaa

SEQ ID NO: 295763 - DNA, 20 bp, Artificial Sequence
  Description of Artificial Sequence: Synthetic oligonucleotide
  Target: ATXN1; (+) strand; PAM type: YTN; PAM sequence: TTT
gcacaagcaatgaagcatct

SEQ ID NO: 295764 - DNA, 20 bp, Artificial Sequence
  Description of Artificial Sequence: Synthetic oligonucleotide
  Target: ATXN1; (+) strand; PAM type: YTN; PAM sequence: TTG
cacaagcaatgaagcatctg

SEQ ID NO: 295765 - DNA, 20 bp, Artificial Sequence
  Description of Artificial Sequence: Synthetic oligonucleotide
  Target: ATXN1; (+) strand; PAM type: YTN; PAM sequence: CTG
catcttcatcaaacttcttt

SEQ ID NO: 295766 - DNA, 20 bp, Artificial Sequence
  Description of Artificial Sequence: Synthetic oligonucleotide
  Target: ATXN1; (+) strand; PAM type: YTN; PAM sequence: CTT
catcaaacttcttttttttt

SEQ ID NO: 295767 - DNA, 20 bp, Artificial Sequence
  Description of Artificial Sequence: Synthetic oligonucleotide
  Target: ATXN1; (+) strand; PAM type: YTN; PAM sequence: TTC
atcaaacttctttttttttt

SEQ ID NO: 295768 - DNA, 20 bp, Artificial Sequence
  Description of Artificial Sequence: Synthetic oligonucleotide
  Target: ATXN1; (+) strand; PAM type: YTN; PAM sequence: CTT
cttttttttttttttgaaat

SEQ ID NO: 295769 - DNA, 20 bp, Artificial Sequence
  Description of Artificial Sequence: Synthetic oligonucleotide
  Target: ATXN1; (+) strand; PAM type: YTN; PAM sequence: TTC
ttttttttttttttgaaata

SEQ ID NO: 295770 - DNA, 20 bp, Artificial Sequence
  Description of Artificial Sequence: Synthetic oligonucleotide
  Target: ATXN1; (+) strand; PAM type: YTN; PAM sequence: CTT
ttttttttttttgaaataga

SEQ ID NO: 295771 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgaaatagag

SEQ ID NO: 295772 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgaaatagagt

SEQ ID NO: 295773 - DNA, 20 bp, Artificial Sequence
  Description of Artificial Sequence: Synthetic oligonucleotide
  Target: ATXN1; (+) strand; PAM type: YTN; PAM sequence: TTT
tttttttttgaaatagagtt

SEQ ID NO: 295774 - DNA, 20 bp, Artificial Sequence
  Description of Artificial Sequence: Synthetic oligonucleotide
  Target: ATXN1; (+) strand; PAM type: YTN; PAM sequence: TTT
ttttttttgaaatagagttt

SEQ ID NO: 295775 - DNA, 20 bp, Artificial Sequence
  Description of Artificial Sequence: Synthetic oligonucleotide
  Target: ATXN1; (+) strand; PAM type: YTN; PAM sequence: TTT
tttttttgaaatagagtttt

SEQ ID NO: 295776 - DNA, 20 bp, Artificial Sequence
  Description of Artificial Sequence: Synthetic oligonucleotide
  Target: ATXN1; (+) strand; PAM type: YTN; PAM sequence: TTT
ttttttgaaatagagttttg

SEQ ID NO: 295777 - DNA, 20 bp, Artificial Sequence
  Description of Artificial Sequence: Synthetic oligonucleotide
  Target: ATXN1; (+) strand; PAM type: YTN; PAM sequence: TTT
tttttgaaatagagttttgc

SEQ ID NO: 295778 - DNA, 20 bp, Artificial Sequence
  Description of Artificial Sequence: Synthetic oligonucleotide
  Target: ATXN1; (+) strand; PAM type: YTN; PAM sequence: TTT
ttttgaaatagagttttgct

SEQ ID NO: 295779 - DNA, 20 bp, Artificial Sequence
  Description of Artificial Sequence: Synthetic oligonucleotide
  Target: ATXN1; (+) strand; PAM type: YTN; PAM sequence: TTT
tttgaaatagagttttgctc

SEQ ID NO: 295780 - DNA, 20 bp, Artificial Sequence
  Description of Artificial Sequence: Synthetic oligonucleotide
  Target: ATXN1; (+) strand; PAM type: YTN; PAM sequence: TTT
ttgaaatagagttttgctct

SEQ ID NO: 295781 - DNA, 20 bp, Artificial Sequence
  Description of Artificial Sequence: Synthetic oligonucleotide
  Target: ATXN1; (+) strand; PAM type: YTN; PAM sequence: TTT
tgaaatagagttttgctctt

SEQ ID NO: 295782 - DNA, 20 bp, Artificial Sequence
  Description of Artificial Sequence: Synthetic oligonucleotide
  Target: ATXN1; (+) strand; PAM type: YTN; PAM sequence: TTT
gaaatagagttttgctcttg

SEQ ID NO: 295783 - DNA, 20 bp, Artificial Sequence
  Description of Artificial Sequence: Synthetic oligonucleotide
  Target: ATXN1; (+) strand; PAM type: YTN; PAM sequence: TTG
aaatagagttttgctcttgt

SEQ ID NO: 295784 - DNA, 20 bp, Artificial Sequence
  Description of Artificial Sequence: Synthetic oligonucleotide
  Target: ATXN1; (+) strand; PAM type: YTN; PAM sequence: TTT
tgctcttgttgcccaggctg

SEQ ID NO: 295785 - DNA, 20 bp, Artificial Sequence
  Description of Artificial Sequence: Synthetic oligonucleotide
  Target: ATXN1; (+) strand; PAM type: YTN; PAM sequence: TTT
gctcttgttgcccaggctgg

SEQ ID NO: 295786 - DNA, 20 bp, Artificial Sequence
  Description of Artificial Sequence: Synthetic oligonucleotide
  Target: ATXN1; (+) strand; PAM type: YTN; PAM sequence: TTG
ctcttgttgcccaggctgga

SEQ ID NO: 295787 - DNA, 20 bp, Artificial Sequence
  Description of Artificial Sequence: Synthetic oligonucleotide
  Target: ATXN1; (+) strand; PAM type: YTN; PAM sequence: CTC
ttgttgcccaggctggagta

SEQ ID NO: 295788 - DNA, 20 bp, Artificial Sequence
  Description of Artificial Sequence: Synthetic oligonucleotide
  Target: ATXN1; (+) strand; PAM type: YTN; PAM sequence: CTT
gttgcccaggctggagtaca

SEQ ID NO: 295789 - DNA, 20 bp, Artificial Sequence
  Description of Artificial Sequence: Synthetic oligonucleotide
  Target: ATXN1; (+) strand; PAM type: YTN; PAM sequence: TTG
ttgcccaggctggagtacaa

SEQ ID NO: 295790 - DNA, 20 bp, Artificial Sequence
  Description of Artificial Sequence: Synthetic oligonucleotide
  Target: ATXN1; (+) strand; PAM type: YTN; PAM sequence: TTG
cccaggctggagtacaatgg

SEQ ID NO: 295791 - DNA, 20 bp, Artificial Sequence
  Description of Artificial Sequence: Synthetic oligonucleotide
  Target: ATXN1; (+) strand; PAM type: YTN; PAM sequence: CTG
gagtacaatggtgtggtctc

SEQ ID NO: 295792 - DNA, 20 bp, Artificial Sequence
  Description of Artificial Sequence: Synthetic oligonucleotide
  Target: ATXN1; (+) strand; PAM type: YTN; PAM sequence: CTC
agctcactgcaacctctgcc

SEQ ID NO: 295793 - DNA, 20 bp, Artificial Sequence
  Description of Artificial Sequence: Synthetic oligonucleotide
  Target: ATXN1; (+) strand; PAM type: YTN; PAM sequence: CTC
actgcaacctctgcctctca

SEQ ID NO: 295794 - DNA, 20 bp, Artificial Sequence
  Description of Artificial Sequence: Synthetic oligonucleotide
  Target: ATXN1; (+) strand; PAM type: YTN; PAM sequence: CTG
caacctctgcctctcaggtt

SEQ ID NO: 295795 - DNA, 20 bp, Artificial Sequence
  Description of Artificial Sequence: Synthetic oligonucleotide
  Target: ATXN1; (+) strand; PAM type: YTN; PAM sequence: CTC
tgcctctcaggttcaagcaa

SEQ ID NO: 295796 - DNA, 20 bp, Artificial Sequence
  Description of Artificial Sequence: Synthetic oligonucleotide
  Target: ATXN1; (+) strand; PAM type: YTN; PAM sequence: CTG
cctctcaggttcaagcaatt

SEQ ID NO: 295797 - DNA, 20 bp, Artificial Sequence
  Description of Artificial Sequence: Synthetic oligonucleotide
  Target: ATXN1; (+) strand; PAM type: YTN; PAM sequence: CTC
tcaggttcaagcaattctcc

SEQ ID NO: 295798 - DNA, 20 bp, Artificial Sequence
  Description of Artificial Sequence: Synthetic oligonucleotide
  Target: ATXN1; (+) strand; PAM type: YTN; PAM sequence: CTC
aggttcaagcaattctcctg

SEQ ID NO: 295799 - DNA, 20 bp, Artificial Sequence
  Description of Artificial Sequence: Synthetic oligonucleotide
  Target: ATXN1; (+) strand; PAM type: YTN; PAM sequence: TTC
aagcaattctcctgcctcag

SEQ ID NO: 295800 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcccaag

SEQ ID NO: 295801 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccaagta

SEQ ID NO: 295802 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaagtagct

SEQ ID NO: 295803 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagtagctggga

SEQ ID NO: 295804 - DNA, 20 bp, Artificial Sequence
  Description of Artificial Sequence: Synthetic oligonucleotide
  Target: ATXN1; (+) strand; PAM type: YTN; PAM sequence: CTC
ccaagtagctgggattacag

SEQ ID NO: 295805 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcacacgccac

SEQ ID NO: 295806 - DNA, 20 bp, Artificial Sequence
  Description of Artificial Sequence: Synthetic oligonucleotide
  Target: ATXN1; (+) strand; PAM type: YTN; PAM sequence: TTA
caggcacacgccaccacgcc

SEQ ID NO: 295807 - DNA, 20 bp, Artificial Sequence
  Description of Artificial Sequence: Synthetic oligonucleotide
  Target: ATXN1; (+) strand; PAM type: YTN; PAM sequence: CTA
attttttgtatttttagtag

SEQ ID NO: 295808 - DNA, 20 bp, Artificial Sequence
  Description of Artificial Sequence: Synthetic oligonucleotide
  Target: ATXN1; (+) strand; PAM type: YTN; PAM sequence: TTT
tttgtatttttagtagagac

SEQ ID NO: 295809 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagaca

SEQ ID NO: 295810 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagacag

SEQ ID NO: 295811 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagacagg

SEQ ID NO: 295812 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagacagga

SEQ ID NO: 295813 - DNA, 20 bp, Artificial Sequence
  Description of Artificial Sequence: Synthetic oligonucleotide
  Target: ATXN1; (+) strand; PAM type: YTN; PAM sequence: TTT
ttagtagagacaggatttca

SEQ ID NO: 295814 - DNA, 20 bp, Artificial Sequence
  Description of Artificial Sequence: Synthetic oligonucleotide
  Target: ATXN1; (+) strand; PAM type: YTN; PAM sequence: TTT
tagtagagacaggatttcac

SEQ ID NO: 295815 - DNA, 20 bp, Artificial Sequence
  Description of Artificial Sequence: Synthetic oligonucleotide
  Target: ATXN1; (+) strand; PAM type: YTN; PAM sequence: TTT
agtagagacaggatttcacc

SEQ ID NO: 295816 - DNA, 20 bp, Artificial Sequence
  Description of Artificial Sequence: Synthetic oligonucleotide
  Target: ATXN1; (+) strand; PAM type: YTN; PAM sequence: TTA
gtagagacaggatttcacca

SEQ ID NO: 295817 - DNA, 20 bp, Artificial Sequence
  Description of Artificial Sequence: Synthetic oligonucleotide
  Target: ATXN1; (+) strand; PAM type: YTN; PAM sequence: TTT
caccatgttggccaggctgg

SEQ ID NO: 295818 - DNA, 20 bp, Artificial Sequence
  Description of Artificial Sequence: Synthetic oligonucleotide
  Target: ATXN1; (+) strand; PAM type: YTN; PAM sequence: TTC
accatgttggccaggctggt

SEQ ID NO: 295819 - DNA, 20 bp, Artificial Sequence
  Description of Artificial Sequence: Synthetic oligonucleotide
  Target: ATXN1; (+) strand; PAM type: YTN; PAM sequence: TTG
gccaggctggtcttgaactc

SEQ ID NO: 295820 - DNA, 20 bp, Artificial Sequence
  Description of Artificial Sequence: Synthetic oligonucleotide
  Target: ATXN1; (+) strand; PAM type: YTN; PAM sequence: CTG
gtcttgaactcttgacctca

SEQ ID NO: 295821 - DNA, 20 bp, Artificial Sequence
  Description of Artificial Sequence: Synthetic oligonucleotide
  Target: ATXN1; (+) strand; PAM type: YTN; PAM sequence: CTT
gaactcttgacctcaggtga

SEQ ID NO: 295822 - DNA, 20 bp, Artificial Sequence
  Description of Artificial Sequence: Synthetic oligonucleotide
  Target: ATXN1; (+) strand; PAM type: YTN; PAM sequence: TTG
aactcttgacctcaggtgat

SEQ ID NO: 295823 - DNA, 20 bp, Artificial Sequence
  Description of Artificial Sequence: Synthetic oligonucleotide
  Target: ATXN1; (+) strand; PAM type: YTN; PAM sequence: CTC
ttgacctcaggtgatctgct

SEQ ID NO: 295824 - DNA, 20 bp, Artificial Sequence
  Description of Artificial Sequence: Synthetic oligonucleotide
  Target: ATXN1; (+) strand; PAM type: YTN; PAM sequence: CTT
gacctcaggtgatctgctgg

SEQ ID NO: 295825 - DNA, 20 bp, Artificial Sequence
  Description of Artificial Sequence: Synthetic oligonucleotide
  Target: ATXN1; (+) strand; PAM type: YTN; PAM sequence: TTG
acctcaggtgatctgctggt

SEQ ID NO: 295826 - DNA, 20 bp, Artificial Sequence
  Description of Artificial Sequence: Synthetic oligonucleotide
  Target: ATXN1; (+) strand; PAM type: YTN; PAM sequence: CTC
aggtgatctgctggtctcgg

SEQ ID NO: 295827 - DNA, 20 bp, Artificial Sequence
  Description of Artificial Sequence: Synthetic oligonucleotide
  Target: ATXN1; (+) strand; PAM type: YTN; PAM sequence: CTG
ctggtctcggcctcccaaag

SEQ ID NO: 295828 - DNA, 20 bp, Artificial Sequence
  Description of Artificial Sequence: Synthetic oligonucleotide
  Target: ATXN1; (+) strand; PAM type: YTN; PAM sequence: CTG
gtctcggcctcccaaagtgc

SEQ ID NO: 295829 - DNA, 20 bp, Artificial Sequence
  Description of Artificial Sequence: Synthetic oligonucleotide
  Target: ATXN1; (+) strand; PAM type: YTN; PAM sequence: CTC
ggcctcccaaagtgctggga

SEQ ID NO: 295830 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctgggattacag

SEQ ID NO: 295831 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcgtgggccac

SEQ ID NO: 295832 - DNA, 20 bp, Artificial Sequence
  Description of Artificial Sequence: Synthetic oligonucleotide
  Target: ATXN1; (+) strand; PAM type: YTN; PAM sequence: TTA
caggcgtgggccactgcacc

SEQ ID NO: 295833 - DNA, 20 bp, Artificial Sequence
  Description of Artificial Sequence: Synthetic oligonucleotide
  Target: ATXN1; (+) strand; PAM type: YTN; PAM sequence: CTG
cacccggccattcatcaggc

SEQ ID NO: 295834 - DNA, 20 bp, Artificial Sequence
  Description of Artificial Sequence: Synthetic oligonucleotide
  Target: ATXN1; (+) strand; PAM type: YTN; PAM sequence: TTC
atcaggcttcttaacctgcc

SEQ ID NO: 295835 - DNA, 20 bp, Artificial Sequence
  Description of Artificial Sequence: Synthetic oligonucleotide
  Target: ATXN1; (+) strand; PAM type: YTN; PAM sequence: CTT
cttaacctgccacatagctc

SEQ ID NO: 295836 - DNA, 20 bp, Artificial Sequence
  Description of Artificial Sequence: Synthetic oligonucleotide
  Target: ATXN1; (+) strand; PAM type: YTN; PAM sequence: TTC
ttaacctgccacatagctct

SEQ ID NO: 295837 - DNA, 20 bp, Artificial Sequence
  Description of Artificial Sequence: Synthetic oligonucleotide
  Target: ATXN1; (+) strand; PAM type: YTN; PAM sequence: CTT
aacctgccacatagctctac

SEQ ID NO: 295838 - DNA, 20 bp, Artificial Sequence
  Description of Artificial Sequence: Synthetic oligonucleotide
  Target: ATXN1; (+) strand; PAM type: YTN; PAM sequence: TTA
acctgccacatagctctaca

SEQ ID NO: 295839 - DNA, 20 bp, Artificial Sequence
  Description of Artificial Sequence: Synthetic oligonucleotide
  Target: ATXN1; (+) strand; PAM type: YTN; PAM sequence: CTG
ccacatagctctacaattct

SEQ ID NO: 295840 - DNA, 20 bp, Artificial Sequence
  Description of Artificial Sequence: Synthetic oligonucleotide
  Target: ATXN1; (+) strand; PAM type: YTN; PAM sequence: CTC
tacaattcttgcatctttga

SEQ ID NO: 295841 - DNA, 20 bp, Artificial Sequence
  Description of Artificial Sequence: Synthetic oligonucleotide
  Target: ATXN1; (+) strand; PAM type: YTN; PAM sequence: CTA
caattcttgcatctttgata

SEQ ID NO: 295842 - DNA, 20 bp, Artificial Sequence
  Description of Artificial Sequence: Synthetic oligonucleotide
  Target: ATXN1; (+) strand; PAM type: YTN; PAM sequence: TTC
ttgcatctttgataccttaa

SEQ ID NO: 295843 - DNA, 20 bp, Artificial Sequence
  Description of Artificial Sequence: Synthetic oligonucleotide
  Target: ATXN1; (+) strand; PAM type: YTN; PAM sequence: CTT
gcatctttgataccttaact

SEQ ID NO: 295844 - DNA, 20 bp, Artificial Sequence
  Description of Artificial Sequence: Synthetic oligonucleotide
  Target: ATXN1; (+) strand; PAM type: YTN; PAM sequence: TTG
catctttgataccttaacta

SEQ ID NO: 295845 - DNA, 20 bp, Artificial Sequence
  Description of Artificial Sequence: Synthetic oligonucleotide
  Target: ATXN1; (+) strand; PAM type: YTN; PAM sequence: CTT
tgataccttaactatatcat

SEQ ID NO: 295846 - DNA, 20 bp, Artificial Sequence
  Description of Artificial Sequence: Synthetic oligonucleotide
  Target: ATXN1; (+) strand; PAM type: YTN; PAM sequence: TTT
gataccttaactatatcata

SEQ ID NO: 295847 - DNA, 20 bp, Artificial Sequence
  Description of Artificial Sequence: Synthetic oligonucleotide
  Target: ATXN1; (+) strand; PAM type: YTN; PAM sequence: TTG
ataccttaactatatcataa

SEQ ID NO: 295848 - DNA, 20 bp, Artificial Sequence
  Description of Artificial Sequence: Synthetic oligonucleotide
  Target: ATXN1; (+) strand; PAM type: YTN; PAM sequence: CTT
aactatatcataagctatat

SEQ ID NO: 295849 - DNA, 20 bp, Artificial Sequence
  Description of Artificial Sequence: Synthetic oligonucleotide
  Target: ATXN1; (+) strand; PAM type: YTN; PAM sequence: TTA
actatatcataagctatatt

SEQ ID NO: 295850 - DNA, 20 bp, Artificial Sequence
  Description of Artificial Sequence: Synthetic oligonucleotide
  Target: ATXN1; (+) strand; PAM type: YTN; PAM sequence: CTA
tatcataagctatattcagt

SEQ ID NO: 295851 - DNA, 20 bp, Artificial Sequence
  Description of Artificial Sequence: Synthetic oligonucleotide
  Target: ATXN1; (+) strand; PAM type: YTN; PAM sequence: CTA
tattcagttgtcaaagaaaa

SEQ ID NO: 295852 - DNA, 20 bp, Artificial Sequence
  Description of Artificial Sequence: Synthetic oligonucleotide
  Target: ATXN1; (+) strand; PAM type: YTN; PAM sequence: TTC
agttgtcaaagaaaacagaa

SEQ ID NO: 295853 - DNA, 20 bp, Artificial Sequence
  Description of Artificial Sequence: Synthetic oligonucleotide
  Target: ATXN1; (+) strand; PAM type: YTN; PAM sequence: TTG
tcaaagaaaacagaaaggta

SEQ ID NO: 295854 - DNA, 20 bp, Artificial Sequence
  Description of Artificial Sequence: Synthetic oligonucleotide
  Target: ATXN1; (+) strand; PAM type: YTN; PAM sequence: CTC
ttgctgtttgaagagcaacc

SEQ ID NO: 295855 - DNA, 20 bp, Artificial Sequence
  Description of Artificial Sequence: Synthetic oligonucleotide
  Target: ATXN1; (+) strand; PAM type: YTN; PAM sequence: CTT
gctgtttgaagagcaacctc

SEQ ID NO: 295856 - DNA, 20 bp, Artificial Sequence
  Description of Artificial Sequence: Synthetic oligonucleotide
  Target: ATXN1; (+) strand; PAM type: YTN; PAM sequence: TTG
ctgtttgaagagcaacctca

SEQ ID NO: 295857 - DNA, 20 bp, Artificial Sequence
  Description of Artificial Sequence: Synthetic oligonucleotide
  Target: ATXN1; (+) strand; PAM type: YTN; PAM sequence: CTG
tttgaagagcaacctcagta

SEQ ID NO: 295858 - DNA, 20 bp, Artificial Sequence
  Description of Artificial Sequence: Synthetic oligonucleotide
  Target: ATXN1; (+) strand; PAM type: YTN; PAM sequence: TTT
gaagagcaacctcagtatgg

SEQ ID NO: 295859 - DNA, 20 bp, Artificial Sequence
  Description of Artificial Sequence: Synthetic oligonucleotide
  Target: ATXN1; (+) strand; PAM type: YTN; PAM sequence: TTG
aagagcaacctcagtatggt

SEQ ID NO: 295860 - DNA, 20 bp, Artificial Sequence
  Description of Artificial Sequence: Synthetic oligonucleotide
  Target: ATXN1; (+) strand; PAM type: YTN; PAM sequence: CTC
agtatggttcttccatttca

SEQ ID NO: 295861 - DNA, 20 bp, Artificial Sequence
  Description of Artificial Sequence: Synthetic oligonucleotide
  Target: ATXN1; (+) strand; PAM type: YTN; PAM sequence: TTC
ttccatttcagtctggttaa

SEQ ID NO: 295862 - DNA, 20 bp, Artificial Sequence
  Description of Artificial Sequence: Synthetic oligonucleotide
  Target: ATXN1; (+) strand; PAM type: YTN; PAM sequence: CTT
ccatttcagtctggttaatt

SEQ ID NO: 295863 - DNA, 20 bp, Artificial Sequence
  Description of Artificial Sequence: Synthetic oligonucleotide
  Target: ATXN1; (+) strand; PAM type: YTN; PAM sequence: TTC
catttcagtctggttaattt

SEQ ID NO: 295864 - DNA, 20 bp, Artificial Sequence
  Description of Artificial Sequence: Synthetic oligonucleotide
  Target: ATXN1; (+) strand; PAM type: YTN; PAM sequence: TTT
cagtctggttaatttgcgtc

SEQ ID NO: 295865 - DNA, 20 bp, Artificial Sequence
  Description of Artificial Sequence: Synthetic oligonucleotide
  Target: ATXN1; (+) strand; PAM type: YTN; PAM sequence: TTC
agtctggttaatttgcgtca

SEQ ID NO: 295866 - DNA, 20 bp, Artificial Sequence
  Description of Artificial Sequence: Synthetic oligonucleotide
  Target: ATXN1; (+) strand; PAM type: YTN; PAM sequence: CTG
gttaatttgcgtcatttaac

SEQ ID NO: 295867 - DNA, 20 bp, Artificial Sequence
  Description of Artificial Sequence: Synthetic oligonucleotide
  Target: ATXN1; (+) strand; PAM type: YTN; PAM sequence: TTA
atttgcgtcatttaactatt

SEQ ID NO: 295868 - DNA, 20 bp, Artificial Sequence
  Description of Artificial Sequence: Synthetic oligonucleotide
  Target: ATXN1; (+) strand; PAM type: YTN; PAM sequence: TTT
gcgtcatttaactattagag

SEQ ID NO: 295869 - DNA, 20 bp, Artificial Sequence
  Description of Artificial Sequence: Synthetic oligonucleotide
  Target: ATXN1; (+) strand; PAM type: YTN; PAM sequence: TTG
cgtcatttaactattagaga

SEQ ID NO: 295870 - DNA, 20 bp, Artificial Sequence
  Description of Artificial Sequence: Synthetic oligonucleotide
  Target: ATXN1; (+) strand; PAM type: YTN; PAM sequence: TTT
aactattagagaatttccag

SEQ ID NO: 295871 - DNA, 20 bp, Artificial Sequence
  Description of Artificial Sequence: Synthetic oligonucleotide
  Target: ATXN1; (+) strand; PAM type: YTN; PAM sequence: TTA
actattagagaatttccagc

SEQ ID NO: 295872 - DNA, 20 bp, Artificial Sequence
  Description of Artificial Sequence: Synthetic oligonucleotide
  Target: ATXN1; (+) strand; PAM type: YTN; PAM sequence: CTA
ttagagaatttccagcacca

SEQ ID NO: 295873 - DNA, 20 bp, Artificial Sequence
  Description of Artificial Sequence: Synthetic oligonucleotide
  Target: ATXN1; (+) strand; PAM type: YTN; PAM sequence: TTA
gagaatttccagcaccattt

SEQ ID NO: 295874 - DNA, 20 bp, Artificial Sequence
  Description of Artificial Sequence: Synthetic oligonucleotide
  Target: ATXN1; (+) strand; PAM type: YTN; PAM sequence: TTT
ccagcaccatttgccaacgc

SEQ ID NO: 295875 - DNA, 20 bp, Artificial Sequence
  Description of Artificial Sequence: Synthetic oligonucleotide
  Target: ATXN1; (+) strand; PAM type: YTN; PAM sequence: TTC
cagcaccatttgccaacgct

SEQ ID NO: 295876 - DNA, 20 bp, Artificial Sequence
  Description of Artificial Sequence: Synthetic oligonucleotide
  Target: ATXN1; (+) strand; PAM type: YTN; PAM sequence: TTT
gccaacgctgtaataaatag

SEQ ID NO: 295877 - DNA, 20 bp, Artificial Sequence
  Description of Artificial Sequence: Synthetic oligonucleotide
  Target: ATXN1; (+) strand; PAM type: YTN; PAM sequence: TTG
ccaacgctgtaataaatagt

SEQ ID NO: 295878 - DNA, 20 bp, Artificial Sequence
  Description of Artificial Sequence: Synthetic oligonucleotide
  Target: ATXN1; (+) strand; PAM type: YTN; PAM sequence: CTG
taataaatagtcctataaac

SEQ ID NO: 295879 - DNA, 20 bp, Artificial Sequence
  Description of Artificial Sequence: Synthetic oligonucleotide
  Target: ATXN1; (+) strand; PAM type: YTN; PAM sequence: CTA
taaactgaatgtctttttgc

SEQ ID NO: 295880 - DNA, 20 bp, Artificial Sequence
  Description of Artificial Sequence: Synthetic oligonucleotide
  Target: ATXN1; (+) strand; PAM type: YTN; PAM sequence: CTG
aatgtctttttgcaattgta

SEQ ID NO: 295881 - DNA, 20 bp, Artificial Sequence
  Description of Artificial Sequence: Synthetic oligonucleotide
  Target: ATXN1; (+) strand; PAM type: YTN; PAM sequence: CTT
tttgcaattgtaaagggttt

SEQ ID NO: 295882 - DNA, 20 bp, Artificial Sequence
  Description of Artificial Sequence: Synthetic oligonucleotide
  Target: ATXN1; (+) strand; PAM type: YTN; PAM sequence: TTT
ttgcaattgtaaagggtttt

SEQ ID NO: 295883 - DNA, 20 bp, Artificial Sequence
  Description of Artificial Sequence: Synthetic oligonucleotide
  Target: ATXN1; (+) strand; PAM type: YTN; PAM sequence: TTT
tgcaattgtaaagggttttc

SEQ ID NO: 295884 - DNA, 20 bp, Artificial Sequence
  Description of Artificial Sequence: Synthetic oligonucleotide
  Target: ATXN1; (+) strand; PAM type: YTN; PAM sequence: TTT
gcaattgtaaagggttttcc

SEQ ID NO: 295885 - DNA, 20 bp, Artificial Sequence
  Description of Artificial Sequence: Synthetic oligonucleotide
  Target: ATXN1; (+) strand; PAM type: YTN; PAM sequence: TTG
caattgtaaagggttttccc

SEQ ID NO: 295886 - DNA, 20 bp, Artificial Sequence
  Description of Artificial Sequence: Synthetic oligonucleotide
  Target: ATXN1; (+) strand; PAM type: YTN; PAM sequence: TTG
taaagggttttccctgaaac

SEQ ID NO: 295887 - DNA, 20 bp, Artificial Sequence
  Description of Artificial Sequence: Synthetic oligonucleotide
  Target: ATXN1; (+) strand; PAM type: YTN; PAM sequence: TTT
tccctgaaactactcagtgg

SEQ ID NO: 295888 - DNA, 20 bp, Artificial Sequence
  Description of Artificial Sequence: Synthetic oligonucleotide
  Target: ATXN1; (+) strand; PAM type: YTN; PAM sequence: TTT
ccctgaaactactcagtggt

SEQ ID NO: 295889 - DNA, 20 bp, Artificial Sequence
  Description of Artificial Sequence: Synthetic oligonucleotide
  Target: ATXN1; (+) strand; PAM type: YTN; PAM sequence: TTC
cctgaaactactcagtggta

SEQ ID NO: 295890 - DNA, 20 bp, Artificial Sequence
  Description of Artificial Sequence: Synthetic oligonucleotide
  Target: ATXN1; (+) strand; PAM type: YTN; PAM sequence: CTG
aaactactcagtggtaagga

SEQ ID NO: 295891 - DNA, 20 bp, Artificial Sequence
  Description of Artificial Sequence: Synthetic oligonucleotide
  Target: ATXN1; (+) strand; PAM type: YTN; PAM sequence: CTA
ctcagtggtaaggaaaagaa

SEQ ID NO: 295892 - DNA, 20 bp, Artificial Sequence
  Description of Artificial Sequence: Synthetic oligonucleotide
  Target: ATXN1; (+) strand; PAM type: YTN; PAM sequence: CTC
agtggtaaggaaaagaacaa

SEQ ID NO: 295893 - DNA, 20 bp, Artificial Sequence
  Description of Artificial Sequence: Synthetic oligonucleotide
  Target: ATXN1; (+) strand; PAM type: YTN; PAM sequence: CTG
aataagatagccacagtatt

SEQ ID NO: 295894 - DNA, 20 bp, Artificial Sequence
  Description of Artificial Sequence: Synthetic oligonucleotide
  Target: ATXN1; (+) strand; PAM type: YTN; PAM sequence: TTT
tctgtttggatttttttttt

SEQ ID NO: 295895 - DNA, 20 bp, Artificial Sequence
  Description of Artificial Sequence: Synthetic oligonucleotide
  Target: ATXN1; (+) strand; PAM type: YTN; PAM sequence: TTT
ctgtttggattttttttttt

SEQ ID NO: 295896 - DNA, 20 bp, Artificial Sequence
  Description of Artificial Sequence: Synthetic oligonucleotide
  Target: ATXN1; (+) strand; PAM type: YTN; PAM sequence: TTC
tgtttggatttttttttttt

SEQ ID NO: 295897 - DNA, 20 bp, Artificial Sequence
  Description of Artificial Sequence: Synthetic oligonucleotide
  Target: ATXN1; (+) strand; PAM type: YTN; PAM sequence: CTG
tttggatttttttttttttt

SEQ ID NO: 295898 - DNA, 20 bp, Artificial Sequence
  Description of Artificial Sequence: Synthetic oligonucleotide
  Target: ATXN1; (+) strand; PAM type: YTN; PAM sequence: TTT
ggattttttttttttttttt

SEQ ID NO: 295899 - DNA, 20 bp, Artificial Sequence
  Description of Artificial Sequence: Synthetic oligonucleotide
  Target: ATXN1; (+) strand; PAM type: YTN; PAM sequence: TTG
gatttttttttttttttttt

SEQ ID NO: 295900 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttgaa

SEQ ID NO: 295901 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttgaaa

SEQ ID NO: 295902 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttgaaat

SEQ ID NO: 295903 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttgaaatg

SEQ ID NO: 295904 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgaaatgg

SEQ ID NO: 295905 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgaaatgga

SEQ ID NO: 295906 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgaaatggag

SEQ ID NO: 295907 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgaaatggagt

SEQ ID NO: 295908 - DNA, 20 bp, Artificial Sequence
  Description of Artificial Sequence: Synthetic oligonucleotide
  Target: ATXN1; (+) strand; PAM type: YTN; PAM sequence: TTT
tttttttttgaaatggagtt

SEQ ID NO: 295909 - DNA, 20 bp, Artificial Sequence
  Description of Artificial Sequence: Synthetic oligonucleotide
  Target: ATXN1; (+) strand; PAM type: YTN; PAM sequence: TTT
ttttttttgaaatggagttt

SEQ ID NO: 295910 - DNA, 20 bp, Artificial Sequence
  Description of Artificial Sequence: Synthetic oligonucleotide
  Target: ATXN1; (+) strand; PAM type: YTN; PAM sequence: TTT
tttttttgaaatggagtttt

SEQ ID NO: 295911 - DNA, 20 bp, Artificial Sequence
  Description of Artificial Sequence: Synthetic oligonucleotide
  Target: ATXN1; (+) strand; PAM type: YTN; PAM sequence: TTT
ttttttgaaatggagttttg

SEQ ID NO: 295912 - DNA, 20 bp, Artificial Sequence
  Description of Artificial Sequence: Synthetic oligonucleotide
  Target: ATXN1; (+) strand; PAM type: YTN; PAM sequence: TTT
tttttgaaatggagttttgc

SEQ ID NO: 295913 - DNA, 20 bp, Artificial Sequence
  Description of Artificial Sequence: Synthetic oligonucleotide
  Target: ATXN1; (+) strand; PAM type: YTN; PAM sequence: TTT
ttttgaaatggagttttgct

SEQ ID NO: 295914 - DNA, 20 bp, Artificial Sequence
  Description of Artificial Sequence: Synthetic oligonucleotide
  Target: ATXN1; (+) strand; PAM type: YTN; PAM sequence: TTT
tttgaaatggagttttgctc

SEQ ID NO: 295915 - DNA, 20 bp, Artificial Sequence
  Description of Artificial Sequence: Synthetic oligonucleotide
  Target: ATXN1; (+) strand; PAM type: YTN; PAM sequence: TTT
ttgaaatggagttttgctct

SEQ ID NO: 295916 - DNA, 20 bp, Artificial Sequence
  Description of Artificial Sequence: Synthetic oligonucleotide
  Target: ATXN1; (+) strand; PAM type: YTN; PAM sequence: TTT
tgaaatggagttttgctctt

SEQ ID NO: 295917 - DNA, 20 bp, Artificial Sequence
  Description of Artificial Sequence: Synthetic oligonucleotide
  Target: ATXN1; (+) strand; PAM type: YTN; PAM sequence: TTT
gaaatggagttttgctcttg

SEQ ID NO: 295918 - DNA, 20 bp, Artificial Sequence
  Description of Artificial Sequence: Synthetic oligonucleotide
  Target: ATXN1; (+) strand; PAM type: YTN; PAM sequence: TTG
aaatggagttttgctcttgt

SEQ ID NO: 295919 - DNA, 20 bp, Artificial Sequence
  Description of Artificial Sequence: Synthetic oligonucleotide
  Target: ATXN1; (+) strand; PAM type: YTN; PAM sequence: TTT
tgctcttgttgcccaggctg

SEQ ID NO: 295920 - DNA, 20 bp, Artificial Sequence
  Description of Artificial Sequence: Synthetic oligonucleotide
  Target: ATXN1; (+) strand; PAM type: YTN; PAM sequence: TTT
gctcttgttgcccaggctgt

SEQ ID NO: 295921 - DNA, 20 bp, Artificial Sequence
  Description of Artificial Sequence: Synthetic oligonucleotide
  Target: ATXN1; (+) strand; PAM type: YTN; PAM sequence: TTG
ctcttgttgcccaggctgta

SEQ ID NO: 295922 - DNA, 20 bp, Artificial Sequence
  Description of Artificial Sequence: Synthetic oligonucleotide
  Target: ATXN1; (+) strand; PAM type: YTN; PAM sequence: CTC
ttgttgcccaggctgtagtg

SEQ ID NO: 295923 - DNA, 20 bp, Artificial Sequence
  Description of Artificial Sequence: Synthetic oligonucleotide
  Target: ATXN1; (+) strand; PAM type: YTN; PAM sequence: CTT
gttgcccaggctgtagtgca

SEQ ID NO: 295924 - DNA, 20 bp, Artificial Sequence
  Description of Artificial Sequence: Synthetic oligonucleotide
  Target: ATXN1; (+) strand; PAM type: YTN; PAM sequence: TTG
ttgcccaggctgtagtgcaa

SEQ ID NO: 295925 - DNA, 20 bp, Artificial Sequence
  Description of Artificial Sequence: Synthetic oligonucleotide
  Target: ATXN1; (+) strand; PAM type: YTN; PAM sequence: TTG
cccaggctgtagtgcaatgg

SEQ ID NO: 295926 - DNA, 20 bp, Artificial Sequence
  Description of Artificial Sequence: Synthetic oligonucleotide
  Target: ATXN1; (+) strand; PAM type: YTN; PAM sequence: CTG
tagtgcaatggtgcaatgtc

SEQ ID NO: 295927 - DNA, 20 bp, Artificial Sequence
  Description of Artificial Sequence: Synthetic oligonucleotide
  Target: ATXN1; (+) strand; PAM type: YTN; PAM sequence: CTC
gctgcaacctctgcctcccg

SEQ ID NO: 295928 - DNA, 20 bp, Artificial Sequence
  Description of Artificial Sequence: Synthetic oligonucleotide
  Target: ATXN1; (+) strand; PAM type: YTN; PAM sequence: CTG
caacctctgcctcccgggtt

SEQ ID NO: 295929 - DNA, 20 bp, Artificial Sequence
  Description of Artificial Sequence: Synthetic oligonucleotide
  Target: ATXN1; (+) strand; PAM type: YTN; PAM sequence: CTC
tgcctcccgggttcaagcga

SEQ ID NO: 295930 - DNA, 20 bp, Artificial Sequence
  Description of Artificial Sequence: Synthetic oligonucleotide
  Target: ATXN1; (+) strand; PAM type: YTN; PAM sequence: CTG
cctcccgggttcaagcgatt

SEQ ID NO: 295931 - DNA, 20 bp, Artificial Sequence
  Description of Artificial Sequence: Synthetic oligonucleotide
  Target: ATXN1; (+) strand; PAM type: YTN; PAM sequence: CTC
ccgggttcaagcgattctcc

SEQ ID NO: 295932 - DNA, 20 bp, Artificial Sequence
  Description of Artificial Sequence: Synthetic oligonucleotide
  Target: ATXN1; (+) strand; PAM type: YTN; PAM sequence: TTC
aagcgattctcctgcctcag

SEQ ID NO: 295933 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcccaag

SEQ ID NO: 295934 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccaagca

SEQ ID NO: 295935 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaagcagct

SEQ ID NO: 295936 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagcagctggga

SEQ ID NO: 295937 - DNA, 20 bp, Artificial Sequence
  Description of Artificial Sequence: Synthetic oligonucleotide
  Target: ATXN1; (+) strand; PAM type: YTN; PAM sequence: CTC
ccaagcagctgggattacag

SEQ ID NO: 295938 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcgtccaccac

SEQ ID NO: 295939 - DNA, 20 bp, Artificial Sequence
  Description of Artificial Sequence: Synthetic oligonucleotide
  Target: ATXN1; (+) strand; PAM type: YTN; PAM sequence: TTA
caggcgtccaccaccatgcc

SEQ ID NO: 295940 - DNA, 20 bp, Artificial Sequence
  Description of Artificial Sequence: Synthetic oligonucleotide
  Target: ATXN1; (+) strand; PAM type: YTN; PAM sequence: CTG
gctaattaatctttagtaga

SEQ ID NO: 295941 - DNA, 20 bp, Artificial Sequence
  Description of Artificial Sequence: Synthetic oligonucleotide
  Target: ATXN1; (+) strand; PAM type: YTN; PAM sequence: CTA
attaatctttagtagagacg

SEQ ID NO: 295942 - DNA, 20 bp, Artificial Sequence
  Description of Artificial Sequence: Synthetic oligonucleotide
  Target: ATXN1; (+) strand; PAM type: YTN; PAM sequence: TTA
atctttagtagagacggggt

SEQ ID NO: 295943 - DNA, 20 bp, Artificial Sequence
  Description of Artificial Sequence: Synthetic oligonucleotide
  Target: ATXN1; (+) strand; PAM type: YTN; PAM sequence: CTT
tagtagagacggggtttcac

SEQ ID NO: 295944 - DNA, 20 bp, Artificial Sequence
  Description of Artificial Sequence: Synthetic oligonucleotide
  Target: ATXN1; (+) strand; PAM type: YTN; PAM sequence: TTT
agtagagacggggtttcacc

SEQ ID NO: 295945 - DNA, 20 bp, Artificial Sequence
  Description of Artificial Sequence: Synthetic oligonucleotide
  Target: ATXN1; (+) strand; PAM type: YTN; PAM sequence: TTA
gtagagacggggtttcacca

SEQ ID NO: 295946 - DNA, 20 bp, Artificial Sequence
  Description of Artificial Sequence: Synthetic oligonucleotide
  Target: ATXN1; (+) strand; PAM type: YTN; PAM sequence: TTT
caccatgttggtcaggctgg

SEQ ID NO: 295947 - DNA, 20 bp, Artificial Sequence
  Description of Artificial Sequence: Synthetic oligonucleotide
  Target: ATXN1; (+) strand; PAM type: YTN; PAM sequence: TTC
accatgttggtcaggctggt

SEQ ID NO: 295948 - DNA, 20 bp, Artificial Sequence
  Description of Artificial Sequence: Synthetic oligonucleotide
  Target: ATXN1; (+) strand; PAM type: YTN; PAM sequence: TTG
gtcaggctggtctctaactc

SEQ ID NO: 295949 - DNA, 20 bp, Artificial Sequence
  Description of Artificial Sequence: Synthetic oligonucleotide
  Target: ATXN1; (+) strand; PAM type: YTN; PAM sequence: CTG
gtctctaactcctgacctca

SEQ ID NO: 295950 - DNA, 20 bp, Artificial Sequence
  Description of Artificial Sequence: Synthetic oligonucleotide
  Target: ATXN1; (+) strand; PAM type: YTN; PAM sequence: CTC
taactcctgacctcaggtga

SEQ ID NO: 295951 - DNA, 20 bp, Artificial Sequence
  Description of Artificial Sequence: Synthetic oligonucleotide
  Target: ATXN1; (+) strand; PAM type: YTN; PAM sequence: CTA
actcctgacctcaggtgatc

SEQ ID NO: 295952 - DNA, 20 bp, Artificial Sequence
  Description of Artificial Sequence: Synthetic oligonucleotide
  Target: ATXN1; (+) strand; PAM type: YTN; PAM sequence: CTC
ctgacctcaggtgatccacc

SEQ ID NO: 295953 - DNA, 20 bp, Artificial Sequence
  Description of Artificial Sequence: Synthetic oligonucleotide
  Target: ATXN1; (+) strand; PAM type: YTN; PAM sequence: CTG
acctcaggtgatccacccac

SEQ ID NO: 295954 - DNA, 20 bp, Artificial Sequence
  Description of Artificial Sequence: Synthetic oligonucleotide
  Target: ATXN1; (+) strand; PAM type: YTN; PAM sequence: CTC
aggtgatccacccacctcgg

SEQ ID NO: 295955 - DNA, 20 bp, Artificial Sequence
  Description of Artificial Sequence: Synthetic oligonucleotide
  Target: ATXN1; (+) strand; PAM type: YTN; PAM sequence: CTC
ggcctcccgaagtgctagga

SEQ ID NO: 295956 - DNA, 20 bp, Artificial Sequence
  Description of Artificial Sequence: Synthetic oligonucleotide
  Target: ATXN1; (+) strand; PAM type: YTN; PAM sequence: CTC
ccgaagtgctaggattacag

SEQ ID NO: 295957 - DNA, 20 bp, Artificial Sequence
  Description of Artificial Sequence: Synthetic oligonucleotide
  Target: ATXN1; (+) strand; PAM type: YTN; PAM sequence: CTA
ggattacaggcaggagccac

SEQ ID NO: 295958 - DNA, 20 bp, Artificial Sequence
  Description of Artificial Sequence: Synthetic oligonucleotide
  Target: ATXN1; (+) strand; PAM type: YTN; PAM sequence: TTA
caggcaggagccaccgtgcc

SEQ ID NO: 295959 - DNA, 20 bp, Artificial Sequence
  Description of Artificial Sequence: Synthetic oligonucleotide
  Target: ATXN1; (+) strand; PAM type: YTN; PAM sequence: CTG
gatttttttttaatatagga

SEQ ID NO: 295960 - DNA, 20 bp, Artificial Sequence
  Description of Artificial Sequence: Synthetic oligonucleotide
  Target: ATXN1; (+) strand; PAM type: YTN; PAM sequence: TTT
ttttttaatataggaaaaaa

SEQ ID NO: 295961 - DNA, 20 bp, Artificial Sequence
  Description of Artificial Sequence: Synthetic oligonucleotide
  Target: ATXN1; (+) strand; PAM type: YTN; PAM sequence: TTT
tttttaatataggaaaaaat

SEQ ID NO: 295962 - DNA, 20 bp, Artificial Sequence
  Description of Artificial Sequence: Synthetic oligonucleotide
  Target: ATXN1; (+) strand; PAM type: YTN; PAM sequence: TTT
ttttaatataggaaaaaatc

SEQ ID NO: 295963 - DNA, 20 bp, Artificial Sequence
  Description of Artificial Sequence: Synthetic oligonucleotide
  Target: ATXN1; (+) strand; PAM type: YTN; PAM sequence: TTT
tttaatataggaaaaaatca

SEQ ID NO: 295964 - DNA, 20 bp, Artificial Sequence
  Description of Artificial Sequence: Synthetic oligonucleotide
  Target: ATXN1; (+) strand; PAM type: YTN; PAM sequence: TTT
ttaatataggaaaaaatcaa

SEQ ID NO: 295965 - DNA, 20 bp, Artificial Sequence
  Description of Artificial Sequence: Synthetic oligonucleotide
  Target: ATXN1; (+) strand; PAM type: YTN; PAM sequence: TTT
taatataggaaaaaatcaat

SEQ ID NO: 295966 - DNA, 20 bp, Artificial Sequence
  Description of Artificial Sequence: Synthetic oligonucleotide
  Target: ATXN1; (+) strand; PAM type: YTN; PAM sequence: TTT
aatataggaaaaaatcaatt

SEQ ID NO: 295967 - DNA, 20 bp, Artificial Sequence
  Description of Artificial Sequence: Synthetic oligonucleotide
  Target: ATXN1; (+) strand; PAM type: YTN; PAM sequence: TTA
atataggaaaaaatcaattt

SEQ ID NO: 295968 - DNA, 20 bp, Artificial Sequence
  Description of Artificial Sequence: Synthetic oligonucleotide
  Target: ATXN1; (+) strand; PAM type: YTN; PAM sequence: TTT
tcagttggcaatagaaagtc

SEQ ID NO: 295969 - DNA, 20 bp, Artificial Sequence
  Description of Artificial Sequence: Synthetic oligonucleotide
  Target: ATXN1; (+) strand; PAM type: YTN; PAM sequence: TTT
cagttggcaatagaaagtca

SEQ ID NO: 295970 - DNA, 20 bp, Artificial Sequence
  Description of Artificial Sequence: Synthetic oligonucleotide
  Target: ATXN1; (+) strand; PAM type: YTN; PAM sequence: TTC
agttggcaatagaaagtcac

SEQ ID NO: 295971 - DNA, 20 bp, Artificial Sequence
  Description of Artificial Sequence: Synthetic oligonucleotide
  Target: ATXN1; (+) strand; PAM type: YTN; PAM sequence: TTG
gcaatagaaagtcactaagg

SEQ ID NO: 295972 - DNA, 20 bp, Artificial Sequence
  Description of Artificial Sequence: Synthetic oligonucleotide
  Target: ATXN1; (+) strand; PAM type: YTN; PAM sequence: CTA
aggattcaaactgtacgaag

SEQ ID NO: 295973 - DNA, 20 bp, Artificial Sequence
  Description of Artificial Sequence: Synthetic oligonucleotide
  Target: ATXN1; (+) strand; PAM type: YTN; PAM sequence: TTC
aaactgtacgaagtgtttca

SEQ ID NO: 295974 - DNA, 20 bp, Artificial Sequence
  Description of Artificial Sequence: Synthetic oligonucleotide
  Target: ATXN1; (+) strand; PAM type: YTN; PAM sequence: CTG
tacgaagtgtttcagtagga

SEQ ID NO: 295975 - DNA, 20 bp, Artificial Sequence
  Description of Artificial Sequence: Synthetic oligonucleotide
  Target: ATXN1; (+) strand; PAM type: YTN; PAM sequence: TTT
cagtaggaaccggcaagacc

SEQ ID NO: 295976 - DNA, 20 bp, Artificial Sequence
  Description of Artificial Sequence: Synthetic oligonucleotide
  Target: ATXN1; (+) strand; PAM type: YTN; PAM sequence: TTC
agtaggaaccggcaagacca

SEQ ID NO: 295977 - DNA, 20 bp, Artificial Sequence
  Description of Artificial Sequence: Synthetic oligonucleotide
  Target: ATXN1; (+) strand; PAM type: YTN; PAM sequence: TTT
tttaaaaagaacttttgaat

SEQ ID NO: 295978 - DNA, 20 bp, Artificial Sequence
  Description of Artificial Sequence: Synthetic oligonucleotide
  Target: ATXN1; (+) strand; PAM type: YTN; PAM sequence: TTT
ttaaaaagaacttttgaatt

SEQ ID NO: 295979 - DNA, 20 bp, Artificial Sequence
  Description of Artificial Sequence: Synthetic oligonucleotide
  Target: ATXN1; (+) strand; PAM type: YTN; PAM sequence: TTT
taaaaagaacttttgaatta

SEQ ID NO: 295980 - DNA, 20 bp, Artificial Sequence
  Description of Artificial Sequence: Synthetic oligonucleotide
  Target: ATXN1; (+) strand; PAM type: YTN; PAM sequence: TTT
aaaaagaacttttgaattat

SEQ ID NO: 295981 - DNA, 20 bp, Artificial Sequence
  Description of Artificial Sequence: Synthetic oligonucleotide
  Target: ATXN1; (+) strand; PAM type: YTN; PAM sequence: TTA
aaaagaacttttgaattata

SEQ ID NO: 295982 - DNA, 20 bp, Artificial Sequence
  Description of Artificial Sequence: Synthetic oligonucleotide
  Target: ATXN1; (+) strand; PAM type: YTN; PAM sequence: CTT
ttgaattatataaaatacag

SEQ ID NO: 295983 - DNA, 20 bp, Artificial Sequence
  Description of Artificial Sequence: Synthetic oligonucleotide
  Target: ATXN1; (+) strand; PAM type: YTN; PAM sequence: TTT
tgaattatataaaatacagt

SEQ ID NO: 295984 - DNA, 20 bp, Artificial Sequence
  Description of Artificial Sequence: Synthetic oligonucleotide
  Target: ATXN1; (+) strand; PAM type: YTN; PAM sequence: TTT
gaattatataaaatacagtg

SEQ ID NO: 295985 - DNA, 20 bp, Artificial Sequence
  Description of Artificial Sequence: Synthetic oligonucleotide
  Target: ATXN1; (+) strand; PAM type: YTN; PAM sequence: TTG
aattatataaaatacagtga

SEQ ID NO: 295986 - DNA, 20 bp, Artificial Sequence
  Description of Artificial Sequence: Synthetic oligonucleotide
  Target: ATXN1; (+) strand; PAM type: YTN; PAM sequence: TTA
tataaaatacagtgactatt

SEQ ID NO: 295987 - DNA, 20 bp, Artificial Sequence
  Description of Artificial Sequence: Synthetic oligonucleotide
  Target: ATXN1; (+) strand; PAM type: YTN; PAM sequence: CTA
ttgtccctataattattata

SEQ ID NO: 295988 - DNA, 20 bp, Artificial Sequence
  Description of Artificial Sequence: Synthetic oligonucleotide
  Target: ATXN1; (+) strand; PAM type: YTN; PAM sequence: TTG
tccctataattattataaca

SEQ ID NO: 295989 - DNA, 20 bp, Artificial Sequence
  Description of Artificial Sequence: Synthetic oligonucleotide
  Target: ATXN1; (+) strand; PAM type: YTN; PAM sequence: CTA
taattattataacaaattaa

SEQ ID NO: 295990 - DNA, 20 bp, Artificial Sequence
  Description of Artificial Sequence: Synthetic oligonucleotide
  Target: ATXN1; (+) strand; PAM type: YTN; PAM sequence: TTA
ttataacaaattaagatgtt

SEQ ID NO: 295991 - DNA, 20 bp, Artificial Sequence
  Description of Artificial Sequence: Synthetic oligonucleotide
  Target: ATXN1; (+) strand; PAM type: YTN; PAM sequence: TTA
taacaaattaagatgtttct

SEQ ID NO: 295992 - DNA, 20 bp, Artificial Sequence
  Description of Artificial Sequence: Synthetic oligonucleotide
  Target: ATXN1; (+) strand; PAM type: YTN; PAM sequence: TTA
agatgtttctattctttctg

SEQ ID NO: 295993 - DNA, 20 bp, Artificial Sequence
  Description of Artificial Sequence: Synthetic oligonucleotide
  Target: ATXN1; (+) strand; PAM type: YTN; PAM sequence: TTT
ctattctttctgtggcatag

SEQ ID NO: 295994 - DNA, 20 bp, Artificial Sequence
  Description of Artificial Sequence: Synthetic oligonucleotide
  Target: ATXN1; (+) strand; PAM type: YTN; PAM sequence: TTC
tattctttctgtggcataga

SEQ ID NO: 295995 - DNA, 20 bp, Artificial Sequence
  Description of Artificial Sequence: Synthetic oligonucleotide
  Target: ATXN1; (+) strand; PAM type: YTN; PAM sequence: CTA
ttctttctgtggcatagaca

SEQ ID NO: 295996 - DNA, 20 bp, Artificial Sequence
  Description of Artificial Sequence: Synthetic oligonucleotide
  Target: ATXN1; (+) strand; PAM type: YTN; PAM sequence: TTC
tttctgtggcatagacatgt

SEQ ID NO: 295997 - DNA, 20 bp, Artificial Sequence
  Description of Artificial Sequence: Synthetic oligonucleotide
  Target: ATXN1; (+) strand; PAM type: YTN; PAM sequence: CTT
tctgtggcatagacatgtga

SEQ ID NO: 295998 - DNA, 20 bp, Artificial Sequence
  Description of Artificial Sequence: Synthetic oligonucleotide
  Target: ATXN1; (+) strand; PAM type: YTN; PAM sequence: TTT
ctgtggcatagacatgtgaa

SEQ ID NO: 295999 - DNA, 20 bp, Artificial Sequence
  Description of Artificial Sequence: Synthetic oligonucleotide
  Target: ATXN1; (+) strand; PAM type: YTN; PAM sequence: TTC
tgtggcatagacatgtgaaa

SEQ ID NO: 296000 - DNA, 20 bp, Artificial Sequence
  Description of Artificial Sequence: Synthetic oligonucleotide
  Target: ATXN1; (+) strand; PAM type: YTN; PAM sequence: CTG
tggcatagacatgtgaaata

SEQ ID NO: 296001 - DNA, 20 bp, Artificial Sequence
  Description of Artificial Sequence: Synthetic oligonucleotide
  Target: ATXN1; (+) strand; PAM type: YTN; PAM sequence: TTC
tcgctgcactcctgcctcaa

SEQ ID NO: 296002 - DNA, 20 bp, Artificial Sequence
  Description of Artificial Sequence: Synthetic oligonucleotide
  Target: ATXN1; (+) strand; PAM type: YTN; PAM sequence: CTC
gctgcactcctgcctcaata

SEQ ID NO: 296003 - DNA, 20 bp, Artificial Sequence
  Description of Artificial Sequence: Synthetic oligonucleotide
  Target: ATXN1; (+) strand; PAM type: YTN; PAM sequence: CTG
cactcctgcctcaatacaaa

SEQ ID NO: 296004 - DNA, 20 bp, Artificial Sequence
  Description of Artificial Sequence: Synthetic oligonucleotide
  Target: ATXN1; (+) strand; PAM type: YTN; PAM sequence: CTC
ctgcctcaatacaaatttag

SEQ ID NO: 296005 - DNA, 20 bp, Artificial Sequence
  Description of Artificial Sequence: Synthetic oligonucleotide
  Target: ATXN1; (+) strand; PAM type: YTN; PAM sequence: CTG
cctcaatacaaatttagaat

SEQ ID NO: 296006 - DNA, 20 bp, Artificial Sequence
  Description of Artificial Sequence: Synthetic oligonucleotide
  Target: ATXN1; (+) strand; PAM type: YTN; PAM sequence: CTC
aatacaaatttagaatggca

SEQ ID NO: 296007 - DNA, 20 bp, Artificial Sequence
  Description of Artificial Sequence: Synthetic oligonucleotide
  Target: ATXN1; (+) strand; PAM type: YTN; PAM sequence: TTT
agaatggcactgtgccggga

SEQ ID NO: 296008 - DNA, 20 bp, Artificial Sequence
  Description of Artificial Sequence: Synthetic oligonucleotide
  Target: ATXN1; (+) strand; PAM type: YTN; PAM sequence: TTA
gaatggcactgtgccgggaa

SEQ ID NO: 296009 - DNA, 20 bp, Artificial Sequence
  Description of Artificial Sequence: Synthetic oligonucleotide
  Target: ATXN1; (+) strand; PAM type: YTN; PAM sequence: CTG
tgccgggaagaaactggtgc

SEQ ID NO: 296010 - DNA, 20 bp, Artificial Sequence
  Description of Artificial Sequence: Synthetic oligonucleotide
  Target: ATXN1; (+) strand; PAM type: YTN; PAM sequence: CTG
gtgctgggtggtgcaagtat

SEQ ID NO: 296011 - DNA, 20 bp, Artificial Sequence
  Description of Artificial Sequence: Synthetic oligonucleotide
  Target: ATXN1; (+) strand; PAM type: YTN; PAM sequence: CTG
ggtggtgcaagtatcagtct

SEQ ID NO: 296012 - DNA, 20 bp, Artificial Sequence
  Description of Artificial Sequence: Synthetic oligonucleotide
  Target: ATXN1; (+) strand; PAM type: YTN; PAM sequence: CTC
atgtcttaggaagatgatgc

SEQ ID NO: 296013 - DNA, 20 bp, Artificial Sequence
  Description of Artificial Sequence: Synthetic oligonucleotide
  Target: ATXN1; (+) strand; PAM type: YTN; PAM sequence: CTT
aggaagatgatgctcatcac

SEQ ID NO: 296014 - DNA, 20 bp, Artificial Sequence
  Description of Artificial Sequence: Synthetic oligonucleotide
  Target: ATXN1; (+) strand; PAM type: YTN; PAM sequence: TTA
ggaagatgatgctcatcacg

SEQ ID NO: 296015 - DNA, 20 bp, Artificial Sequence
  Description of Artificial Sequence: Synthetic oligonucleotide
  Target: ATXN1; (+) strand; PAM type: YTN; PAM sequence: CTC
atcacgcagcagccaggagc

SEQ ID NO: 296016 - DNA, 20 bp, Artificial Sequence
  Description of Artificial Sequence: Synthetic oligonucleotide
  Target: ATXN1; (+) strand; PAM type: YTN; PAM sequence: TTT
tttaattttttatttattta

SEQ ID NO: 296017 - DNA, 20 bp, Artificial Sequence
  Description of Artificial Sequence: Synthetic oligonucleotide
  Target: ATXN1; (+) strand; PAM type: YTN; PAM sequence: TTT
ttaattttttatttatttat

SEQ ID NO: 296018 - DNA, 20 bp, Artificial Sequence
  Description of Artificial Sequence: Synthetic oligonucleotide
  Target: ATXN1; (+) strand; PAM type: YTN; PAM sequence: TTT
taattttttatttatttatt

SEQ ID NO: 296019 - DNA, 20 bp, Artificial Sequence
  Description of Artificial Sequence: Synthetic oligonucleotide
  Target: ATXN1; (+) strand; PAM type: YTN; PAM sequence: TTT
aattttttatttatttattt

SEQ ID NO: 296020 - DNA, 20 bp, Artificial Sequence
  Description of Artificial Sequence: Synthetic oligonucleotide
  Target: ATXN1; (+) strand; PAM type: YTN; PAM sequence: TTA
attttttatttatttattta

SEQ ID NO: 296021 - DNA, 20 bp, Artificial Sequence
  Description of Artificial Sequence: Synthetic oligonucleotide
  Target: ATXN1; (+) strand; PAM type: YTN; PAM sequence: TTT
tttatttatttatttattta

SEQ ID NO: 296022 - DNA, 20 bp, Artificial Sequence
  Description of Artificial Sequence: Synthetic oligonucleotide
  Target: ATXN1; (+) strand; PAM type: YTN; PAM sequence: TTT
ttatttatttatttatttat

SEQ ID NO: 296023 - DNA, 20 bp, Artificial Sequence
  Description of Artificial Sequence: Synthetic oligonucleotide
  Target: ATXN1; (+) strand; PAM type: YTN; PAM sequence: TTT
tatttatttatttatttatt

SEQ ID NO: 296024 - DNA, 20 bp, Artificial Sequence
  Description of Artificial Sequence: Synthetic oligonucleotide
  Target: ATXN1; (+) strand; PAM type: YTN; PAM sequence: TTT
atttatttatttatttattt

SEQ ID NO: 296025 - DNA, 20 bp, Artificial Sequence
  Description of Artificial Sequence: Synthetic oligonucleotide
  Target: ATXN1; (+) strand; PAM type: YTN; PAM sequence: TTA
tttatttatttatttattta

SEQ ID NO: 296026 - DNA, 20 bp, Artificial Sequence
  Description of Artificial Sequence: Synthetic oligonucleotide
  Target: ATXN1; (+) strand; PAM type: YTN; PAM sequence: TTT
atttatttatttatttattt

SEQ ID NO: 296027 - DNA, 20 bp, Artificial Sequence
  Description of Artificial Sequence: Synthetic oligonucleotide
  Target: ATXN1; (+) strand; PAM type: YTN; PAM sequence: TTA
tttatttatttatttattta

SEQ ID NO: 296028 - DNA, 20 bp, Artificial Sequence
  Description of Artificial Sequence: Synthetic oligonucleotide
  Target: ATXN1; (+) strand; PAM type: YTN; PAM sequence: TTT
atttatttatttatttattt

SEQ ID NO: 296029 - DNA, 20 bp, Artificial Sequence
  Description of Artificial Sequence: Synthetic oligonucleotide
  Target: ATXN1; (+) strand; PAM type: YTN; PAM sequence: TTA
tttatttatttatttattta

SEQ ID NO: 296030 - DNA, 20 bp, Artificial Sequence
  Description of Artificial Sequence: Synthetic oligonucleotide
  Target: ATXN1; (+) strand; PAM type: YTN; PAM sequence: TTT
atttatttatttatttattt

SEQ ID NO: 296031 - DNA, 20 bp, Artificial Sequence
  Description of Artificial Sequence: Synthetic oligonucleotide
  Target: ATXN1; (+) strand; PAM type: YTN; PAM sequence: TTA
tttatttatttatttattta

SEQ ID NO: 296032 - DNA, 20 bp, Artificial Sequence
  Description of Artificial Sequence: Synthetic oligonucleotide
  Target: ATXN1; (+) strand; PAM type: YTN; PAM sequence: TTT
atttatttatttatttagag

SEQ ID NO: 296033 - DNA, 20 bp, Artificial Sequence
  Description of Artificial Sequence: Synthetic oligonucleotide
  Target: ATXN1; (+) strand; PAM type: YTN; PAM sequence: TTA
tttatttatttatttagaga

SEQ ID NO: 296034 - DNA, 20 bp, Artificial Sequence
  Description of Artificial Sequence: Synthetic oligonucleotide
  Target: ATXN1; (+) strand; PAM type: YTN; PAM sequence: TTT
atttatttatttagagacag

SEQ ID NO: 296035 - DNA, 20 bp, Artificial Sequence
  Description of Artificial Sequence: Synthetic oligonucleotide
  Target: ATXN1; (+) strand; PAM type: YTN; PAM sequence: TTA
tttatttatttagagacagg

SEQ ID NO: 296036 - DNA, 20 bp, Artificial Sequence
  Description of Artificial Sequence: Synthetic oligonucleotide
  Target: ATXN1; (+) strand; PAM type: YTN; PAM sequence: TTT
atttatttagagacagggtc

SEQ ID NO: 296037 - DNA, 20 bp, Artificial Sequence
  Description of Artificial Sequence: Synthetic oligonucleotide
  Target: ATXN1; (+) strand; PAM type: YTN; PAM sequence: TTA
tttatttagagacagggtct

SEQ ID NO: 296038 - DNA, 20 bp, Artificial Sequence
  Description of Artificial Sequence: Synthetic oligonucleotide
  Target: ATXN1; (+) strand; PAM type: YTN; PAM sequence: TTT
atttagagacagggtcttgc

SEQ ID NO: 296039 - DNA, 20 bp, Artificial Sequence
  Description of Artificial Sequence: Synthetic oligonucleotide
  Target: ATXN1; (+) strand; PAM type: YTN; PAM sequence: TTA
tttagagacagggtcttgct

SEQ ID NO: 296040 - DNA, 20 bp, Artificial Sequence
  Description of Artificial Sequence: Synthetic oligonucleotide
  Target: ATXN1; (+) strand; PAM type: YTN; PAM sequence: TTT
agagacagggtcttgctctg

SEQ ID NO: 296041 - DNA, 20 bp, Artificial Sequence
  Description of Artificial Sequence: Synthetic oligonucleotide
  Target: ATXN1; (+) strand; PAM type: YTN; PAM sequence: TTA
gagacagggtcttgctctgt

SEQ ID NO: 296042 - DNA, 20 bp, Artificial Sequence
  Description of Artificial Sequence: Synthetic oligonucleotide
  Target: ATXN1; (+) strand; PAM type: YTN; PAM sequence: CTT
gctctgtcacttaggctgga

SEQ ID NO: 296043 - DNA, 20 bp, Artificial Sequence
  Description of Artificial Sequence: Synthetic oligonucleotide
  Target: ATXN1; (+) strand; PAM type: YTN; PAM sequence: TTG
ctctgtcacttaggctggag

SEQ ID NO: 296044 - DNA, 20 bp, Artificial Sequence
  Description of Artificial Sequence: Synthetic oligonucleotide
  Target: ATXN1; (+) strand; PAM type: YTN; PAM sequence: CTC
tgtcacttaggctggagtgt

SEQ ID NO: 296045 - DNA, 20 bp, Artificial Sequence
  Description of Artificial Sequence: Synthetic oligonucleotide
  Target: ATXN1; (+) strand; PAM type: YTN; PAM sequence: CTG
tcacttaggctggagtgtag

SEQ ID NO: 296046 - DNA, 20 bp, Artificial Sequence
  Description of Artificial Sequence: Synthetic oligonucleotide
  Target: ATXN1; (+) strand; PAM type: YTN; PAM sequence: CTT
aggctggagtgtagtggtgt

SEQ ID NO: 296047 - DNA, 20 bp, Artificial Sequence
  Description of Artificial Sequence: Synthetic oligonucleotide
  Target: ATXN1; (+) strand; PAM type: YTN; PAM sequence: TTA
ggctggagtgtagtggtgtg

SEQ ID NO: 296048 - DNA, 20 bp, Artificial Sequence
  Description of Artificial Sequence: Synthetic oligonucleotide
  Target: ATXN1; (+) strand; PAM type: YTN; PAM sequence: CTG
gagtgtagtggtgtgatcat

SEQ ID NO: 296049 - DNA, 20 bp, Artificial Sequence
  Description of Artificial Sequence: Synthetic oligonucleotide
  Target: ATXN1; (+) strand; PAM type: YTN; PAM sequence: CTC
acggcaacctcgaactcctc

SEQ ID NO: 296050 - DNA, 20 bp, Artificial Sequence
  Description of Artificial Sequence: Synthetic oligonucleotide
  Target: ATXN1; (+) strand; PAM type: YTN; PAM sequence: CTC
gaactcctcaactcaagcag

SEQ ID NO: 296051 - DNA, 20 bp, Artificial Sequence
  Description of Artificial Sequence: Synthetic oligonucleotide
  Target: ATXN1; (+) strand; PAM type: YTN; PAM sequence: CTC
ctcaactcaagcagtcctcc

SEQ ID NO: 296052 - DNA, 20 bp, Artificial Sequence
  Description of Artificial Sequence: Synthetic oligonucleotide
  Target: ATXN1; (+) strand; PAM type: YTN; PAM sequence: CTC
aactcaagcagtcctcccag

SEQ ID NO: 296053 - DNA, 20 bp, Artificial Sequence
  Description of Artificial Sequence: Synthetic oligonucleotide
  Target: ATXN1; (+) strand; PAM type: YTN; PAM sequence: CTC
aagcagtcctcccagctcag

SEQ ID NO: 296054 - DNA, 20 bp, Artificial Sequence
  Description of Artificial Sequence: Synthetic oligonucleotide
  Target: ATXN1; (+) strand; PAM type: YTN; PAM sequence: CTC
ccagctcagcctcccaagta

SEQ ID NO: 296055 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagtagctggga

SEQ ID NO: 296056 - DNA, 20 bp, Artificial Sequence
  Description of Artificial Sequence: Synthetic oligonucleotide
  Target: ATXN1; (+) strand; PAM type: YTN; PAM sequence: CTC
ccaagtagctgggattacag

SEQ ID NO: 296057 - DNA, 20 bp, Artificial Sequence
  Description of Artificial Sequence: Synthetic oligonucleotide
  Target: ATXN1; (+) strand; PAM type: YTN; PAM sequence: CTG
ggattacaggtgtgacccat

SEQ ID NO: 296058 - DNA, 20 bp, Artificial Sequence
  Description of Artificial Sequence: Synthetic oligonucleotide
  Target: ATXN1; (+) strand; PAM type: YTN; PAM sequence: TTA
caggtgtgacccatcatgtc

SEQ ID NO: 296059 - DNA, 20 bp, Artificial Sequence
  Description of Artificial Sequence: Synthetic oligonucleotide
  Target: ATXN1; (+) strand; PAM type: YTN; PAM sequence: TTT
ttgatccatactgatggaat

SEQ ID NO: 296060 - DNA, 20 bp, Artificial Sequence
  Description of Artificial Sequence: Synthetic oligonucleotide
  Target: ATXN1; (+) strand; PAM type: YTN; PAM sequence: TTT
tgatccatactgatggaata

SEQ ID NO: 296061 - DNA, 20 bp, Artificial Sequence
  Description of Artificial Sequence: Synthetic oligonucleotide
  Target: ATXN1; (+) strand; PAM type: YTN; PAM sequence: TTT
gatccatactgatggaatat

SEQ ID NO: 296062 - DNA, 20 bp, Artificial Sequence
  Description of Artificial Sequence: Synthetic oligonucleotide
  Target: ATXN1; (+) strand; PAM type: YTN; PAM sequence: TTG
atccatactgatggaatatt

SEQ ID NO: 296063 - DNA, 20 bp, Artificial Sequence
  Description of Artificial Sequence: Synthetic oligonucleotide
  Target: ATXN1; (+) strand; PAM type: YTN; PAM sequence: CTG
atggaatattctttattttg

SEQ ID NO: 296064 - DNA, 20 bp, Artificial Sequence
  Description of Artificial Sequence: Synthetic oligonucleotide
  Target: ATXN1; (+) strand; PAM type: YTN; PAM sequence: TTC
tttattttggtctgactctt

SEQ ID NO: 296065 - DNA, 20 bp, Artificial Sequence
  Description of Artificial Sequence: Synthetic oligonucleotide
  Target: ATXN1; (+) strand; PAM type: YTN; PAM sequence: CTT
tattttggtctgactcttag

SEQ ID NO: 296066 - DNA, 20 bp, Artificial Sequence
  Description of Artificial Sequence: Synthetic oligonucleotide
  Target: ATXN1; (+) strand; PAM type: YTN; PAM sequence: TTT
attttggtctgactcttagg

SEQ ID NO: 296067 - DNA, 20 bp, Artificial Sequence
  Description of Artificial Sequence: Synthetic oligonucleotide
  Target: ATXN1; (+) strand; PAM type: YTN; PAM sequence: TTA
ttttggtctgactcttagga

SEQ ID NO: 296068 - DNA, 20 bp, Artificial Sequence
  Description of Artificial Sequence: Synthetic oligonucleotide
  Target: ATXN1; (+) strand; PAM type: YTN; PAM sequence: TTT
tggtctgactcttaggattg

SEQ ID NO: 296069 - DNA, 20 bp, Artificial Sequence
  Description of Artificial Sequence: Synthetic oligonucleotide
  Target: ATXN1; (+) strand; PAM type: YTN; PAM sequence: TTT
ggtctgactcttaggattgt

SEQ ID NO: 296070 - DNA, 20 bp, Artificial Sequence
  Description of Artificial Sequence: Synthetic oligonucleotide
  Target: ATXN1; (+) strand; PAM type: YTN; PAM sequence: TTG
gtctgactcttaggattgta

SEQ ID NO: 296071 - DNA, 20 bp, Artificial Sequence
  Description of Artificial Sequence: Synthetic oligonucleotide
  Target: ATXN1; (+) strand; PAM type: YTN; PAM sequence: CTG
actcttaggattgtacccac

SEQ ID NO: 296072 - DNA, 20 bp, Artificial Sequence
  Description of Artificial Sequence: Synthetic oligonucleotide
  Target: ATXN1; (+) strand; PAM type: YTN; PAM sequence: CTC
ttaggattgtacccacaacc

SEQ ID NO: 296073 - DNA, 20 bp, Artificial Sequence
  Description of Artificial Sequence: Synthetic oligonucleotide
  Target: ATXN1; (+) strand; PAM type: YTN; PAM sequence: CTT
aggattgtacccacaaccaa

SEQ ID NO: 296074 - DNA, 20 bp, Artificial Sequence
  Description of Artificial Sequence: Synthetic oligonucleotide
  Target: ATXN1; (+) strand; PAM type: YTN; PAM sequence: TTA
ggattgtacccacaaccaat

SEQ ID NO: 296075 - DNA, 20 bp, Artificial Sequence
  Description of Artificial Sequence: Synthetic oligonucleotide
  Target: ATXN1; (+) strand; PAM type: YTN; PAM sequence: TTG
tacccacaaccaatggaaac

SEQ ID NO: 296076 - DNA, 20 bp, Artificial Sequence
  Description of Artificial Sequence: Synthetic oligonucleotide
  Target: ATXN1; (+) strand; PAM type: YTN; PAM sequence: CTA
aagcactggaaagaaagaat

SEQ ID NO: 296077 - DNA, 20 bp, Artificial Sequence
  Description of Artificial Sequence: Synthetic oligonucleotide
  Target: ATXN1; (+) strand; PAM type: YTN; PAM sequence: CTG
gaaagaaagaatcataaaaa

SEQ ID NO: 296078 - DNA, 20 bp, Artificial Sequence
  Description of Artificial Sequence: Synthetic oligonucleotide
  Target: ATXN1; (+) strand; PAM type: YTN; PAM sequence: CTG
ccatttctaaatctttctgt

SEQ ID NO: 296079 - DNA, 20 bp, Artificial Sequence
  Description of Artificial Sequence: Synthetic oligonucleotide
  Target: ATXN1; (+) strand; PAM type: YTN; PAM sequence: TTT
ctaaatctttctgttaccca

SEQ ID NO: 296080 - DNA, 20 bp, Artificial Sequence
  Description of Artificial Sequence: Synthetic oligonucleotide
  Target: ATXN1; (+) strand; PAM type: YTN; PAM sequence: TTC
taaatctttctgttacccaa

SEQ ID NO: 296081 - DNA, 20 bp, Artificial Sequence
  Description of Artificial Sequence: Synthetic oligonucleotide
  Target: ATXN1; (+) strand; PAM type: YTN; PAM sequence: CTA
aatctttctgttacccaaag

SEQ ID NO: 296082 - DNA, 20 bp, Artificial Sequence
  Description of Artificial Sequence: Synthetic oligonucleotide
  Target: ATXN1; (+) strand; PAM type: YTN; PAM sequence: CTT
tctgttacccaaagtgactg

SEQ ID NO: 296083 - DNA, 20 bp, Artificial Sequence
  Description of Artificial Sequence: Synthetic oligonucleotide
  Target: ATXN1; (+) strand; PAM type: YTN; PAM sequence: TTT
ctgttacccaaagtgactgt

SEQ ID NO: 296084 - DNA, 20 bp, Artificial Sequence
  Description of Artificial Sequence: Synthetic oligonucleotide
  Target: ATXN1; (+) strand; PAM type: YTN; PAM sequence: TTC
tgttacccaaagtgactgtg

SEQ ID NO: 296085 - DNA, 20 bp, Artificial Sequence
  Description of Artificial Sequence: Synthetic oligonucleotide
  Target: ATXN1; (+) strand; PAM type: YTN; PAM sequence: CTG
ttacccaaagtgactgtgtt

SEQ ID NO: 296086 - DNA, 20 bp, Artificial Sequence
  Description of Artificial Sequence: Synthetic oligonucleotide
  Target: ATXN1; (+) strand; PAM type: YTN; PAM sequence: TTA
cccaaagtgactgtgtttta

SEQ ID NO: 296087 - DNA, 20 bp, Artificial Sequence
  Description of Artificial Sequence: Synthetic oligonucleotide
  Target: ATXN1; (+) strand; PAM type: YTN; PAM sequence: CTG
tgttttattaaaggcatgtg

SEQ ID NO: 296088 - DNA, 20 bp, Artificial Sequence
  Description of Artificial Sequence: Synthetic oligonucleotide
  Target: ATXN1; (+) strand; PAM type: YTN; PAM sequence: TTT
tattaaaggcatgtgatgca

SEQ ID NO: 296089 - DNA, 20 bp, Artificial Sequence
  Description of Artificial Sequence: Synthetic oligonucleotide
  Target: ATXN1; (+) strand; PAM type: YTN; PAM sequence: TTT
attaaaggcatgtgatgcat

SEQ ID NO: 296090 - DNA, 20 bp, Artificial Sequence
  Description of Artificial Sequence: Synthetic oligonucleotide
  Target: ATXN1; (+) strand; PAM type: YTN; PAM sequence: TTA
ttaaaggcatgtgatgcatc

SEQ ID NO: 296091 - DNA, 20 bp, Artificial Sequence
  Description of Artificial Sequence: Synthetic oligonucleotide
  Target: ATXN1; (+) strand; PAM type: YTN; PAM sequence: TTA
aaggcatgtgatgcatcacc

SEQ ID NO: 296092 - DNA, 20 bp, Artificial Sequence
  Description of Artificial Sequence: Synthetic oligonucleotide
  Target: ATXN1; (+) strand; PAM type: YTN; PAM sequence: TTT
tttgccatttaaaaatacca

SEQ ID NO: 296093 - DNA, 20 bp, Artificial Sequence
  Description of Artificial Sequence: Synthetic oligonucleotide
  Target: ATXN1; (+) strand; PAM type: YTN; PAM sequence: TTT
ttgccatttaaaaataccaa

SEQ ID NO: 296094 - DNA, 20 bp, Artificial Sequence
  Description of Artificial Sequence: Synthetic oligonucleotide
  Target: ATXN1; (+) strand; PAM type: YTN; PAM sequence: TTT
tgccatttaaaaataccaaa

SEQ ID NO: 296095 - DNA, 20 bp, Artificial Sequence
  Description of Artificial Sequence: Synthetic oligonucleotide
  Target: ATXN1; (+) strand; PAM type: YTN; PAM sequence: TTT
gccatttaaaaataccaaac

SEQ ID NO: 296096 - DNA, 20 bp, Artificial Sequence
  Description of Artificial Sequence: Synthetic oligonucleotide
  Target: ATXN1; (+) strand; PAM type: YTN; PAM sequence: TTG
ccatttaaaaataccaaaca

SEQ ID NO: 296097 - DNA, 20 bp, Artificial Sequence
  Description of Artificial Sequence: Synthetic oligonucleotide
  Target: ATXN1; (+) strand; PAM type: YTN; PAM sequence: TTT
aaaaataccaaacagtagta

SEQ ID NO: 296098 - DNA, 20 bp, Artificial Sequence
  Description of Artificial Sequence: Synthetic oligonucleotide
  Target: ATXN1; (+) strand; PAM type: YTN; PAM sequence: TTA
aaaataccaaacagtagtaa

SEQ ID NO: 296099 - DNA, 20 bp, Artificial Sequence
  Description of Artificial Sequence: Synthetic oligonucleotide
  Target: ATXN1; (+) strand; PAM type: YTN; PAM sequence: CTC
aacagctaggctgctaccac

SEQ ID NO: 296100 - DNA, 20 bp, Artificial Sequence
  Description of Artificial Sequence: Synthetic oligonucleotide
  Target: ATXN1; (+) strand; PAM type: YTN; PAM sequence: CTA
ggctgctaccacttaacctg

SEQ ID NO: 296101 - DNA, 20 bp, Artificial Sequence
  Description of Artificial Sequence: Synthetic oligonucleotide
  Target: ATXN1; (+) strand; PAM type: YTN; PAM sequence: CTG
ctaccacttaacctgcaatt

SEQ ID NO: 296102 - DNA, 20 bp, Artificial Sequence
  Description of Artificial Sequence: Synthetic oligonucleotide
  Target: ATXN1; (+) strand; PAM type: YTN; PAM sequence: CTA
ccacttaacctgcaatttgg

SEQ ID NO: 296103 - DNA, 20 bp, Artificial Sequence
  Description of Artificial Sequence: Synthetic oligonucleotide
  Target: ATXN1; (+) strand; PAM type: YTN; PAM sequence: CTT
aacctgcaatttggacaatt

SEQ ID NO: 296104 - DNA, 20 bp, Artificial Sequence
  Description of Artificial Sequence: Synthetic oligonucleotide
  Target: ATXN1; (+) strand; PAM type: YTN; PAM sequence: TTA
acctgcaatttggacaattt

SEQ ID NO: 296105 - DNA, 20 bp, Artificial Sequence
  Description of Artificial Sequence: Synthetic oligonucleotide
  Target: ATXN1; (+) strand; PAM type: YTN; PAM sequence: CTG
caatttggacaattttgtgg

SEQ ID NO: 296106 - DNA, 20 bp, Artificial Sequence
  Description of Artificial Sequence: Synthetic oligonucleotide
  Target: ATXN1; (+) strand; PAM type: YTN; PAM sequence: TTT
ggacaattttgtggggatga

SEQ ID NO: 296107 - DNA, 20 bp, Artificial Sequence
  Description of Artificial Sequence: Synthetic oligonucleotide
  Target: ATXN1; (+) strand; PAM type: YTN; PAM sequence: TTG
gacaattttgtggggatgaa

SEQ ID NO: 296108 - DNA, 20 bp, Artificial Sequence
  Description of Artificial Sequence: Synthetic oligonucleotide
  Target: ATXN1; (+) strand; PAM type: YTN; PAM sequence: TTT
tgtggggatgaaattacttt

SEQ ID NO: 296109 - DNA, 20 bp, Artificial Sequence
  Description of Artificial Sequence: Synthetic oligonucleotide
  Target: ATXN1; (+) strand; PAM type: YTN; PAM sequence: TTT
gtggggatgaaattactttg

SEQ ID NO: 296110 - DNA, 20 bp, Artificial Sequence
  Description of Artificial Sequence: Synthetic oligonucleotide
  Target: ATXN1; (+) strand; PAM type: YTN; PAM sequence: TTG
tggggatgaaattactttgt

SEQ ID NO: 296111 - DNA, 20 bp, Artificial Sequence
  Description of Artificial Sequence: Synthetic oligonucleotide
  Target: ATXN1; (+) strand; PAM type: YTN; PAM sequence: TTA
ctttgtcttatgacacatgg

SEQ ID NO: 296112 - DNA, 20 bp, Artificial Sequence
  Description of Artificial Sequence: Synthetic oligonucleotide
  Target: ATXN1; (+) strand; PAM type: YTN; PAM sequence: CTT
tgtcttatgacacatggagc

SEQ ID NO: 296113 - DNA, 20 bp, Artificial Sequence
  Description of Artificial Sequence: Synthetic oligonucleotide
  Target: ATXN1; (+) strand; PAM type: YTN; PAM sequence: TTT
gtcttatgacacatggagca

SEQ ID NO: 296114 - DNA, 20 bp, Artificial Sequence
  Description of Artificial Sequence: Synthetic oligonucleotide
  Target: ATXN1; (+) strand; PAM type: YTN; PAM sequence: TTG
tcttatgacacatggagcag

SEQ ID NO: 296115 - DNA, 20 bp, Artificial Sequence
  Description of Artificial Sequence: Synthetic oligonucleotide
  Target: ATXN1; (+) strand; PAM type: YTN; PAM sequence: CTT
atgacacatggagcagatgc

SEQ ID NO: 296116 - DNA, 20 bp, Artificial Sequence
  Description of Artificial Sequence: Synthetic oligonucleotide
  Target: ATXN1; (+) strand; PAM type: YTN; PAM sequence: TTA
tgacacatggagcagatgct

SEQ ID NO: 296117 - DNA, 20 bp, Artificial Sequence
  Description of Artificial Sequence: Synthetic oligonucleotide
  Target: ATXN1; (+) strand; PAM type: YTN; PAM sequence: CTA
ctaattaacacacaaaaatg

SEQ ID NO: 296118 - DNA, 20 bp, Artificial Sequence
  Description of Artificial Sequence: Synthetic oligonucleotide
  Target: ATXN1; (+) strand; PAM type: YTN; PAM sequence: CTA
attaacacacaaaaatgtct

SEQ ID NO: 296119 - DNA, 20 bp, Artificial Sequence
  Description of Artificial Sequence: Synthetic oligonucleotide
  Target: ATXN1; (+) strand; PAM type: YTN; PAM sequence: TTA
acacacaaaaatgtctaaaa

SEQ ID NO: 296120 - DNA, 20 bp, Artificial Sequence
  Description of Artificial Sequence: Synthetic oligonucleotide
  Target: ATXN1; (+) strand; PAM type: YTN; PAM sequence: CTA
aaacagagctttaaaaaaac

SEQ ID NO: 296121 - DNA, 20 bp, Artificial Sequence
  Description of Artificial Sequence: Synthetic oligonucleotide
  Target: ATXN1; (+) strand; PAM type: YTN; PAM sequence: CTT
taaaaaaacatatgcatttg

SEQ ID NO: 296122 - DNA, 20 bp, Artificial Sequence
  Description of Artificial Sequence: Synthetic oligonucleotide
  Target: ATXN1; (+) strand; PAM type: YTN; PAM sequence: TTT
aaaaaaacatatgcatttgg

SEQ ID NO: 296123 - DNA, 20 bp, Artificial Sequence
  Description of Artificial Sequence: Synthetic oligonucleotide
  Target: ATXN1; (+) strand; PAM type: YTN; PAM sequence: TTA
aaaaaacatatgcatttgga

SEQ ID NO: 296124 - DNA, 20 bp, Artificial Sequence
  Description of Artificial Sequence: Synthetic oligonucleotide
  Target: ATXN1; (+) strand; PAM type: YTN; PAM sequence: TTT
ggaaacagaagtagaaacag

SEQ ID NO: 296125 - DNA, 20 bp, Artificial Sequence
  Description of Artificial Sequence: Synthetic oligonucleotide
  Target: ATXN1; (+) strand; PAM type: YTN; PAM sequence: TTG
gaaacagaagtagaaacagc

SEQ ID NO: 296126 - DNA, 20 bp, Artificial Sequence
  Description of Artificial Sequence: Synthetic oligonucleotide
  Target: ATXN1; (+) strand; PAM type: YTN; PAM sequence: CTT
caaagagtataagcaaaatg

SEQ ID NO: 296127 - DNA, 20 bp, Artificial Sequence
  Description of Artificial Sequence: Synthetic oligonucleotide
  Target: ATXN1; (+) strand; PAM type: YTN; PAM sequence: TTC
aaagagtataagcaaaatgg

SEQ ID NO: 296128 - DNA, 20 bp, Artificial Sequence
  Description of Artificial Sequence: Synthetic oligonucleotide
  Target: ATXN1; (+) strand; PAM type: YTN; PAM sequence: TTT
ttttaagaaagtcaatcaga

SEQ ID NO: 296129 - DNA, 20 bp, Artificial Sequence
  Description of Artificial Sequence: Synthetic oligonucleotide
  Target: ATXN1; (+) strand; PAM type: YTN; PAM sequence: TTT
tttaagaaagtcaatcagat

SEQ ID NO: 296130 - DNA, 20 bp, Artificial Sequence
  Description of Artificial Sequence: Synthetic oligonucleotide
  Target: ATXN1; (+) strand; PAM type: YTN; PAM sequence: TTT
ttaagaaagtcaatcagatt

SEQ ID NO: 296131 - DNA, 20 bp, Artificial Sequence
  Description of Artificial Sequence: Synthetic oligonucleotide
  Target: ATXN1; (+) strand; PAM type: YTN; PAM sequence: TTT
taagaaagtcaatcagattc

SEQ ID NO: 296132 - DNA, 20 bp, Artificial Sequence
  Description of Artificial Sequence: Synthetic oligonucleotide
  Target: ATXN1; (+) strand; PAM type: YTN; PAM sequence: TTT
aagaaagtcaatcagattcg

SEQ ID NO: 296133 - DNA, 20 bp, Artificial Sequence
  Description of Artificial Sequence: Synthetic oligonucleotide
  Target: ATXN1; (+) strand; PAM type: YTN; PAM sequence: TTA
agaaagtcaatcagattcgc

SEQ ID NO: 296134 - DNA, 20 bp, Artificial Sequence
  Description of Artificial Sequence: Synthetic oligonucleotide
  Target: ATXN1; (+) strand; PAM type: YTN; PAM sequence: TTC
gcaagtgaattttataggcc

SEQ ID NO: 296135 - DNA, 20 bp, Artificial Sequence
  Description of Artificial Sequence: Synthetic oligonucleotide
  Target: ATXN1; (+) strand; PAM type: YTN; PAM sequence: TTT
tataggcctctctctaaata

SEQ ID NO: 296136 - DNA, 20 bp, Artificial Sequence
  Description of Artificial Sequence: Synthetic oligonucleotide
  Target: ATXN1; (+) strand; PAM type: YTN; PAM sequence: TTT
ataggcctctctctaaataa

SEQ ID NO: 296137 - DNA, 20 bp, Artificial Sequence
  Description of Artificial Sequence: Synthetic oligonucleotide
  Target: ATXN1; (+) strand; PAM type: YTN; PAM sequence: TTA
taggcctctctctaaataaa

SEQ ID NO: 296138 - DNA, 20 bp, Artificial Sequence
  Description of Artificial Sequence: Synthetic oligonucleotide
  Target: ATXN1; (+) strand; PAM type: YTN; PAM sequence: CTC
tctctaaataaagtatggat

SEQ ID NO: 296139 - DNA, 20 bp, Artificial Sequence
  Description of Artificial Sequence: Synthetic oligonucleotide
  Target: ATXN1; (+) strand; PAM type: YTN; PAM sequence: CTC
tctaaataaagtatggattt

SEQ ID NO: 296140 - DNA, 20 bp, Artificial Sequence
  Description of Artificial Sequence: Synthetic oligonucleotide
  Target: ATXN1; (+) strand; PAM type: YTN; PAM sequence: CTC
taaataaagtatggatttga

SEQ ID NO: 296141 - DNA, 20 bp, Artificial Sequence
  Description of Artificial Sequence: Synthetic oligonucleotide
  Target: ATXN1; (+) strand; PAM type: YTN; PAM sequence: CTA
aataaagtatggatttgaag

SEQ ID NO: 296142 - DNA, 20 bp, Artificial Sequence
  Description of Artificial Sequence: Synthetic oligonucleotide
  Target: ATXN1; (+) strand; PAM type: YTN; PAM sequence: TTT
gaaggaaaatgtcttgcttt

SEQ ID NO: 296143 - DNA, 20 bp, Artificial Sequence
  Description of Artificial Sequence: Synthetic oligonucleotide
  Target: ATXN1; (+) strand; PAM type: YTN; PAM sequence: TTG
aaggaaaatgtcttgctttt

SEQ ID NO: 296144 - DNA, 20 bp, Artificial Sequence
  Description of Artificial Sequence: Synthetic oligonucleotide
  Target: ATXN1; (+) strand; PAM type: YTN; PAM sequence: CTT
gcttttaatttttttgttaa

SEQ ID NO: 296145 - DNA, 20 bp, Artificial Sequence
  Description of Artificial Sequence: Synthetic oligonucleotide
  Target: ATXN1; (+) strand; PAM type: YTN; PAM sequence: TTG
cttttaatttttttgttaac

SEQ ID NO: 296146 - DNA, 20 bp, Artificial Sequence
  Description of Artificial Sequence: Synthetic oligonucleotide
  Target: ATXN1; (+) strand; PAM type: YTN; PAM sequence: CTT
ttaatttttttgttaacgga

SEQ ID NO: 296147 - DNA, 20 bp, Artificial Sequence
  Description of Artificial Sequence: Synthetic oligonucleotide
  Target: ATXN1; (+) strand; PAM type: YTN; PAM sequence: TTT
taatttttttgttaacggaa

SEQ ID NO: 296148 - DNA, 20 bp, Artificial Sequence
  Description of Artificial Sequence: Synthetic oligonucleotide
  Target: ATXN1; (+) strand; PAM type: YTN; PAM sequence: TTT
aatttttttgttaacggaaa

SEQ ID NO: 296149 - DNA, 20 bp, Artificial Sequence
  Description of Artificial Sequence: Synthetic oligonucleotide
  Target: ATXN1; (+) strand; PAM type: YTN; PAM sequence: TTA
atttttttgttaacggaaag

SEQ ID NO: 296150 - DNA, 20 bp, Artificial Sequence
  Description of Artificial Sequence: Synthetic oligonucleotide
  Target: ATXN1; (+) strand; PAM type: YTN; PAM sequence: TTT
ttttgttaacggaaagaggg

SEQ ID NO: 296151 - DNA, 20 bp, Artificial Sequence
  Description of Artificial Sequence: Synthetic oligonucleotide
  Target: ATXN1; (+) strand; PAM type: YTN; PAM sequence: TTT
tttgttaacggaaagagggc

SEQ ID NO: 296152 - DNA, 20 bp, Artificial Sequence
  Description of Artificial Sequence: Synthetic oligonucleotide
  Target: ATXN1; (+) strand; PAM type: YTN; PAM sequence: TTT
ttgttaacggaaagagggca

SEQ ID NO: 296153 - DNA, 20 bp, Artificial Sequence
  Description of Artificial Sequence: Synthetic oligonucleotide
  Target: ATXN1; (+) strand; PAM type: YTN; PAM sequence: TTT
tgttaacggaaagagggcag

SEQ ID NO: 296154 - DNA, 20 bp, Artificial Sequence
  Description of Artificial Sequence: Synthetic oligonucleotide
  Target: ATXN1; (+) strand; PAM type: YTN; PAM sequence: TTT
gttaacggaaagagggcagc

SEQ ID NO: 296155 - DNA, 20 bp, Artificial Sequence
  Description of Artificial Sequence: Synthetic oligonucleotide
  Target: ATXN1; (+) strand; PAM type: YTN; PAM sequence: TTG
ttaacggaaagagggcagcc

SEQ ID NO: 296156 - DNA, 20 bp, Artificial Sequence
  Description of Artificial Sequence: Synthetic oligonucleotide
  Target: ATXN1; (+) strand; PAM type: YTN; PAM sequence: TTA
acggaaagagggcagcccat

SEQ ID NO: 296157 - DNA, 20 bp, Artificial Sequence
  Description of Artificial Sequence: Synthetic oligonucleotide
  Target: ATXN1; (+) strand; PAM type: YTN; PAM sequence: TTC
cataggatgttatattccat

SEQ ID NO: 296158 - DNA, 20 bp, Artificial Sequence
  Description of Artificial Sequence: Synthetic oligonucleotide
  Target: ATXN1; (+) strand; PAM type: YTN; PAM sequence: TTA
tattccattgtggaacatta

SEQ ID NO: 296159 - DNA, 20 bp, Artificial Sequence
  Description of Artificial Sequence: Synthetic oligonucleotide
  Target: ATXN1; (+) strand; PAM type: YTN; PAM sequence: TTC
cattgtggaacattatgttg

SEQ ID NO: 296160 - DNA, 20 bp, Artificial Sequence
  Description of Artificial Sequence: Synthetic oligonucleotide
  Target: ATXN1; (+) strand; PAM type: YTN; PAM sequence: TTG
tggaacattatgttgtgcca

SEQ ID NO: 296161 - DNA, 20 bp, Artificial Sequence
  Description of Artificial Sequence: Synthetic oligonucleotide
  Target: ATXN1; (+) strand; PAM type: YTN; PAM sequence: TTA
tgttgtgccaaaattaaaag

SEQ ID NO: 296162 - DNA, 20 bp, Artificial Sequence
  Description of Artificial Sequence: Synthetic oligonucleotide
  Target: ATXN1; (+) strand; PAM type: YTN; PAM sequence: TTG
tgccaaaattaaaaggagga

SEQ ID NO: 296163 - DNA, 20 bp, Artificial Sequence
  Description of Artificial Sequence: Synthetic oligonucleotide
  Target: ATXN1; (+) strand; PAM type: YTN; PAM sequence: TTA
aaaggaggataaaaaaaggt

SEQ ID NO: 296164 - DNA, 20 bp, Artificial Sequence
  Description of Artificial Sequence: Synthetic oligonucleotide
  Target: ATXN1; (+) strand; PAM type: YTN; PAM sequence: TTG
ggataatttgtttttaaagg

SEQ ID NO: 296165 - DNA, 20 bp, Artificial Sequence
  Description of Artificial Sequence: Synthetic oligonucleotide
  Target: ATXN1; (+) strand; PAM type: YTN; PAM sequence: TTT
gtttttaaaggttgggataa

SEQ ID NO: 296166 - DNA, 20 bp, Artificial Sequence
  Description of Artificial Sequence: Synthetic oligonucleotide
  Target: ATXN1; (+) strand; PAM type: YTN; PAM sequence: TTG
tttttaaaggttgggataaa

SEQ ID NO: 296167 - DNA, 20 bp, Artificial Sequence
  Description of Artificial Sequence: Synthetic oligonucleotide
  Target: ATXN1; (+) strand; PAM type: YTN; PAM sequence: TTT
ttaaaggttgggataaattt

SEQ ID NO: 296168 - DNA, 20 bp, Artificial Sequence
  Description of Artificial Sequence: Synthetic oligonucleotide
  Target: ATXN1; (+) strand; PAM type: YTN; PAM sequence: TTT
taaaggttgggataaatttg

SEQ ID NO: 296169 - DNA, 20 bp, Artificial Sequence
  Description of Artificial Sequence: Synthetic oligonucleotide
  Target: ATXN1; (+) strand; PAM type: YTN; PAM sequence: TTT
aaaggttgggataaatttgg

SEQ ID NO: 296170 - DNA, 20 bp, Artificial Sequence
  Description of Artificial Sequence: Synthetic oligonucleotide
  Target: ATXN1; (+) strand; PAM type: YTN; PAM sequence: TTA
aaggttgggataaatttggg

SEQ ID NO: 296171 - DNA, 20 bp, Artificial Sequence
  Description of Artificial Sequence: Synthetic oligonucleotide
  Target: ATXN1; (+) strand; PAM type: YTN; PAM sequence: TTG
ggataaatttgggaaagact

SEQ ID NO: 296172 - DNA, 20 bp, Artificial Sequence
  Description of Artificial Sequence: Synthetic oligonucleotide
  Target: ATXN1; (+) strand; PAM type: YTN; PAM sequence: TTT
gggaaagactttggagggtc

SEQ ID NO: 296173 - DNA, 20 bp, Artificial Sequence
  Description of Artificial Sequence: Synthetic oligonucleotide
  Target: ATXN1; (+) strand; PAM type: YTN; PAM sequence: TTG
ggaaagactttggagggtct

SEQ ID NO: 296174 - DNA, 20 bp, Artificial Sequence
  Description of Artificial Sequence: Synthetic oligonucleotide
  Target: ATXN1; (+) strand; PAM type: YTN; PAM sequence: CTT
tggagggtctcatatgttca

SEQ ID NO: 296175 - DNA, 20 bp, Artificial Sequence
  Description of Artificial Sequence: Synthetic oligonucleotide
  Target: ATXN1; (+) strand; PAM type: YTN; PAM sequence: TTT
ggagggtctcatatgttcat

SEQ ID NO: 296176 - DNA, 20 bp, Artificial Sequence
  Description of Artificial Sequence: Synthetic oligonucleotide
  Target: ATXN1; (+) strand; PAM type: YTN; PAM sequence: TTG
gagggtctcatatgttcatg

SEQ ID NO: 296177 - DNA, 20 bp, Artificial Sequence
  Description of Artificial Sequence: Synthetic oligonucleotide
  Target: ATXN1; (+) strand; PAM type: YTN; PAM sequence: CTC
atatgttcatgtgtattgta

SEQ ID NO: 296178 - DNA, 20 bp, Artificial Sequence
  Description of Artificial Sequence: Synthetic oligonucleotide
  Target: ATXN1; (+) strand; PAM type: YTN; PAM sequence: TTC
atgtgtattgtaaatctatg

SEQ ID NO: 296179 - DNA, 20 bp, Artificial Sequence
  Description of Artificial Sequence: Synthetic oligonucleotide
  Target: ATXN1; (+) strand; PAM type: YTN; PAM sequence: TTG
taaatctatgaggggagaaa

SEQ ID NO: 296180 - DNA, 20 bp, Artificial Sequence
  Description of Artificial Sequence: Synthetic oligonucleotide
  Target: ATXN1; (+) strand; PAM type: YTN; PAM sequence: CTA
tgaggggagaaagcactcat

SEQ ID NO: 296181 - DNA, 20 bp, Artificial Sequence
  Description of Artificial Sequence: Synthetic oligonucleotide
  Target: ATXN1; (+) strand; PAM type: YTN; PAM sequence: CTC
atctaggcccaaaatatatt

SEQ ID NO: 296182 - DNA, 20 bp, Artificial Sequence
  Description of Artificial Sequence: Synthetic oligonucleotide
  Target: ATXN1; (+) strand; PAM type: YTN; PAM sequence: CTA
ggcccaaaatatattttacc

SEQ ID NO: 296183 - DNA, 20 bp, Artificial Sequence
  Description of Artificial Sequence: Synthetic oligonucleotide
  Target: ATXN1; (+) strand; PAM type: YTN; PAM sequence: TTT
taccacagaacactttttcc

SEQ ID NO: 296184 - DNA, 20 bp, Artificial Sequence
  Description of Artificial Sequence: Synthetic oligonucleotide
  Target: ATXN1; (+) strand; PAM type: YTN; PAM sequence: TTT
accacagaacactttttcca

SEQ ID NO: 296185 - DNA, 20 bp, Artificial Sequence
  Description of Artificial Sequence: Synthetic oligonucleotide
  Target: ATXN1; (+) strand; PAM type: YTN; PAM sequence: TTA
ccacagaacactttttccag

SEQ ID NO: 296186 - DNA, 20 bp, Artificial Sequence
  Description of Artificial Sequence: Synthetic oligonucleotide
  Target: ATXN1; (+) strand; PAM type: YTN; PAM sequence: CTT
tttccagaagaaaggtgaaa

SEQ ID NO: 296187 - DNA, 20 bp, Artificial Sequence
  Description of Artificial Sequence: Synthetic oligonucleotide
  Target: ATXN1; (+) strand; PAM type: YTN; PAM sequence: TTT
ttccagaagaaaggtgaaac

SEQ ID NO: 296188 - DNA, 20 bp, Artificial Sequence
  Description of Artificial Sequence: Synthetic oligonucleotide
  Target: ATXN1; (+) strand; PAM type: YTN; PAM sequence: TTT
tccagaagaaaggtgaaacc

SEQ ID NO: 296189 - DNA, 20 bp, Artificial Sequence
  Description of Artificial Sequence: Synthetic oligonucleotide
  Target: ATXN1; (+) strand; PAM type: YTN; PAM sequence: TTT
ccagaagaaaggtgaaacca

SEQ ID NO: 296190 - DNA, 20 bp, Artificial Sequence
  Description of Artificial Sequence: Synthetic oligonucleotide
  Target: ATXN1; (+) strand; PAM type: YTN; PAM sequence: TTC
cagaagaaaggtgaaaccag

SEQ ID NO: 296191 - DNA, 20 bp, Artificial Sequence
  Description of Artificial Sequence: Synthetic oligonucleotide
  Target: ATXN1; (+) strand; PAM type: YTN; PAM sequence: CTG
accagactaggccagtggtc

SEQ ID NO: 296192 - DNA, 20 bp, Artificial Sequence
  Description of Artificial Sequence: Synthetic oligonucleotide
  Target: ATXN1; (+) strand; PAM type: YTN; PAM sequence: CTA
ggccagtggtcctcacactt

SEQ ID NO: 296193 - DNA, 20 bp, Artificial Sequence
  Description of Artificial Sequence: Synthetic oligonucleotide
  Target: ATXN1; (+) strand; PAM type: YTN; PAM sequence: CTC
acacttttggtcctcacact

SEQ ID NO: 296194 - DNA, 20 bp, Artificial Sequence
  Description of Artificial Sequence: Synthetic oligonucleotide
  Target: ATXN1; (+) strand; PAM type: YTN; PAM sequence: CTT
ttggtcctcacacttaaaag

SEQ ID NO: 296195 - DNA, 20 bp, Artificial Sequence
  Description of Artificial Sequence: Synthetic oligonucleotide
  Target: ATXN1; (+) strand; PAM type: YTN; PAM sequence: TTT
tggtcctcacacttaaaagc

SEQ ID NO: 296196 - DNA, 20 bp, Artificial Sequence
  Description of Artificial Sequence: Synthetic oligonucleotide
  Target: ATXN1; (+) strand; PAM type: YTN; PAM sequence: TTT
ggtcctcacacttaaaagct

SEQ ID NO: 296197 - DNA, 20 bp, Artificial Sequence
  Description of Artificial Sequence: Synthetic oligonucleotide
  Target: ATXN1; (+) strand; PAM type: YTN; PAM sequence: TTG
gtcctcacacttaaaagctc

SEQ ID NO: 296198 - DNA, 20 bp, Artificial Sequence
  Description of Artificial Sequence: Synthetic oligonucleotide
  Target: ATXN1; (+) strand; PAM type: YTN; PAM sequence: CTC
acacttaaaagctccttggg

SEQ ID NO: 296199 - DNA, 20 bp, Artificial Sequence
  Description of Artificial Sequence: Synthetic oligonucleotide
  Target: ATXN1; (+) strand; PAM type: YTN; PAM sequence: CTT
aaaagctccttgggtcctca

SEQ ID NO: 296200 - DNA, 20 bp, Artificial Sequence
  Description of Artificial Sequence: Synthetic oligonucleotide
  Target: ATXN1; (+) strand; PAM type: YTN; PAM sequence: TTA
aaagctccttgggtcctcaa

SEQ ID NO: 296201 - DNA, 20 bp, Artificial Sequence
  Description of Artificial Sequence: Synthetic oligonucleotide
  Target: ATXN1; (+) strand; PAM type: YTN; PAM sequence: CTC
cttgggtcctcaataaattt

SEQ ID NO: 296202 - DNA, 20 bp, Artificial Sequence
  Description of Artificial Sequence: Synthetic oligonucleotide
  Target: ATXN1; (+) strand; PAM type: YTN; PAM sequence: CTT
gggtcctcaataaattttaa

SEQ ID NO: 296203 - DNA, 20 bp, Artificial Sequence
  Description of Artificial Sequence: Synthetic oligonucleotide
  Target: ATXN1; (+) strand; PAM type: YTN; PAM sequence: TTG
ggtcctcaataaattttaag

SEQ ID NO: 296204 - DNA, 20 bp, Artificial Sequence
  Description of Artificial Sequence: Synthetic oligonucleotide
  Target: ATXN1; (+) strand; PAM type: YTN; PAM sequence: CTC
aataaattttaagagtataa

SEQ ID NO: 296205 - DNA, 20 bp, Artificial Sequence
  Description of Artificial Sequence: Synthetic oligonucleotide
  Target: ATXN1; (+) strand; PAM type: YTN; PAM sequence: TTT
taagagtataaagtttcctc

SEQ ID NO: 296206 - DNA, 20 bp, Artificial Sequence
  Description of Artificial Sequence: Synthetic oligonucleotide
  Target: ATXN1; (+) strand; PAM type: YTN; PAM sequence: TTT
aagagtataaagtttcctct

SEQ ID NO: 296207 - DNA, 20 bp, Artificial Sequence
  Description of Artificial Sequence: Synthetic oligonucleotide
  Target: ATXN1; (+) strand; PAM type: YTN; PAM sequence: TTA
agagtataaagtttcctcta

SEQ ID NO: 296208 - DNA, 20 bp, Artificial Sequence
  Description of Artificial Sequence: Synthetic oligonucleotide
  Target: ATXN1; (+) strand; PAM type: YTN; PAM sequence: TTT
cctctatactcctaaaattt

SEQ ID NO: 296209 - DNA, 20 bp, Artificial Sequence
  Description of Artificial Sequence: Synthetic oligonucleotide
  Target: ATXN1; (+) strand; PAM type: YTN; PAM sequence: TTC
ctctatactcctaaaattta

SEQ ID NO: 296210 - DNA, 20 bp, Artificial Sequence
  Description of Artificial Sequence: Synthetic oligonucleotide
  Target: ATXN1; (+) strand; PAM type: YTN; PAM sequence: CTC
tatactcctaaaatttattg

SEQ ID NO: 296211 - DNA, 20 bp, Artificial Sequence
  Description of Artificial Sequence: Synthetic oligonucleotide
  Target: ATXN1; (+) strand; PAM type: YTN; PAM sequence: CTA
tactcctaaaatttattgag

SEQ ID NO: 296212 - DNA, 20 bp, Artificial Sequence
  Description of Artificial Sequence: Synthetic oligonucleotide
  Target: ATXN1; (+) strand; PAM type: YTN; PAM sequence: CTC
ctaaaatttattgaggaccc

SEQ ID NO: 296213 - DNA, 20 bp, Artificial Sequence
  Description of Artificial Sequence: Synthetic oligonucleotide
  Target: ATXN1; (+) strand; PAM type: YTN; PAM sequence: CTA
aaatttattgaggaccccaa

SEQ ID NO: 296214 - DNA, 20 bp, Artificial Sequence
  Description of Artificial Sequence: Synthetic oligonucleotide
  Target: ATXN1; (+) strand; PAM type: YTN; PAM sequence: TTT
attgaggaccccaaggaact

SEQ ID NO: 296215 - DNA, 20 bp, Artificial Sequence
  Description of Artificial Sequence: Synthetic oligonucleotide
  Target: ATXN1; (+) strand; PAM type: YTN; PAM sequence: TTA
ttgaggaccccaaggaactt

SEQ ID NO: 296216 - DNA, 20 bp, Artificial Sequence
  Description of Artificial Sequence: Synthetic oligonucleotide
  Target: ATXN1; (+) strand; PAM type: YTN; PAM sequence: TTG
aggaccccaaggaacttttc

SEQ ID NO: 296217 - DNA, 20 bp, Artificial Sequence
  Description of Artificial Sequence: Synthetic oligonucleotide
  Target: ATXN1; (+) strand; PAM type: YTN; PAM sequence: CTT
ttcattaggtagatcatatt

SEQ ID NO: 296218 - DNA, 20 bp, Artificial Sequence
  Description of Artificial Sequence: Synthetic oligonucleotide
  Target: ATXN1; (+) strand; PAM type: YTN; PAM sequence: TTT
tcattaggtagatcatattt

SEQ ID NO: 296219 - DNA, 20 bp, Artificial Sequence
  Description of Artificial Sequence: Synthetic oligonucleotide
  Target: ATXN1; (+) strand; PAM type: YTN; PAM sequence: TTT
cattaggtagatcatattta

SEQ ID NO: 296220 - DNA, 20 bp, Artificial Sequence
  Description of Artificial Sequence: Synthetic oligonucleotide
  Target: ATXN1; (+) strand; PAM type: YTN; PAM sequence: TTC
attaggtagatcatatttaa

SEQ ID NO: 296221 - DNA, 20 bp, Artificial Sequence
  Description of Artificial Sequence: Synthetic oligonucleotide
  Target: ATXN1; (+) strand; PAM type: YTN; PAM sequence: TTA
ggtagatcatatttaacaac

SEQ ID NO: 296222 - DNA, 20 bp, Artificial Sequence
  Description of Artificial Sequence: Synthetic oligonucleotide
  Target: ATXN1; (+) strand; PAM type: YTN; PAM sequence: TTT
aacaactattataccatatt

SEQ ID NO: 296223 - DNA, 20 bp, Artificial Sequence
  Description of Artificial Sequence: Synthetic oligonucleotide
  Target: ATXN1; (+) strand; PAM type: YTN; PAM sequence: TTA
acaactattataccatatta

SEQ ID NO: 296224 - DNA, 20 bp, Artificial Sequence
  Description of Artificial Sequence: Synthetic oligonucleotide
  Target: ATXN1; (+) strand; PAM type: YTN; PAM sequence: CTA
ttataccatattagaagcaa

SEQ ID NO: 296225 - DNA, 20 bp, Artificial Sequence
  Description of Artificial Sequence: Synthetic oligonucleotide
  Target: ATXN1; (+) strand; PAM type: YTN; PAM sequence: TTA
taccatattagaagcaaaat

SEQ ID NO: 296226 - DNA, 20 bp, Artificial Sequence
  Description of Artificial Sequence: Synthetic oligonucleotide
  Target: ATXN1; (+) strand; PAM type: YTN; PAM sequence: TTA
gaagcaaaattgagaaaaat

SEQ ID NO: 296227 - DNA, 20 bp, Artificial Sequence
  Description of Artificial Sequence: Synthetic oligonucleotide
  Target: ATXN1; (+) strand; PAM type: YTN; PAM sequence: TTG
agaaaaatgtaaaatattca

SEQ ID NO: 296228 - DNA, 20 bp, Artificial Sequence
  Description of Artificial Sequence: Synthetic oligonucleotide
  Target: ATXN1; (+) strand; PAM type: YTN; PAM sequence: TTC
attagttcatttaatagaaa

SEQ ID NO: 296229 - DNA, 20 bp, Artificial Sequence
  Description of Artificial Sequence: Synthetic oligonucleotide
  Target: ATXN1; (+) strand; PAM type: YTN; PAM sequence: TTA
gttcatttaatagaaatact

SEQ ID NO: 296230 - DNA, 20 bp, Artificial Sequence
  Description of Artificial Sequence: Synthetic oligonucleotide
  Target: ATXN1; (+) strand; PAM type: YTN; PAM sequence: TTC
atttaatagaaatactaata

SEQ ID NO: 296231 - DNA, 20 bp, Artificial Sequence
  Description of Artificial Sequence: Synthetic oligonucleotide
  Target: ATXN1; (+) strand; PAM type: YTN; PAM sequence: TTT
aatagaaatactaatatacc

SEQ ID NO: 296232 - DNA, 20 bp, Artificial Sequence
  Description of Artificial Sequence: Synthetic oligonucleotide
  Target: ATXN1; (+) strand; PAM type: YTN; PAM sequence: TTA
atagaaatactaatataccc

SEQ ID NO: 296233 - DNA, 20 bp, Artificial Sequence
  Description of Artificial Sequence: Synthetic oligonucleotide
  Target: ATXN1; (+) strand; PAM type: YTN; PAM sequence: CTA
atatacccattgcatactac

SEQ ID NO: 296234 - DNA, 20 bp, Artificial Sequence
  Description of Artificial Sequence: Synthetic oligonucleotide
  Target: ATXN1; (+) strand; PAM type: YTN; PAM sequence: TTG
catactacatgaaataacat

SEQ ID NO: 296235 - DNA, 20 bp, Artificial Sequence
  Description of Artificial Sequence: Synthetic oligonucleotide
  Target: ATXN1; (+) strand; PAM type: YTN; PAM sequence: CTA
catgaaataacatctttatg

SEQ ID NO: 296236 - DNA, 20 bp, Artificial Sequence
  Description of Artificial Sequence: Synthetic oligonucleotide
  Target: ATXN1; (+) strand; PAM type: YTN; PAM sequence: CTT
tatgaaaaaataattatatt

SEQ ID NO: 296237 - DNA, 20 bp, Artificial Sequence
  Description of Artificial Sequence: Synthetic oligonucleotide
  Target: ATXN1; (+) strand; PAM type: YTN; PAM sequence: TTT
atgaaaaaataattatattt

SEQ ID NO: 296238 - DNA, 20 bp, Artificial Sequence
  Description of Artificial Sequence: Synthetic oligonucleotide
  Target: ATXN1; (+) strand; PAM type: YTN; PAM sequence: TTA
tgaaaaaataattatatttt

SEQ ID NO: 296239 - DNA, 20 bp, Artificial Sequence
  Description of Artificial Sequence: Synthetic oligonucleotide
  Target: ATXN1; (+) strand; PAM type: YTN; PAM sequence: TTA
tatttttcagaacaaaaaag

SEQ ID NO: 296240 - DNA, 20 bp, Artificial Sequence
  Description of Artificial Sequence: Synthetic oligonucleotide
  Target: ATXN1; (+) strand; PAM type: YTN; PAM sequence: TTT
ttcagaacaaaaaagttagt

SEQ ID NO: 296241 - DNA, 20 bp, Artificial Sequence
  Description of Artificial Sequence: Synthetic oligonucleotide
  Target: ATXN1; (+) strand; PAM type: YTN; PAM sequence: TTT
tcagaacaaaaaagttagtg

SEQ ID NO: 296242 - DNA, 20 bp, Artificial Sequence
  Description of Artificial Sequence: Synthetic oligonucleotide
  Target: ATXN1; (+) strand; PAM type: YTN; PAM sequence: TTT
cagaacaaaaaagttagtga

SEQ ID NO: 296243 - DNA, 20 bp, Artificial Sequence
  Description of Artificial Sequence: Synthetic oligonucleotide
  Target: ATXN1; (+) strand; PAM type: YTN; PAM sequence: TTC
agaacaaaaaagttagtgac

SEQ ID NO: 296244 - DNA, 20 bp, Artificial Sequence
  Description of Artificial Sequence: Synthetic oligonucleotide
  Target: ATXN1; (+) strand; PAM type: YTN; PAM sequence: TTA
gtgacaagagtgagatccat

SEQ ID NO: 296245 - DNA, 20 bp, Artificial Sequence
  Description of Artificial Sequence: Synthetic oligonucleotide
  Target: ATXN1; (+) strand; PAM type: YTN; PAM sequence: TTT
agatttttgcagctctcttt

SEQ ID NO: 296246 - DNA, 20 bp, Artificial Sequence
  Description of Artificial Sequence: Synthetic oligonucleotide
  Target: ATXN1; (+) strand; PAM type: YTN; PAM sequence: TTA
gatttttgcagctctcttta

SEQ ID NO: 296247 - DNA, 20 bp, Artificial Sequence
  Description of Artificial Sequence: Synthetic oligonucleotide
  Target: ATXN1; (+) strand; PAM type: YTN; PAM sequence: TTT
ttgcagctctctttaatgcc

SEQ ID NO: 296248 - DNA, 20 bp, Artificial Sequence
  Description of Artificial Sequence: Synthetic oligonucleotide
  Target: ATXN1; (+) strand; PAM type: YTN; PAM sequence: TTT
tgcagctctctttaatgcct

SEQ ID NO: 296249 - DNA, 20 bp, Artificial Sequence
  Description of Artificial Sequence: Synthetic oligonucleotide
  Target: ATXN1; (+) strand; PAM type: YTN; PAM sequence: TTT
gcagctctctttaatgcctg

SEQ ID NO: 296250 - DNA, 20 bp, Artificial Sequence
  Description of Artificial Sequence: Synthetic oligonucleotide
  Target: ATXN1; (+) strand; PAM type: YTN; PAM sequence: TTG
cagctctctttaatgcctgg

SEQ ID NO: 296251 - DNA, 20 bp, Artificial Sequence
  Description of Artificial Sequence: Synthetic oligonucleotide
  Target: ATXN1; (+) strand; PAM type: YTN; PAM sequence: CTC
tctttaatgcctggcttaat

SEQ ID NO: 296252 - DNA, 20 bp, Artificial Sequence
  Description of Artificial Sequence: Synthetic oligonucleotide
  Target: ATXN1; (+) strand; PAM type: YTN; PAM sequence: CTC
tttaatgcctggcttaatgg

SEQ ID NO: 296253 - DNA, 20 bp, Artificial Sequence
  Description of Artificial Sequence: Synthetic oligonucleotide
  Target: ATXN1; (+) strand; PAM type: YTN; PAM sequence: CTT
taatgcctggcttaatggaa

SEQ ID NO: 296254 - DNA, 20 bp, Artificial Sequence
  Description of Artificial Sequence: Synthetic oligonucleotide
  Target: ATXN1; (+) strand; PAM type: YTN; PAM sequence: TTT
aatgcctggcttaatggaaa

SEQ ID NO: 296255 - DNA, 20 bp, Artificial Sequence
  Description of Artificial Sequence: Synthetic oligonucleotide
  Target: ATXN1; (+) strand; PAM type: YTN; PAM sequence: TTA
atgcctggcttaatggaaaa

SEQ ID NO: 296256 - DNA, 20 bp, Artificial Sequence
  Description of Artificial Sequence: Synthetic oligonucleotide
  Target: ATXN1; (+) strand; PAM type: YTN; PAM sequence: CTG
gcttaatggaaaatggttaa

SEQ ID NO: 296257 - DNA, 20 bp, Artificial Sequence
  Description of Artificial Sequence: Synthetic oligonucleotide
  Target: ATXN1; (+) strand; PAM type: YTN; PAM sequence: CTT
aatggaaaatggttaaattc

SEQ ID NO: 296258 - DNA, 20 bp, Artificial Sequence
  Description of Artificial Sequence: Synthetic oligonucleotide
  Target: ATXN1; (+) strand; PAM type: YTN; PAM sequence: TTA
atggaaaatggttaaattct

SEQ ID NO: 296259 - DNA, 20 bp, Artificial Sequence
  Description of Artificial Sequence: Synthetic oligonucleotide
  Target: ATXN1; (+) strand; PAM type: YTN; PAM sequence: TTA
aattctcttctgtgcctctg

SEQ ID NO: 296260 - DNA, 20 bp, Artificial Sequence
  Description of Artificial Sequence: Synthetic oligonucleotide
  Target: ATXN1; (+) strand; PAM type: YTN; PAM sequence: TTC
tcttctgtgcctctgaattc

SEQ ID NO: 296261 - DNA, 20 bp, Artificial Sequence
  Description of Artificial Sequence: Synthetic oligonucleotide
  Target: ATXN1; (+) strand; PAM type: YTN; PAM sequence: CTC
ttctgtgcctctgaattcag

SEQ ID NO: 296262 - DNA, 20 bp, Artificial Sequence
  Description of Artificial Sequence: Synthetic oligonucleotide
  Target: ATXN1; (+) strand; PAM type: YTN; PAM sequence: CTT
ctgtgcctctgaattcagtt

SEQ ID NO: 296263 - DNA, 20 bp, Artificial Sequence
  Description of Artificial Sequence: Synthetic oligonucleotide
  Target: ATXN1; (+) strand; PAM type: YTN; PAM sequence: TTC
tgtgcctctgaattcagttt

SEQ ID NO: 296264 - DNA, 20 bp, Artificial Sequence
  Description of Artificial Sequence: Synthetic oligonucleotide
  Target: ATXN1; (+) strand; PAM type: YTN; PAM sequence: CTG
tgcctctgaattcagttttc

SEQ ID NO: 296265 - DNA, 20 bp, Artificial Sequence
  Description of Artificial Sequence: Synthetic oligonucleotide
  Target: ATXN1; (+) strand; PAM type: YTN; PAM sequence: CTC
tgaattcagttttctgtgat

SEQ ID NO: 296266 - DNA, 20 bp, Artificial Sequence
  Description of Artificial Sequence: Synthetic oligonucleotide
  Target: ATXN1; (+) strand; PAM type: YTN; PAM sequence: CTG
aattcagttttctgtgatat

SEQ ID NO: 296267 - DNA, 20 bp, Artificial Sequence
  Description of Artificial Sequence: Synthetic oligonucleotide
  Target: ATXN1; (+) strand; PAM type: YTN; PAM sequence: TTC
agttttctgtgatatgttgt

SEQ ID NO: 296268 - DNA, 20 bp, Artificial Sequence
  Description of Artificial Sequence: Synthetic oligonucleotide
  Target: ATXN1; (+) strand; PAM type: YTN; PAM sequence: TTT
tctgtgatatgttgtttggt

SEQ ID NO: 296269 - DNA, 20 bp, Artificial Sequence
  Description of Artificial Sequence: Synthetic oligonucleotide
  Target: ATXN1; (+) strand; PAM type: YTN; PAM sequence: TTT
ctgtgatatgttgtttggtt

SEQ ID NO: 296270 - DNA, 20 bp, Artificial Sequence
  Description of Artificial Sequence: Synthetic oligonucleotide
  Target: ATXN1; (+) strand; PAM type: YTN; PAM sequence: TTC
tgtgatatgttgtttggttg

SEQ ID NO: 296271 - DNA, 20 bp, Artificial Sequence
  Description of Artificial Sequence: Synthetic oligonucleotide
  Target: ATXN1; (+) strand; PAM type: YTN; PAM sequence: CTG
tgatatgttgtttggttgaa

SEQ ID NO: 296272 - DNA, 20 bp, Artificial Sequence
  Description of Artificial Sequence: Synthetic oligonucleotide
  Target: ATXN1; (+) strand; PAM type: YTN; PAM sequence: TTG
tttggttgaagtatgtggag

SEQ ID NO: 296273 - DNA, 20 bp, Artificial Sequence
  Description of Artificial Sequence: Synthetic oligonucleotide
  Target: ATXN1; (+) strand; PAM type: YTN; PAM sequence: TTT
ggttgaagtatgtggagaag

SEQ ID NO: 296274 - DNA, 20 bp, Artificial Sequence
  Description of Artificial Sequence: Synthetic oligonucleotide
  Target: ATXN1; (+) strand; PAM type: YTN; PAM sequence: TTG
gttgaagtatgtggagaaga

SEQ ID NO: 296275 - DNA, 20 bp, Artificial Sequence
  Description of Artificial Sequence: Synthetic oligonucleotide
  Target: ATXN1; (+) strand; PAM type: YTN; PAM sequence: TTG
aagtatgtggagaagatgtg

SEQ ID NO: 296276 - DNA, 20 bp, Artificial Sequence
  Description of Artificial Sequence: Synthetic oligonucleotide
  Target: ATXN1; (+) strand; PAM type: YTN; PAM sequence: TTT
cagcaattgtggatattctt

SEQ ID NO: 296277 - DNA, 20 bp, Artificial Sequence
  Description of Artificial Sequence: Synthetic oligonucleotide
  Target: ATXN1; (+) strand; PAM type: YTN; PAM sequence: TTC
agcaattgtggatattcttt

SEQ ID NO: 296278 - DNA, 20 bp, Artificial Sequence
  Description of Artificial Sequence: Synthetic oligonucleotide
  Target: ATXN1; (+) strand; PAM type: YTN; PAM sequence: TTG
tggatattctttttttatat

SEQ ID NO: 296279 - DNA, 20 bp, Artificial Sequence
  Description of Artificial Sequence: Synthetic oligonucleotide
  Target: ATXN1; (+) strand; PAM type: YTN; PAM sequence: TTC
tttttttatatcataccaaa

SEQ ID NO: 296280 - DNA, 20 bp, Artificial Sequence
  Description of Artificial Sequence: Synthetic oligonucleotide
  Target: ATXN1; (+) strand; PAM type: YTN; PAM sequence: CTT
tttttatatcataccaaaac

SEQ ID NO: 296281 - DNA, 20 bp, Artificial Sequence
  Description of Artificial Sequence: Synthetic oligonucleotide
  Target: ATXN1; (+) strand; PAM type: YTN; PAM sequence: TTT
ttttatatcataccaaaact

SEQ ID NO: 296282 - DNA, 20 bp, Artificial Sequence
  Description of Artificial Sequence: Synthetic oligonucleotide
  Target: ATXN1; (+) strand; PAM type: YTN; PAM sequence: TTT
tttatatcataccaaaactc

SEQ ID NO: 296283 - DNA, 20 bp, Artificial Sequence
  Description of Artificial Sequence: Synthetic oligonucleotide
  Target: ATXN1; (+) strand; PAM type: YTN; PAM sequence: TTT
ttatatcataccaaaactca

SEQ ID NO: 296284 - DNA, 20 bp, Artificial Sequence
  Description of Artificial Sequence: Synthetic oligonucleotide
  Target: ATXN1; (+) strand; PAM type: YTN; PAM sequence: TTT
tatatcataccaaaactcaa

SEQ ID NO: 296285 - DNA, 20 bp, Artificial Sequence
  Description of Artificial Sequence: Synthetic oligonucleotide
  Target: ATXN1; (+) strand; PAM type: YTN; PAM sequence: TTT
atatcataccaaaactcaat

SEQ ID NO: 296286 - DNA, 20 bp, Artificial Sequence
  Description of Artificial Sequence: Synthetic oligonucleotide
  Target: ATXN1; (+) strand; PAM type: YTN; PAM sequence: TTA
tatcataccaaaactcaata

SEQ ID NO: 296287 - DNA, 20 bp, Artificial Sequence
  Description of Artificial Sequence: Synthetic oligonucleotide
  Target: ATXN1; (+) strand; PAM type: YTN; PAM sequence: CTC
aataagtggtagtttcttaa

SEQ ID NO: 296288 - DNA, 20 bp, Artificial Sequence
  Description of Artificial Sequence: Synthetic oligonucleotide
  Target: ATXN1; (+) strand; PAM type: YTN; PAM sequence: TTT
cttaaaggggagcagcacca

SEQ ID NO: 296289 - DNA, 20 bp, Artificial Sequence
  Description of Artificial Sequence: Synthetic oligonucleotide
  Target: ATXN1; (+) strand; PAM type: YTN; PAM sequence: TTC
ttaaaggggagcagcaccat

SEQ ID NO: 296290 - DNA, 20 bp, Artificial Sequence
  Description of Artificial Sequence: Synthetic oligonucleotide
  Target: ATXN1; (+) strand; PAM type: YTN; PAM sequence: CTT
aaaggggagcagcaccatgg

SEQ ID NO: 296291 - DNA, 20 bp, Artificial Sequence
  Description of Artificial Sequence: Synthetic oligonucleotide
  Target: ATXN1; (+) strand; PAM type: YTN; PAM sequence: TTA
aaggggagcagcaccatgga

SEQ ID NO: 296292 - DNA, 20 bp, Artificial Sequence
  Description of Artificial Sequence: Synthetic oligonucleotide
  Target: ATXN1; (+) strand; PAM type: YTN; PAM sequence: CTG
aagcatagaaataaactcta

SEQ ID NO: 296293 - DNA, 20 bp, Artificial Sequence
  Description of Artificial Sequence: Synthetic oligonucleotide
  Target: ATXN1; (+) strand; PAM type: YTN; PAM sequence: CTC
taagtattcttttatattaa

SEQ ID NO: 296294 - DNA, 20 bp, Artificial Sequence
  Description of Artificial Sequence: Synthetic oligonucleotide
  Target: ATXN1; (+) strand; PAM type: YTN; PAM sequence: CTA
agtattcttttatattaaaa

SEQ ID NO: 296295 - DNA, 20 bp, Artificial Sequence
  Description of Artificial Sequence: Synthetic oligonucleotide
  Target: ATXN1; (+) strand; PAM type: YTN; PAM sequence: TTC
ttttatattaaaattcatta

SEQ ID NO: 296296 - DNA, 20 bp, Artificial Sequence
  Description of Artificial Sequence: Synthetic oligonucleotide
  Target: ATXN1; (+) strand; PAM type: YTN; PAM sequence: CTT
ttatattaaaattcattagt

SEQ ID NO: 296297 - DNA, 20 bp, Artificial Sequence
  Description of Artificial Sequence: Synthetic oligonucleotide
  Target: ATXN1; (+) strand; PAM type: YTN; PAM sequence: TTT
tatattaaaattcattagtc

SEQ ID NO: 296298 - DNA, 20 bp, Artificial Sequence
  Description of Artificial Sequence: Synthetic oligonucleotide
  Target: ATXN1; (+) strand; PAM type: YTN; PAM sequence: TTT
atattaaaattcattagtct

SEQ ID NO: 296299 - DNA, 20 bp, Artificial Sequence
  Description of Artificial Sequence: Synthetic oligonucleotide
  Target: ATXN1; (+) strand; PAM type: YTN; PAM sequence: TTA
tattaaaattcattagtcta

SEQ ID NO: 296300 - DNA, 20 bp, Artificial Sequence
  Description of Artificial Sequence: Synthetic oligonucleotide
  Target: ATXN1; (+) strand; PAM type: YTN; PAM sequence: TTA
aaattcattagtctatcttg

SEQ ID NO: 296301 - DNA, 20 bp, Artificial Sequence
  Description of Artificial Sequence: Synthetic oligonucleotide
  Target: ATXN1; (+) strand; PAM type: YTN; PAM sequence: TTC
attagtctatcttgaacttt

SEQ ID NO: 296302 - DNA, 20 bp, Artificial Sequence
  Description of Artificial Sequence: Synthetic oligonucleotide
  Target: ATXN1; (+) strand; PAM type: YTN; PAM sequence: TTA
gtctatcttgaactttggat

SEQ ID NO: 296303 - DNA, 20 bp, Artificial Sequence
  Description of Artificial Sequence: Synthetic oligonucleotide
  Target: ATXN1; (+) strand; PAM type: YTN; PAM sequence: CTA
tcttgaactttggatggatc

SEQ ID NO: 296304 - DNA, 20 bp, Artificial Sequence
  Description of Artificial Sequence: Synthetic oligonucleotide
  Target: ATXN1; (+) strand; PAM type: YTN; PAM sequence: CTT
gaactttggatggatcttta

SEQ ID NO: 296305 - DNA, 20 bp, Artificial Sequence
  Description of Artificial Sequence: Synthetic oligonucleotide
  Target: ATXN1; (+) strand; PAM type: YTN; PAM sequence: TTG
aactttggatggatctttag

SEQ ID NO: 296306 - DNA, 20 bp, Artificial Sequence
  Description of Artificial Sequence: Synthetic oligonucleotide
  Target: ATXN1; (+) strand; PAM type: YTN; PAM sequence: CTT
tggatggatctttagctatg

SEQ ID NO: 296307 - DNA, 20 bp, Artificial Sequence
  Description of Artificial Sequence: Synthetic oligonucleotide
  Target: ATXN1; (+) strand; PAM type: YTN; PAM sequence: TTT
ggatggatctttagctatgc

SEQ ID NO: 296308 - DNA, 20 bp, Artificial Sequence
  Description of Artificial Sequence: Synthetic oligonucleotide
  Target: ATXN1; (+) strand; PAM type: YTN; PAM sequence: TTG
gatggatctttagctatgca

SEQ ID NO: 296309 - DNA, 20 bp, Artificial Sequence
  Description of Artificial Sequence: Synthetic oligonucleotide
  Target: ATXN1; (+) strand; PAM type: YTN; PAM sequence: CTT
tagctatgcatgattttgta

SEQ ID NO: 296310 - DNA, 20 bp, Artificial Sequence
  Description of Artificial Sequence: Synthetic oligonucleotide
  Target: ATXN1; (+) strand; PAM type: YTN; PAM sequence: TTT
agctatgcatgattttgtaa

SEQ ID NO: 296311 - DNA, 20 bp, Artificial Sequence
  Description of Artificial Sequence: Synthetic oligonucleotide
  Target: ATXN1; (+) strand; PAM type: YTN; PAM sequence: TTA
gctatgcatgattttgtaac

SEQ ID NO: 296312 - DNA, 20 bp, Artificial Sequence
  Description of Artificial Sequence: Synthetic oligonucleotide
  Target: ATXN1; (+) strand; PAM type: YTN; PAM sequence: CTA
tgcatgattttgtaacatca

SEQ ID NO: 296313 - DNA, 20 bp, Artificial Sequence
  Description of Artificial Sequence: Synthetic oligonucleotide
  Target: ATXN1; (+) strand; PAM type: YTN; PAM sequence: TTT
tgtaacatcataccctggtc

SEQ ID NO: 296314 - DNA, 20 bp, Artificial Sequence
  Description of Artificial Sequence: Synthetic oligonucleotide
  Target: ATXN1; (+) strand; PAM type: YTN; PAM sequence: TTT
gtaacatcataccctggtca

SEQ ID NO: 296315 - DNA, 20 bp, Artificial Sequence
  Description of Artificial Sequence: Synthetic oligonucleotide
  Target: ATXN1; (+) strand; PAM type: YTN; PAM sequence: TTG
taacatcataccctggtcat

SEQ ID NO: 296316 - DNA, 20 bp, Artificial Sequence
  Description of Artificial Sequence: Synthetic oligonucleotide
  Target: ATXN1; (+) strand; PAM type: YTN; PAM sequence: CTG
gtcatttggaaaattatatt

SEQ ID NO: 296317 - DNA, 20 bp, Artificial Sequence
  Description of Artificial Sequence: Synthetic oligonucleotide
  Target: ATXN1; (+) strand; PAM type: YTN; PAM sequence: TTT
ggaaaattatattagttcag

SEQ ID NO: 296318 - DNA, 20 bp, Artificial Sequence
  Description of Artificial Sequence: Synthetic oligonucleotide
  Target: ATXN1; (+) strand; PAM type: YTN; PAM sequence: TTG
gaaaattatattagttcagt

SEQ ID NO: 296319 - DNA, 20 bp, Artificial Sequence
  Description of Artificial Sequence: Synthetic oligonucleotide
  Target: ATXN1; (+) strand; PAM type: YTN; PAM sequence: TTA
tattagttcagtgaattatg

SEQ ID NO: 296320 - DNA, 20 bp, Artificial Sequence
  Description of Artificial Sequence: Synthetic oligonucleotide
  Target: ATXN1; (+) strand; PAM type: YTN; PAM sequence: TTA
gttcagtgaattatgcaaat

SEQ ID NO: 296321 - DNA, 20 bp, Artificial Sequence
  Description of Artificial Sequence: Synthetic oligonucleotide
  Target: ATXN1; (+) strand; PAM type: YTN; PAM sequence: TTC
agtgaattatgcaaatcttc

SEQ ID NO: 296322 - DNA, 20 bp, Artificial Sequence
  Description of Artificial Sequence: Synthetic oligonucleotide
  Target: ATXN1; (+) strand; PAM type: YTN; PAM sequence: TTA
tgcaaatcttccaaaagttg

SEQ ID NO: 296323 - DNA, 20 bp, Artificial Sequence
  Description of Artificial Sequence: Synthetic oligonucleotide
  Target: ATXN1; (+) strand; PAM type: YTN; PAM sequence: CTT
ccaaaagttgacacatttca

SEQ ID NO: 296324 - DNA, 20 bp, Artificial Sequence
  Description of Artificial Sequence: Synthetic oligonucleotide
  Target: ATXN1; (+) strand; PAM type: YTN; PAM sequence: TTC
caaaagttgacacatttcat

SEQ ID NO: 296325 - DNA, 20 bp, Artificial Sequence
  Description of Artificial Sequence: Synthetic oligonucleotide
  Target: ATXN1; (+) strand; PAM type: YTN; PAM sequence: TTG
acacatttcattacacaata

SEQ ID NO: 296326 - DNA, 20 bp, Artificial Sequence
  Description of Artificial Sequence: Synthetic oligonucleotide
  Target: ATXN1; (+) strand; PAM type: YTN; PAM sequence: TTT
cattacacaatatcatcaca

SEQ ID NO: 296327 - DNA, 20 bp, Artificial Sequence
  Description of Artificial Sequence: Synthetic oligonucleotide
  Target: ATXN1; (+) strand; PAM type: YTN; PAM sequence: TTC
attacacaatatcatcacac

SEQ ID NO: 296328 - DNA, 20 bp, Artificial Sequence
  Description of Artificial Sequence: Synthetic oligonucleotide
  Target: ATXN1; (+) strand; PAM type: YTN; PAM sequence: TTA
cacaatatcatcacacatca

SEQ ID NO: 296329 - DNA, 20 bp, Artificial Sequence
  Description of Artificial Sequence: Synthetic oligonucleotide
  Target: ATXN1; (+) strand; PAM type: YTN; PAM sequence: CTC
tgaaaaactccgctgtacac

SEQ ID NO: 296330 - DNA, 20 bp, Artificial Sequence
  Description of Artificial Sequence: Synthetic oligonucleotide
  Target: ATXN1; (+) strand; PAM type: YTN; PAM sequence: CTG
aaaaactccgctgtacacat

SEQ ID NO: 296331 - DNA, 20 bp, Artificial Sequence
  Description of Artificial Sequence: Synthetic oligonucleotide
  Target: ATXN1; (+) strand; PAM type: YTN; PAM sequence: CTC
cgctgtacacatggaagaga

SEQ ID NO: 296332 - DNA, 20 bp, Artificial Sequence
  Description of Artificial Sequence: Synthetic oligonucleotide
  Target: ATXN1; (+) strand; PAM type: YTN; PAM sequence: CTG
tacacatggaagagaatggg

SEQ ID NO: 296333 - DNA, 20 bp, Artificial Sequence
  Description of Artificial Sequence: Synthetic oligonucleotide
  Target: ATXN1; (+) strand; PAM type: YTN; PAM sequence: CTT
agtattaccataaaaataat

SEQ ID NO: 296334 - DNA, 20 bp, Artificial Sequence
  Description of Artificial Sequence: Synthetic oligonucleotide
  Target: ATXN1; (+) strand; PAM type: YTN; PAM sequence: TTA
gtattaccataaaaataatc

SEQ ID NO: 296335 - DNA, 20 bp, Artificial Sequence
  Description of Artificial Sequence: Synthetic oligonucleotide
  Target: ATXN1; (+) strand; PAM type: YTN; PAM sequence: TTA
ccataaaaataatcttgatc

SEQ ID NO: 296336 - DNA, 20 bp, Artificial Sequence
  Description of Artificial Sequence: Synthetic oligonucleotide
  Target: ATXN1; (+) strand; PAM type: YTN; PAM sequence: CTT
gatcttacagatgtccctcc

SEQ ID NO: 296337 - DNA, 20 bp, Artificial Sequence
  Description of Artificial Sequence: Synthetic oligonucleotide
  Target: ATXN1; (+) strand; PAM type: YTN; PAM sequence: TTG
atcttacagatgtccctcca

SEQ ID NO: 296338 - DNA, 20 bp, Artificial Sequence
  Description of Artificial Sequence: Synthetic oligonucleotide
  Target: ATXN1; (+) strand; PAM type: YTN; PAM sequence: CTT
acagatgtccctccagaaaa

SEQ ID NO: 296339 - DNA, 20 bp, Artificial Sequence
  Description of Artificial Sequence: Synthetic oligonucleotide
  Target: ATXN1; (+) strand; PAM type: YTN; PAM sequence: TTA
cagatgtccctccagaaaag

SEQ ID NO: 296340 - DNA, 20 bp, Artificial Sequence
  Description of Artificial Sequence: Synthetic oligonucleotide
  Target: ATXN1; (+) strand; PAM type: YTN; PAM sequence: CTC
cagaaaaggtcttgggtggg

SEQ ID NO: 296341 - DNA, 20 bp, Artificial Sequence
  Description of Artificial Sequence: Synthetic oligonucleotide
  Target: ATXN1; (+) strand; PAM type: YTN; PAM sequence: CTT
gggtgggggtgggggggttc

SEQ ID NO: 296342 - DNA, 20 bp, Artificial Sequence
  Description of Artificial Sequence: Synthetic oligonucleotide
  Target: ATXN1; (+) strand; PAM type: YTN; PAM sequence: TTG
ggtgggggtgggggggttcc

SEQ ID NO: 296343 - DNA, 20 bp, Artificial Sequence
  Description of Artificial Sequence: Synthetic oligonucleotide
  Target: ATXN1; (+) strand; PAM type: YTN; PAM sequence: TTC
ccaaagtgagaactgctgac

SEQ ID NO: 296344 - DNA, 20 bp, Artificial Sequence
  Description of Artificial Sequence: Synthetic oligonucleotide
  Target: ATXN1; (+) strand; PAM type: YTN; PAM sequence: CTG
ctgaccaggcagacattcta

SEQ ID NO: 296345 - DNA, 20 bp, Artificial Sequence
  Description of Artificial Sequence: Synthetic oligonucleotide
  Target: ATXN1; (+) strand; PAM type: YTN; PAM sequence: CTG
accaggcagacattctaaac

SEQ ID NO: 296346 - DNA, 20 bp, Artificial Sequence
  Description of Artificial Sequence: Synthetic oligonucleotide
  Target: ATXN1; (+) strand; PAM type: YTN; PAM sequence: TTC
taaaccccacagatccctac

SEQ ID NO: 296347 - DNA, 20 bp, Artificial Sequence
  Description of Artificial Sequence: Synthetic oligonucleotide
  Target: ATXN1; (+) strand; PAM type: YTN; PAM sequence: CTA
aaccccacagatccctactg

SEQ ID NO: 296348 - DNA, 20 bp, Artificial Sequence
  Description of Artificial Sequence: Synthetic oligonucleotide
  Target: ATXN1; (+) strand; PAM type: YTN; PAM sequence: CTA
ctggaagtaaaagcacagaa

SEQ ID NO: 296349 - DNA, 20 bp, Artificial Sequence
  Description of Artificial Sequence: Synthetic oligonucleotide
  Target: ATXN1; (+) strand; PAM type: YTN; PAM sequence: CTG
gaagtaaaagcacagaactc

SEQ ID NO: 296350 - DNA, 20 bp, Artificial Sequence
  Description of Artificial Sequence: Synthetic oligonucleotide
  Target: ATXN1; (+) strand; PAM type: YTN; PAM sequence: CTC
taggtttccttctggcctca

SEQ ID NO: 296351 - DNA, 20 bp, Artificial Sequence
  Description of Artificial Sequence: Synthetic oligonucleotide
  Target: ATXN1; (+) strand; PAM type: YTN; PAM sequence: CTA
ggtttccttctggcctcaat

SEQ ID NO: 296352 - DNA, 20 bp, Artificial Sequence
  Description of Artificial Sequence: Synthetic oligonucleotide
  Target: ATXN1; (+) strand; PAM type: YTN; PAM sequence: TTT
ccttctggcctcaatttcca

SEQ ID NO: 296353 - DNA, 20 bp, Artificial Sequence
  Description of Artificial Sequence: Synthetic oligonucleotide
  Target: ATXN1; (+) strand; PAM type: YTN; PAM sequence: TTC
cttctggcctcaatttccat

SEQ ID NO: 296354 - DNA, 20 bp, Artificial Sequence
  Description of Artificial Sequence: Synthetic oligonucleotide
  Target: ATXN1; (+) strand; PAM type: YTN; PAM sequence: CTT
ctggcctcaatttccataat

SEQ ID NO: 296355 - DNA, 20 bp, Artificial Sequence
  Description of Artificial Sequence: Synthetic oligonucleotide
  Target: ATXN1; (+) strand; PAM type: YTN; PAM sequence: TTC
tggcctcaatttccataatt

SEQ ID NO: 296356 - DNA, 20 bp, Artificial Sequence
  Description of Artificial Sequence: Synthetic oligonucleotide
  Target: ATXN1; (+) strand; PAM type: YTN; PAM sequence: CTG
gcctcaatttccataattcc

SEQ ID NO: 296357 - DNA, 20 bp, Artificial Sequence
  Description of Artificial Sequence: Synthetic oligonucleotide
  Target: ATXN1; (+) strand; PAM type: YTN; PAM sequence: CTC
aatttccataattcccacca

SEQ ID NO: 296358 - DNA, 20 bp, Artificial Sequence
  Description of Artificial Sequence: Synthetic oligonucleotide
  Target: ATXN1; (+) strand; PAM type: YTN; PAM sequence: TTT
ccataattcccaccatttgt

SEQ ID NO: 296359 - DNA, 20 bp, Artificial Sequence
  Description of Artificial Sequence: Synthetic oligonucleotide
  Target: ATXN1; (+) strand; PAM type: YTN; PAM sequence: TTC
cataattcccaccatttgtc

SEQ ID NO: 296360 - DNA, 20 bp, Artificial Sequence
  Description of Artificial Sequence: Synthetic oligonucleotide
  Target: ATXN1; (+) strand; PAM type: YTN; PAM sequence: TTC
ccaccatttgtcctcttggg

SEQ ID NO: 296361 - DNA, 20 bp, Artificial Sequence
  Description of Artificial Sequence: Synthetic oligonucleotide
  Target: ATXN1; (+) strand; PAM type: YTN; PAM sequence: TTT
gtcctcttggggatcactga

SEQ ID NO: 296362 - DNA, 20 bp, Artificial Sequence
  Description of Artificial Sequence: Synthetic oligonucleotide
  Target: ATXN1; (+) strand; PAM type: YTN; PAM sequence: TTG
tcctcttggggatcactgag

SEQ ID NO: 296363 - DNA, 20 bp, Artificial Sequence
  Description of Artificial Sequence: Synthetic oligonucleotide
  Target: ATXN1; (+) strand; PAM type: YTN; PAM sequence: CTC
ttggggatcactgagtacaa

SEQ ID NO: 296364 - DNA, 20 bp, Artificial Sequence
  Description of Artificial Sequence: Synthetic oligonucleotide
  Target: ATXN1; (+) strand; PAM type: YTN; PAM sequence: CTT
ggggatcactgagtacaacc

SEQ ID NO: 296365 - DNA, 20 bp, Artificial Sequence
  Description of Artificial Sequence: Synthetic oligonucleotide
  Target: ATXN1; (+) strand; PAM type: YTN; PAM sequence: TTG
gggatcactgagtacaacct

SEQ ID NO: 296366 - DNA, 20 bp, Artificial Sequence
  Description of Artificial Sequence: Synthetic oligonucleotide
  Target: ATXN1; (+) strand; PAM type: YTN; PAM sequence: CTG
agtacaacctaacaaagacc

SEQ ID NO: 296367 - DNA, 20 bp, Artificial Sequence
  Description of Artificial Sequence: Synthetic oligonucleotide
  Target: ATXN1; (+) strand; PAM type: YTN; PAM sequence: CTA
acaaagaccattaacccatg

SEQ ID NO: 296368 - DNA, 20 bp, Artificial Sequence
  Description of Artificial Sequence: Synthetic oligonucleotide
  Target: ATXN1; (+) strand; PAM type: YTN; PAM sequence: TTA
acccatgtggtcaagaacat

SEQ ID NO: 296369 - DNA, 20 bp, Artificial Sequence
  Description of Artificial Sequence: Synthetic oligonucleotide
  Target: ATXN1; (+) strand; PAM type: YTN; PAM sequence: TTA
tctgtgggcggaaaactgta

SEQ ID NO: 296370 - DNA, 20 bp, Artificial Sequence
  Description of Artificial Sequence: Synthetic oligonucleotide
  Target: ATXN1; (+) strand; PAM type: YTN; PAM sequence: CTG
tgggcggaaaactgtattta

SEQ ID NO: 296371 - DNA, 20 bp, Artificial Sequence
  Description of Artificial Sequence: Synthetic oligonucleotide
  Target: ATXN1; (+) strand; PAM type: YTN; PAM sequence: CTG
tatttacttggattctacta

SEQ ID NO: 296372 - DNA, 20 bp, Artificial Sequence
  Description of Artificial Sequence: Synthetic oligonucleotide
  Target: ATXN1; (+) strand; PAM type: YTN; PAM sequence: TTT
acttggattctactaggcaa

SEQ ID NO: 296373 - DNA, 20 bp, Artificial Sequence
  Description of Artificial Sequence: Synthetic oligonucleotide
  Target: ATXN1; (+) strand; PAM type: YTN; PAM sequence: TTA
cttggattctactaggcaag

SEQ ID NO: 296374 - DNA, 20 bp, Artificial Sequence
  Description of Artificial Sequence: Synthetic oligonucleotide
  Target: ATXN1; (+) strand; PAM type: YTN; PAM sequence: CTT
ggattctactaggcaagaaa

SEQ ID NO: 296375 - DNA, 20 bp, Artificial Sequence
  Description of Artificial Sequence: Synthetic oligonucleotide
  Target: ATXN1; (+) strand; PAM type: YTN; PAM sequence: TTG
gattctactaggcaagaaac

SEQ ID NO: 296376 - DNA, 20 bp, Artificial Sequence
  Description of Artificial Sequence: Synthetic oligonucleotide
  Target: ATXN1; (+) strand; PAM type: YTN; PAM sequence: TTC
tactaggcaagaaactgtga

SEQ ID NO: 296377 - DNA, 20 bp, Artificial Sequence
  Description of Artificial Sequence: Synthetic oligonucleotide
  Target: ATXN1; (+) strand; PAM type: YTN; PAM sequence: CTA
ctaggcaagaaactgtgaga

SEQ ID NO: 296378 - DNA, 20 bp, Artificial Sequence
  Description of Artificial Sequence: Synthetic oligonucleotide
  Target: ATXN1; (+) strand; PAM type: YTN; PAM sequence: CTA
ggcaagaaactgtgagaagt

SEQ ID NO: 296379 - DNA, 20 bp, Artificial Sequence
  Description of Artificial Sequence: Synthetic oligonucleotide
  Target: ATXN1; (+) strand; PAM type: YTN; PAM sequence: CTG
tgagaagtgtgcatttttaa

SEQ ID NO: 296380 - DNA, 20 bp, Artificial Sequence
  Description of Artificial Sequence: Synthetic oligonucleotide
  Target: ATXN1; (+) strand; PAM type: YTN; PAM sequence: TTT
ttaattttgttttattttta

SEQ ID NO: 296381 - DNA, 20 bp, Artificial Sequence
  Description of Artificial Sequence: Synthetic oligonucleotide
  Target: ATXN1; (+) strand; PAM type: YTN; PAM sequence: TTT
taattttgttttatttttat

SEQ ID NO: 296382 - DNA, 20 bp, Artificial Sequence
  Description of Artificial Sequence: Synthetic oligonucleotide
  Target: ATXN1; (+) strand; PAM type: YTN; PAM sequence: TTT
aattttgttttatttttatg

SEQ ID NO: 296383 - DNA, 20 bp, Artificial Sequence
  Description of Artificial Sequence: Synthetic oligonucleotide
  Target: ATXN1; (+) strand; PAM type: YTN; PAM sequence: TTA
attttgttttatttttatgg

SEQ ID NO: 296384 - DNA, 20 bp, Artificial Sequence
  Description of Artificial Sequence: Synthetic oligonucleotide
  Target: ATXN1; (+) strand; PAM type: YTN; PAM sequence: TTT
tgttttatttttatgggtac

SEQ ID NO: 296385 - DNA, 20 bp, Artificial Sequence
  Description of Artificial Sequence: Synthetic oligonucleotide
  Target: ATXN1; (+) strand; PAM type: YTN; PAM sequence: TTT
gttttatttttatgggtaca

SEQ ID NO: 296386 - DNA, 20 bp, Artificial Sequence
  Description of Artificial Sequence: Synthetic oligonucleotide
  Target: ATXN1; (+) strand; PAM type: YTN; PAM sequence: TTG
ttttatttttatgggtacat

SEQ ID NO: 296387 - DNA, 20 bp, Artificial Sequence
  Description of Artificial Sequence: Synthetic oligonucleotide
  Target: ATXN1; (+) strand; PAM type: YTN; PAM sequence: TTT
tatttttatgggtacatgat

SEQ ID NO: 296388 - DNA, 20 bp, Artificial Sequence
  Description of Artificial Sequence: Synthetic oligonucleotide
  Target: ATXN1; (+) strand; PAM type: YTN; PAM sequence: TTT
atttttatgggtacatgatc

SEQ ID NO: 296389 - DNA, 20 bp, Artificial Sequence
  Description of Artificial Sequence: Synthetic oligonucleotide
  Target: ATXN1; (+) strand; PAM type: YTN; PAM sequence: TTA
tttttatgggtacatgatcg

SEQ ID NO: 296390 - DNA, 20 bp, Artificial Sequence
  Description of Artificial Sequence: Synthetic oligonucleotide
  Target: ATXN1; (+) strand; PAM type: YTN; PAM sequence: TTT
ttatgggtacatgatcgttg

SEQ ID NO: 296391 - DNA, 20 bp, Artificial Sequence
  Description of Artificial Sequence: Synthetic oligonucleotide
  Target: ATXN1; (+) strand; PAM type: YTN; PAM sequence: TTT
tatgggtacatgatcgttgt

SEQ ID NO: 296392 - DNA, 20 bp, Artificial Sequence
  Description of Artificial Sequence: Synthetic oligonucleotide
  Target: ATXN1; (+) strand; PAM type: YTN; PAM sequence: TTT
atgggtacatgatcgttgtg

SEQ ID NO: 296393 - DNA, 20 bp, Artificial Sequence
  Description of Artificial Sequence: Synthetic oligonucleotide
  Target: ATXN1; (+) strand; PAM type: YTN; PAM sequence: TTA
tgggtacatgatcgttgtgc

SEQ ID NO: 296394 - DNA, 20 bp, Artificial Sequence
  Description of Artificial Sequence: Synthetic oligonucleotide
  Target: ATXN1; (+) strand; PAM type: YTN; PAM sequence: TTG
tgcatatttattgggtacat

SEQ ID NO: 296395 - DNA, 20 bp, Artificial Sequence
  Description of Artificial Sequence: Synthetic oligonucleotide
  Target: ATXN1; (+) strand; PAM type: YTN; PAM sequence: TTT
attgggtacatgtgattttt

SEQ ID NO: 296396 - DNA, 20 bp, Artificial Sequence
  Description of Artificial Sequence: Synthetic oligonucleotide
  Target: ATXN1; (+) strand; PAM type: YTN; PAM sequence: TTA
ttgggtacatgtgatttttt

SEQ ID NO: 296397 - DNA, 20 bp, Artificial Sequence
  Description of Artificial Sequence: Synthetic oligonucleotide
  Target: ATXN1; (+) strand; PAM type: YTN; PAM sequence: TTG
ggtacatgtgattttttgat

SEQ ID NO: 296398 - DNA, 20 bp, Artificial Sequence
  Description of Artificial Sequence: Synthetic oligonucleotide
  Target: ATXN1; (+) strand; PAM type: YTN; PAM sequence: TTT
tttgatacaagcacacaatg

SEQ ID NO: 296399 - DNA, 20 bp, Artificial Sequence
  Description of Artificial Sequence: Synthetic oligonucleotide
  Target: ATXN1; (+) strand; PAM type: YTN; PAM sequence: TTT
ttgatacaagcacacaatgt

SEQ ID NO: 296400 - DNA, 20 bp, Artificial Sequence
  Description of Artificial Sequence: Synthetic oligonucleotide
  Target: ATXN1; (+) strand; PAM type: YTN; PAM sequence: TTT
tgatacaagcacacaatgtg

SEQ ID NO: 296401 - DNA, 20 bp, Artificial Sequence
  Description of Artificial Sequence: Synthetic oligonucleotide
  Target: ATXN1; (+) strand; PAM type: YTN; PAM sequence: TTT
gatacaagcacacaatgtgt

SEQ ID NO: 296402 - DNA, 20 bp, Artificial Sequence
  Description of Artificial Sequence: Synthetic oligonucleotide
  Target: ATXN1; (+) strand; PAM type: YTN; PAM sequence: TTG
atacaagcacacaatgtgta

SEQ ID NO: 296403 - DNA, 20 bp, Artificial Sequence
  Description of Artificial Sequence: Synthetic oligonucleotide
  Target: ATXN1; (+) strand; PAM type: YTN; PAM sequence: TTT
gggatacccatcacttcatt

SEQ ID NO: 296404 - DNA, 20 bp, Artificial Sequence
  Description of Artificial Sequence: Synthetic oligonucleotide
  Target: ATXN1; (+) strand; PAM type: YTN; PAM sequence: TTG
ggatacccatcacttcattt

SEQ ID NO: 296405 - DNA, 20 bp, Artificial Sequence
  Description of Artificial Sequence: Synthetic oligonucleotide
  Target: ATXN1; (+) strand; PAM type: YTN; PAM sequence: CTT
catttctttttgttagggac

SEQ ID NO: 296406 - DNA, 20 bp, Artificial Sequence
  Description of Artificial Sequence: Synthetic oligonucleotide
  Target: ATXN1; (+) strand; PAM type: YTN; PAM sequence: TTC
atttctttttgttagggaca

SEQ ID NO: 296407 - DNA, 20 bp, Artificial Sequence
  Description of Artificial Sequence: Synthetic oligonucleotide
  Target: ATXN1; (+) strand; PAM type: YTN; PAM sequence: TTT
ctttttgttagggacattcc

SEQ ID NO: 296408 - DNA, 20 bp, Artificial Sequence
  Description of Artificial Sequence: Synthetic oligonucleotide
  Target: ATXN1; (+) strand; PAM type: YTN; PAM sequence: TTC
tttttgttagggacattcca

SEQ ID NO: 296409 - DNA, 20 bp, Artificial Sequence
  Description of Artificial Sequence: Synthetic oligonucleotide
  Target: ATXN1; (+) strand; PAM type: YTN; PAM sequence: CTT
tttgttagggacattccaaa

SEQ ID NO: 296410 - DNA, 20 bp, Artificial Sequence
  Description of Artificial Sequence: Synthetic oligonucleotide
  Target: ATXN1; (+) strand; PAM type: YTN; PAM sequence: TTT
ttgttagggacattccaaat

SEQ ID NO: 296411 - DNA, 20 bp, Artificial Sequence
  Description of Artificial Sequence: Synthetic oligonucleotide
  Target: ATXN1; (+) strand; PAM type: YTN; PAM sequence: TTT
tgttagggacattccaaatt

SEQ ID NO: 296412 - DNA, 20 bp, Artificial Sequence
  Description of Artificial Sequence: Synthetic oligonucleotide
  Target: ATXN1; (+) strand; PAM type: YTN; PAM sequence: TTT
gttagggacattccaaattc

SEQ ID NO: 296413 - DNA, 20 bp, Artificial Sequence
  Description of Artificial Sequence: Synthetic oligonucleotide
  Target: ATXN1; (+) strand; PAM type: YTN; PAM sequence: TTG
ttagggacattccaaattca

SEQ ID NO: 296414 - DNA, 20 bp, Artificial Sequence
  Description of Artificial Sequence: Synthetic oligonucleotide
  Target: ATXN1; (+) strand; PAM type: YTN; PAM sequence: TTA
gggacattccaaattcattc

SEQ ID NO: 296415 - DNA, 20 bp, Artificial Sequence
  Description of Artificial Sequence: Synthetic oligonucleotide
  Target: ATXN1; (+) strand; PAM type: YTN; PAM sequence: TTC
caaattcattcctctagtta

SEQ ID NO: 296416 - DNA, 20 bp, Artificial Sequence
  Description of Artificial Sequence: Synthetic oligonucleotide
  Target: ATXN1; (+) strand; PAM type: YTN; PAM sequence: TTC
attcctctagttattttgaa

SEQ ID NO: 296417 - DNA, 20 bp, Artificial Sequence
  Description of Artificial Sequence: Synthetic oligonucleotide
  Target: ATXN1; (+) strand; PAM type: YTN; PAM sequence: TTC
ctctagttattttgaaatat

SEQ ID NO: 296418 - DNA, 20 bp, Artificial Sequence
  Description of Artificial Sequence: Synthetic oligonucleotide
  Target: ATXN1; (+) strand; PAM type: YTN; PAM sequence: CTC
tagttattttgaaatataca

SEQ ID NO: 296419 - DNA, 20 bp, Artificial Sequence
  Description of Artificial Sequence: Synthetic oligonucleotide
  Target: ATXN1; (+) strand; PAM type: YTN; PAM sequence: CTA
gttattttgaaatatacaat

SEQ ID NO: 296420 - DNA, 20 bp, Artificial Sequence
  Description of Artificial Sequence: Synthetic oligonucleotide
  Target: ATXN1; (+) strand; PAM type: YTN; PAM sequence: TTA
ttttgaaatatacaataagt

SEQ ID NO: 296421 - DNA, 20 bp, Artificial Sequence
  Description of Artificial Sequence: Synthetic oligonucleotide
  Target: ATXN1; (+) strand; PAM type: YTN; PAM sequence: TTT
tgaaatatacaataagttat

SEQ ID NO: 296422 - DNA, 20 bp, Artificial Sequence
  Description of Artificial Sequence: Synthetic oligonucleotide
  Target: ATXN1; (+) strand; PAM type: YTN; PAM sequence: TTT
gaaatatacaataagttatt

SEQ ID NO: 296423 - DNA, 20 bp, Artificial Sequence
  Description of Artificial Sequence: Synthetic oligonucleotide
  Target: ATXN1; (+) strand; PAM type: YTN; PAM sequence: TTG
aaatatacaataagttattg

SEQ ID NO: 296424 - DNA, 20 bp, Artificial Sequence
  Description of Artificial Sequence: Synthetic oligonucleotide
  Target: ATXN1; (+) strand; PAM type: YTN; PAM sequence: TTA
ttgttaactattgttgccct

SEQ ID NO: 296425 - DNA, 20 bp, Artificial Sequence
  Description of Artificial Sequence: Synthetic oligonucleotide
  Target: ATXN1; (+) strand; PAM type: YTN; PAM sequence: TTG
ttaactattgttgccctatt

SEQ ID NO: 296426 - DNA, 20 bp, Artificial Sequence
  Description of Artificial Sequence: Synthetic oligonucleotide
  Target: ATXN1; (+) strand; PAM type: YTN; PAM sequence: TTA
actattgttgccctattgtg

SEQ ID NO: 296427 - DNA, 20 bp, Artificial Sequence
  Description of Artificial Sequence: Synthetic oligonucleotide
  Target: ATXN1; (+) strand; PAM type: YTN; PAM sequence: CTA
ttgttgccctattgtgctac

SEQ ID NO: 296428 - DNA, 20 bp, Artificial Sequence
  Description of Artificial Sequence: Synthetic oligonucleotide
  Target: ATXN1; (+) strand; PAM type: YTN; PAM sequence: TTG
ttgccctattgtgctactga

SEQ ID NO: 296429 - DNA, 20 bp, Artificial Sequence
  Description of Artificial Sequence: Synthetic oligonucleotide
  Target: ATXN1; (+) strand; PAM type: YTN; PAM sequence: TTG
ccctattgtgctactgaaca

SEQ ID NO: 296430 - DNA, 20 bp, Artificial Sequence
  Description of Artificial Sequence: Synthetic oligonucleotide
  Target: ATXN1; (+) strand; PAM type: YTN; PAM sequence: CTA
ttgtgctactgaacactagc

SEQ ID NO: 296431 - DNA, 20 bp, Artificial Sequence
  Description of Artificial Sequence: Synthetic oligonucleotide
  Target: ATXN1; (+) strand; PAM type: YTN; PAM sequence: TTG
tgctactgaacactagctct

SEQ ID NO: 296432 - DNA, 20 bp, Artificial Sequence
  Description of Artificial Sequence: Synthetic oligonucleotide
  Target: ATXN1; (+) strand; PAM type: YTN; PAM sequence: CTA
ctgaacactagctcttattc

SEQ ID NO: 296433 - DNA, 20 bp, Artificial Sequence
  Description of Artificial Sequence: Synthetic oligonucleotide
  Target: ATXN1; (+) strand; PAM type: YTN; PAM sequence: CTG
aacactagctcttattccta

SEQ ID NO: 296434 - DNA, 20 bp, Artificial Sequence
  Description of Artificial Sequence: Synthetic oligonucleotide
  Target: ATXN1; (+) strand; PAM type: YTN; PAM sequence: CTA
gctcttattcctactatcta

SEQ ID NO: 296435 - DNA, 20 bp, Artificial Sequence
  Description of Artificial Sequence: Synthetic oligonucleotide
  Target: ATXN1; (+) strand; PAM type: YTN; PAM sequence: CTC
ttattcctactatctaacta

SEQ ID NO: 296436 - DNA, 20 bp, Artificial Sequence
  Description of Artificial Sequence: Synthetic oligonucleotide
  Target: ATXN1; (+) strand; PAM type: YTN; PAM sequence: CTT
attcctactatctaactata

SEQ ID NO: 296437 - DNA, 20 bp, Artificial Sequence
  Description of Artificial Sequence: Synthetic oligonucleotide
  Target: ATXN1; (+) strand; PAM type: YTN; PAM sequence: TTA
ttcctactatctaactatat

SEQ ID NO: 296438 - DNA, 20 bp, Artificial Sequence
  Description of Artificial Sequence: Synthetic oligonucleotide
  Target: ATXN1; (+) strand; PAM type: YTN; PAM sequence: TTC
ctactatctaactatatttt

SEQ ID NO: 296439 - DNA, 20 bp, Artificial Sequence
  Description of Artificial Sequence: Synthetic oligonucleotide
  Target: ATXN1; (+) strand; PAM type: YTN; PAM sequence: CTA
ctatctaactatatttttat

SEQ ID NO: 296440 - DNA, 20 bp, Artificial Sequence
  Description of Artificial Sequence: Synthetic oligonucleotide
  Target: ATXN1; (+) strand; PAM type: YTN; PAM sequence: CTA
tctaactatatttttatagc

SEQ ID NO: 296441 - DNA, 20 bp, Artificial Sequence
  Description of Artificial Sequence: Synthetic oligonucleotide
  Target: ATXN1; (+) strand; PAM type: YTN; PAM sequence: CTA
actatatttttatagccact

SEQ ID NO: 296442 - DNA, 20 bp, Artificial Sequence
  Description of Artificial Sequence: Synthetic oligonucleotide
  Target: ATXN1; (+) strand; PAM type: YTN; PAM sequence: CTA
tatttttatagccactaacc

SEQ ID NO: 296443 - DNA, 20 bp, Artificial Sequence
  Description of Artificial Sequence: Synthetic oligonucleotide
  Target: ATXN1; (+) strand; PAM type: YTN; PAM sequence: TTT
ttatagccactaaccaacct

SEQ ID NO: 296444 - DNA, 20 bp, Artificial Sequence
  Description of Artificial Sequence: Synthetic oligonucleotide
  Target: ATXN1; (+) strand; PAM type: YTN; PAM sequence: TTT
tatagccactaaccaacctc

SEQ ID NO: 296445 - DNA, 20 bp, Artificial Sequence
  Description of Artificial Sequence: Synthetic oligonucleotide
  Target: ATXN1; (+) strand; PAM type: YTN; PAM sequence: TTT
atagccactaaccaacctct

SEQ ID NO: 296446 - DNA, 20 bp, Artificial Sequence
  Description of Artificial Sequence: Synthetic oligonucleotide
  Target: ATXN1; (+) strand; PAM type: YTN; PAM sequence: TTA
tagccactaaccaacctctc

SEQ ID NO: 296447 - DNA, 20 bp, Artificial Sequence
  Description of Artificial Sequence: Synthetic oligonucleotide
  Target: ATXN1; (+) strand; PAM type: YTN; PAM sequence: CTA
accaacctctctttattcct

SEQ ID NO: 296448 - DNA, 20 bp, Artificial Sequence
  Description of Artificial Sequence: Synthetic oligonucleotide
  Target: ATXN1; (+) strand; PAM type: YTN; PAM sequence: CTC
tctttattcctccctcctca

SEQ ID NO: 296449 - DNA, 20 bp, Artificial Sequence
  Description of Artificial Sequence: Synthetic oligonucleotide
  Target: ATXN1; (+) strand; PAM type: YTN; PAM sequence: CTC
tttattcctccctcctcact

SEQ ID NO: 296450 - DNA, 20 bp, Artificial Sequence
  Description of Artificial Sequence: Synthetic oligonucleotide
  Target: ATXN1; (+) strand; PAM type: YTN; PAM sequence: CTT
tattcctccctcctcactac

SEQ ID NO: 296451 - DNA, 20 bp, Artificial Sequence
  Description of Artificial Sequence: Synthetic oligonucleotide
  Target: ATXN1; (+) strand; PAM type: YTN; PAM sequence: TTT
attcctccctcctcactacc

SEQ ID NO: 296452 - DNA, 20 bp, Artificial Sequence
  Description of Artificial Sequence: Synthetic oligonucleotide
  Target: ATXN1; (+) strand; PAM type: YTN; PAM sequence: TTA
ttcctccctcctcactaccc

SEQ ID NO: 296453 - DNA, 20 bp, Artificial Sequence
  Description of Artificial Sequence: Synthetic oligonucleotide
  Target: ATXN1; (+) strand; PAM type: YTN; PAM sequence: TTC
ctccctcctcactacccttt

SEQ ID NO: 296454 - DNA, 20 bp, Artificial Sequence
  Description of Artificial Sequence: Synthetic oligonucleotide
  Target: ATXN1; (+) strand; PAM type: YTN; PAM sequence: CTC
cctcctcactaccctttcca

SEQ ID NO: 296455 - DNA, 20 bp, Artificial Sequence
  Description of Artificial Sequence: Synthetic oligonucleotide
  Target: ATXN1; (+) strand; PAM type: YTN; PAM sequence: CTC
ctcactaccctttccatcct

SEQ ID NO: 296456 - DNA, 20 bp, Artificial Sequence
  Description of Artificial Sequence: Synthetic oligonucleotide
  Target: ATXN1; (+) strand; PAM type: YTN; PAM sequence: CTC
actaccctttccatcctctg

SEQ ID NO: 296457 - DNA, 20 bp, Artificial Sequence
  Description of Artificial Sequence: Synthetic oligonucleotide
  Target: ATXN1; (+) strand; PAM type: YTN; PAM sequence: CTA
ccctttccatcctctgctaa

SEQ ID NO: 296458 - DNA, 20 bp, Artificial Sequence
  Description of Artificial Sequence: Synthetic oligonucleotide
  Target: ATXN1; (+) strand; PAM type: YTN; PAM sequence: CTT
tccatcctctgctaaccatc

SEQ ID NO: 296459 - DNA, 20 bp, Artificial Sequence
  Description of Artificial Sequence: Synthetic oligonucleotide
  Target: ATXN1; (+) strand; PAM type: YTN; PAM sequence: TTT
ccatcctctgctaaccatca

SEQ ID NO: 296460 - DNA, 20 bp, Artificial Sequence
  Description of Artificial Sequence: Synthetic oligonucleotide
  Target: ATXN1; (+) strand; PAM type: YTN; PAM sequence: TTC
catcctctgctaaccatcat

SEQ ID NO: 296461 - DNA, 20 bp, Artificial Sequence
  Description of Artificial Sequence: Synthetic oligonucleotide
  Target: ATXN1; (+) strand; PAM type: YTN; PAM sequence: CTC
tgctaaccatcattctactc

SEQ ID NO: 296462 - DNA, 20 bp, Artificial Sequence
  Description of Artificial Sequence: Synthetic oligonucleotide
  Target: ATXN1; (+) strand; PAM type: YTN; PAM sequence: CTG
ctaaccatcattctactctc

SEQ ID NO: 296463 - DNA, 20 bp, Artificial Sequence
  Description of Artificial Sequence: Synthetic oligonucleotide
  Target: ATXN1; (+) strand; PAM type: YTN; PAM sequence: CTA
accatcattctactctctgt

SEQ ID NO: 296464 - DNA, 20 bp, Artificial Sequence
  Description of Artificial Sequence: Synthetic oligonucleotide
  Target: ATXN1; (+) strand; PAM type: YTN; PAM sequence: TTC
tactctctgtctccatgacg

SEQ ID NO: 296465 - DNA, 20 bp, Artificial Sequence
  Description of Artificial Sequence: Synthetic oligonucleotide
  Target: ATXN1; (+) strand; PAM type: YTN; PAM sequence: CTA
ctctctgtctccatgacgtc

SEQ ID NO: 296466 - DNA, 20 bp, Artificial Sequence
  Description of Artificial Sequence: Synthetic oligonucleotide
  Target: ATXN1; (+) strand; PAM type: YTN; PAM sequence: CTC
tctgtctccatgacgtcatg

SEQ ID NO: 296467 - DNA, 20 bp, Artificial Sequence
  Description of Artificial Sequence: Synthetic oligonucleotide
  Target: ATXN1; (+) strand; PAM type: YTN; PAM sequence: CTC
tgtctccatgacgtcatgtt

SEQ ID NO: 296468 - DNA, 20 bp, Artificial Sequence
  Description of Artificial Sequence: Synthetic oligonucleotide
  Target: ATXN1; (+) strand; PAM type: YTN; PAM sequence: CTG
tctccatgacgtcatgtttc

SEQ ID NO: 296469 - DNA, 20 bp, Artificial Sequence
  Description of Artificial Sequence: Synthetic oligonucleotide
  Target: ATXN1; (+) strand; PAM type: YTN; PAM sequence: CTC
catgacgtcatgtttcttag

SEQ ID NO: 296470 - DNA, 20 bp, Artificial Sequence
  Description of Artificial Sequence: Synthetic oligonucleotide
  Target: ATXN1; (+) strand; PAM type: YTN; PAM sequence: TTT
cttagctccctcatatgagt

SEQ ID NO: 296471 - DNA, 20 bp, Artificial Sequence
  Description of Artificial Sequence: Synthetic oligonucleotide
  Target: ATXN1; (+) strand; PAM type: YTN; PAM sequence: TTC
ttagctccctcatatgagtg

SEQ ID NO: 296472 - DNA, 20 bp, Artificial Sequence
  Description of Artificial Sequence: Synthetic oligonucleotide
  Target: ATXN1; (+) strand; PAM type: YTN; PAM sequence: CTT
agctccctcatatgagtgag

SEQ ID NO: 296473 - DNA, 20 bp, Artificial Sequence
  Description of Artificial Sequence: Synthetic oligonucleotide
  Target: ATXN1; (+) strand; PAM type: YTN; PAM sequence: TTA
gctccctcatatgagtgaga

SEQ ID NO: 296474 - DNA, 20 bp, Artificial Sequence
  Description of Artificial Sequence: Synthetic oligonucleotide
  Target: ATXN1; (+) strand; PAM type: YTN; PAM sequence: CTC
cctcatatgagtgagaatat

SEQ ID NO: 296475 - DNA, 20 bp, Artificial Sequence
  Description of Artificial Sequence: Synthetic oligonucleotide
  Target: ATXN1; (+) strand; PAM type: YTN; PAM sequence: CTC
atatgagtgagaatatgtga

SEQ ID NO: 296476 - DNA, 20 bp, Artificial Sequence
  Description of Artificial Sequence: Synthetic oligonucleotide
  Target: ATXN1; (+) strand; PAM type: YTN; PAM sequence: TTT
gtctttctgtgcctggctta

SEQ ID NO: 296477 - DNA, 20 bp, Artificial Sequence
  Description of Artificial Sequence: Synthetic oligonucleotide
  Target: ATXN1; (+) strand; PAM type: YTN; PAM sequence: TTG
tctttctgtgcctggcttat

SEQ ID NO: 296478 - DNA, 20 bp, Artificial Sequence
  Description of Artificial Sequence: Synthetic oligonucleotide
  Target: ATXN1; (+) strand; PAM type: YTN; PAM sequence: CTT
tctgtgcctggcttatttta

SEQ ID NO: 296479 - DNA, 20 bp, Artificial Sequence
  Description of Artificial Sequence: Synthetic oligonucleotide
  Target: ATXN1; (+) strand; PAM type: YTN; PAM sequence: TTT
ctgtgcctggcttattttac

SEQ ID NO: 296480 - DNA, 20 bp, Artificial Sequence
  Description of Artificial Sequence: Synthetic oligonucleotide
  Target: ATXN1; (+) strand; PAM type: YTN; PAM sequence: TTC
tgtgcctggcttattttact

SEQ ID NO: 296481 - DNA, 20 bp, Artificial Sequence
  Description of Artificial Sequence: Synthetic oligonucleotide
  Target: ATXN1; (+) strand; PAM type: YTN; PAM sequence: CTG
tgcctggcttattttactta

SEQ ID NO: 296482 - DNA, 20 bp, Artificial Sequence
  Description of Artificial Sequence: Synthetic oligonucleotide
  Target: ATXN1; (+) strand; PAM type: YTN; PAM sequence: CTG
gcttattttacttaacataa

SEQ ID NO: 296483 - DNA, 20 bp, Artificial Sequence
  Description of Artificial Sequence: Synthetic oligonucleotide
  Target: ATXN1; (+) strand; PAM type: YTN; PAM sequence: CTT
attttacttaacataacgtc

SEQ ID NO: 296484 - DNA, 20 bp, Artificial Sequence
  Description of Artificial Sequence: Synthetic oligonucleotide
  Target: ATXN1; (+) strand; PAM type: YTN; PAM sequence: TTA
ttttacttaacataacgtct

SEQ ID NO: 296485 - DNA, 20 bp, Artificial Sequence
  Description of Artificial Sequence: Synthetic oligonucleotide
  Target: ATXN1; (+) strand; PAM type: YTN; PAM sequence: TTT
tacttaacataacgtcttcc

SEQ ID NO: 296486 - DNA, 20 bp, Artificial Sequence
  Description of Artificial Sequence: Synthetic oligonucleotide
  Target: ATXN1; (+) strand; PAM type: YTN; PAM sequence: TTT
acttaacataacgtcttcca

SEQ ID NO: 296487 - DNA, 20 bp, Artificial Sequence
  Description of Artificial Sequence: Synthetic oligonucleotide
  Target: ATXN1; (+) strand; PAM type: YTN; PAM sequence: TTA
cttaacataacgtcttccag

SEQ ID NO: 296488 - DNA, 20 bp, Artificial Sequence
  Description of Artificial Sequence: Synthetic oligonucleotide
  Target: ATXN1; (+) strand; PAM type: YTN; PAM sequence: CTT
aacataacgtcttccagttc

SEQ ID NO: 296489 - DNA, 20 bp, Artificial Sequence
  Description of Artificial Sequence: Synthetic oligonucleotide
  Target: ATXN1; (+) strand; PAM type: YTN; PAM sequence: TTA
acataacgtcttccagttcc

SEQ ID NO: 296490 - DNA, 20 bp, Artificial Sequence
  Description of Artificial Sequence: Synthetic oligonucleotide
  Target: ATXN1; (+) strand; PAM type: YTN; PAM sequence: CTT
ccagttccagccatgttgtt

SEQ ID NO: 296491 - DNA, 20 bp, Artificial Sequence
  Description of Artificial Sequence: Synthetic oligonucleotide
  Target: ATXN1; (+) strand; PAM type: YTN; PAM sequence: TTC
cagttccagccatgttgtta

SEQ ID NO: 296492 - DNA, 20 bp, Artificial Sequence
  Description of Artificial Sequence: Synthetic oligonucleotide
  Target: ATXN1; (+) strand; PAM type: YTN; PAM sequence: TTC
cagccatgttgttacaaatg

SEQ ID NO: 296493 - DNA, 20 bp, Artificial Sequence
  Description of Artificial Sequence: Synthetic oligonucleotide
  Target: ATXN1; (+) strand; PAM type: YTN; PAM sequence: TTG
ttacaaatgacagaatttca

SEQ ID NO: 296494 - DNA, 20 bp, Artificial Sequence
  Description of Artificial Sequence: Synthetic oligonucleotide
  Target: ATXN1; (+) strand; PAM type: YTN; PAM sequence: TTA
caaatgacagaatttcattc

SEQ ID NO: 296495 - DNA, 20 bp, Artificial Sequence
  Description of Artificial Sequence: Synthetic oligonucleotide
  Target: ATXN1; (+) strand; PAM type: YTN; PAM sequence: TTT
cattcttttgtatggctgaa

SEQ ID NO: 296496 - DNA, 20 bp, Artificial Sequence
  Description of Artificial Sequence: Synthetic oligonucleotide
  Target: ATXN1; (+) strand; PAM type: YTN; PAM sequence: TTC
attcttttgtatggctgaat

SEQ ID NO: 296497 - DNA, 20 bp, Artificial Sequence
  Description of Artificial Sequence: Synthetic oligonucleotide
  Target: ATXN1; (+) strand; PAM type: YTN; PAM sequence: TTC
ttttgtatggctgaataata

SEQ ID NO: 296498 - DNA, 20 bp, Artificial Sequence
  Description of Artificial Sequence: Synthetic oligonucleotide
  Target: ATXN1; (+) strand; PAM type: YTN; PAM sequence: CTT
ttgtatggctgaataatatt

SEQ ID NO: 296499 - DNA, 20 bp, Artificial Sequence
  Description of Artificial Sequence: Synthetic oligonucleotide
  Target: ATXN1; (+) strand; PAM type: YTN; PAM sequence: TTT
tgtatggctgaataatattc

SEQ ID NO: 296500 - DNA, 20 bp, Artificial Sequence
  Description of Artificial Sequence: Synthetic oligonucleotide
  Target: ATXN1; (+) strand; PAM type: YTN; PAM sequence: TTT
gtatggctgaataatattcc

SEQ ID NO: 296501 - DNA, 20 bp, Artificial Sequence
  Description of Artificial Sequence: Synthetic oligonucleotide
  Target: ATXN1; (+) strand; PAM type: YTN; PAM sequence: TTG
tatggctgaataatattcca

SEQ ID NO: 296502 - DNA, 20 bp, Artificial Sequence
  Description of Artificial Sequence: Synthetic oligonucleotide
  Target: ATXN1; (+) strand; PAM type: YTN; PAM sequence: CTG
aataatattccactgtgtat

SEQ ID NO: 296503 - DNA, 20 bp, Artificial Sequence
  Description of Artificial Sequence: Synthetic oligonucleotide
  Target: ATXN1; (+) strand; PAM type: YTN; PAM sequence: TTC
cactgtgtatatgtacctta

SEQ ID NO: 296504 - DNA, 20 bp, Artificial Sequence
  Description of Artificial Sequence: Synthetic oligonucleotide
  Target: ATXN1; (+) strand; PAM type: YTN; PAM sequence: CTG
tgtatatgtaccttattttc

SEQ ID NO: 296505 - DNA, 20 bp, Artificial Sequence
  Description of Artificial Sequence: Synthetic oligonucleotide
  Target: ATXN1; (+) strand; PAM type: YTN; PAM sequence: CTT
attttctttatccattcctt

SEQ ID NO: 296506 - DNA, 20 bp, Artificial Sequence
  Description of Artificial Sequence: Synthetic oligonucleotide
  Target: ATXN1; (+) strand; PAM type: YTN; PAM sequence: TTA
ttttctttatccattccttc

SEQ ID NO: 296507 - DNA, 20 bp, Artificial Sequence
  Description of Artificial Sequence: Synthetic oligonucleotide
  Target: ATXN1; (+) strand; PAM type: YTN; PAM sequence: TTT
tctttatccattccttcatt

SEQ ID NO: 296508 - DNA, 20 bp, Artificial Sequence
  Description of Artificial Sequence: Synthetic oligonucleotide
  Target: ATXN1; (+) strand; PAM type: YTN; PAM sequence: TTT
ctttatccattccttcattg

SEQ ID NO: 296509 - DNA, 20 bp, Artificial Sequence
  Description of Artificial Sequence: Synthetic oligonucleotide
  Target: ATXN1; (+) strand; PAM type: YTN; PAM sequence: TTC
tttatccattccttcattga

SEQ ID NO: 296510 - DNA, 20 bp, Artificial Sequence
  Description of Artificial Sequence: Synthetic oligonucleotide
  Target: ATXN1; (+) strand; PAM type: YTN; PAM sequence: CTT
tatccattccttcattgatg

SEQ ID NO: 296511 - DNA, 20 bp, Artificial Sequence
  Description of Artificial Sequence: Synthetic oligonucleotide
  Target: ATXN1; (+) strand; PAM type: YTN; PAM sequence: TTT
atccattccttcattgatgg

SEQ ID NO: 296512 - DNA, 20 bp, Artificial Sequence
  Description of Artificial Sequence: Synthetic oligonucleotide
  Target: ATXN1; (+) strand; PAM type: YTN; PAM sequence: TTA
tccattccttcattgatgga

SEQ ID NO: 296513 - DNA, 20 bp, Artificial Sequence
  Description of Artificial Sequence: Synthetic oligonucleotide
  Target: ATXN1; (+) strand; PAM type: YTN; PAM sequence: TTC
cttcattgatggagacttag

SEQ ID NO: 296514 - DNA, 20 bp, Artificial Sequence
  Description of Artificial Sequence: Synthetic oligonucleotide
  Target: ATXN1; (+) strand; PAM type: YTN; PAM sequence: CTT
cattgatggagacttagatt

SEQ ID NO: 296515 - DNA, 20 bp, Artificial Sequence
  Description of Artificial Sequence: Synthetic oligonucleotide
  Target: ATXN1; (+) strand; PAM type: YTN; PAM sequence: TTC
attgatggagacttagattg

SEQ ID NO: 296516 - DNA, 20 bp, Artificial Sequence
  Description of Artificial Sequence: Synthetic oligonucleotide
  Target: ATXN1; (+) strand; PAM type: YTN; PAM sequence: TTG
atggagacttagattgattc

SEQ ID NO: 296517 - DNA, 20 bp, Artificial Sequence
  Description of Artificial Sequence: Synthetic oligonucleotide
  Target: ATXN1; (+) strand; PAM type: YTN; PAM sequence: CTT
agattgattccatatcttgg

SEQ ID NO: 296518 - DNA, 20 bp, Artificial Sequence
  Description of Artificial Sequence: Synthetic oligonucleotide
  Target: ATXN1; (+) strand; PAM type: YTN; PAM sequence: TTA
gattgattccatatcttggc

SEQ ID NO: 296519 - DNA, 20 bp, Artificial Sequence
  Description of Artificial Sequence: Synthetic oligonucleotide
  Target: ATXN1; (+) strand; PAM type: YTN; PAM sequence: TTG
attccatatcttggctataa

SEQ ID NO: 296520 - DNA, 20 bp, Artificial Sequence
  Description of Artificial Sequence: Synthetic oligonucleotide
  Target: ATXN1; (+) strand; PAM type: YTN; PAM sequence: TTC
catatcttggctataatgaa

SEQ ID NO: 296521 - DNA, 20 bp, Artificial Sequence
  Description of Artificial Sequence: Synthetic oligonucleotide
  Target: ATXN1; (+) strand; PAM type: YTN; PAM sequence: CTT
ggctataatgaatagctgca

SEQ ID NO: 296522 - DNA, 20 bp, Artificial Sequence
  Description of Artificial Sequence: Synthetic oligonucleotide
  Target: ATXN1; (+) strand; PAM type: YTN; PAM sequence: TTG
gctataatgaatagctgcaa

SEQ ID NO: 296523 - DNA, 20 bp, Artificial Sequence
  Description of Artificial Sequence: Synthetic oligonucleotide
  Target: ATXN1; (+) strand; PAM type: YTN; PAM sequence: CTA
taatgaatagctgcaacaaa

SEQ ID NO: 296524 - DNA, 20 bp, Artificial Sequence
  Description of Artificial Sequence: Synthetic oligonucleotide
  Target: ATXN1; (+) strand; PAM type: YTN; PAM sequence: CTG
caacaaacatgggagtgcag

SEQ ID NO: 296525 - DNA, 20 bp, Artificial Sequence
  Description of Artificial Sequence: Synthetic oligonucleotide
  Target: ATXN1; (+) strand; PAM type: YTN; PAM sequence: CTC
ttcaatatactgatttcctt

SEQ ID NO: 296526 - DNA, 20 bp, Artificial Sequence
  Description of Artificial Sequence: Synthetic oligonucleotide
  Target: ATXN1; (+) strand; PAM type: YTN; PAM sequence: CTT
caatatactgatttcctttc

SEQ ID NO: 296527 - DNA, 20 bp, Artificial Sequence
  Description of Artificial Sequence: Synthetic oligonucleotide
  Target: ATXN1; (+) strand; PAM type: YTN; PAM sequence: TTC
aatatactgatttcctttct

SEQ ID NO: 296528 - DNA, 20 bp, Artificial Sequence
  Description of Artificial Sequence: Synthetic oligonucleotide
  Target: ATXN1; (+) strand; PAM type: YTN; PAM sequence: CTG
atttcctttcttctggatat

SEQ ID NO: 296529 - DNA, 20 bp, Artificial Sequence
  Description of Artificial Sequence: Synthetic oligonucleotide
  Target: ATXN1; (+) strand; PAM type: YTN; PAM sequence: TTT
cctttcttctggatatatac

SEQ ID NO: 296530 - DNA, 20 bp, Artificial Sequence
  Description of Artificial Sequence: Synthetic oligonucleotide
  Target: ATXN1; (+) strand; PAM type: YTN; PAM sequence: TTC
ctttcttctggatatataca

SEQ ID NO: 296531 - DNA, 20 bp, Artificial Sequence
  Description of Artificial Sequence: Synthetic oligonucleotide
  Target: ATXN1; (+) strand; PAM type: YTN; PAM sequence: CTT
tcttctggatatatacatga

SEQ ID NO: 296532 - DNA, 20 bp, Artificial Sequence
  Description of Artificial Sequence: Synthetic oligonucleotide
  Target: ATXN1; (+) strand; PAM type: YTN; PAM sequence: TTT
cttctggatatatacatgac

SEQ ID NO: 296533 - DNA, 20 bp, Artificial Sequence
  Description of Artificial Sequence: Synthetic oligonucleotide
  Target: ATXN1; (+) strand; PAM type: YTN; PAM sequence: TTC
ttctggatatatacatgact

SEQ ID NO: 296534 - DNA, 20 bp, Artificial Sequence
  Description of Artificial Sequence: Synthetic oligonucleotide
  Target: ATXN1; (+) strand; PAM type: YTN; PAM sequence: CTT
ctggatatatacatgacttt

SEQ ID NO: 296535 - DNA, 20 bp, Artificial Sequence
  Description of Artificial Sequence: Synthetic oligonucleotide
  Target: ATXN1; (+) strand; PAM type: YTN; PAM sequence: TTC
tggatatatacatgactttt

SEQ ID NO: 296536 - DNA, 20 bp, Artificial Sequence
  Description of Artificial Sequence: Synthetic oligonucleotide
  Target: ATXN1; (+) strand; PAM type: YTN; PAM sequence: CTG
gatatatacatgacttttct

SEQ ID NO: 296537 - DNA, 20 bp, Artificial Sequence
  Description of Artificial Sequence: Synthetic oligonucleotide
  Target: ATXN1; (+) strand; PAM type: YTN; PAM sequence: CTT
ttcttttctttctttctttt

SEQ ID NO: 296538 - DNA, 20 bp, Artificial Sequence
  Description of Artificial Sequence: Synthetic oligonucleotide
  Target: ATXN1; (+) strand; PAM type: YTN; PAM sequence: TTT
tcttttctttctttcttttt

SEQ ID NO: 296539 - DNA, 20 bp, Artificial Sequence
  Description of Artificial Sequence: Synthetic oligonucleotide
  Target: ATXN1; (+) strand; PAM type: YTN; PAM sequence: TTT
cttttctttctttctttttt

SEQ ID NO: 296540 - DNA, 20 bp, Artificial Sequence
  Description of Artificial Sequence: Synthetic oligonucleotide
  Target: ATXN1; (+) strand; PAM type: YTN; PAM sequence: TTC
ttttctttctttcttttttt

SEQ ID NO: 296541 - DNA, 20 bp, Artificial Sequence
  Description of Artificial Sequence: Synthetic oligonucleotide
  Target: ATXN1; (+) strand; PAM type: YTN; PAM sequence: CTT
ttctttctttcttttttttt

SEQ ID NO: 296542 - DNA, 20 bp, Artificial Sequence
  Description of Artificial Sequence: Synthetic oligonucleotide
  Target: ATXN1; (+) strand; PAM type: YTN; PAM sequence: TTT
tctttctttctttttttttg

SEQ ID NO: 296543 - DNA, 20 bp, Artificial Sequence
  Description of Artificial Sequence: Synthetic oligonucleotide
  Target: ATXN1; (+) strand; PAM type: YTN; PAM sequence: TTT
ctttctttctttttttttgg

SEQ ID NO: 296544 - DNA, 20 bp, Artificial Sequence
  Description of Artificial Sequence: Synthetic oligonucleotide
  Target: ATXN1; (+) strand; PAM type: YTN; PAM sequence: TTC
tttctttctttttttttgga

SEQ ID NO: 296545 - DNA, 20 bp, Artificial Sequence
  Description of Artificial Sequence: Synthetic oligonucleotide
  Target: ATXN1; (+) strand; PAM type: YTN; PAM sequence: CTT
tctttctttttttttggagt

SEQ ID NO: 296546 - DNA, 20 bp, Artificial Sequence
  Description of Artificial Sequence: Synthetic oligonucleotide
  Target: ATXN1; (+) strand; PAM type: YTN; PAM sequence: TTT
ctttctttttttttggagtc

SEQ ID NO: 296547 - DNA, 20 bp, Artificial Sequence
  Description of Artificial Sequence: Synthetic oligonucleotide
  Target: ATXN1; (+) strand; PAM type: YTN; PAM sequence: TTC
tttctttttttttggagtct

SEQ ID NO: 296548 - DNA, 20 bp, Artificial Sequence
  Description of Artificial Sequence: Synthetic oligonucleotide
  Target: ATXN1; (+) strand; PAM type: YTN; PAM sequence: CTT
tctttttttttggagtctag

SEQ ID NO: 296549 - DNA, 20 bp, Artificial Sequence
  Description of Artificial Sequence: Synthetic oligonucleotide
  Target: ATXN1; (+) strand; PAM type: YTN; PAM sequence: TTT
ctttttttttggagtctagc

SEQ ID NO: 296550 - DNA, 20 bp, Artificial Sequence
  Description of Artificial Sequence: Synthetic oligonucleotide
  Target: ATXN1; (+) strand; PAM type: YTN; PAM sequence: TTC
tttttttttggagtctagct

SEQ ID NO: 296551 - DNA, 20 bp, Artificial Sequence
  Description of Artificial Sequence: Synthetic oligonucleotide
  Target: ATXN1; (+) strand; PAM type: YTN; PAM sequence: CTT
tttttttggagtctagctgt

SEQ ID NO: 296552 - DNA, 20 bp, Artificial Sequence
  Description of Artificial Sequence: Synthetic oligonucleotide
  Target: ATXN1; (+) strand; PAM type: YTN; PAM sequence: TTT
ttttttggagtctagctgtg

SEQ ID NO: 296553 - DNA, 20 bp, Artificial Sequence
  Description of Artificial Sequence: Synthetic oligonucleotide
  Target: ATXN1; (+) strand; PAM type: YTN; PAM sequence: TTT
tttttggagtctagctgtgt

SEQ ID NO: 296554 - DNA, 20 bp, Artificial Sequence
  Description of Artificial Sequence: Synthetic oligonucleotide
  Target: ATXN1; (+) strand; PAM type: YTN; PAM sequence: TTT
ttttggagtctagctgtgtc

SEQ ID NO: 296555 - DNA, 20 bp, Artificial Sequence
  Description of Artificial Sequence: Synthetic oligonucleotide
  Target: ATXN1; (+) strand; PAM type: YTN; PAM sequence: TTT
tttggagtctagctgtgtca

SEQ ID NO: 296556 - DNA, 20 bp, Artificial Sequence
  Description of Artificial Sequence: Synthetic oligonucleotide
  Target: ATXN1; (+) strand; PAM type: YTN; PAM sequence: TTT
ttggagtctagctgtgtcac

SEQ ID NO: 296557 - DNA, 20 bp, Artificial Sequence
  Description of Artificial Sequence: Synthetic oligonucleotide
  Target: ATXN1; (+) strand; PAM type: YTN; PAM sequence: TTT
tggagtctagctgtgtcacc

SEQ ID NO: 296558 - DNA, 20 bp, Artificial Sequence
  Description of Artificial Sequence: Synthetic oligonucleotide
  Target: ATXN1; (+) strand; PAM type: YTN; PAM sequence: TTT
ggagtctagctgtgtcacca

SEQ ID NO: 296559 - DNA, 20 bp, Artificial Sequence
  Description of Artificial Sequence: Synthetic oligonucleotide
  Target: ATXN1; (+) strand; PAM type: YTN; PAM sequence: TTG
gagtctagctgtgtcaccag

SEQ ID NO: 296560 - DNA, 20 bp, Artificial Sequence
  Description of Artificial Sequence: Synthetic oligonucleotide
  Target: ATXN1; (+) strand; PAM type: YTN; PAM sequence: CTA
gctgtgtcaccaggctggag

SEQ ID NO: 296561 - DNA, 20 bp, Artificial Sequence
  Description of Artificial Sequence: Synthetic oligonucleotide
  Target: ATXN1; (+) strand; PAM type: YTN; PAM sequence: CTG
tgtcaccaggctggagtgta

SEQ ID NO: 296562 - DNA, 20 bp, Artificial Sequence
  Description of Artificial Sequence: Synthetic oligonucleotide
  Target: ATXN1; (+) strand; PAM type: YTN; PAM sequence: CTG
gagtgtagtactgtgatctc

SEQ ID NO: 296563 - DNA, 20 bp, Artificial Sequence
  Description of Artificial Sequence: Synthetic oligonucleotide
  Target: ATXN1; (+) strand; PAM type: YTN; PAM sequence: CTG
tgatctcagctcactgcaac

SEQ ID NO: 296564 - DNA, 20 bp, Artificial Sequence
  Description of Artificial Sequence: Synthetic oligonucleotide
  Target: ATXN1; (+) strand; PAM type: YTN; PAM sequence: CTC
agctcactgcaacctctgac

SEQ ID NO: 296565 - DNA, 20 bp, Artificial Sequence
  Description of Artificial Sequence: Synthetic oligonucleotide
  Target: ATXN1; (+) strand; PAM type: YTN; PAM sequence: CTC
actgcaacctctgactccct

SEQ ID NO: 296566 - DNA, 20 bp, Artificial Sequence
  Description of Artificial Sequence: Synthetic oligonucleotide
  Target: ATXN1; (+) strand; PAM type: YTN; PAM sequence: CTG
caacctctgactccctggtt

SEQ ID NO: 296567 - DNA, 20 bp, Artificial Sequence
  Description of Artificial Sequence: Synthetic oligonucleotide
  Target: ATXN1; (+) strand; PAM type: YTN; PAM sequence: CTC
tgactccctggttccagtga

SEQ ID NO: 296568 - DNA, 20 bp, Artificial Sequence
  Description of Artificial Sequence: Synthetic oligonucleotide
  Target: ATXN1; (+) strand; PAM type: YTN; PAM sequence: CTG
actccctggttccagtgatt

SEQ ID NO: 296569 - DNA, 20 bp, Artificial Sequence
  Description of Artificial Sequence: Synthetic oligonucleotide
  Target: ATXN1; (+) strand; PAM type: YTN; PAM sequence: CTC
cctggttccagtgattctcc

SEQ ID NO: 296570 - DNA, 20 bp, Artificial Sequence
  Description of Artificial Sequence: Synthetic oligonucleotide
  Target: ATXN1; (+) strand; PAM type: YTN; PAM sequence: CTG
gttccagtgattctcctgcc

SEQ ID NO: 296571 - DNA, 20 bp, Artificial Sequence
  Description of Artificial Sequence: Synthetic oligonucleotide
  Target: ATXN1; (+) strand; PAM type: YTN; PAM sequence: TTC
cagtgattctcctgcctcag

SEQ ID NO: 296572 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcccgag

SEQ ID NO: 296573 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccgagta

SEQ ID NO: 296574 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccgagtagct

SEQ ID NO: 296575 - DNA, 20 bp, Artificial Sequence
  Description of Artificial Sequence: Synthetic oligonucleotide
  Target: ATXN1; (+) strand; PAM type: YTN; PAM sequence: CTC
agcctcccgagtagctggga

SEQ ID NO: 296576 - DNA, 20 bp, Artificial Sequence
  Description of Artificial Sequence: Synthetic oligonucleotide
  Target: ATXN1; (+) strand; PAM type: YTN; PAM sequence: CTC
ccgagtagctgggattactg

SEQ ID NO: 296577 - DNA, 20 bp, Artificial Sequence
  Description of Artificial Sequence: Synthetic oligonucleotide
  Target: ATXN1; (+) strand; PAM type: YTN; PAM sequence: CTG
ggattactggcacatgccac

SEQ ID NO: 296578 - DNA, 20 bp, Artificial Sequence
  Description of Artificial Sequence: Synthetic oligonucleotide
  Target: ATXN1; (+) strand; PAM type: YTN; PAM sequence: TTA
ctggcacatgccaccacact

SEQ ID NO: 296579 - DNA, 20 bp, Artificial Sequence
  Description of Artificial Sequence: Synthetic oligonucleotide
  Target: ATXN1; (+) strand; PAM type: YTN; PAM sequence: CTG
gcacatgccaccacactcag

SEQ ID NO: 296580 - DNA, 20 bp, Artificial Sequence
  Description of Artificial Sequence: Synthetic oligonucleotide
  Target: ATXN1; (+) strand; PAM type: YTN; PAM sequence: CTC
agttactttttgcatttata

SEQ ID NO: 296581 - DNA, 20 bp, Artificial Sequence
  Description of Artificial Sequence: Synthetic oligonucleotide
  Target: ATXN1; (+) strand; PAM type: YTN; PAM sequence: TTA
ctttttgcatttatagtaga

SEQ ID NO: 296582 - DNA, 20 bp, Artificial Sequence
  Description of Artificial Sequence: Synthetic oligonucleotide
  Target: ATXN1; (+) strand; PAM type: YTN; PAM sequence: CTT
tttgcatttatagtagagac

SEQ ID NO: 296583 - DNA, 20 bp, Artificial Sequence
  Description of Artificial Sequence: Synthetic oligonucleotide
  Target: ATXN1; (+) strand; PAM type: YTN; PAM sequence: TTT
ttgcatttatagtagagacg

SEQ ID NO: 296584 - DNA, 20 bp, Artificial Sequence
  Description of Artificial Sequence: Synthetic oligonucleotide
  Target: ATXN1; (+) strand; PAM type: YTN; PAM sequence: TTT
tgcatttatagtagagacgg

SEQ ID NO: 296585 - DNA, 20 bp, Artificial Sequence
  Description of Artificial Sequence: Synthetic oligonucleotide
  Target: ATXN1; (+) strand; PAM type: YTN; PAM sequence: TTT
gcatttatagtagagacgga

SEQ ID NO: 296586 - DNA, 20 bp, Artificial Sequence
  Description of Artificial Sequence: Synthetic oligonucleotide
  Target: ATXN1; (+) strand; PAM type: YTN; PAM sequence: TTG
catttatagtagagacggag

SEQ ID NO: 296587 - DNA, 20 bp, Artificial Sequence
  Description of Artificial Sequence: Synthetic oligonucleotide
  Target: ATXN1; (+) strand; PAM type: YTN; PAM sequence: TTT
atagtagagacggagtttca

SEQ ID NO: 296588 - DNA, 20 bp, Artificial Sequence
  Description of Artificial Sequence: Synthetic oligonucleotide
  Target: ATXN1; (+) strand; PAM type: YTN; PAM sequence: TTA
tagtagagacggagtttcac

SEQ ID NO: 296589 - DNA, 20 bp, Artificial Sequence
  Description of Artificial Sequence: Synthetic oligonucleotide
  Target: ATXN1; (+) strand; PAM type: YTN; PAM sequence: TTT
caccatgttggccaggatgg

SEQ ID NO: 296590 - DNA, 20 bp, Artificial Sequence
  Description of Artificial Sequence: Synthetic oligonucleotide
  Target: ATXN1; (+) strand; PAM type: YTN; PAM sequence: TTC
accatgttggccaggatggt

SEQ ID NO: 296591 - DNA, 20 bp, Artificial Sequence
  Description of Artificial Sequence: Synthetic oligonucleotide
  Target: ATXN1; (+) strand; PAM type: YTN; PAM sequence: TTG
gccaggatggtcttgctctc

SEQ ID NO: 296592 - DNA, 20 bp, Artificial Sequence
  Description of Artificial Sequence: Synthetic oligonucleotide
  Target: ATXN1; (+) strand; PAM type: YTN; PAM sequence: CTT
gctctcctgactttgtgatc

SEQ ID NO: 296593 - DNA, 20 bp, Artificial Sequence
  Description of Artificial Sequence: Synthetic oligonucleotide
  Target: ATXN1; (+) strand; PAM type: YTN; PAM sequence: TTG
ctctcctgactttgtgatcc

SEQ ID NO: 296594 - DNA, 20 bp, Artificial Sequence
  Description of Artificial Sequence: Synthetic oligonucleotide
  Target: ATXN1; (+) strand; PAM type: YTN; PAM sequence: CTC
tcctgactttgtgatccgtt

SEQ ID NO: 296595 - DNA, 20 bp, Artificial Sequence
  Description of Artificial Sequence: Synthetic oligonucleotide
  Target: ATXN1; (+) strand; PAM type: YTN; PAM sequence: CTC
ctgactttgtgatccgttcg

SEQ ID NO: 296596 - DNA, 20 bp, Artificial Sequence
  Description of Artificial Sequence: Synthetic oligonucleotide
  Target: ATXN1; (+) strand; PAM type: YTN; PAM sequence: CTG
actttgtgatccgttcgcct

SEQ ID NO: 296597 - DNA, 20 bp, Artificial Sequence
  Description of Artificial Sequence: Synthetic oligonucleotide
  Target: ATXN1; (+) strand; PAM type: YTN; PAM sequence: CTT
tgtgatccgttcgcctcggt

SEQ ID NO: 296598 - DNA, 20 bp, Artificial Sequence
  Description of Artificial Sequence: Synthetic oligonucleotide
  Target: ATXN1; (+) strand; PAM type: YTN; PAM sequence: TTT
gtgatccgttcgcctcggtc

SEQ ID NO: 296599 - DNA, 20 bp, Artificial Sequence
  Description of Artificial Sequence: Synthetic oligonucleotide
  Target: ATXN1; (+) strand; PAM type: YTN; PAM sequence: TTG
tgatccgttcgcctcggtct

SEQ ID NO: 296600 - DNA, 20 bp, Artificial Sequence
  Description of Artificial Sequence: Synthetic oligonucleotide
  Target: ATXN1; (+) strand; PAM type: YTN; PAM sequence: TTC
gcctcggtctcccaaagtgc

SEQ ID NO: 296601 - DNA, 20 bp, Artificial Sequence
  Description of Artificial Sequence: Synthetic oligonucleotide
  Target: ATXN1; (+) strand; PAM type: YTN; PAM sequence: CTC
ggtctcccaaagtgctggca

SEQ ID NO: 296602 - DNA, 20 bp, Artificial Sequence
  Description of Artificial Sequence: Synthetic oligonucleotide
  Target: ATXN1; (+) strand; PAM type: YTN; PAM sequence: CTC
ccaaagtgctggcattacag

SEQ ID NO: 296603 - DNA, 20 bp, Artificial Sequence
  Description of Artificial Sequence: Synthetic oligonucleotide
  Target: ATXN1; (+) strand; PAM type: YTN; PAM sequence: CTG
gcattacaggtgtgagccac

SEQ ID NO: 296604 - DNA, 20 bp, Artificial Sequence
  Description of Artificial Sequence: Synthetic oligonucleotide
  Target: ATXN1; (+) strand; PAM type: YTN; PAM sequence: TTA
caggtgtgagccactgcacc

SEQ ID NO: 296605 - DNA, 20 bp, Artificial Sequence
  Description of Artificial Sequence: Synthetic oligonucleotide
  Target: ATXN1; (+) strand; PAM type: YTN; PAM sequence: CTG
cacccagccatgactttttt

SEQ ID NO: 296606 - DNA, 20 bp, Artificial Sequence
  Description of Artificial Sequence: Synthetic oligonucleotide
  Target: ATXN1; (+) strand; PAM type: YTN; PAM sequence: CTT
tttttttagcaaacactttc

SEQ ID NO: 296607 - DNA, 20 bp, Artificial Sequence
  Description of Artificial Sequence: Synthetic oligonucleotide
  Target: ATXN1; (+) strand; PAM type: YTN; PAM sequence: TTT
ttttttagcaaacactttct

SEQ ID NO: 296608 - DNA, 20 bp, Artificial Sequence
  Description of Artificial Sequence: Synthetic oligonucleotide
  Target: ATXN1; (+) strand; PAM type: YTN; PAM sequence: TTT
tttttagcaaacactttctt

SEQ ID NO: 296609 - DNA, 20 bp, Artificial Sequence
  Description of Artificial Sequence: Synthetic oligonucleotide
  Target: ATXN1; (+) strand; PAM type: YTN; PAM sequence: TTT
ttttagcaaacactttcttc

SEQ ID NO: 296610 - DNA, 20 bp, Artificial Sequence
  Description of Artificial Sequence: Synthetic oligonucleotide
  Target: ATXN1; (+) strand; PAM type: YTN; PAM sequence: TTT
tttagcaaacactttcttcc

SEQ ID NO: 296611 - DNA, 20 bp, Artificial Sequence
  Description of Artificial Sequence: Synthetic oligonucleotide
  Target: ATXN1; (+) strand; PAM type: YTN; PAM sequence: TTT
ttagcaaacactttcttcca

SEQ ID NO: 296612 - DNA, 20 bp, Artificial Sequence
  Description of Artificial Sequence: Synthetic oligonucleotide
  Target: ATXN1; (+) strand; PAM type: YTN; PAM sequence: TTT
tagcaaacactttcttccaa

SEQ ID NO: 296613 - DNA, 20 bp, Artificial Sequence
  Description of Artificial Sequence: Synthetic oligonucleotide
  Target: ATXN1; (+) strand; PAM type: YTN; PAM sequence: TTT
agcaaacactttcttccaat

SEQ ID NO: 296614 - DNA, 20 bp, Artificial Sequence
  Description of Artificial Sequence: Synthetic oligonucleotide
  Target: ATXN1; (+) strand; PAM type: YTN; PAM sequence: TTA
gcaaacactttcttccaatc

SEQ ID NO: 296615 - DNA, 20 bp, Artificial Sequence
  Description of Artificial Sequence: Synthetic oligonucleotide
  Target: ATXN1; (+) strand; PAM type: YTN; PAM sequence: CTT
tcttccaatctaggctttaa

SEQ ID NO: 296616 - DNA, 20 bp, Artificial Sequence
  Description of Artificial Sequence: Synthetic oligonucleotide
  Target: ATXN1; (+) strand; PAM type: YTN; PAM sequence: TTT
cttccaatctaggctttaag

SEQ ID NO: 296617 - DNA, 20 bp, Artificial Sequence
  Description of Artificial Sequence: Synthetic oligonucleotide
  Target: ATXN1; (+) strand; PAM type: YTN; PAM sequence: TTC
ttccaatctaggctttaaga

SEQ ID NO: 296618 - DNA, 20 bp, Artificial Sequence
  Description of Artificial Sequence: Synthetic oligonucleotide
  Target: ATXN1; (+) strand; PAM type: YTN; PAM sequence: CTT
ccaatctaggctttaagaat

SEQ ID NO: 296619 - DNA, 20 bp, Artificial Sequence
  Description of Artificial Sequence: Synthetic oligonucleotide
  Target: ATXN1; (+) strand; PAM type: YTN; PAM sequence: TTC
caatctaggctttaagaatc

SEQ ID NO: 296620 - DNA, 20 bp, Artificial Sequence
  Description of Artificial Sequence: Synthetic oligonucleotide
  Target: ATXN1; (+) strand; PAM type: YTN; PAM sequence: CTA
ggctttaagaatctagttaa

SEQ ID NO: 296621 - DNA, 20 bp, Artificial Sequence
  Description of Artificial Sequence: Synthetic oligonucleotide
  Target: ATXN1; (+) strand; PAM type: YTN; PAM sequence: CTT
taagaatctagttaaaattt

SEQ ID NO: 296622 - DNA, 20 bp, Artificial Sequence
  Description of Artificial Sequence: Synthetic oligonucleotide
  Target: ATXN1; (+) strand; PAM type: YTN; PAM sequence: TTT
aagaatctagttaaaatttc

SEQ ID NO: 296623 - DNA, 20 bp, Artificial Sequence
  Description of Artificial Sequence: Synthetic oligonucleotide
  Target: ATXN1; (+) strand; PAM type: YTN; PAM sequence: TTA
agaatctagttaaaatttct

SEQ ID NO: 296624 - DNA, 20 bp, Artificial Sequence
  Description of Artificial Sequence: Synthetic oligonucleotide
  Target: ATXN1; (+) strand; PAM type: YTN; PAM sequence: CTA
gttaaaatttcttttaacta

SEQ ID NO: 296625 - DNA, 20 bp, Artificial Sequence
  Description of Artificial Sequence: Synthetic oligonucleotide
  Target: ATXN1; (+) strand; PAM type: YTN; PAM sequence: TTA
aaatttcttttaactaaagg

SEQ ID NO: 296626 - DNA, 20 bp, Artificial Sequence
  Description of Artificial Sequence: Synthetic oligonucleotide
  Target: ATXN1; (+) strand; PAM type: YTN; PAM sequence: TTT
cttttaactaaaggaataaa

SEQ ID NO: 296627 - DNA, 20 bp, Artificial Sequence
  Description of Artificial Sequence: Synthetic oligonucleotide
  Target: ATXN1; (+) strand; PAM type: YTN; PAM sequence: TTC
ttttaactaaaggaataaac

SEQ ID NO: 296628 - DNA, 20 bp, Artificial Sequence
  Description of Artificial Sequence: Synthetic oligonucleotide
  Target: ATXN1; (+) strand; PAM type: YTN; PAM sequence: CTT
ttaactaaaggaataaactt

SEQ ID NO: 296629 - DNA, 20 bp, Artificial Sequence
  Description of Artificial Sequence: Synthetic oligonucleotide
  Target: ATXN1; (+) strand; PAM type: YTN; PAM sequence: TTT
taactaaaggaataaacttt

SEQ ID NO: 296630 - DNA, 20 bp, Artificial Sequence
  Description of Artificial Sequence: Synthetic oligonucleotide
  Target: ATXN1; (+) strand; PAM type: YTN; PAM sequence: TTT
aactaaaggaataaactttt

SEQ ID NO: 296631 - DNA, 20 bp, Artificial Sequence
  Description of Artificial Sequence: Synthetic oligonucleotide
  Target: ATXN1; (+) strand; PAM type: YTN; PAM sequence: TTA
actaaaggaataaactttta

SEQ ID NO: 296632 - DNA, 20 bp, Artificial Sequence
  Description of Artificial Sequence: Synthetic oligonucleotide
  Target: ATXN1; (+) strand; PAM type: YTN; PAM sequence: CTA
aaggaataaacttttaaagt

SEQ ID NO: 296633 - DNA, 20 bp, Artificial Sequence
  Description of Artificial Sequence: Synthetic oligonucleotide
  Target: ATXN1; (+) strand; PAM type: YTN; PAM sequence: CTT
ttaaagtacatggaaagaga

SEQ ID NO: 296634 - DNA, 20 bp, Artificial Sequence
  Description of Artificial Sequence: Synthetic oligonucleotide
  Target: ATXN1; (+) strand; PAM type: YTN; PAM sequence: TTT
taaagtacatggaaagagat

SEQ ID NO: 296635 - DNA, 20 bp, Artificial Sequence
  Description of Artificial Sequence: Synthetic oligonucleotide
  Target: ATXN1; (+) strand; PAM type: YTN; PAM sequence: TTT
aaagtacatggaaagagatt

SEQ ID NO: 296636 - DNA, 20 bp, Artificial Sequence
  Description of Artificial Sequence: Synthetic oligonucleotide
  Target: ATXN1; (+) strand; PAM type: YTN; PAM sequence: TTA
aagtacatggaaagagattc

SEQ ID NO: 296637 - DNA, 20 bp, Artificial Sequence
  Description of Artificial Sequence: Synthetic oligonucleotide
  Target: ATXN1; (+) strand; PAM type: YTN; PAM sequence: TTC
agaaagacctttttcatgaa

SEQ ID NO: 296638 - DNA, 20 bp, Artificial Sequence
  Description of Artificial Sequence: Synthetic oligonucleotide
  Target: ATXN1; (+) strand; PAM type: YTN; PAM sequence: CTT
tttcatgaaatcaattcatg

SEQ ID NO: 296639 - DNA, 20 bp, Artificial Sequence
  Description of Artificial Sequence: Synthetic oligonucleotide
  Target: ATXN1; (+) strand; PAM type: YTN; PAM sequence: TTT
ttcatgaaatcaattcatga

SEQ ID NO: 296640 - DNA, 20 bp, Artificial Sequence
  Description of Artificial Sequence: Synthetic oligonucleotide
  Target: ATXN1; (+) strand; PAM type: YTN; PAM sequence: TTT
tcatgaaatcaattcatgaa

SEQ ID NO: 296641 - DNA, 20 bp, Artificial Sequence
  Description of Artificial Sequence: Synthetic oligonucleotide
  Target: ATXN1; (+) strand; PAM type: YTN; PAM sequence: TTT
catgaaatcaattcatgaag

SEQ ID NO: 296642 - DNA, 20 bp, Artificial Sequence
  Description of Artificial Sequence: Synthetic oligonucleotide
  Target: ATXN1; (+) strand; PAM type: YTN; PAM sequence: TTC
atgaaatcaattcatgaagt

SEQ ID NO: 296643 - DNA, 20 bp, Artificial Sequence
  Description of Artificial Sequence: Synthetic oligonucleotide
  Target: ATXN1; (+) strand; PAM type: YTN; PAM sequence: TTC
atgaagtaactaggtaaatt

SEQ ID NO: 296644 - DNA, 20 bp, Artificial Sequence
  Description of Artificial Sequence: Synthetic oligonucleotide
  Target: ATXN1; (+) strand; PAM type: YTN; PAM sequence: CTA
ggtaaattataaatcattat

SEQ ID NO: 296645 - DNA, 20 bp, Artificial Sequence
  Description of Artificial Sequence: Synthetic oligonucleotide
  Target: ATXN1; (+) strand; PAM type: YTN; PAM sequence: TTA
taaatcattatctatttaga

SEQ ID NO: 296646 - DNA, 20 bp, Artificial Sequence
  Description of Artificial Sequence: Synthetic oligonucleotide
  Target: ATXN1; (+) strand; PAM type: YTN; PAM sequence: TTA
tctatttagaaagaaaatac

SEQ ID NO: 296647 - DNA, 20 bp, Artificial Sequence
  Description of Artificial Sequence: Synthetic oligonucleotide
  Target: ATXN1; (+) strand; PAM type: YTN; PAM sequence: CTA
tttagaaagaaaatacgcaa

SEQ ID NO: 296648 - DNA, 20 bp, Artificial Sequence
  Description of Artificial Sequence: Synthetic oligonucleotide
  Target: ATXN1; (+) strand; PAM type: YTN; PAM sequence: TTT
agaaagaaaatacgcaaaga

SEQ ID NO: 296649 - DNA, 20 bp, Artificial Sequence
  Description of Artificial Sequence: Synthetic oligonucleotide
  Target: ATXN1; (+) strand; PAM type: YTN; PAM sequence: TTA
gaaagaaaatacgcaaagaa

SEQ ID NO: 296650 - DNA, 20 bp, Artificial Sequence
  Description of Artificial Sequence: Synthetic oligonucleotide
  Target: ATXN1; (+) strand; PAM type: YTN; PAM sequence: CTA
ctaaacaacactggttatct

SEQ ID NO: 296651 - DNA, 20 bp, Artificial Sequence
  Description of Artificial Sequence: Synthetic oligonucleotide
  Target: ATXN1; (+) strand; PAM type: YTN; PAM sequence: CTA
aacaacactggttatctttg

SEQ ID NO: 296652 - DNA, 20 bp, Artificial Sequence
  Description of Artificial Sequence: Synthetic oligonucleotide
  Target: ATXN1; (+) strand; PAM type: YTN; PAM sequence: CTG
gttatctttgggtgttaatg

SEQ ID NO: 296653 - DNA, 20 bp, Artificial Sequence
  Description of Artificial Sequence: Synthetic oligonucleotide
  Target: ATXN1; (+) strand; PAM type: YTN; PAM sequence: TTA
tctttgggtgttaatggaca

SEQ ID NO: 296654 - DNA, 20 bp, Artificial Sequence
  Description of Artificial Sequence: Synthetic oligonucleotide
  Target: ATXN1; (+) strand; PAM type: YTN; PAM sequence: CTT
tgggtgttaatggacacatg

SEQ ID NO: 296655 - DNA, 20 bp, Artificial Sequence
  Description of Artificial Sequence: Synthetic oligonucleotide
  Target: ATXN1; (+) strand; PAM type: YTN; PAM sequence: TTT
gggtgttaatggacacatgc

SEQ ID NO: 296656 - DNA, 20 bp, Artificial Sequence
  Description of Artificial Sequence: Synthetic oligonucleotide
  Target: ATXN1; (+) strand; PAM type: YTN; PAM sequence: TTG
ggtgttaatggacacatgca

SEQ ID NO: 296657 - DNA, 20 bp, Artificial Sequence
  Description of Artificial Sequence: Synthetic oligonucleotide
  Target: ATXN1; (+) strand; PAM type: YTN; PAM sequence: TTA
atggacacatgcaatgataa

SEQ ID NO: 296658 - DNA, 20 bp, Artificial Sequence
  Description of Artificial Sequence: Synthetic oligonucleotide
  Target: ATXN1; (+) strand; PAM type: YTN; PAM sequence: CTA
acattcacatgttaagccct

SEQ ID NO: 296659 - DNA, 20 bp, Artificial Sequence
  Description of Artificial Sequence: Synthetic oligonucleotide
  Target: ATXN1; (+) strand; PAM type: YTN; PAM sequence: TTC
acatgttaagcccttgagtt

SEQ ID NO: 296660 - DNA, 20 bp, Artificial Sequence
  Description of Artificial Sequence: Synthetic oligonucleotide
  Target: ATXN1; (+) strand; PAM type: YTN; PAM sequence: TTA
agcccttgagtttcattatc

SEQ ID NO: 296661 - DNA, 20 bp, Artificial Sequence
  Description of Artificial Sequence: Synthetic oligonucleotide
  Target: ATXN1; (+) strand; PAM type: YTN; PAM sequence: CTT
gagtttcattatctcctcta

SEQ ID NO: 296662 - DNA, 20 bp, Artificial Sequence
  Description of Artificial Sequence: Synthetic oligonucleotide
  Target: ATXN1; (+) strand; PAM type: YTN; PAM sequence: TTG
agtttcattatctcctctaa

SEQ ID NO: 296663 - DNA, 20 bp, Artificial Sequence
  Description of Artificial Sequence: Synthetic oligonucleotide
  Target: ATXN1; (+) strand; PAM type: YTN; PAM sequence: TTT
cattatctcctctaagccct

SEQ ID NO: 296664 - DNA, 20 bp, Artificial Sequence
  Description of Artificial Sequence: Synthetic oligonucleotide
  Target: ATXN1; (+) strand; PAM type: YTN; PAM sequence: TTC
attatctcctctaagcccta

SEQ ID NO: 296665 - DNA, 20 bp, Artificial Sequence
  Description of Artificial Sequence: Synthetic oligonucleotide
  Target: ATXN1; (+) strand; PAM type: YTN; PAM sequence: TTA
tctcctctaagccctagaac

SEQ ID NO: 296666 - DNA, 20 bp, Artificial Sequence
  Description of Artificial Sequence: Synthetic oligonucleotide
  Target: ATXN1; (+) strand; PAM type: YTN; PAM sequence: CTC
ctctaagccctagaaccatc

SEQ ID NO: 296667 - DNA, 20 bp, Artificial Sequence
  Description of Artificial Sequence: Synthetic oligonucleotide
  Target: ATXN1; (+) strand; PAM type: YTN; PAM sequence: CTC
taagccctagaaccatccta

SEQ ID NO: 296668 - DNA, 20 bp, Artificial Sequence
  Description of Artificial Sequence: Synthetic oligonucleotide
  Target: ATXN1; (+) strand; PAM type: YTN; PAM sequence: CTA
agccctagaaccatcctagg

SEQ ID NO: 296669 - DNA, 20 bp, Artificial Sequence
  Description of Artificial Sequence: Synthetic oligonucleotide
  Target: ATXN1; (+) strand; PAM type: YTN; PAM sequence: CTA
gaaccatcctaggcagtgga

SEQ ID NO: 296670 - DNA, 20 bp, Artificial Sequence
  Description of Artificial Sequence: Synthetic oligonucleotide
  Target: ATXN1; (+) strand; PAM type: YTN; PAM sequence: CTA
ggcagtggacacttttatta

SEQ ID NO: 296671 - DNA, 20 bp, Artificial Sequence
  Description of Artificial Sequence: Synthetic oligonucleotide
  Target: ATXN1; (+) strand; PAM type: YTN; PAM sequence: CTT
ttattacccgccttctaata

SEQ ID NO: 296672 - DNA, 20 bp, Artificial Sequence
  Description of Artificial Sequence: Synthetic oligonucleotide
  Target: ATXN1; (+) strand; PAM type: YTN; PAM sequence: TTT
tattacccgccttctaataa

SEQ ID NO: 296673 - DNA, 20 bp, Artificial Sequence
  Description of Artificial Sequence: Synthetic oligonucleotide
  Target: ATXN1; (+) strand; PAM type: YTN; PAM sequence: TTT
attacccgccttctaataaa

SEQ ID NO: 296674 - DNA, 20 bp, Artificial Sequence
  Description of Artificial Sequence: Synthetic oligonucleotide
  Target: ATXN1; (+) strand; PAM type: YTN; PAM sequence: TTA
ttacccgccttctaataaat

SEQ ID NO: 296675 - DNA, 20 bp, Artificial Sequence
  Description of Artificial Sequence: Synthetic oligonucleotide
  Target: ATXN1; (+) strand; PAM type: YTN; PAM sequence: TTA
cccgccttctaataaataaa

SEQ ID NO: 296676 - DNA, 20 bp, Artificial Sequence
  Description of Artificial Sequence: Synthetic oligonucleotide
  Target: ATXN1; (+) strand; PAM type: YTN; PAM sequence: CTT
ctaataaataaagaaatgga

SEQ ID NO: 296677 - DNA, 20 bp, Artificial Sequence
  Description of Artificial Sequence: Synthetic oligonucleotide
  Target: ATXN1; (+) strand; PAM type: YTN; PAM sequence: TTC
taataaataaagaaatggag

SEQ ID NO: 296678 - DNA, 20 bp, Artificial Sequence
  Description of Artificial Sequence: Synthetic oligonucleotide
  Target: ATXN1; (+) strand; PAM type: YTN; PAM sequence: CTA
ataaataaagaaatggaggt

SEQ ID NO: 296679 - DNA, 20 bp, Artificial Sequence
  Description of Artificial Sequence: Synthetic oligonucleotide
  Target: ATXN1; (+) strand; PAM type: YTN; PAM sequence: CTA
cataatgtacccacaagtga

SEQ ID NO: 296680 - DNA, 20 bp, Artificial Sequence
  Description of Artificial Sequence: Synthetic oligonucleotide
  Target: ATXN1; (+) strand; PAM type: YTN; PAM sequence: TTG
aggactccaacctccatcca

SEQ ID NO: 296681 - DNA, 20 bp, Artificial Sequence
  Description of Artificial Sequence: Synthetic oligonucleotide
  Target: ATXN1; (+) strand; PAM type: YTN; PAM sequence: CTC
caacctccatccacctgaga

SEQ ID NO: 296682 - DNA, 20 bp, Artificial Sequence
  Description of Artificial Sequence: Synthetic oligonucleotide
  Target: ATXN1; (+) strand; PAM type: YTN; PAM sequence: CTC
catccacctgagagcaaaga

SEQ ID NO: 296683 - DNA, 20 bp, Artificial Sequence
  Description of Artificial Sequence: Synthetic oligonucleotide
  Target: ATXN1; (+) strand; PAM type: YTN; PAM sequence: CTG
agagcaaagattctctatct

SEQ ID NO: 296684 - DNA, 20 bp, Artificial Sequence
  Description of Artificial Sequence: Synthetic oligonucleotide
  Target: ATXN1; (+) strand; PAM type: YTN; PAM sequence: TTC
tctatctcctcagtctgctg

SEQ ID NO: 296685 - DNA, 20 bp, Artificial Sequence
  Description of Artificial Sequence: Synthetic oligonucleotide
  Target: ATXN1; (+) strand; PAM type: YTN; PAM sequence: CTC
tatctcctcagtctgctgcc

SEQ ID NO: 296686 - DNA, 20 bp, Artificial Sequence
  Description of Artificial Sequence: Synthetic oligonucleotide
  Target: ATXN1; (+) strand; PAM type: YTN; PAM sequence: CTA
tctcctcagtctgctgcctc

SEQ ID NO: 296687 - DNA, 20 bp, Artificial Sequence
  Description of Artificial Sequence: Synthetic oligonucleotide
  Target: ATXN1; (+) strand; PAM type: YTN; PAM sequence: CTC
ctcagtctgctgcctccttt

SEQ ID NO: 296688 - DNA, 20 bp, Artificial Sequence
  Description of Artificial Sequence: Synthetic oligonucleotide
  Target: ATXN1; (+) strand; PAM type: YTN; PAM sequence: CTC
agtctgctgcctcctttcca

SEQ ID NO: 296689 - DNA, 20 bp, Artificial Sequence
  Description of Artificial Sequence: Synthetic oligonucleotide
  Target: ATXN1; (+) strand; PAM type: YTN; PAM sequence: CTG
ctgcctcctttccaattaat

SEQ ID NO: 296690 - DNA, 20 bp, Artificial Sequence
  Description of Artificial Sequence: Synthetic oligonucleotide
  Target: ATXN1; (+) strand; PAM type: YTN; PAM sequence: CTG
cctcctttccaattaatagt

SEQ ID NO: 296691 - DNA, 20 bp, Artificial Sequence
  Description of Artificial Sequence: Synthetic oligonucleotide
  Target: ATXN1; (+) strand; PAM type: YTN; PAM sequence: CTC
ctttccaattaatagttgac

SEQ ID NO: 296692 - DNA, 20 bp, Artificial Sequence
  Description of Artificial Sequence: Synthetic oligonucleotide
  Target: ATXN1; (+) strand; PAM type: YTN; PAM sequence: CTT
tccaattaatagttgactga

SEQ ID NO: 296693 - DNA, 20 bp, Artificial Sequence
  Description of Artificial Sequence: Synthetic oligonucleotide
  Target: ATXN1; (+) strand; PAM type: YTN; PAM sequence: TTT
ccaattaatagttgactgaa

SEQ ID NO: 296694 - DNA, 20 bp, Artificial Sequence
  Description of Artificial Sequence: Synthetic oligonucleotide
  Target: ATXN1; (+) strand; PAM type: YTN; PAM sequence: TTC
caattaatagttgactgaac

SEQ ID NO: 296695 - DNA, 20 bp, Artificial Sequence
  Description of Artificial Sequence: Synthetic oligonucleotide
  Target: ATXN1; (+) strand; PAM type: YTN; PAM sequence: TTA
atagttgactgaacttcggt

SEQ ID NO: 296696 - DNA, 20 bp, Artificial Sequence
  Description of Artificial Sequence: Synthetic oligonucleotide
  Target: ATXN1; (+) strand; PAM type: YTN; PAM sequence: TTG
actgaacttcggtagattct

SEQ ID NO: 296697 - DNA, 20 bp, Artificial Sequence
  Description of Artificial Sequence: Synthetic oligonucleotide
  Target: ATXN1; (+) strand; PAM type: YTN; PAM sequence: CTG
aacttcggtagattcttcct

SEQ ID NO: 296698 - DNA, 20 bp, Artificial Sequence
  Description of Artificial Sequence: Synthetic oligonucleotide
  Target: ATXN1; (+) strand; PAM type: YTN; PAM sequence: CTT
cggtagattcttcctctggc

SEQ ID NO: 296699 - DNA, 20 bp, Artificial Sequence
  Description of Artificial Sequence: Synthetic oligonucleotide
  Target: ATXN1; (+) strand; PAM type: YTN; PAM sequence: TTC
ggtagattcttcctctggca

SEQ ID NO: 296700 - DNA, 20 bp, Artificial Sequence
  Description of Artificial Sequence: Synthetic oligonucleotide
  Target: ATXN1; (+) strand; PAM type: YTN; PAM sequence: TTC
ttcctctggcaggtattcca

SEQ ID NO: 296701 - DNA, 20 bp, Artificial Sequence
  Description of Artificial Sequence: Synthetic oligonucleotide
  Target: ATXN1; (+) strand; PAM type: YTN; PAM sequence: CTT
cctctggcaggtattccaca

SEQ ID NO: 296702 - DNA, 20 bp, Artificial Sequence
  Description of Artificial Sequence: Synthetic oligonucleotide
  Target: ATXN1; (+) strand; PAM type: YTN; PAM sequence: TTC
ctctggcaggtattccacaa

SEQ ID NO: 296703 - DNA, 20 bp, Artificial Sequence
  Description of Artificial Sequence: Synthetic oligonucleotide
  Target: ATXN1; (+) strand; PAM type: YTN; PAM sequence: CTC
tggcaggtattccacaatca

SEQ ID NO: 296704 - DNA, 20 bp, Artificial Sequence
  Description of Artificial Sequence: Synthetic oligonucleotide
  Target: ATXN1; (+) strand; PAM type: YTN; PAM sequence: CTG
gcaggtattccacaatcatg

SEQ ID NO: 296705 - DNA, 20 bp, Artificial Sequence
  Description of Artificial Sequence: Synthetic oligonucleotide
  Target: ATXN1; (+) strand; PAM type: YTN; PAM sequence: TTC
cacaatcatgaaacatcctc

SEQ ID NO: 296706 - DNA, 20 bp, Artificial Sequence
  Description of Artificial Sequence: Synthetic oligonucleotide
  Target: ATXN1; (+) strand; PAM type: YTN; PAM sequence: CTC
ttcactttcttgtttcaaag

SEQ ID NO: 296707 - DNA, 20 bp, Artificial Sequence
  Description of Artificial Sequence: Synthetic oligonucleotide
  Target: ATXN1; (+) strand; PAM type: YTN; PAM sequence: CTT
cactttcttgtttcaaagtg

SEQ ID NO: 296708 - DNA, 20 bp, Artificial Sequence
  Description of Artificial Sequence: Synthetic oligonucleotide
  Target: ATXN1; (+) strand; PAM type: YTN; PAM sequence: TTC
actttcttgtttcaaagtga

SEQ ID NO: 296709 - DNA, 20 bp, Artificial Sequence
  Description of Artificial Sequence: Synthetic oligonucleotide
  Target: ATXN1; (+) strand; PAM type: YTN; PAM sequence: CTT
tcttgtttcaaagtgaggag

SEQ ID NO: 296710 - DNA, 20 bp, Artificial Sequence
  Description of Artificial Sequence: Synthetic oligonucleotide
  Target: ATXN1; (+) strand; PAM type: YTN; PAM sequence: TTT
cttgtttcaaagtgaggagt

SEQ ID NO: 296711 - DNA, 20 bp, Artificial Sequence
  Description of Artificial Sequence: Synthetic oligonucleotide
  Target: ATXN1; (+) strand; PAM type: YTN; PAM sequence: TTC
ttgtttcaaagtgaggagtt

SEQ ID NO: 296712 - DNA, 20 bp, Artificial Sequence
  Description of Artificial Sequence: Synthetic oligonucleotide
  Target: ATXN1; (+) strand; PAM type: YTN; PAM sequence: CTT
gtttcaaagtgaggagttgg

SEQ ID NO: 296713 - DNA, 20 bp, Artificial Sequence
  Description of Artificial Sequence: Synthetic oligonucleotide
  Target: ATXN1; (+) strand; PAM type: YTN; PAM sequence: TTG
tttcaaagtgaggagttggc

SEQ ID NO: 296714 - DNA, 20 bp, Artificial Sequence
  Description of Artificial Sequence: Synthetic oligonucleotide
  Target: ATXN1; (+) strand; PAM type: YTN; PAM sequence: TTT
caaagtgaggagttggcttg

SEQ ID NO: 296715 - DNA, 20 bp, Artificial Sequence
  Description of Artificial Sequence: Synthetic oligonucleotide
  Target: ATXN1; (+) strand; PAM type: YTN; PAM sequence: TTC
aaagtgaggagttggcttga

SEQ ID NO: 296716 - DNA, 20 bp, Artificial Sequence
  Description of Artificial Sequence: Synthetic oligonucleotide
  Target: ATXN1; (+) strand; PAM type: YTN; PAM sequence: TTG
gcttgatgaattggctcaga

SEQ ID NO: 296717 - DNA, 20 bp, Artificial Sequence
  Description of Artificial Sequence: Synthetic oligonucleotide
  Target: ATXN1; (+) strand; PAM type: YTN; PAM sequence: CTT
gatgaattggctcagagccc

SEQ ID NO: 296718 - DNA, 20 bp, Artificial Sequence
  Description of Artificial Sequence: Synthetic oligonucleotide
  Target: ATXN1; (+) strand; PAM type: YTN; PAM sequence: TTG
atgaattggctcagagccca

SEQ ID NO: 296719 - DNA, 20 bp, Artificial Sequence
  Description of Artificial Sequence: Synthetic oligonucleotide
  Target: ATXN1; (+) strand; PAM type: YTN; PAM sequence: TTG
gctcagagcccatcctaaaa

SEQ ID NO: 296720 - DNA, 20 bp, Artificial Sequence
  Description of Artificial Sequence: Synthetic oligonucleotide
  Target: ATXN1; (+) strand; PAM type: YTN; PAM sequence: CTC
agagcccatcctaaaatatg

SEQ ID NO: 296721 - DNA, 20 bp, Artificial Sequence
  Description of Artificial Sequence: Synthetic oligonucleotide
  Target: ATXN1; (+) strand; PAM type: YTN; PAM sequence: CTA
aaatatgtacgtgtcggtaa

SEQ ID NO: 296722 - DNA, 20 bp, Artificial Sequence
  Description of Artificial Sequence: Synthetic oligonucleotide
  Target: ATXN1; (+) strand; PAM type: YTN; PAM sequence: TTC
ttttgcctccccaaagcaga

SEQ ID NO: 296723 - DNA, 20 bp, Artificial Sequence
  Description of Artificial Sequence: Synthetic oligonucleotide
  Target: ATXN1; (+) strand; PAM type: YTN; PAM sequence: CTT
ttgcctccccaaagcagacc

SEQ ID NO: 296724 - DNA, 20 bp, Artificial Sequence
  Description of Artificial Sequence: Synthetic oligonucleotide
  Target: ATXN1; (+) strand; PAM type: YTN; PAM sequence: TTT
tgcctccccaaagcagaccg

SEQ ID NO: 296725 - DNA, 20 bp, Artificial Sequence
  Description of Artificial Sequence: Synthetic oligonucleotide
  Target: ATXN1; (+) strand; PAM type: YTN; PAM sequence: TTT
gcctccccaaagcagaccgg

SEQ ID NO: 296726 - DNA, 20 bp, Artificial Sequence
  Description of Artificial Sequence: Synthetic oligonucleotide
  Target: ATXN1; (+) strand; PAM type: YTN; PAM sequence: TTG
cctccccaaagcagaccggt

SEQ ID NO: 296727 - DNA, 20 bp, Artificial Sequence
  Description of Artificial Sequence: Synthetic oligonucleotide
  Target: ATXN1; (+) strand; PAM type: YTN; PAM sequence: CTC
cccaaagcagaccggttatc

SEQ ID NO: 296728 - DNA, 20 bp, Artificial Sequence
  Description of Artificial Sequence: Synthetic oligonucleotide
  Target: ATXN1; (+) strand; PAM type: YTN; PAM sequence: TTA
tcacatggaaaaaggagtct

SEQ ID NO: 296729 - DNA, 20 bp, Artificial Sequence
  Description of Artificial Sequence: Synthetic oligonucleotide
  Target: ATXN1; (+) strand; PAM type: YTN; PAM sequence: CTC
actcacaagccacacgctgg

SEQ ID NO: 296730 - DNA, 20 bp, Artificial Sequence
  Description of Artificial Sequence: Synthetic oligonucleotide
  Target: ATXN1; (+) strand; PAM type: YTN; PAM sequence: CTC
acaagccacacgctggattc

SEQ ID NO: 296731 - DNA, 20 bp, Artificial Sequence
  Description of Artificial Sequence: Synthetic oligonucleotide
  Target: ATXN1; (+) strand; PAM type: YTN; PAM sequence: CTG
gattctgtgaggttaaaact

SEQ ID NO: 296732 - DNA, 20 bp, Artificial Sequence
  Description of Artificial Sequence: Synthetic oligonucleotide
  Target: ATXN1; (+) strand; PAM type: YTN; PAM sequence: TTC
tgtgaggttaaaacttttga

SEQ ID NO: 296733 - DNA, 20 bp, Artificial Sequence
  Description of Artificial Sequence: Synthetic oligonucleotide
  Target: ATXN1; (+) strand; PAM type: YTN; PAM sequence: CTG
tgaggttaaaacttttgatt

SEQ ID NO: 296734 - DNA, 20 bp, Artificial Sequence
  Description of Artificial Sequence: Synthetic oligonucleotide
  Target: ATXN1; (+) strand; PAM type: YTN; PAM sequence: TTA
aaacttttgattcttagaag

SEQ ID NO: 296735 - DNA, 20 bp, Artificial Sequence
  Description of Artificial Sequence: Synthetic oligonucleotide
  Target: ATXN1; (+) strand; PAM type: YTN; PAM sequence: CTT
ttgattcttagaaggacatg

SEQ ID NO: 296736 - DNA, 20 bp, Artificial Sequence
  Description of Artificial Sequence: Synthetic oligonucleotide
  Target: ATXN1; (+) strand; PAM type: YTN; PAM sequence: TTT
tgattcttagaaggacatga

SEQ ID NO: 296737 - DNA, 20 bp, Artificial Sequence
  Description of Artificial Sequence: Synthetic oligonucleotide
  Target: ATXN1; (+) strand; PAM type: YTN; PAM sequence: TTT
gattcttagaaggacatgag

SEQ ID NO: 296738 - DNA, 20 bp, Artificial Sequence
  Description of Artificial Sequence: Synthetic oligonucleotide
  Target: ATXN1; (+) strand; PAM type: YTN; PAM sequence: TTG
attcttagaaggacatgagg

SEQ ID NO: 296739 - DNA, 20 bp, Artificial Sequence
  Description of Artificial Sequence: Synthetic oligonucleotide
  Target: ATXN1; (+) strand; PAM type: YTN; PAM sequence: TTC
ttagaaggacatgaggatag

SEQ ID NO: 296740 - DNA, 20 bp, Artificial Sequence
  Description of Artificial Sequence: Synthetic oligonucleotide
  Target: ATXN1; (+) strand; PAM type: YTN; PAM sequence: CTT
agaaggacatgaggatagag

SEQ ID NO: 296741 - DNA, 20 bp, Artificial Sequence
  Description of Artificial Sequence: Synthetic oligonucleotide
  Target: ATXN1; (+) strand; PAM type: YTN; PAM sequence: TTA
gaaggacatgaggatagagc

SEQ ID NO: 296742 - DNA, 20 bp, Artificial Sequence
  Description of Artificial Sequence: Synthetic oligonucleotide
  Target: ATXN1; (+) strand; PAM type: YTN; PAM sequence: CTG
atgttctgtaaacaaaatga

SEQ ID NO: 296743 - DNA, 20 bp, Artificial Sequence
  Description of Artificial Sequence: Synthetic oligonucleotide
  Target: ATXN1; (+) strand; PAM type: YTN; PAM sequence: TTC
tgtaaacaaaatgatggtct

SEQ ID NO: 296744 - DNA, 20 bp, Artificial Sequence
  Description of Artificial Sequence: Synthetic oligonucleotide
  Target: ATXN1; (+) strand; PAM type: YTN; PAM sequence: CTG
taaacaaaatgatggtctgt

SEQ ID NO: 296745 - DNA, 20 bp, Artificial Sequence
  Description of Artificial Sequence: Synthetic oligonucleotide
  Target: ATXN1; (+) strand; PAM type: YTN; PAM sequence: CTG
taaacaaaattcaaggtatc

SEQ ID NO: 296746 - DNA, 20 bp, Artificial Sequence
  Description of Artificial Sequence: Synthetic oligonucleotide
  Target: ATXN1; (+) strand; PAM type: YTN; PAM sequence: TTC
aaggtatcctcagcccagcc

SEQ ID NO: 296747 - DNA, 20 bp, Artificial Sequence
  Description of Artificial Sequence: Synthetic oligonucleotide
  Target: ATXN1; (+) strand; PAM type: YTN; PAM sequence: CTC
agcccagcccgaatcccctg

SEQ ID NO: 296748 - DNA, 20 bp, Artificial Sequence
  Description of Artificial Sequence: Synthetic oligonucleotide
  Target: ATXN1; (+) strand; PAM type: YTN; PAM sequence: CTG
tttattcctctgaaagcaca

SEQ ID NO: 296749 - DNA, 20 bp, Artificial Sequence
  Description of Artificial Sequence: Synthetic oligonucleotide
  Target: ATXN1; (+) strand; PAM type: YTN; PAM sequence: TTT
attcctctgaaagcacattt

SEQ ID NO: 296750 - DNA, 20 bp, Artificial Sequence
  Description of Artificial Sequence: Synthetic oligonucleotide
  Target: ATXN1; (+) strand; PAM type: YTN; PAM sequence: TTA
ttcctctgaaagcacattta

SEQ ID NO: 296751 - DNA, 20 bp, Artificial Sequence
  Description of Artificial Sequence: Synthetic oligonucleotide
  Target: ATXN1; (+) strand; PAM type: YTN; PAM sequence: TTC
ctctgaaagcacatttatga

SEQ ID NO: 296752 - DNA, 20 bp, Artificial Sequence
  Description of Artificial Sequence: Synthetic oligonucleotide
  Target: ATXN1; (+) strand; PAM type: YTN; PAM sequence: CTC
tgaaagcacatttatgaaac

SEQ ID NO: 296753 - DNA, 20 bp, Artificial Sequence
  Description of Artificial Sequence: Synthetic oligonucleotide
  Target: ATXN1; (+) strand; PAM type: YTN; PAM sequence: CTG
aaagcacatttatgaaacaa

SEQ ID NO: 296754 - DNA, 20 bp, Artificial Sequence
  Description of Artificial Sequence: Synthetic oligonucleotide
  Target: ATXN1; (+) strand; PAM type: YTN; PAM sequence: TTT
atgaaacaagctctgcaaaa

SEQ ID NO: 296755 - DNA, 20 bp, Artificial Sequence
  Description of Artificial Sequence: Synthetic oligonucleotide
  Target: ATXN1; (+) strand; PAM type: YTN; PAM sequence: TTA
tgaaacaagctctgcaaaaa

SEQ ID NO: 296756 - DNA, 20 bp, Artificial Sequence
  Description of Artificial Sequence: Synthetic oligonucleotide
  Target: ATXN1; (+) strand; PAM type: YTN; PAM sequence: CTC
tgcaaaaatgccagtcatct

SEQ ID NO: 296757 - DNA, 20 bp, Artificial Sequence
  Description of Artificial Sequence: Synthetic oligonucleotide
  Target: ATXN1; (+) strand; PAM type: YTN; PAM sequence: CTG
caaaaatgccagtcatctct

SEQ ID NO: 296758 - DNA, 20 bp, Artificial Sequence
  Description of Artificial Sequence: Synthetic oligonucleotide
  Target: ATXN1; (+) strand; PAM type: YTN; PAM sequence: CTC
taaggcaccacagtaaggca

SEQ ID NO: 296759 - DNA, 20 bp, Artificial Sequence
  Description of Artificial Sequence: Synthetic oligonucleotide
  Target: ATXN1; (+) strand; PAM type: YTN; PAM sequence: CTA
aggcaccacagtaaggcaag

SEQ ID NO: 296760 - DNA, 20 bp, Artificial Sequence
  Description of Artificial Sequence: Synthetic oligonucleotide
  Target: ATXN1; (+) strand; PAM type: YTN; PAM sequence: CTA
tgtagtgttatccttttgaa

SEQ ID NO: 296761 - DNA, 20 bp, Artificial Sequence
  Description of Artificial Sequence: Synthetic oligonucleotide
  Target: ATXN1; (+) strand; PAM type: YTN; PAM sequence: TTA
tccttttgaagtgctttcta

SEQ ID NO: 296762 - DNA, 20 bp, Artificial Sequence
  Description of Artificial Sequence: Synthetic oligonucleotide
  Target: ATXN1; (+) strand; PAM type: YTN; PAM sequence: CTT
ttgaagtgctttctaaacgc

SEQ ID NO: 296763 - DNA, 20 bp, Artificial Sequence
  Description of Artificial Sequence: Synthetic oligonucleotide
  Target: ATXN1; (+) strand; PAM type: YTN; PAM sequence: TTT
tgaagtgctttctaaacgct

SEQ ID NO: 296764 - DNA, 20 bp, Artificial Sequence
  Description of Artificial Sequence: Synthetic oligonucleotide
  Target: ATXN1; (+) strand; PAM type: YTN; PAM sequence: TTT
gaagtgctttctaaacgctt

SEQ ID NO: 296765 - DNA, 20 bp, Artificial Sequence
  Description of Artificial Sequence: Synthetic oligonucleotide
  Target: ATXN1; (+) strand; PAM type: YTN; PAM sequence: TTG
aagtgctttctaaacgctta

SEQ ID NO: 296766 - DNA, 20 bp, Artificial Sequence
  Description of Artificial Sequence: Synthetic oligonucleotide
  Target: ATXN1; (+) strand; PAM type: YTN; PAM sequence: CTT
tctaaacgcttaactccctt

SEQ ID NO: 296767 - DNA, 20 bp, Artificial Sequence
  Description of Artificial Sequence: Synthetic oligonucleotide
  Target: ATXN1; (+) strand; PAM type: YTN; PAM sequence: TTT
ctaaacgcttaactcccttg

SEQ ID NO: 296768 - DNA, 20 bp, Artificial Sequence
  Description of Artificial Sequence: Synthetic oligonucleotide
  Target: ATXN1; (+) strand; PAM type: YTN; PAM sequence: TTC
taaacgcttaactcccttgg

SEQ ID NO: 296769 - DNA, 20 bp, Artificial Sequence
  Description of Artificial Sequence: Synthetic oligonucleotide
  Target: ATXN1; (+) strand; PAM type: YTN; PAM sequence: CTA
aacgcttaactcccttgggt

SEQ ID NO: 296770 - DNA, 20 bp, Artificial Sequence
  Description of Artificial Sequence: Synthetic oligonucleotide
  Target: ATXN1; (+) strand; PAM type: YTN; PAM sequence: CTT
aactcccttgggtcagttga

SEQ ID NO: 296771 - DNA, 20 bp, Artificial Sequence
  Description of Artificial Sequence: Synthetic oligonucleotide
  Target: ATXN1; (+) strand; PAM type: YTN; PAM sequence: TTA
actcccttgggtcagttgat

SEQ ID NO: 296772 - DNA, 20 bp, Artificial Sequence
  Description of Artificial Sequence: Synthetic oligonucleotide
  Target: ATXN1; (+) strand; PAM type: YTN; PAM sequence: CTC
ccttgggtcagttgattcac

SEQ ID NO: 296773 - DNA, 20 bp, Artificial Sequence
  Description of Artificial Sequence: Synthetic oligonucleotide
  Target: ATXN1; (+) strand; PAM type: YTN; PAM sequence: CTT
gggtcagttgattcaccatc

SEQ ID NO: 296774 - DNA, 20 bp, Artificial Sequence
  Description of Artificial Sequence: Synthetic oligonucleotide
  Target: ATXN1; (+) strand; PAM type: YTN; PAM sequence: TTG
ggtcagttgattcaccatcc

SEQ ID NO: 296775 - DNA, 20 bp, Artificial Sequence
  Description of Artificial Sequence: Synthetic oligonucleotide
  Target: ATXN1; (+) strand; PAM type: YTN; PAM sequence: TTG
attcaccatccacctctgtc

SEQ ID NO: 296776 - DNA, 20 bp, Artificial Sequence
  Description of Artificial Sequence: Synthetic oligonucleotide
  Target: ATXN1; (+) strand; PAM type: YTN; PAM sequence: TTC
accatccacctctgtcccct

SEQ ID NO: 296777 - DNA, 20 bp, Artificial Sequence
  Description of Artificial Sequence: Synthetic oligonucleotide
  Target: ATXN1; (+) strand; PAM type: YTN; PAM sequence: CTC
tgtcccctttgcttattatt

SEQ ID NO: 296778 - DNA, 20 bp, Artificial Sequence
  Description of Artificial Sequence: Synthetic oligonucleotide
  Target: ATXN1; (+) strand; PAM type: YTN; PAM sequence: CTG
tcccctttgcttattatttc

SEQ ID NO: 296779 - DNA, 20 bp, Artificial Sequence
  Description of Artificial Sequence: Synthetic oligonucleotide
  Target: ATXN1; (+) strand; PAM type: YTN; PAM sequence: CTT
tgcttattatttctctcacc

SEQ ID NO: 296780 - DNA, 20 bp, Artificial Sequence
  Description of Artificial Sequence: Synthetic oligonucleotide
  Target: ATXN1; (+) strand; PAM type: YTN; PAM sequence: TTT
gcttattatttctctcacct

SEQ ID NO: 296781 - DNA, 20 bp, Artificial Sequence
  Description of Artificial Sequence: Synthetic oligonucleotide
  Target: ATXN1; (+) strand; PAM type: YTN; PAM sequence: TTG
cttattatttctctcacctc

SEQ ID NO: 296782 - DNA, 20 bp, Artificial Sequence
  Description of Artificial Sequence: Synthetic oligonucleotide
  Target: ATXN1; (+) strand; PAM type: YTN; PAM sequence: CTT
attatttctctcacctcaga

SEQ ID NO: 296783 - DNA, 20 bp, Artificial Sequence
  Description of Artificial Sequence: Synthetic oligonucleotide
  Target: ATXN1; (+) strand; PAM type: YTN; PAM sequence: TTA
ttatttctctcacctcagat

SEQ ID NO: 296784 - DNA, 20 bp, Artificial Sequence
  Description of Artificial Sequence: Synthetic oligonucleotide
  Target: ATXN1; (+) strand; PAM type: YTN; PAM sequence: TTA
tttctctcacctcagatggc

SEQ ID NO: 296785 - DNA, 20 bp, Artificial Sequence
  Description of Artificial Sequence: Synthetic oligonucleotide
  Target: ATXN1; (+) strand; PAM type: YTN; PAM sequence: TTT
ctctcacctcagatggcttt

SEQ ID NO: 296786 - DNA, 20 bp, Artificial Sequence
  Description of Artificial Sequence: Synthetic oligonucleotide
  Target: ATXN1; (+) strand; PAM type: YTN; PAM sequence: TTC
tctcacctcagatggctttc

SEQ ID NO: 296787 - DNA, 20 bp, Artificial Sequence
  Description of Artificial Sequence: Synthetic oligonucleotide
  Target: ATXN1; (+) strand; PAM type: YTN; PAM sequence: CTC
tcacctcagatggctttcct

SEQ ID NO: 296788 - DNA, 20 bp, Artificial Sequence
  Description of Artificial Sequence: Synthetic oligonucleotide
  Target: ATXN1; (+) strand; PAM type: YTN; PAM sequence: CTC
acctcagatggctttccttc

SEQ ID NO: 296789 - DNA, 20 bp, Artificial Sequence
  Description of Artificial Sequence: Synthetic oligonucleotide
  Target: ATXN1; (+) strand; PAM type: YTN; PAM sequence: CTC
agatggctttccttctgcta

SEQ ID NO: 296790 - DNA, 20 bp, Artificial Sequence
  Description of Artificial Sequence: Synthetic oligonucleotide
  Target: ATXN1; (+) strand; PAM type: YTN; PAM sequence: CTT
tccttctgctaacccacaat

SEQ ID NO: 296791 - DNA, 20 bp, Artificial Sequence
  Description of Artificial Sequence: Synthetic oligonucleotide
  Target: ATXN1; (+) strand; PAM type: YTN; PAM sequence: TTT
ccttctgctaacccacaatc

SEQ ID NO: 296792 - DNA, 20 bp, Artificial Sequence
  Description of Artificial Sequence: Synthetic oligonucleotide
  Target: ATXN1; (+) strand; PAM type: YTN; PAM sequence: TTC
cttctgctaacccacaatcg

SEQ ID NO: 296793 - DNA, 20 bp, Artificial Sequence
  Description of Artificial Sequence: Synthetic oligonucleotide
  Target: ATXN1; (+) strand; PAM type: YTN; PAM sequence: CTT
ctgctaacccacaatcgtta

SEQ ID NO: 296794 - DNA, 20 bp, Artificial Sequence
  Description of Artificial Sequence: Synthetic oligonucleotide
  Target: ATXN1; (+) strand; PAM type: YTN; PAM sequence: TTC
tgctaacccacaatcgttaa

SEQ ID NO: 296795 - DNA, 20 bp, Artificial Sequence
  Description of Artificial Sequence: Synthetic oligonucleotide
  Target: ATXN1; (+) strand; PAM type: YTN; PAM sequence: CTG
ctaacccacaatcgttaaaa

SEQ ID NO: 296796 - DNA, 20 bp, Artificial Sequence
  Description of Artificial Sequence: Synthetic oligonucleotide
  Target: ATXN1; (+) strand; PAM type: YTN; PAM sequence: CTA
acccacaatcgttaaaaaca

SEQ ID NO: 296797 - DNA, 20 bp, Artificial Sequence
  Description of Artificial Sequence: Synthetic oligonucleotide
  Target: ATXN1; (+) strand; PAM type: YTN; PAM sequence: TTA
aaaacatactgaacactttc

SEQ ID NO: 296798 - DNA, 20 bp, Artificial Sequence
  Description of Artificial Sequence: Synthetic oligonucleotide
  Target: ATXN1; (+) strand; PAM type: YTN; PAM sequence: CTG
aacactttctagattattct

SEQ ID NO: 296799 - DNA, 20 bp, Artificial Sequence
  Description of Artificial Sequence: Synthetic oligonucleotide
  Target: ATXN1; (+) strand; PAM type: YTN; PAM sequence: CTT
tctagattattcttagtcat

SEQ ID NO: 296800 - DNA, 20 bp, Artificial Sequence
  Description of Artificial Sequence: Synthetic oligonucleotide
  Target: ATXN1; (+) strand; PAM type: YTN; PAM sequence: TTT
ctagattattcttagtcatt

SEQ ID NO: 296801 - DNA, 20 bp, Artificial Sequence
  Description of Artificial Sequence: Synthetic oligonucleotide
  Target: ATXN1; (+) strand; PAM type: YTN; PAM sequence: TTC
tagattattcttagtcattt

SEQ ID NO: 296802 - DNA, 20 bp, Artificial Sequence
  Description of Artificial Sequence: Synthetic oligonucleotide
  Target: ATXN1; (+) strand; PAM type: YTN; PAM sequence: CTA
gattattcttagtcattttt

SEQ ID NO: 296803 - DNA, 20 bp, Artificial Sequence
  Description of Artificial Sequence: Synthetic oligonucleotide
  Target: ATXN1; (+) strand; PAM type: YTN; PAM sequence: TTA
ttcttagtcatttttcaatg

SEQ ID NO: 296804 - DNA, 20 bp, Artificial Sequence
  Description of Artificial Sequence: Synthetic oligonucleotide
  Target: ATXN1; (+) strand; PAM type: YTN; PAM sequence: TTC
ttagtcatttttcaatgccc

SEQ ID NO: 296805 - DNA, 20 bp, Artificial Sequence
  Description of Artificial Sequence: Synthetic oligonucleotide
  Target: ATXN1; (+) strand; PAM type: YTN; PAM sequence: CTT
agtcatttttcaatgcccgg

SEQ ID NO: 296806 - DNA, 20 bp, Artificial Sequence
  Description of Artificial Sequence: Synthetic oligonucleotide
  Target: ATXN1; (+) strand; PAM type: YTN; PAM sequence: TTA
gtcatttttcaatgcccggc

SEQ ID NO: 296807 - DNA, 20 bp, Artificial Sequence
  Description of Artificial Sequence: Synthetic oligonucleotide
  Target: ATXN1; (+) strand; PAM type: YTN; PAM sequence: TTT
ttcaatgcccggctcaagac

SEQ ID NO: 296808 - DNA, 20 bp, Artificial Sequence
  Description of Artificial Sequence: Synthetic oligonucleotide
  Target: ATXN1; (+) strand; PAM type: YTN; PAM sequence: TTT
tcaatgcccggctcaagaca

SEQ ID NO: 296809 - DNA, 20 bp, Artificial Sequence
  Description of Artificial Sequence: Synthetic oligonucleotide
  Target: ATXN1; (+) strand; PAM type: YTN; PAM sequence: TTT
caatgcccggctcaagacat

SEQ ID NO: 296810 - DNA, 20 bp, Artificial Sequence
  Description of Artificial Sequence: Synthetic oligonucleotide
  Target: ATXN1; (+) strand; PAM type: YTN; PAM sequence: TTC
aatgcccggctcaagacatt

SEQ ID NO: 296811 - DNA, 20 bp, Artificial Sequence
  Description of Artificial Sequence: Synthetic oligonucleotide
  Target: ATXN1; (+) strand; PAM type: YTN; PAM sequence: CTC
aagacatttgtctttctata

SEQ ID NO: 296812 - DNA, 20 bp, Artificial Sequence
  Description of Artificial Sequence: Synthetic oligonucleotide
  Target: ATXN1; (+) strand; PAM type: YTN; PAM sequence: TTT
gtctttctataaccactgca

SEQ ID NO: 296813 - DNA, 20 bp, Artificial Sequence
  Description of Artificial Sequence: Synthetic oligonucleotide
  Target: ATXN1; (+) strand; PAM type: YTN; PAM sequence: TTG
tctttctataaccactgcag

SEQ ID NO: 296814 - DNA, 20 bp, Artificial Sequence
  Description of Artificial Sequence: Synthetic oligonucleotide
  Target: ATXN1; (+) strand; PAM type: YTN; PAM sequence: CTT
tctataaccactgcagctca

SEQ ID NO: 296815 - DNA, 20 bp, Artificial Sequence
  Description of Artificial Sequence: Synthetic oligonucleotide
  Target: ATXN1; (+) strand; PAM type: YTN; PAM sequence: TTT
ctataaccactgcagctcac

SEQ ID NO: 296816 - DNA, 20 bp, Artificial Sequence
  Description of Artificial Sequence: Synthetic oligonucleotide
  Target: ATXN1; (+) strand; PAM type: YTN; PAM sequence: TTC
tataaccactgcagctcact

SEQ ID NO: 296817 - DNA, 20 bp, Artificial Sequence
  Description of Artificial Sequence: Synthetic oligonucleotide
  Target: ATXN1; (+) strand; PAM type: YTN; PAM sequence: CTA
taaccactgcagctcactct

SEQ ID NO: 296818 - DNA, 20 bp, Artificial Sequence
  Description of Artificial Sequence: Synthetic oligonucleotide
  Target: ATXN1; (+) strand; PAM type: YTN; PAM sequence: CTG
cagctcactctttccccaaa

SEQ ID NO: 296819 - DNA, 20 bp, Artificial Sequence
  Description of Artificial Sequence: Synthetic oligonucleotide
  Target: ATXN1; (+) strand; PAM type: YTN; PAM sequence: CTC
actctttccccaaagtgcct

SEQ ID NO: 296820 - DNA, 20 bp, Artificial Sequence
  Description of Artificial Sequence: Synthetic oligonucleotide
  Target: ATXN1; (+) strand; PAM type: YTN; PAM sequence: CTC
tttccccaaagtgcctcggg

SEQ ID NO: 296821 - DNA, 20 bp, Artificial Sequence
  Description of Artificial Sequence: Synthetic oligonucleotide
  Target: ATXN1; (+) strand; PAM type: YTN; PAM sequence: CTT
tccccaaagtgcctcgggcc

SEQ ID NO: 296822 - DNA, 20 bp, Artificial Sequence
  Description of Artificial Sequence: Synthetic oligonucleotide
  Target: ATXN1; (+) strand; PAM type: YTN; PAM sequence: TTT
ccccaaagtgcctcgggcca

SEQ ID NO: 296823 - DNA, 20 bp, Artificial Sequence
  Description of Artificial Sequence: Synthetic oligonucleotide
  Target: ATXN1; (+) strand; PAM type: YTN; PAM sequence: TTC
cccaaagtgcctcgggccag

SEQ ID NO: 296824 - DNA, 20 bp, Artificial Sequence
  Description of Artificial Sequence: Synthetic oligonucleotide
  Target: ATXN1; (+) strand; PAM type: YTN; PAM sequence: CTC
gggccaggactcccatcaag

SEQ ID NO: 296825 - DNA, 20 bp, Artificial Sequence
  Description of Artificial Sequence: Synthetic oligonucleotide
  Target: ATXN1; (+) strand; PAM type: YTN; PAM sequence: CTC
ccatcaaggtgggcttacct

SEQ ID NO: 296826 - DNA, 20 bp, Artificial Sequence
  Description of Artificial Sequence: Synthetic oligonucleotide
  Target: ATXN1; (+) strand; PAM type: YTN; PAM sequence: CTT
acctatgtgctctctgaccc

SEQ ID NO: 296827 - DNA, 20 bp, Artificial Sequence
  Description of Artificial Sequence: Synthetic oligonucleotide
  Target: ATXN1; (+) strand; PAM type: YTN; PAM sequence: TTA
cctatgtgctctctgacccc

SEQ ID NO: 296828 - DNA, 20 bp, Artificial Sequence
  Description of Artificial Sequence: Synthetic oligonucleotide
  Target: ATXN1; (+) strand; PAM type: YTN; PAM sequence: CTA
tgtgctctctgaccccctgt

SEQ ID NO: 296829 - DNA, 20 bp, Artificial Sequence
  Description of Artificial Sequence: Synthetic oligonucleotide
  Target: ATXN1; (+) strand; PAM type: YTN; PAM sequence: CTC
tctgaccccctgtaatgttg

SEQ ID NO: 296830 - DNA, 20 bp, Artificial Sequence
  Description of Artificial Sequence: Synthetic oligonucleotide
  Target: ATXN1; (+) strand; PAM type: YTN; PAM sequence: CTC
tgaccccctgtaatgttgcc

SEQ ID NO: 296831 - DNA, 20 bp, Artificial Sequence
  Description of Artificial Sequence: Synthetic oligonucleotide
  Target: ATXN1; (+) strand; PAM type: YTN; PAM sequence: CTG
accccctgtaatgttgcctc

SEQ ID NO: 296832 - DNA, 20 bp, Artificial Sequence
  Description of Artificial Sequence: Synthetic oligonucleotide
  Target: ATXN1; (+) strand; PAM type: YTN; PAM sequence: CTG
taatgttgcctcatttgtgt

SEQ ID NO: 296833 - DNA, 20 bp, Artificial Sequence
  Description of Artificial Sequence: Synthetic oligonucleotide
  Target: ATXN1; (+) strand; PAM type: YTN; PAM sequence: TTG
cctcatttgtgtgagtctcg

SEQ ID NO: 296834 - DNA, 20 bp, Artificial Sequence
  Description of Artificial Sequence: Synthetic oligonucleotide
  Target: ATXN1; (+) strand; PAM type: YTN; PAM sequence: CTC
atttgtgtgagtctcggctt

SEQ ID NO: 296835 - DNA, 20 bp, Artificial Sequence
  Description of Artificial Sequence: Synthetic oligonucleotide
  Target: ATXN1; (+) strand; PAM type: YTN; PAM sequence: TTT
gtgtgagtctcggctttcgt

SEQ ID NO: 296836 - DNA, 20 bp, Artificial Sequence
  Description of Artificial Sequence: Synthetic oligonucleotide
  Target: ATXN1; (+) strand; PAM type: YTN; PAM sequence: TTG
tgtgagtctcggctttcgta

SEQ ID NO: 296837 - DNA, 20 bp, Artificial Sequence
  Description of Artificial Sequence: Synthetic oligonucleotide
  Target: ATXN1; (+) strand; PAM type: YTN; PAM sequence: CTC
ggctttcgtaactattaata

SEQ ID NO: 296838 - DNA, 20 bp, Artificial Sequence
  Description of Artificial Sequence: Synthetic oligonucleotide
  Target: ATXN1; (+) strand; PAM type: YTN; PAM sequence: CTT
tcgtaactattaatagatga

SEQ ID NO: 296839 - DNA, 20 bp, Artificial Sequence
  Description of Artificial Sequence: Synthetic oligonucleotide
  Target: ATXN1; (+) strand; PAM type: YTN; PAM sequence: TTT
cgtaactattaatagatgac

SEQ ID NO: 296840 - DNA, 20 bp, Artificial Sequence
  Description of Artificial Sequence: Synthetic oligonucleotide
  Target: ATXN1; (+) strand; PAM type: YTN; PAM sequence: TTC
gtaactattaatagatgaca

SEQ ID NO: 296841 - DNA, 20 bp, Artificial Sequence
  Description of Artificial Sequence: Synthetic oligonucleotide
  Target: ATXN1; (+) strand; PAM type: YTN; PAM sequence: CTA
ttaatagatgacagatgttc

SEQ ID NO: 296842 - DNA, 20 bp, Artificial Sequence
  Description of Artificial Sequence: Synthetic oligonucleotide
  Target: ATXN1; (+) strand; PAM type: YTN; PAM sequence: TTA
atagatgacagatgttctta

SEQ ID NO: 296843 - DNA, 20 bp, Artificial Sequence
  Description of Artificial Sequence: Synthetic oligonucleotide
  Target: ATXN1; (+) strand; PAM type: YTN; PAM sequence: TTC
ttaaaaccttctagagaaat

SEQ ID NO: 296844 - DNA, 20 bp, Artificial Sequence
  Description of Artificial Sequence: Synthetic oligonucleotide
  Target: ATXN1; (+) strand; PAM type: YTN; PAM sequence: CTT
aaaaccttctagagaaatct

SEQ ID NO: 296845 - DNA, 20 bp, Artificial Sequence
  Description of Artificial Sequence: Synthetic oligonucleotide
  Target: ATXN1; (+) strand; PAM type: YTN; PAM sequence: TTA
aaaccttctagagaaatctc

SEQ ID NO: 296846 - DNA, 20 bp, Artificial Sequence
  Description of Artificial Sequence: Synthetic oligonucleotide
  Target: ATXN1; (+) strand; PAM type: YTN; PAM sequence: CTT
ctagagaaatctctcaaggc

SEQ ID NO: 296847 - DNA, 20 bp, Artificial Sequence
  Description of Artificial Sequence: Synthetic oligonucleotide
  Target: ATXN1; (+) strand; PAM type: YTN; PAM sequence: TTC
tagagaaatctctcaaggca

SEQ ID NO: 296848 - DNA, 20 bp, Artificial Sequence
  Description of Artificial Sequence: Synthetic oligonucleotide
  Target: ATXN1; (+) strand; PAM type: YTN; PAM sequence: CTA
gagaaatctctcaaggcagt

SEQ ID NO: 296849 - DNA, 20 bp, Artificial Sequence
  Description of Artificial Sequence: Synthetic oligonucleotide
  Target: ATXN1; (+) strand; PAM type: YTN; PAM sequence: CTC
tcaaggcagtgcacatagtg

SEQ ID NO: 296850 - DNA, 20 bp, Artificial Sequence
  Description of Artificial Sequence: Synthetic oligonucleotide
  Target: ATXN1; (+) strand; PAM type: YTN; PAM sequence: CTC
aaggcagtgcacatagtgcc

SEQ ID NO: 296851 - DNA, 20 bp, Artificial Sequence
  Description of Artificial Sequence: Synthetic oligonucleotide
  Target: ATXN1; (+) strand; PAM type: YTN; PAM sequence: CTT
gctctcatttttctctaatt

SEQ ID NO: 296852 - DNA, 20 bp, Artificial Sequence
  Description of Artificial Sequence: Synthetic oligonucleotide
  Target: ATXN1; (+) strand; PAM type: YTN; PAM sequence: TTG
ctctcatttttctctaattg

SEQ ID NO: 296853 - DNA, 20 bp, Artificial Sequence
  Description of Artificial Sequence: Synthetic oligonucleotide
  Target: ATXN1; (+) strand; PAM type: YTN; PAM sequence: CTC
tcatttttctctaattgagt

SEQ ID NO: 296854 - DNA, 20 bp, Artificial Sequence
  Description of Artificial Sequence: Synthetic oligonucleotide
  Target: ATXN1; (+) strand; PAM type: YTN; PAM sequence: CTC
atttttctctaattgagtga

SEQ ID NO: 296855 - DNA, 20 bp, Artificial Sequence
  Description of Artificial Sequence: Synthetic oligonucleotide
  Target: ATXN1; (+) strand; PAM type: YTN; PAM sequence: TTT
ttctctaattgagtgaggac

SEQ ID NO: 296856 - DNA, 20 bp, Artificial Sequence
  Description of Artificial Sequence: Synthetic oligonucleotide
  Target: ATXN1; (+) strand; PAM type: YTN; PAM sequence: TTT
tctctaattgagtgaggact

SEQ ID NO: 296857 - DNA, 20 bp, Artificial Sequence
  Description of Artificial Sequence: Synthetic oligonucleotide
  Target: ATXN1; (+) strand; PAM type: YTN; PAM sequence: TTT
ctctaattgagtgaggacta

SEQ ID NO: 296858 - DNA, 20 bp, Artificial Sequence
  Description of Artificial Sequence: Synthetic oligonucleotide
  Target: ATXN1; (+) strand; PAM type: YTN; PAM sequence: TTC
tctaattgagtgaggactaa

SEQ ID NO: 296859 - DNA, 20 bp, Artificial Sequence
  Description of Artificial Sequence: Synthetic oligonucleotide
  Target: ATXN1; (+) strand; PAM type: YTN; PAM sequence: CTC
taattgagtgaggactaaag

SEQ ID NO: 296860 - DNA, 20 bp, Artificial Sequence
  Description of Artificial Sequence: Synthetic oligonucleotide
  Target: ATXN1; (+) strand; PAM type: YTN; PAM sequence: CTA
attgagtgaggactaaagaa

SEQ ID NO: 296861 - DNA, 20 bp, Artificial Sequence
  Description of Artificial Sequence: Synthetic oligonucleotide
  Target: ATXN1; (+) strand; PAM type: YTN; PAM sequence: TTG
agtgaggactaaagaacact

SEQ ID NO: 296862 - DNA, 20 bp, Artificial Sequence
  Description of Artificial Sequence: Synthetic oligonucleotide
  Target: ATXN1; (+) strand; PAM type: YTN; PAM sequence: CTA
aagaacactggcatgttttt

SEQ ID NO: 296863 - DNA, 20 bp, Artificial Sequence
  Description of Artificial Sequence: Synthetic oligonucleotide
  Target: ATXN1; (+) strand; PAM type: YTN; PAM sequence: CTG
gcatgttttttttgtttttg

SEQ ID NO: 296864 - DNA, 20 bp, Artificial Sequence
  Description of Artificial Sequence: Synthetic oligonucleotide
  Target: ATXN1; (+) strand; PAM type: YTN; PAM sequence: TTT
tttttgtttttgttttctta

SEQ ID NO: 296865 - DNA, 20 bp, Artificial Sequence
  Description of Artificial Sequence: Synthetic oligonucleotide
  Target: ATXN1; (+) strand; PAM type: YTN; PAM sequence: TTT
ttttgtttttgttttcttat

SEQ ID NO: 296866 - DNA, 20 bp, Artificial Sequence
  Description of Artificial Sequence: Synthetic oligonucleotide
  Target: ATXN1; (+) strand; PAM type: YTN; PAM sequence: TTT
tttgtttttgttttcttatt

SEQ ID NO: 296867 - DNA, 20 bp, Artificial Sequence
  Description of Artificial Sequence: Synthetic oligonucleotide
  Target: ATXN1; (+) strand; PAM type: YTN; PAM sequence: TTT
ttgtttttgttttcttattt

SEQ ID NO: 296868 - DNA, 20 bp, Artificial Sequence
  Description of Artificial Sequence: Synthetic oligonucleotide
  Target: ATXN1; (+) strand; PAM type: YTN; PAM sequence: TTT
tgtttttgttttcttatttt

SEQ ID NO: 296869 - DNA, 20 bp, Artificial Sequence
  Description of Artificial Sequence: Synthetic oligonucleotide
  Target: ATXN1; (+) strand; PAM type: YTN; PAM sequence: TTT
gtttttgttttcttattttt

SEQ ID NO: 296870 - DNA, 20 bp, Artificial Sequence
  Description of Artificial Sequence: Synthetic oligonucleotide
  Target: ATXN1; (+) strand; PAM type: YTN; PAM sequence: TTG
tttttgttttcttatttttt

SEQ ID NO: 296871 - DNA, 20 bp, Artificial Sequence
  Description of Artificial Sequence: Synthetic oligonucleotide
  Target: ATXN1; (+) strand; PAM type: YTN; PAM sequence: TTT
ttgttttcttatttttttgt

SEQ ID NO: 296872 - DNA, 20 bp, Artificial Sequence
  Description of Artificial Sequence: Synthetic oligonucleotide
  Target: ATXN1; (+) strand; PAM type: YTN; PAM sequence: TTT
tgttttcttatttttttgtt

SEQ ID NO: 296873 - DNA, 20 bp, Artificial Sequence
  Description of Artificial Sequence: Synthetic oligonucleotide
  Target: ATXN1; (+) strand; PAM type: YTN; PAM sequence: TTT
gttttcttatttttttgttt

SEQ ID NO: 296874 - DNA, 20 bp, Artificial Sequence
  Description of Artificial Sequence: Synthetic oligonucleotide
  Target: ATXN1; (+) strand; PAM type: YTN; PAM sequence: TTG
ttttcttatttttttgtttt

SEQ ID NO: 296875 - DNA, 20 bp, Artificial Sequence
  Description of Artificial Sequence: Synthetic oligonucleotide
  Target: ATXN1; (+) strand; PAM type: YTN; PAM sequence: TTT
tcttatttttttgtttttat

SEQ ID NO: 296876 - DNA, 20 bp, Artificial Sequence
  Description of Artificial Sequence: Synthetic oligonucleotide
  Target: ATXN1; (+) strand; PAM type: YTN; PAM sequence: TTT
cttatttttttgtttttatt

SEQ ID NO: 296877 - DNA, 20 bp, Artificial Sequence
  Description of Artificial Sequence: Synthetic oligonucleotide
  Target: ATXN1; (+) strand; PAM type: YTN; PAM sequence: TTC
ttatttttttgtttttatta

SEQ ID NO: 296878 - DNA, 20 bp, Artificial Sequence
  Description of Artificial Sequence: Synthetic oligonucleotide
  Target: ATXN1; (+) strand; PAM type: YTN; PAM sequence: CTT
atttttttgtttttattact

SEQ ID NO: 296879 - DNA, 20 bp, Artificial Sequence
  Description of Artificial Sequence: Synthetic oligonucleotide
  Target: ATXN1; (+) strand; PAM type: YTN; PAM sequence: TTA
tttttttgtttttattacta

SEQ ID NO: 296880 - DNA, 20 bp, Artificial Sequence
  Description of Artificial Sequence: Synthetic oligonucleotide
  Target: ATXN1; (+) strand; PAM type: YTN; PAM sequence: TTT
ttttgtttttattactaaag

SEQ ID NO: 296881 - DNA, 20 bp, Artificial Sequence
  Description of Artificial Sequence: Synthetic oligonucleotide
  Target: ATXN1; (+) strand; PAM type: YTN; PAM sequence: TTT
tttgtttttattactaaagt

SEQ ID NO: 296882 - DNA, 20 bp, Artificial Sequence
  Description of Artificial Sequence: Synthetic oligonucleotide
  Target: ATXN1; (+) strand; PAM type: YTN; PAM sequence: TTT
ttgtttttattactaaagtt

SEQ ID NO: 296883 - DNA, 20 bp, Artificial Sequence
  Description of Artificial Sequence: Synthetic oligonucleotide
  Target: ATXN1; (+) strand; PAM type: YTN; PAM sequence: TTT
tgtttttattactaaagttt

SEQ ID NO: 296884 - DNA, 20 bp, Artificial Sequence
  Description of Artificial Sequence: Synthetic oligonucleotide
  Target: ATXN1; (+) strand; PAM type: YTN; PAM sequence: TTT
gtttttattactaaagtttt

SEQ ID NO: 296885 - DNA, 20 bp, Artificial Sequence
  Description of Artificial Sequence: Synthetic oligonucleotide
  Target: ATXN1; (+) strand; PAM type: YTN; PAM sequence: TTG
tttttattactaaagtttta

SEQ ID NO: 296886 - DNA, 20 bp, Artificial Sequence
  Description of Artificial Sequence: Synthetic oligonucleotide
  Target: ATXN1; (+) strand; PAM type: YTN; PAM sequence: TTT
ttattactaaagttttaggg

SEQ ID NO: 296887 - DNA, 20 bp, Artificial Sequence
  Description of Artificial Sequence: Synthetic oligonucleotide
  Target: ATXN1; (+) strand; PAM type: YTN; PAM sequence: TTT
tattactaaagttttagggt

SEQ ID NO: 296888 - DNA, 20 bp, Artificial Sequence
  Description of Artificial Sequence: Synthetic oligonucleotide
  Target: ATXN1; (+) strand; PAM type: YTN; PAM sequence: TTT
attactaaagttttagggta

SEQ ID NO: 296889 - DNA, 20 bp, Artificial Sequence
  Description of Artificial Sequence: Synthetic oligonucleotide
  Target: ATXN1; (+) strand; PAM type: YTN; PAM sequence: TTA
ttactaaagttttagggtac

SEQ ID NO: 296890 - DNA, 20 bp, Artificial Sequence
  Description of Artificial Sequence: Synthetic oligonucleotide
  Target: ATXN1; (+) strand; PAM type: YTN; PAM sequence: TTA
ctaaagttttagggtacatg

SEQ ID NO: 296891 - DNA, 20 bp, Artificial Sequence
  Description of Artificial Sequence: Synthetic oligonucleotide
  Target: ATXN1; (+) strand; PAM type: YTN; PAM sequence: CTA
aagttttagggtacatgtgc

SEQ ID NO: 296892 - DNA, 20 bp, Artificial Sequence
  Description of Artificial Sequence: Synthetic oligonucleotide
  Target: ATXN1; (+) strand; PAM type: YTN; PAM sequence: TTT
tagggtacatgtgcacaatg

SEQ ID NO: 296893 - DNA, 20 bp, Artificial Sequence
  Description of Artificial Sequence: Synthetic oligonucleotide
  Target: ATXN1; (+) strand; PAM type: YTN; PAM sequence: TTT
agggtacatgtgcacaatgt

SEQ ID NO: 296894 - DNA, 20 bp, Artificial Sequence
  Description of Artificial Sequence: Synthetic oligonucleotide
  Target: ATXN1; (+) strand; PAM type: YTN; PAM sequence: TTA
gggtacatgtgcacaatgtg

SEQ ID NO: 296895 - DNA, 20 bp, Artificial Sequence
  Description of Artificial Sequence: Synthetic oligonucleotide
  Target: ATXN1; (+) strand; PAM type: YTN; PAM sequence: TTT
gttacatatgtacacatgtg

SEQ ID NO: 296896 - DNA, 20 bp, Artificial Sequence
  Description of Artificial Sequence: Synthetic oligonucleotide
  Target: ATXN1; (+) strand; PAM type: YTN; PAM sequence: TTG
ttacatatgtacacatgtgc

SEQ ID NO: 296897 - DNA, 20 bp, Artificial Sequence
  Description of Artificial Sequence: Synthetic oligonucleotide
  Target: ATXN1; (+) strand; PAM type: YTN; PAM sequence: TTA
catatgtacacatgtgccat

SEQ ID NO: 296898 - DNA, 20 bp, Artificial Sequence
  Description of Artificial Sequence: Synthetic oligonucleotide
  Target: ATXN1; (+) strand; PAM type: YTN; PAM sequence: TTG
gtgtgctgcaaccattaact

SEQ ID NO: 296899 - DNA, 20 bp, Artificial Sequence
  Description of Artificial Sequence: Synthetic oligonucleotide
  Target: ATXN1; (+) strand; PAM type: YTN; PAM sequence: CTG
caaccattaactcgtcattt

SEQ ID NO: 296900 - DNA, 20 bp, Artificial Sequence
  Description of Artificial Sequence: Synthetic oligonucleotide
  Target: ATXN1; (+) strand; PAM type: YTN; PAM sequence: TTA
actcgtcatttagcattagg

SEQ ID NO: 296901 - DNA, 20 bp, Artificial Sequence
  Description of Artificial Sequence: Synthetic oligonucleotide
  Target: ATXN1; (+) strand; PAM type: YTN; PAM sequence: CTC
gtcatttagcattaggtata

SEQ ID NO: 296902 - DNA, 20 bp, Artificial Sequence
  Description of Artificial Sequence: Synthetic oligonucleotide
  Target: ATXN1; (+) strand; PAM type: YTN; PAM sequence: TTT
agcattaggtatatctccta

SEQ ID NO: 296903 - DNA, 20 bp, Artificial Sequence
  Description of Artificial Sequence: Synthetic oligonucleotide
  Target: ATXN1; (+) strand; PAM type: YTN; PAM sequence: TTA
gcattaggtatatctcctaa

SEQ ID NO: 296904 - DNA, 20 bp, Artificial Sequence
  Description of Artificial Sequence: Synthetic oligonucleotide
  Target: ATXN1; (+) strand; PAM type: YTN; PAM sequence: TTA
ggtatatctcctaatgctat

SEQ ID NO: 296905 - DNA, 20 bp, Artificial Sequence
  Description of Artificial Sequence: Synthetic oligonucleotide
  Target: ATXN1; (+) strand; PAM type: YTN; PAM sequence: CTC
ctaatgctatccctcccccc

SEQ ID NO: 296906 - DNA, 20 bp, Artificial Sequence
  Description of Artificial Sequence: Synthetic oligonucleotide
  Target: ATXN1; (+) strand; PAM type: YTN; PAM sequence: CTA
atgctatccctcccccctcc

SEQ ID NO: 296907 - DNA, 20 bp, Artificial Sequence
  Description of Artificial Sequence: Synthetic oligonucleotide
  Target: ATXN1; (+) strand; PAM type: YTN; PAM sequence: CTA
tccctcccccctcccccaac

SEQ ID NO: 296908 - DNA, 20 bp, Artificial Sequence
  Description of Artificial Sequence: Synthetic oligonucleotide
  Target: ATXN1; (+) strand; PAM type: YTN; PAM sequence: CTC
ccccctcccccaaccccaca

SEQ ID NO: 296909 - DNA, 20 bp, Artificial Sequence
  Description of Artificial Sequence: Synthetic oligonucleotide
  Target: ATXN1; (+) strand; PAM type: YTN; PAM sequence: CTC
ccccaaccccacaacaggcc

SEQ ID NO: 296910 - DNA, 20 bp, Artificial Sequence
  Description of Artificial Sequence: Synthetic oligonucleotide
  Target: ATXN1; (+) strand; PAM type: YTN; PAM sequence: TTC
cccttcctgtgtccatggaa

SEQ ID NO: 296911 - DNA, 20 bp, Artificial Sequence
  Description of Artificial Sequence: Synthetic oligonucleotide
  Target: ATXN1; (+) strand; PAM type: YTN; PAM sequence: CTT
cctgtgtccatggaacacag

SEQ ID NO: 296912 - DNA, 20 bp, Artificial Sequence
  Description of Artificial Sequence: Synthetic oligonucleotide
  Target: ATXN1; (+) strand; PAM type: YTN; PAM sequence: TTC
ctgtgtccatggaacacagg

SEQ ID NO: 296913 - DNA, 20 bp, Artificial Sequence
  Description of Artificial Sequence: Synthetic oligonucleotide
  Target: ATXN1; (+) strand; PAM type: YTN; PAM sequence: CTG
tgtccatggaacacaggcat

SEQ ID NO: 296914 - DNA, 20 bp, Artificial Sequence
  Description of Artificial Sequence: Synthetic oligonucleotide
  Target: ATXN1; (+) strand; PAM type: YTN; PAM sequence: TTT
ttaacgttgattttattttt

SEQ ID NO: 296915 - DNA, 20 bp, Artificial Sequence
  Description of Artificial Sequence: Synthetic oligonucleotide
  Target: ATXN1; (+) strand; PAM type: YTN; PAM sequence: TTT
taacgttgattttattttta

SEQ ID NO: 296916 - DNA, 20 bp, Artificial Sequence
  Description of Artificial Sequence: Synthetic oligonucleotide
  Target: ATXN1; (+) strand; PAM type: YTN; PAM sequence: TTT
aacgttgattttatttttaa

SEQ ID NO: 296917 - DNA, 20 bp, Artificial Sequence
  Description of Artificial Sequence: Synthetic oligonucleotide
  Target: ATXN1; (+) strand; PAM type: YTN; PAM sequence: TTA
acgttgattttatttttaaa

SEQ ID NO: 296918 - DNA, 20 bp, Artificial Sequence
  Description of Artificial Sequence: Synthetic oligonucleotide
  Target: ATXN1; (+) strand; PAM type: YTN; PAM sequence: TTG
attttatttttaaacatctt

SEQ ID NO: 296919 - DNA, 20 bp, Artificial Sequence
  Description of Artificial Sequence: Synthetic oligonucleotide
  Target: ATXN1; (+) strand; PAM type: YTN; PAM sequence: TTT
tatttttaaacatcttgcct

SEQ ID NO: 296920 - DNA, 20 bp, Artificial Sequence
  Description of Artificial Sequence: Synthetic oligonucleotide
  Target: ATXN1; (+) strand; PAM type: YTN; PAM sequence: TTT
atttttaaacatcttgcctt

SEQ ID NO: 296921 - DNA, 20 bp, Artificial Sequence
  Description of Artificial Sequence: Synthetic oligonucleotide
  Target: ATXN1; (+) strand; PAM type: YTN; PAM sequence: TTA
tttttaaacatcttgccttt

SEQ ID NO: 296922 - DNA, 20 bp, Artificial Sequence
  Description of Artificial Sequence: Synthetic oligonucleotide
  Target: ATXN1; (+) strand; PAM type: YTN; PAM sequence: TTT
ttaaacatcttgccttttgg

SEQ ID NO: 296923 - DNA, 20 bp, Artificial Sequence
  Description of Artificial Sequence: Synthetic oligonucleotide
  Target: ATXN1; (+) strand; PAM type: YTN; PAM sequence: TTT
taaacatcttgccttttggt

SEQ ID NO: 296924 - DNA, 20 bp, Artificial Sequence
  Description of Artificial Sequence: Synthetic oligonucleotide
  Target: ATXN1; (+) strand; PAM type: YTN; PAM sequence: TTT
aaacatcttgccttttggtc

SEQ ID NO: 296925 - DNA, 20 bp, Artificial Sequence
  Description of Artificial Sequence: Synthetic oligonucleotide
  Target: ATXN1; (+) strand; PAM type: YTN; PAM sequence: TTA
aacatcttgccttttggtct

SEQ ID NO: 296926 - DNA, 20 bp, Artificial Sequence
  Description of Artificial Sequence: Synthetic oligonucleotide
  Target: ATXN1; (+) strand; PAM type: YTN; PAM sequence: CTT
gccttttggtcttgagagtc

SEQ ID NO: 296927 - DNA, 20 bp, Artificial Sequence
  Description of Artificial Sequence: Synthetic oligonucleotide
  Target: ATXN1; (+) strand; PAM type: YTN; PAM sequence: TTG
ccttttggtcttgagagtca

SEQ ID NO: 296928 - DNA, 20 bp, Artificial Sequence
  Description of Artificial Sequence: Synthetic oligonucleotide
  Target: ATXN1; (+) strand; PAM type: YTN; PAM sequence: CTT
ttggtcttgagagtcaagat

SEQ ID NO: 296929 - DNA, 20 bp, Artificial Sequence
  Description of Artificial Sequence: Synthetic oligonucleotide
  Target: ATXN1; (+) strand; PAM type: YTN; PAM sequence: TTT
tggtcttgagagtcaagata

SEQ ID NO: 296930 - DNA, 20 bp, Artificial Sequence
  Description of Artificial Sequence: Synthetic oligonucleotide
  Target: ATXN1; (+) strand; PAM type: YTN; PAM sequence: TTT
ggtcttgagagtcaagatat

SEQ ID NO: 296931 - DNA, 20 bp, Artificial Sequence
  Description of Artificial Sequence: Synthetic oligonucleotide
  Target: ATXN1; (+) strand; PAM type: YTN; PAM sequence: TTG
gtcttgagagtcaagatatt

SEQ ID NO: 296932 - DNA, 20 bp, Artificial Sequence
  Description of Artificial Sequence: Synthetic oligonucleotide
  Target: ATXN1; (+) strand; PAM type: YTN; PAM sequence: CTT
gagagtcaagatattagcca

SEQ ID NO: 296933 - DNA, 20 bp, Artificial Sequence
  Description of Artificial Sequence: Synthetic oligonucleotide
  Target: ATXN1; (+) strand; PAM type: YTN; PAM sequence: TTG
agagtcaagatattagccat

SEQ ID NO: 296934 - DNA, 20 bp, Artificial Sequence
  Description of Artificial Sequence: Synthetic oligonucleotide
  Target: ATXN1; (+) strand; PAM type: YTN; PAM sequence: TTA
gccatgtaattgaaccagaa

SEQ ID NO: 296935 - DNA, 20 bp, Artificial Sequence
  Description of Artificial Sequence: Synthetic oligonucleotide
  Target: ATXN1; (+) strand; PAM type: YTN; PAM sequence: TTG
aaccagaagctttagatatt

SEQ ID NO: 296936 - DNA, 20 bp, Artificial Sequence
  Description of Artificial Sequence: Synthetic oligonucleotide
  Target: ATXN1; (+) strand; PAM type: YTN; PAM sequence: CTT
tagatattattaaagagaac

SEQ ID NO: 296937 - DNA, 20 bp, Artificial Sequence
  Description of Artificial Sequence: Synthetic oligonucleotide
  Target: ATXN1; (+) strand; PAM type: YTN; PAM sequence: TTT
agatattattaaagagaaca

SEQ ID NO: 296938 - DNA, 20 bp, Artificial Sequence
  Description of Artificial Sequence: Synthetic oligonucleotide
  Target: ATXN1; (+) strand; PAM type: YTN; PAM sequence: TTA
gatattattaaagagaacag

SEQ ID NO: 296939 - DNA, 20 bp, Artificial Sequence
  Description of Artificial Sequence: Synthetic oligonucleotide
  Target: ATXN1; (+) strand; PAM type: YTN; PAM sequence: TTA
ttaaagagaacaggagtcta

SEQ ID NO: 296940 - DNA, 20 bp, Artificial Sequence
  Description of Artificial Sequence: Synthetic oligonucleotide
  Target: ATXN1; (+) strand; PAM type: YTN; PAM sequence: TTA
aagagaacaggagtctatag

SEQ ID NO: 296941 - DNA, 20 bp, Artificial Sequence
  Description of Artificial Sequence: Synthetic oligonucleotide
  Target: ATXN1; (+) strand; PAM type: YTN; PAM sequence: CTA
tagagttcagccaagggtgc

SEQ ID NO: 296942 - DNA, 20 bp, Artificial Sequence
  Description of Artificial Sequence: Synthetic oligonucleotide
  Target: ATXN1; (+) strand; PAM type: YTN; PAM sequence: TTC
agccaagggtgcccactgag

SEQ ID NO: 296943 - DNA, 20 bp, Artificial Sequence
  Description of Artificial Sequence: Synthetic oligonucleotide
  Target: ATXN1; (+) strand; PAM type: YTN; PAM sequence: CTG
agaagctccatgctagttta

SEQ ID NO: 296944 - DNA, 20 bp, Artificial Sequence
  Description of Artificial Sequence: Synthetic oligonucleotide
  Target: ATXN1; (+) strand; PAM type: YTN; PAM sequence: CTC
catgctagtttatttgtgac

SEQ ID NO: 296945 - DNA, 20 bp, Artificial Sequence
  Description of Artificial Sequence: Synthetic oligonucleotide
  Target: ATXN1; (+) strand; PAM type: YTN; PAM sequence: CTA
gtttatttgtgactttctca

SEQ ID NO: 296946 - DNA, 20 bp, Artificial Sequence
  Description of Artificial Sequence: Synthetic oligonucleotide
  Target: ATXN1; (+) strand; PAM type: YTN; PAM sequence: TTT
atttgtgactttctcaggga

SEQ ID NO: 296947 - DNA, 20 bp, Artificial Sequence
  Description of Artificial Sequence: Synthetic oligonucleotide
  Target: ATXN1; (+) strand; PAM type: YTN; PAM sequence: TTA
tttgtgactttctcagggaa

SEQ ID NO: 296948 - DNA, 20 bp, Artificial Sequence
  Description of Artificial Sequence: Synthetic oligonucleotide
  Target: ATXN1; (+) strand; PAM type: YTN; PAM sequence: TTT
gtgactttctcagggaagag

SEQ ID NO: 296949 - DNA, 20 bp, Artificial Sequence
  Description of Artificial Sequence: Synthetic oligonucleotide
  Target: ATXN1; (+) strand; PAM type: YTN; PAM sequence: TTG
tgactttctcagggaagaga

SEQ ID NO: 296950 - DNA, 20 bp, Artificial Sequence
  Description of Artificial Sequence: Synthetic oligonucleotide
  Target: ATXN1; (+) strand; PAM type: YTN; PAM sequence: CTT
tctcagggaagagaattagg

SEQ ID NO: 296951 - DNA, 20 bp, Artificial Sequence
  Description of Artificial Sequence: Synthetic oligonucleotide
  Target: ATXN1; (+) strand; PAM type: YTN; PAM sequence: TTT
ctcagggaagagaattaggt

SEQ ID NO: 296952 - DNA, 20 bp, Artificial Sequence
  Description of Artificial Sequence: Synthetic oligonucleotide
  Target: ATXN1; (+) strand; PAM type: YTN; PAM sequence: TTC
tcagggaagagaattaggtc

SEQ ID NO: 296953 - DNA, 20 bp, Artificial Sequence
  Description of Artificial Sequence: Synthetic oligonucleotide
  Target: ATXN1; (+) strand; PAM type: YTN; PAM sequence: CTC
agggaagagaattaggtctg

SEQ ID NO: 296954 - DNA, 20 bp, Artificial Sequence
  Description of Artificial Sequence: Synthetic oligonucleotide
  Target: ATXN1; (+) strand; PAM type: YTN; PAM sequence: TTA
ggtctgtcctactgcaaact

SEQ ID NO: 296955 - DNA, 20 bp, Artificial Sequence
  Description of Artificial Sequence: Synthetic oligonucleotide
  Target: ATXN1; (+) strand; PAM type: YTN; PAM sequence: CTG
tcctactgcaaactgaaata

SEQ ID NO: 296956 - DNA, 20 bp, Artificial Sequence
  Description of Artificial Sequence: Synthetic oligonucleotide
  Target: ATXN1; (+) strand; PAM type: YTN; PAM sequence: CTA
ctgcaaactgaaatagaata

SEQ ID NO: 296957 - DNA, 20 bp, Artificial Sequence
  Description of Artificial Sequence: Synthetic oligonucleotide
  Target: ATXN1; (+) strand; PAM type: YTN; PAM sequence: CTG
caaactgaaatagaataaag

SEQ ID NO: 296958 - DNA, 20 bp, Artificial Sequence
  Description of Artificial Sequence: Synthetic oligonucleotide
  Target: ATXN1; (+) strand; PAM type: YTN; PAM sequence: CTG
aaatagaataaagtaggata

SEQ ID NO: 296959 - DNA, 20 bp, Artificial Sequence
  Description of Artificial Sequence: Synthetic oligonucleotide
  Target: ATXN1; (+) strand; PAM type: YTN; PAM sequence: CTA
actcttggcaaaaaattctc

SEQ ID NO: 296960 - DNA, 20 bp, Artificial Sequence
  Description of Artificial Sequence: Synthetic oligonucleotide
  Target: ATXN1; (+) strand; PAM type: YTN; PAM sequence: CTC
ttggcaaaaaattctcagcc

SEQ ID NO: 296961 - DNA, 20 bp, Artificial Sequence
  Description of Artificial Sequence: Synthetic oligonucleotide
  Target: ATXN1; (+) strand; PAM type: YTN; PAM sequence: CTT
ggcaaaaaattctcagccat

SEQ ID NO: 296962 - DNA, 20 bp, Artificial Sequence
  Description of Artificial Sequence: Synthetic oligonucleotide
  Target: ATXN1; (+) strand; PAM type: YTN; PAM sequence: TTG
gcaaaaaattctcagccatt

SEQ ID NO: 296963 - DNA, 20 bp, Artificial Sequence
  Description of Artificial Sequence: Synthetic oligonucleotide
  Target: ATXN1; (+) strand; PAM type: YTN; PAM sequence: TTC
tcagccattcttaatgacat

SEQ ID NO: 296964 - DNA, 20 bp, Artificial Sequence
  Description of Artificial Sequence: Synthetic oligonucleotide
  Target: ATXN1; (+) strand; PAM type: YTN; PAM sequence: CTC
agccattcttaatgacatcc

SEQ ID NO: 296965 - DNA, 20 bp, Artificial Sequence
  Description of Artificial Sequence: Synthetic oligonucleotide
  Target: ATXN1; (+) strand; PAM type: YTN; PAM sequence: TTC
ttaatgacatccatacctcc

SEQ ID NO: 296966 - DNA, 20 bp, Artificial Sequence
  Description of Artificial Sequence: Synthetic oligonucleotide
  Target: ATXN1; (+) strand; PAM type: YTN; PAM sequence: CTT
aatgacatccatacctccag

SEQ ID NO: 296967 - DNA, 20 bp, Artificial Sequence
  Description of Artificial Sequence: Synthetic oligonucleotide
  Target: ATXN1; (+) strand; PAM type: YTN; PAM sequence: TTA
atgacatccatacctccagt

SEQ ID NO: 296968 - DNA, 20 bp, Artificial Sequence
  Description of Artificial Sequence: Synthetic oligonucleotide
  Target: ATXN1; (+) strand; PAM type: YTN; PAM sequence: CTC
cagttccatgccctgttcaa

SEQ ID NO: 296969 - DNA, 20 bp, Artificial Sequence
  Description of Artificial Sequence: Synthetic oligonucleotide
  Target: ATXN1; (+) strand; PAM type: YTN; PAM sequence: TTC
catgccctgttcaagcattt

SEQ ID NO: 296970 - DNA, 20 bp, Artificial Sequence
  Description of Artificial Sequence: Synthetic oligonucleotide
  Target: ATXN1; (+) strand; PAM type: YTN; PAM sequence: CTG
ttcaagcatttcgtatacct

SEQ ID NO: 296971 - DNA, 20 bp, Artificial Sequence
  Description of Artificial Sequence: Synthetic oligonucleotide
  Target: ATXN1; (+) strand; PAM type: YTN; PAM sequence: TTC
aagcatttcgtatacctctg

SEQ ID NO: 296972 - DNA, 20 bp, Artificial Sequence
  Description of Artificial Sequence: Synthetic oligonucleotide
  Target: ATXN1; (+) strand; PAM type: YTN; PAM sequence: TTT
cgtatacctctgttttcagt

SEQ ID NO: 296973 - DNA, 20 bp, Artificial Sequence
  Description of Artificial Sequence: Synthetic oligonucleotide
  Target: ATXN1; (+) strand; PAM type: YTN; PAM sequence: TTC
gtatacctctgttttcagta

SEQ ID NO: 296974 - DNA, 20 bp, Artificial Sequence
  Description of Artificial Sequence: Synthetic oligonucleotide
  Target: ATXN1; (+) strand; PAM type: YTN; PAM sequence: CTC
tgttttcagtaggaatgcca

SEQ ID NO: 296975 - DNA, 20 bp, Artificial Sequence
  Description of Artificial Sequence: Synthetic oligonucleotide
  Target: ATXN1; (+) strand; PAM type: YTN; PAM sequence: CTG
ttttcagtaggaatgccaca

SEQ ID NO: 296976 - DNA, 20 bp, Artificial Sequence
  Description of Artificial Sequence: Synthetic oligonucleotide
  Target: ATXN1; (+) strand; PAM type: YTN; PAM sequence: TTT
tcagtaggaatgccacaaac

SEQ ID NO: 296977 - DNA, 20 bp, Artificial Sequence
  Description of Artificial Sequence: Synthetic oligonucleotide
  Target: ATXN1; (+) strand; PAM type: YTN; PAM sequence: TTT
cagtaggaatgccacaaact

SEQ ID NO: 296978 - DNA, 20 bp, Artificial Sequence
  Description of Artificial Sequence: Synthetic oligonucleotide
  Target: ATXN1; (+) strand; PAM type: YTN; PAM sequence: TTC
agtaggaatgccacaaactg

SEQ ID NO: 296979 - DNA, 20 bp, Artificial Sequence
  Description of Artificial Sequence: Synthetic oligonucleotide
  Target: ATXN1; (+) strand; PAM type: YTN; PAM sequence: CTG
gtatggagcttttattattt

SEQ ID NO: 296980 - DNA, 20 bp, Artificial Sequence
  Description of Artificial Sequence: Synthetic oligonucleotide
  Target: ATXN1; (+) strand; PAM type: YTN; PAM sequence: CTT
ttattattttattttatttt

SEQ ID NO: 296981 - DNA, 20 bp, Artificial Sequence
  Description of Artificial Sequence: Synthetic oligonucleotide
  Target: ATXN1; (+) strand; PAM type: YTN; PAM sequence: TTT
tattattttattttattttt

SEQ ID NO: 296982 - DNA, 20 bp, Artificial Sequence
  Description of Artificial Sequence: Synthetic oligonucleotide
  Target: ATXN1; (+) strand; PAM type: YTN; PAM sequence: TTT
attattttattttatttttt

SEQ ID NO: 296983 - DNA, 20 bp, Artificial Sequence
  Description of Artificial Sequence: Synthetic oligonucleotide
  Target: ATXN1; (+) strand; PAM type: YTN; PAM sequence: TTA
ttattttattttatttttta

SEQ ID NO: 296984 - DNA, 20 bp, Artificial Sequence
  Description of Artificial Sequence: Synthetic oligonucleotide
  Target: ATXN1; (+) strand; PAM type: YTN; PAM sequence: TTA
ttttattttattttttattt

SEQ ID NO: 296985 - DNA, 20 bp, Artificial Sequence
  Description of Artificial Sequence: Synthetic oligonucleotide
  Target: ATXN1; (+) strand; PAM type: YTN; PAM sequence: TTT
tattttattttttattttat

SEQ ID NO: 296986 - DNA, 20 bp, Artificial Sequence
  Description of Artificial Sequence: Synthetic oligonucleotide
  Target: ATXN1; (+) strand; PAM type: YTN; PAM sequence: TTT
attttattttttattttatt

SEQ ID NO: 296987 - DNA, 20 bp, Artificial Sequence
  Description of Artificial Sequence: Synthetic oligonucleotide
  Target: ATXN1; (+) strand; PAM type: YTN; PAM sequence: TTA
ttttattttttattttattt

SEQ ID NO: 296988 - DNA, 20 bp, Artificial Sequence
  Description of Artificial Sequence: Synthetic oligonucleotide
  Target: ATXN1; (+) strand; PAM type: YTN; PAM sequence: TTT
tattttttattttattttat

SEQ ID NO: 296989 - DNA, 20 bp, Artificial Sequence
  Description of Artificial Sequence: Synthetic oligonucleotide
  Target: ATXN1; (+) strand; PAM type: YTN; PAM sequence: TTT
attttttattttattttatt

SEQ ID NO: 296990 - DNA, 20 bp, Artificial Sequence
  Description of Artificial Sequence: Synthetic oligonucleotide
  Target: ATXN1; (+) strand; PAM type: YTN; PAM sequence: TTA
ttttttattttattttattt

SEQ ID NO: 296991 - DNA, 20 bp, Artificial Sequence
  Description of Artificial Sequence: Synthetic oligonucleotide
  Target: ATXN1; (+) strand; PAM type: YTN; PAM sequence: TTT
tttattttattttattttat

SEQ ID NO: 296992 - DNA, 20 bp, Artificial Sequence
  Description of Artificial Sequence: Synthetic oligonucleotide
  Target: ATXN1; (+) strand; PAM type: YTN; PAM sequence: TTT
ttattttattttattttatt

SEQ ID NO: 296993 - DNA, 20 bp, Artificial Sequence
  Description of Artificial Sequence: Synthetic oligonucleotide
  Target: ATXN1; (+) strand; PAM type: YTN; PAM sequence: TTT
tattttattttattttattt

SEQ ID NO: 296994 - DNA, 20 bp, Artificial Sequence
  Description of Artificial Sequence: Synthetic oligonucleotide
  Target: ATXN1; (+) strand; PAM type: YTN; PAM sequence: TTT
attttattttattttattta

SEQ ID NO: 296995 - DNA, 20 bp, Artificial Sequence
  Description of Artificial Sequence: Synthetic oligonucleotide
  Target: ATXN1; (+) strand; PAM type: YTN; PAM sequence: TTA
ttttattttattttatttac

SEQ ID NO: 296996 - DNA, 20 bp, Artificial Sequence
  Description of Artificial Sequence: Synthetic oligonucleotide
  Target: ATXN1; (+) strand; PAM type: YTN; PAM sequence: TTT
tattttattttatttacttt

SEQ ID NO: 296997 - DNA, 20 bp, Artificial Sequence
  Description of Artificial Sequence: Synthetic oligonucleotide
  Target: ATXN1; (+) strand; PAM type: YTN; PAM sequence: TTT
attttattttatttacttta

SEQ ID NO: 296998 - DNA, 20 bp, Artificial Sequence
  Description of Artificial Sequence: Synthetic oligonucleotide
  Target: ATXN1; (+) strand; PAM type: YTN; PAM sequence: TTA
ttttattttatttactttat

SEQ ID NO: 296999 - DNA, 20 bp, Artificial Sequence
  Description of Artificial Sequence: Synthetic oligonucleotide
  Target: ATXN1; (+) strand; PAM type: YTN; PAM sequence: TTT
tattttatttactttatttt

SEQ ID NO: 297000 - DNA, 20 bp, Artificial Sequence
  Description of Artificial Sequence: Synthetic oligonucleotide
  Target: ATXN1; (+) strand; PAM type: YTN; PAM sequence: TTT
attttatttactttatttta

SEQ ID NO: 297001 - DNA, 20 bp, Artificial Sequence
  Description of Artificial Sequence: Synthetic oligonucleotide
  Target: ATXN1; (+) strand; PAM type: YTN; PAM sequence: TTA
ttttatttactttattttat

SEQ ID NO: 297002 - DNA, 20 bp, Artificial Sequence
  Description of Artificial Sequence: Synthetic oligonucleotide
  Target: ATXN1; (+) strand; PAM type: YTN; PAM sequence: TTT
tatttactttattttatttt

SEQ ID NO: 297003 - DNA, 20 bp, Artificial Sequence
  Description of Artificial Sequence: Synthetic oligonucleotide
  Target: ATXN1; (+) strand; PAM type: YTN; PAM sequence: TTT
atttactttattttattttg

SEQ ID NO: 297004 - DNA, 20 bp, Artificial Sequence
  Description of Artificial Sequence: Synthetic oligonucleotide
  Target: ATXN1; (+) strand; PAM type: YTN; PAM sequence: TTA
tttactttattttattttga

SEQ ID NO: 297005 - DNA, 20 bp, Artificial Sequence
  Description of Artificial Sequence: Synthetic oligonucleotide
  Target: ATXN1; (+) strand; PAM type: YTN; PAM sequence: TTT
actttattttattttgagat

SEQ ID NO: 297006 - DNA, 20 bp, Artificial Sequence
  Description of Artificial Sequence: Synthetic oligonucleotide
  Target: ATXN1; (+) strand; PAM type: YTN; PAM sequence: TTA
ctttattttattttgagata

SEQ ID NO: 297007 - DNA, 20 bp, Artificial Sequence
  Description of Artificial Sequence: Synthetic oligonucleotide
  Target: ATXN1; (+) strand; PAM type: YTN; PAM sequence: CTT
tattttattttgagataggg

SEQ ID NO: 297008 - DNA, 20 bp, Artificial Sequence
  Description of Artificial Sequence: Synthetic oligonucleotide
  Target: ATXN1; (+) strand; PAM type: YTN; PAM sequence: TTT
attttattttgagatagggg

SEQ ID NO: 297009 - DNA, 20 bp, Artificial Sequence
  Description of Artificial Sequence: Synthetic oligonucleotide
  Target: ATXN1; (+) strand; PAM type: YTN; PAM sequence: TTA
ttttattttgagataggggt

SEQ ID NO: 297010 - DNA, 20 bp, Artificial Sequence
  Description of Artificial Sequence: Synthetic oligonucleotide
  Target: ATXN1; (+) strand; PAM type: YTN; PAM sequence: TTT
tattttgagataggggtcta

SEQ ID NO: 297011 - DNA, 20 bp, Artificial Sequence
  Description of Artificial Sequence: Synthetic oligonucleotide
  Target: ATXN1; (+) strand; PAM type: YTN; PAM sequence: TTT
attttgagataggggtctat

SEQ ID NO: 297012 - DNA, 20 bp, Artificial Sequence
  Description of Artificial Sequence: Synthetic oligonucleotide
  Target: ATXN1; (+) strand; PAM type: YTN; PAM sequence: TTA
ttttgagataggggtctatg

SEQ ID NO: 297013 - DNA, 20 bp, Artificial Sequence
  Description of Artificial Sequence: Synthetic oligonucleotide
  Target: ATXN1; (+) strand; PAM type: YTN; PAM sequence: TTT
tgagataggggtctatgttg

SEQ ID NO: 297014 - DNA, 20 bp, Artificial Sequence
  Description of Artificial Sequence: Synthetic oligonucleotide
  Target: ATXN1; (+) strand; PAM type: YTN; PAM sequence: TTT
gagataggggtctatgttgc

SEQ ID NO: 297015 - DNA, 20 bp, Artificial Sequence
  Description of Artificial Sequence: Synthetic oligonucleotide
  Target: ATXN1; (+) strand; PAM type: YTN; PAM sequence: TTG
agataggggtctatgttgcc

SEQ ID NO: 297016 - DNA, 20 bp, Artificial Sequence
  Description of Artificial Sequence: Synthetic oligonucleotide
  Target: ATXN1; (+) strand; PAM type: YTN; PAM sequence: CTA
tgttgcccagtctggtcttg

SEQ ID NO: 297017 - DNA, 20 bp, Artificial Sequence
  Description of Artificial Sequence: Synthetic oligonucleotide
  Target: ATXN1; (+) strand; PAM type: YTN; PAM sequence: TTG
cccagtctggtcttgaactc

SEQ ID NO: 297018 - DNA, 20 bp, Artificial Sequence
  Description of Artificial Sequence: Synthetic oligonucleotide
  Target: ATXN1; (+) strand; PAM type: YTN; PAM sequence: CTG
gtcttgaactcctggcctca

SEQ ID NO: 297019 - DNA, 20 bp, Artificial Sequence
  Description of Artificial Sequence: Synthetic oligonucleotide
  Target: ATXN1; (+) strand; PAM type: YTN; PAM sequence: CTT
gaactcctggcctcaagcaa

SEQ ID NO: 297020 - DNA, 20 bp, Artificial Sequence
  Description of Artificial Sequence: Synthetic oligonucleotide
  Target: ATXN1; (+) strand; PAM type: YTN; PAM sequence: TTG
aactcctggcctcaagcaat

SEQ ID NO: 297021 - DNA, 20 bp, Artificial Sequence
  Description of Artificial Sequence: Synthetic oligonucleotide
  Target: ATXN1; (+) strand; PAM type: YTN; PAM sequence: CTC
ctggcctcaagcaatcctcc

SEQ ID NO: 297022 - DNA, 20 bp, Artificial Sequence
  Description of Artificial Sequence: Synthetic oligonucleotide
  Target: ATXN1; (+) strand; PAM type: YTN; PAM sequence: CTG
gcctcaagcaatcctcccac

SEQ ID NO: 297023 - DNA, 20 bp, Artificial Sequence
  Description of Artificial Sequence: Synthetic oligonucleotide
  Target: ATXN1; (+) strand; PAM type: YTN; PAM sequence: CTC
aagcaatcctcccaccttgg

SEQ ID NO: 297024 - DNA, 20 bp, Artificial Sequence
  Description of Artificial Sequence: Synthetic oligonucleotide
  Target: ATXN1; (+) strand; PAM type: YTN; PAM sequence: CTC
ccaccttggcctcctgggta

SEQ ID NO: 297025 - DNA, 20 bp, Artificial Sequence
  Description of Artificial Sequence: Synthetic oligonucleotide
  Target: ATXN1; (+) strand; PAM type: YTN; PAM sequence: CTT
ggcctcctgggtaaggatct

SEQ ID NO: 297026 - DNA, 20 bp, Artificial Sequence
  Description of Artificial Sequence: Synthetic oligonucleotide
  Target: ATXN1; (+) strand; PAM type: YTN; PAM sequence: TTG
gcctcctgggtaaggatctt

SEQ ID NO: 297027 - DNA, 20 bp, Artificial Sequence
  Description of Artificial Sequence: Synthetic oligonucleotide
  Target: ATXN1; (+) strand; PAM type: YTN; PAM sequence: CTC
ctgggtaaggatctttgtaa

SEQ ID NO: 297028 - DNA, 20 bp, Artificial Sequence
  Description of Artificial Sequence: Synthetic oligonucleotide
  Target: ATXN1; (+) strand; PAM type: YTN; PAM sequence: CTG
ggtaaggatctttgtaatga

SEQ ID NO: 297029 - DNA, 20 bp, Artificial Sequence
  Description of Artificial Sequence: Synthetic oligonucleotide
  Target: ATXN1; (+) strand; PAM type: YTN; PAM sequence: CTT
tgtaatgaatattattattt

SEQ ID NO: 297030 - DNA, 20 bp, Artificial Sequence
  Description of Artificial Sequence: Synthetic oligonucleotide
  Target: ATXN1; (+) strand; PAM type: YTN; PAM sequence: TTT
gtaatgaatattattatttg

SEQ ID NO: 297031 - DNA, 20 bp, Artificial Sequence
  Description of Artificial Sequence: Synthetic oligonucleotide
  Target: ATXN1; (+) strand; PAM type: YTN; PAM sequence: TTG
taatgaatattattatttgg

SEQ ID NO: 297032 - DNA, 20 bp, Artificial Sequence
  Description of Artificial Sequence: Synthetic oligonucleotide
  Target: ATXN1; (+) strand; PAM type: YTN; PAM sequence: TTA
ttatttggatgacagactgc

SEQ ID NO: 297033 - DNA, 20 bp, Artificial Sequence
  Description of Artificial Sequence: Synthetic oligonucleotide
  Target: ATXN1; (+) strand; PAM type: YTN; PAM sequence: TTA
tttggatgacagactgcagg

SEQ ID NO: 297034 - DNA, 20 bp, Artificial Sequence
  Description of Artificial Sequence: Synthetic oligonucleotide
  Target: ATXN1; (+) strand; PAM type: YTN; PAM sequence: TTT
ggatgacagactgcaggaag

SEQ ID NO: 297035 - DNA, 20 bp, Artificial Sequence
  Description of Artificial Sequence: Synthetic oligonucleotide
  Target: ATXN1; (+) strand; PAM type: YTN; PAM sequence: TTG
gatgacagactgcaggaagc

SEQ ID NO: 297036 - DNA, 20 bp, Artificial Sequence
  Description of Artificial Sequence: Synthetic oligonucleotide
  Target: ATXN1; (+) strand; PAM type: YTN; PAM sequence: CTG
caggaagcccagaatccacc

SEQ ID NO: 297037 - DNA, 20 bp, Artificial Sequence
  Description of Artificial Sequence: Synthetic oligonucleotide
  Target: ATXN1; (+) strand; PAM type: YTN; PAM sequence: TTT
tcttggcatcataattactc

SEQ ID NO: 297038 - DNA, 20 bp, Artificial Sequence
  Description of Artificial Sequence: Synthetic oligonucleotide
  Target: ATXN1; (+) strand; PAM type: YTN; PAM sequence: TTT
cttggcatcataattactct

SEQ ID NO: 297039 - DNA, 20 bp, Artificial Sequence
  Description of Artificial Sequence: Synthetic oligonucleotide
  Target: ATXN1; (+) strand; PAM type: YTN; PAM sequence: TTC
ttggcatcataattactctt

SEQ ID NO: 297040 - DNA, 20 bp, Artificial Sequence
  Description of Artificial Sequence: Synthetic oligonucleotide
  Target: ATXN1; (+) strand; PAM type: YTN; PAM sequence: CTT
ggcatcataattactctttg

SEQ ID NO: 297041 - DNA, 20 bp, Artificial Sequence
  Description of Artificial Sequence: Synthetic oligonucleotide
  Target: ATXN1; (+) strand; PAM type: YTN; PAM sequence: TTG
gcatcataattactctttga

SEQ ID NO: 297042 - DNA, 20 bp, Artificial Sequence
  Description of Artificial Sequence: Synthetic oligonucleotide
  Target: ATXN1; (+) strand; PAM type: YTN; PAM sequence: TTA
ctctttgagaaattgtgctg

SEQ ID NO: 297043 - DNA, 20 bp, Artificial Sequence
  Description of Artificial Sequence: Synthetic oligonucleotide
  Target: ATXN1; (+) strand; PAM type: YTN; PAM sequence: CTC
tttgagaaattgtgctgtac

SEQ ID NO: 297044 - DNA, 20 bp, Artificial Sequence
  Description of Artificial Sequence: Synthetic oligonucleotide
  Target: ATXN1; (+) strand; PAM type: YTN; PAM sequence: CTT
tgagaaattgtgctgtacac

SEQ ID NO: 297045 - DNA, 20 bp, Artificial Sequence
  Description of Artificial Sequence: Synthetic oligonucleotide
  Target: ATXN1; (+) strand; PAM type: YTN; PAM sequence: TTT
gagaaattgtgctgtacact

SEQ ID NO: 297046 - DNA, 20 bp, Artificial Sequence
  Description of Artificial Sequence: Synthetic oligonucleotide
  Target: ATXN1; (+) strand; PAM type: YTN; PAM sequence: TTG
agaaattgtgctgtacactt

SEQ ID NO: 297047 - DNA, 20 bp, Artificial Sequence
  Description of Artificial Sequence: Synthetic oligonucleotide
  Target: ATXN1; (+) strand; PAM type: YTN; PAM sequence: TTG
tgctgtacactttgtataaa

SEQ ID NO: 297048 - DNA, 20 bp, Artificial Sequence
  Description of Artificial Sequence: Synthetic oligonucleotide
  Target: ATXN1; (+) strand; PAM type: YTN; PAM sequence: CTG
tacactttgtataaaatgag

SEQ ID NO: 297049 - DNA, 20 bp, Artificial Sequence
  Description of Artificial Sequence: Synthetic oligonucleotide
  Target: ATXN1; (+) strand; PAM type: YTN; PAM sequence: CTT
tgtataaaatgagagcatgt

SEQ ID NO: 297050 - DNA, 20 bp, Artificial Sequence
  Description of Artificial Sequence: Synthetic oligonucleotide
  Target: ATXN1; (+) strand; PAM type: YTN; PAM sequence: TTT
gtataaaatgagagcatgta

SEQ ID NO: 297051 - DNA, 20 bp, Artificial Sequence
  Description of Artificial Sequence: Synthetic oligonucleotide
  Target: ATXN1; (+) strand; PAM type: YTN; PAM sequence: TTG
tataaaatgagagcatgtaa

SEQ ID NO: 297052 - DNA, 20 bp, Artificial Sequence
  Description of Artificial Sequence: Synthetic oligonucleotide
  Target: ATXN1; (+) strand; PAM type: YTN; PAM sequence: CTC
ccatagtatgtcaaactcac

SEQ ID NO: 297053 - DNA, 20 bp, Artificial Sequence
  Description of Artificial Sequence: Synthetic oligonucleotide
  Target: ATXN1; (+) strand; PAM type: YTN; PAM sequence: CTC
acgaggcatttccttctcct

SEQ ID NO: 297054 - DNA, 20 bp, Artificial Sequence
  Description of Artificial Sequence: Synthetic oligonucleotide
  Target: ATXN1; (+) strand; PAM type: YTN; PAM sequence: TTT
ccttctcctccaaaccctcc

SEQ ID NO: 297055 - DNA, 20 bp, Artificial Sequence
  Description of Artificial Sequence: Synthetic oligonucleotide
  Target: ATXN1; (+) strand; PAM type: YTN; PAM sequence: TTC
cttctcctccaaaccctcct

SEQ ID NO: 297056 - DNA, 20 bp, Artificial Sequence
  Description of Artificial Sequence: Synthetic oligonucleotide
  Target: ATXN1; (+) strand; PAM type: YTN; PAM sequence: CTT
ctcctccaaaccctcctttc

SEQ ID NO: 297057 - DNA, 20 bp, Artificial Sequence
  Description of Artificial Sequence: Synthetic oligonucleotide
  Target: ATXN1; (+) strand; PAM type: YTN; PAM sequence: TTC
tcctccaaaccctcctttct

SEQ ID NO: 297058 - DNA, 20 bp, Artificial Sequence
  Description of Artificial Sequence: Synthetic oligonucleotide
  Target: ATXN1; (+) strand; PAM type: YTN; PAM sequence: CTC
ctccaaaccctcctttctct

SEQ ID NO: 297059 - DNA, 20 bp, Artificial Sequence
  Description of Artificial Sequence: Synthetic oligonucleotide
  Target: ATXN1; (+) strand; PAM type: YTN; PAM sequence: CTC
caaaccctcctttctctcag

SEQ ID NO: 297060 - DNA, 20 bp, Artificial Sequence
  Description of Artificial Sequence: Synthetic oligonucleotide
  Target: ATXN1; (+) strand; PAM type: YTN; PAM sequence: CTC
ctttctctcagacaaaccaa

SEQ ID NO: 297061 - DNA, 20 bp, Artificial Sequence
  Description of Artificial Sequence: Synthetic oligonucleotide
  Target: ATXN1; (+) strand; PAM type: YTN; PAM sequence: CTT
tctctcagacaaaccaagta

SEQ ID NO: 297062 - DNA, 20 bp, Artificial Sequence
  Description of Artificial Sequence: Synthetic oligonucleotide
  Target: ATXN1; (+) strand; PAM type: YTN; PAM sequence: TTT
ctctcagacaaaccaagtaa

SEQ ID NO: 297063 - DNA, 20 bp, Artificial Sequence
  Description of Artificial Sequence: Synthetic oligonucleotide
  Target: ATXN1; (+) strand; PAM type: YTN; PAM sequence: TTC
tctcagacaaaccaagtaat

SEQ ID NO: 297064 - DNA, 20 bp, Artificial Sequence
  Description of Artificial Sequence: Synthetic oligonucleotide
  Target: ATXN1; (+) strand; PAM type: YTN; PAM sequence: CTC
tcagacaaaccaagtaattg

SEQ ID NO: 297065 - DNA, 20 bp, Artificial Sequence
  Description of Artificial Sequence: Synthetic oligonucleotide
  Target: ATXN1; (+) strand; PAM type: YTN; PAM sequence: CTC
agacaaaccaagtaattgaa

SEQ ID NO: 297066 - DNA, 20 bp, Artificial Sequence
  Description of Artificial Sequence: Synthetic oligonucleotide
  Target: ATXN1; (+) strand; PAM type: YTN; PAM sequence: TTG
aagacatgtattttcaagga

SEQ ID NO: 297067 - DNA, 20 bp, Artificial Sequence
  Description of Artificial Sequence: Synthetic oligonucleotide
  Target: ATXN1; (+) strand; PAM type: YTN; PAM sequence: TTT
tcaaggaacatggctaagag

SEQ ID NO: 297068 - DNA, 20 bp, Artificial Sequence
  Description of Artificial Sequence: Synthetic oligonucleotide
  Target: ATXN1; (+) strand; PAM type: YTN; PAM sequence: TTT
caaggaacatggctaagagc

SEQ ID NO: 297069 - DNA, 20 bp, Artificial Sequence
  Description of Artificial Sequence: Synthetic oligonucleotide
  Target: ATXN1; (+) strand; PAM type: YTN; PAM sequence: TTC
aaggaacatggctaagagca

SEQ ID NO: 297070 - DNA, 20 bp, Artificial Sequence
  Description of Artificial Sequence: Synthetic oligonucleotide
  Target: ATXN1; (+) strand; PAM type: YTN; PAM sequence: CTA
agagcagactgtttctttac

SEQ ID NO: 297071 - DNA, 20 bp, Artificial Sequence
  Description of Artificial Sequence: Synthetic oligonucleotide
  Target: ATXN1; (+) strand; PAM type: YTN; PAM sequence: CTG
tttctttaccacatcaaact

SEQ ID NO: 297072 - DNA, 20 bp, Artificial Sequence
  Description of Artificial Sequence: Synthetic oligonucleotide
  Target: ATXN1; (+) strand; PAM type: YTN; PAM sequence: TTT
ctttaccacatcaaacttct

SEQ ID NO: 297073 - DNA, 20 bp, Artificial Sequence
  Description of Artificial Sequence: Synthetic oligonucleotide
  Target: ATXN1; (+) strand; PAM type: YTN; PAM sequence: TTC
tttaccacatcaaacttctg

SEQ ID NO: 297074 - DNA, 20 bp, Artificial Sequence
  Description of Artificial Sequence: Synthetic oligonucleotide
  Target: ATXN1; (+) strand; PAM type: YTN; PAM sequence: CTT
taccacatcaaacttctgtg

SEQ ID NO: 297075 - DNA, 20 bp, Artificial Sequence
  Description of Artificial Sequence: Synthetic oligonucleotide
  Target: ATXN1; (+) strand; PAM type: YTN; PAM sequence: TTT
accacatcaaacttctgtgc

SEQ ID NO: 297076 - DNA, 20 bp, Artificial Sequence
  Description of Artificial Sequence: Synthetic oligonucleotide
  Target: ATXN1; (+) strand; PAM type: YTN; PAM sequence: TTA
ccacatcaaacttctgtgca

SEQ ID NO: 297077 - DNA, 20 bp, Artificial Sequence
  Description of Artificial Sequence: Synthetic oligonucleotide
  Target: ATXN1; (+) strand; PAM type: YTN; PAM sequence: CTT
ctgtgcagaagttaagaaag

SEQ ID NO: 297078 - DNA, 20 bp, Artificial Sequence
  Description of Artificial Sequence: Synthetic oligonucleotide
  Target: ATXN1; (+) strand; PAM type: YTN; PAM sequence: TTC
tgtgcagaagttaagaaagg

SEQ ID NO: 297079 - DNA, 20 bp, Artificial Sequence
  Description of Artificial Sequence: Synthetic oligonucleotide
  Target: ATXN1; (+) strand; PAM type: YTN; PAM sequence: CTG
tgcagaagttaagaaaggag

SEQ ID NO: 297080 - DNA, 20 bp, Artificial Sequence
  Description of Artificial Sequence: Synthetic oligonucleotide
  Target: ATXN1; (+) strand; PAM type: YTN; PAM sequence: TTA
agaaaggagaatcactctaa

SEQ ID NO: 297081 - DNA, 20 bp, Artificial Sequence
  Description of Artificial Sequence: Synthetic oligonucleotide
  Target: ATXN1; (+) strand; PAM type: YTN; PAM sequence: CTC
taatgcttattcctaatgac

SEQ ID NO: 297082 - DNA, 20 bp, Artificial Sequence
  Description of Artificial Sequence: Synthetic oligonucleotide
  Target: ATXN1; (+) strand; PAM type: YTN; PAM sequence: CTA
atgcttattcctaatgactg

SEQ ID NO: 297083 - DNA, 20 bp, Artificial Sequence
  Description of Artificial Sequence: Synthetic oligonucleotide
  Target: ATXN1; (+) strand; PAM type: YTN; PAM sequence: CTT
attcctaatgactgtgatag

SEQ ID NO: 297084 - DNA, 20 bp, Artificial Sequence
  Description of Artificial Sequence: Synthetic oligonucleotide
  Target: ATXN1; (+) strand; PAM type: YTN; PAM sequence: TTA
ttcctaatgactgtgataga

SEQ ID NO: 297085 - DNA, 20 bp, Artificial Sequence
  Description of Artificial Sequence: Synthetic oligonucleotide
  Target: ATXN1; (+) strand; PAM type: YTN; PAM sequence: TTC
ctaatgactgtgatagactt

SEQ ID NO: 297086 - DNA, 20 bp, Artificial Sequence
  Description of Artificial Sequence: Synthetic oligonucleotide
  Target: ATXN1; (+) strand; PAM type: YTN; PAM sequence: CTA
atgactgtgatagactttct

SEQ ID NO: 297087 - DNA, 20 bp, Artificial Sequence
  Description of Artificial Sequence: Synthetic oligonucleotide
  Target: ATXN1; (+) strand; PAM type: YTN; PAM sequence: CTG
tgatagactttctgccttga

SEQ ID NO: 297088 - DNA, 20 bp, Artificial Sequence
  Description of Artificial Sequence: Synthetic oligonucleotide
  Target: ATXN1; (+) strand; PAM type: YTN; PAM sequence: CTT
tctgccttgaatggtgcatt

SEQ ID NO: 297089 - DNA, 20 bp, Artificial Sequence
  Description of Artificial Sequence: Synthetic oligonucleotide
  Target: ATXN1; (+) strand; PAM type: YTN; PAM sequence: TTT
ctgccttgaatggtgcattt

SEQ ID NO: 297090 - DNA, 20 bp, Artificial Sequence
  Description of Artificial Sequence: Synthetic oligonucleotide
  Target: ATXN1; (+) strand; PAM type: YTN; PAM sequence: TTC
tgccttgaatggtgcatttc

SEQ ID NO: 297091 - DNA, 20 bp, Artificial Sequence
  Description of Artificial Sequence: Synthetic oligonucleotide
  Target: ATXN1; (+) strand; PAM type: YTN; PAM sequence: CTG
ccttgaatggtgcatttcca

SEQ ID NO: 297092 - DNA, 20 bp, Artificial Sequence
  Description of Artificial Sequence: Synthetic oligonucleotide
  Target: ATXN1; (+) strand; PAM type: YTN; PAM sequence: CTT
gaatggtgcatttccatttg

SEQ ID NO: 297093 - DNA, 20 bp, Artificial Sequence
  Description of Artificial Sequence: Synthetic oligonucleotide
  Target: ATXN1; (+) strand; PAM type: YTN; PAM sequence: TTG
aatggtgcatttccatttgt

SEQ ID NO: 297094 - DNA, 20 bp, Artificial Sequence
  Description of Artificial Sequence: Synthetic oligonucleotide
  Target: ATXN1; (+) strand; PAM type: YTN; PAM sequence: TTT
ccatttgtaagctccattta

SEQ ID NO: 297095 - DNA, 20 bp, Artificial Sequence
  Description of Artificial Sequence: Synthetic oligonucleotide
  Target: ATXN1; (+) strand; PAM type: YTN; PAM sequence: TTC
catttgtaagctccatttat

SEQ ID NO: 297096 - DNA, 20 bp, Artificial Sequence
  Description of Artificial Sequence: Synthetic oligonucleotide
  Target: ATXN1; (+) strand; PAM type: YTN; PAM sequence: TTT
gtaagctccatttatagaat

SEQ ID NO: 297097 - DNA, 20 bp, Artificial Sequence
  Description of Artificial Sequence: Synthetic oligonucleotide
  Target: ATXN1; (+) strand; PAM type: YTN; PAM sequence: TTG
taagctccatttatagaatc

SEQ ID NO: 297098 - DNA, 20 bp, Artificial Sequence
  Description of Artificial Sequence: Synthetic oligonucleotide
  Target: ATXN1; (+) strand; PAM type: YTN; PAM sequence: CTC
catttatagaatcacacaag

SEQ ID NO: 297099 - DNA, 20 bp, Artificial Sequence
  Description of Artificial Sequence: Synthetic oligonucleotide
  Target: ATXN1; (+) strand; PAM type: YTN; PAM sequence: TTT
atagaatcacacaagttttt

SEQ ID NO: 297100 - DNA, 20 bp, Artificial Sequence
  Description of Artificial Sequence: Synthetic oligonucleotide
  Target: ATXN1; (+) strand; PAM type: YTN; PAM sequence: TTA
tagaatcacacaagtttttg

SEQ ID NO: 297101 - DNA, 20 bp, Artificial Sequence
  Description of Artificial Sequence: Synthetic oligonucleotide
  Target: ATXN1; (+) strand; PAM type: YTN; PAM sequence: TTT
ttgccttcctctgaaaccta

SEQ ID NO: 297102 - DNA, 20 bp, Artificial Sequence
  Description of Artificial Sequence: Synthetic oligonucleotide
  Target: ATXN1; (+) strand; PAM type: YTN; PAM sequence: TTT
tgccttcctctgaaacctaa

SEQ ID NO: 297103 - DNA, 20 bp, Artificial Sequence
  Description of Artificial Sequence: Synthetic oligonucleotide
  Target: ATXN1; (+) strand; PAM type: YTN; PAM sequence: TTT
gccttcctctgaaacctaac

SEQ ID NO: 297104 - DNA, 20 bp, Artificial Sequence
  Description of Artificial Sequence: Synthetic oligonucleotide
  Target: ATXN1; (+) strand; PAM type: YTN; PAM sequence: TTG
ccttcctctgaaacctaaca

SEQ ID NO: 297105 - DNA, 20 bp, Artificial Sequence
  Description of Artificial Sequence: Synthetic oligonucleotide
  Target: ATXN1; (+) strand; PAM type: YTN; PAM sequence: CTT
cctctgaaacctaacaccct

SEQ ID NO: 297106 - DNA, 20 bp, Artificial Sequence
  Description of Artificial Sequence: Synthetic oligonucleotide
  Target: ATXN1; (+) strand; PAM type: YTN; PAM sequence: TTC
ctctgaaacctaacaccctg

SEQ ID NO: 297107 - DNA, 20 bp, Artificial Sequence
  Description of Artificial Sequence: Synthetic oligonucleotide
  Target: ATXN1; (+) strand; PAM type: YTN; PAM sequence: CTC
tgaaacctaacaccctgatc

SEQ ID NO: 297108 - DNA, 20 bp, Artificial Sequence
  Description of Artificial Sequence: Synthetic oligonucleotide
  Target: ATXN1; (+) strand; PAM type: YTN; PAM sequence: CTG
aaacctaacaccctgatctt

SEQ ID NO: 297109 - DNA, 20 bp, Artificial Sequence
  Description of Artificial Sequence: Synthetic oligonucleotide
  Target: ATXN1; (+) strand; PAM type: YTN; PAM sequence: CTA
acaccctgatcttacccttt

SEQ ID NO: 297110 - DNA, 20 bp, Artificial Sequence
  Description of Artificial Sequence: Synthetic oligonucleotide
  Target: ATXN1; (+) strand; PAM type: YTN; PAM sequence: CTG
atcttacccttttttgtata

SEQ ID NO: 297111 - DNA, 20 bp, Artificial Sequence
  Description of Artificial Sequence: Synthetic oligonucleotide
  Target: ATXN1; (+) strand; PAM type: YTN; PAM sequence: CTT
acccttttttgtatacatca

SEQ ID NO: 297112 - DNA, 20 bp, Artificial Sequence
  Description of Artificial Sequence: Synthetic oligonucleotide
  Target: ATXN1; (+) strand; PAM type: YTN; PAM sequence: TTA
cccttttttgtatacatcac

SEQ ID NO: 297113 - DNA, 20 bp, Artificial Sequence
  Description of Artificial Sequence: Synthetic oligonucleotide
  Target: ATXN1; (+) strand; PAM type: YTN; PAM sequence: CTT
ttttgtatacatcactcttg

SEQ ID NO: 297114 - DNA, 20 bp, Artificial Sequence
  Description of Artificial Sequence: Synthetic oligonucleotide
  Target: ATXN1; (+) strand; PAM type: YTN; PAM sequence: TTT
tttgtatacatcactcttgg

SEQ ID NO: 297115 - DNA, 20 bp, Artificial Sequence
  Description of Artificial Sequence: Synthetic oligonucleotide
  Target: ATXN1; (+) strand; PAM type: YTN; PAM sequence: TTT
ttgtatacatcactcttggt

SEQ ID NO: 297116 - DNA, 20 bp, Artificial Sequence
  Description of Artificial Sequence: Synthetic oligonucleotide
  Target: ATXN1; (+) strand; PAM type: YTN; PAM sequence: TTT
tgtatacatcactcttggtg

SEQ ID NO: 297117 - DNA, 20 bp, Artificial Sequence
  Description of Artificial Sequence: Synthetic oligonucleotide
  Target: ATXN1; (+) strand; PAM type: YTN; PAM sequence: TTT
gtatacatcactcttggtgg

SEQ ID NO: 297118 - DNA, 20 bp, Artificial Sequence
  Description of Artificial Sequence: Synthetic oligonucleotide
  Target: ATXN1; (+) strand; PAM type: YTN; PAM sequence: TTG
tatacatcactcttggtgga

SEQ ID NO: 297119 - DNA, 20 bp, Artificial Sequence
  Description of Artificial Sequence: Synthetic oligonucleotide
  Target: ATXN1; (+) strand; PAM type: YTN; PAM sequence: CTC
ttggtggaaattttcaacaa

SEQ ID NO: 297120 - DNA, 20 bp, Artificial Sequence
  Description of Artificial Sequence: Synthetic oligonucleotide
  Target: ATXN1; (+) strand; PAM type: YTN; PAM sequence: CTT
ggtggaaattttcaacaacc

SEQ ID NO: 297121 - DNA, 20 bp, Artificial Sequence
  Description of Artificial Sequence: Synthetic oligonucleotide
  Target: ATXN1; (+) strand; PAM type: YTN; PAM sequence: TTG
gtggaaattttcaacaacca

SEQ ID NO: 297122 - DNA, 20 bp, Artificial Sequence
  Description of Artificial Sequence: Synthetic oligonucleotide
  Target: ATXN1; (+) strand; PAM type: YTN; PAM sequence: TTT
tcaacaaccacaaaggtggg

SEQ ID NO: 297123 - DNA, 20 bp, Artificial Sequence
  Description of Artificial Sequence: Synthetic oligonucleotide
  Target: ATXN1; (+) strand; PAM type: YTN; PAM sequence: TTT
caacaaccacaaaggtgggg

SEQ ID NO: 297124 - DNA, 20 bp, Artificial Sequence
  Description of Artificial Sequence: Synthetic oligonucleotide
  Target: ATXN1; (+) strand; PAM type: YTN; PAM sequence: TTC
aacaaccacaaaggtggggg

SEQ ID NO: 297125 - DNA, 20 bp, Artificial Sequence
  Description of Artificial Sequence: Synthetic oligonucleotide
  Target: ATXN1; (+) strand; PAM type: YTN; PAM sequence: CTG
actccttagtcatgtttcct

SEQ ID NO: 297126 - DNA, 20 bp, Artificial Sequence
  Description of Artificial Sequence: Synthetic oligonucleotide
  Target: ATXN1; (+) strand; PAM type: YTN; PAM sequence: CTC
cttagtcatgtttcctgatg

SEQ ID NO: 297127 - DNA, 20 bp, Artificial Sequence
  Description of Artificial Sequence: Synthetic oligonucleotide
  Target: ATXN1; (+) strand; PAM type: YTN; PAM sequence: CTT
agtcatgtttcctgatgttg

SEQ ID NO: 297128 - DNA, 20 bp, Artificial Sequence
  Description of Artificial Sequence: Synthetic oligonucleotide
  Target: ATXN1; (+) strand; PAM type: YTN; PAM sequence: TTA
gtcatgtttcctgatgttgc

SEQ ID NO: 297129 - DNA, 20 bp, Artificial Sequence
  Description of Artificial Sequence: Synthetic oligonucleotide
  Target: ATXN1; (+) strand; PAM type: YTN; PAM sequence: TTT
cctgatgttgccattttagt

SEQ ID NO: 297130 - DNA, 20 bp, Artificial Sequence
  Description of Artificial Sequence: Synthetic oligonucleotide
  Target: ATXN1; (+) strand; PAM type: YTN; PAM sequence: TTC
ctgatgttgccattttagtg

SEQ ID NO: 297131 - DNA, 20 bp, Artificial Sequence
  Description of Artificial Sequence: Synthetic oligonucleotide
  Target: ATXN1; (+) strand; PAM type: YTN; PAM sequence: CTG
atgttgccattttagtgtat

SEQ ID NO: 297132 - DNA, 20 bp, Artificial Sequence
  Description of Artificial Sequence: Synthetic oligonucleotide
  Target: ATXN1; (+) strand; PAM type: YTN; PAM sequence: TTG
ccattttagtgtattttaag

SEQ ID NO: 297133 - DNA, 20 bp, Artificial Sequence
  Description of Artificial Sequence: Synthetic oligonucleotide
  Target: ATXN1; (+) strand; PAM type: YTN; PAM sequence: TTT
tagtgtattttaagtattta

SEQ ID NO: 297134 - DNA, 20 bp, Artificial Sequence
  Description of Artificial Sequence: Synthetic oligonucleotide
  Target: ATXN1; (+) strand; PAM type: YTN; PAM sequence: TTT
agtgtattttaagtatttac

SEQ ID NO: 297135 - DNA, 20 bp, Artificial Sequence
  Description of Artificial Sequence: Synthetic oligonucleotide
  Target: ATXN1; (+) strand; PAM type: YTN; PAM sequence: TTA
gtgtattttaagtatttact

SEQ ID NO: 297136 - DNA, 20 bp, Artificial Sequence
  Description of Artificial Sequence: Synthetic oligonucleotide
  Target: ATXN1; (+) strand; PAM type: YTN; PAM sequence: TTT
taagtatttacttatggcaa

SEQ ID NO: 297137 - DNA, 20 bp, Artificial Sequence
  Description of Artificial Sequence: Synthetic oligonucleotide
  Target: ATXN1; (+) strand; PAM type: YTN; PAM sequence: TTT
aagtatttacttatggcaac

SEQ ID NO: 297138 - DNA, 20 bp, Artificial Sequence
  Description of Artificial Sequence: Synthetic oligonucleotide
  Target: ATXN1; (+) strand; PAM type: YTN; PAM sequence: TTA
agtatttacttatggcaaca

SEQ ID NO: 297139 - DNA, 20 bp, Artificial Sequence
  Description of Artificial Sequence: Synthetic oligonucleotide
  Target: ATXN1; (+) strand; PAM type: YTN; PAM sequence: TTT
acttatggcaacaattatag

SEQ ID NO: 297140 - DNA, 20 bp, Artificial Sequence
  Description of Artificial Sequence: Synthetic oligonucleotide
  Target: ATXN1; (+) strand; PAM type: YTN; PAM sequence: TTA
cttatggcaacaattatagt

SEQ ID NO: 297141 - DNA, 20 bp, Artificial Sequence
  Description of Artificial Sequence: Synthetic oligonucleotide
  Target: ATXN1; (+) strand; PAM type: YTN; PAM sequence: CTT
atggcaacaattatagttca

SEQ ID NO: 297142 - DNA, 20 bp, Artificial Sequence
  Description of Artificial Sequence: Synthetic oligonucleotide
  Target: ATXN1; (+) strand; PAM type: YTN; PAM sequence: TTA
tggcaacaattatagttcac

SEQ ID NO: 297143 - DNA, 20 bp, Artificial Sequence
  Description of Artificial Sequence: Synthetic oligonucleotide
  Target: ATXN1; (+) strand; PAM type: YTN; PAM sequence: TTA
tagttcacaaagcactgttc

SEQ ID NO: 297144 - DNA, 20 bp, Artificial Sequence
  Description of Artificial Sequence: Synthetic oligonucleotide
  Target: ATXN1; (+) strand; PAM type: YTN; PAM sequence: TTC
acaaagcactgttctctttt

SEQ ID NO: 297145 - DNA, 20 bp, Artificial Sequence
  Description of Artificial Sequence: Synthetic oligonucleotide
  Target: ATXN1; (+) strand; PAM type: YTN; PAM sequence: CTG
ttctctttttccatccggca

SEQ ID NO: 297146 - DNA, 20 bp, Artificial Sequence
  Description of Artificial Sequence: Synthetic oligonucleotide
  Target: ATXN1; (+) strand; PAM type: YTN; PAM sequence: TTC
tctttttccatccggcagac

SEQ ID NO: 297147 - DNA, 20 bp, Artificial Sequence
  Description of Artificial Sequence: Synthetic oligonucleotide
  Target: ATXN1; (+) strand; PAM type: YTN; PAM sequence: CTC
tttttccatccggcagaccc

SEQ ID NO: 297148 - DNA, 20 bp, Artificial Sequence
  Description of Artificial Sequence: Synthetic oligonucleotide
  Target: ATXN1; (+) strand; PAM type: YTN; PAM sequence: CTT
tttccatccggcagaccccc

SEQ ID NO: 297149 - DNA, 20 bp, Artificial Sequence
  Description of Artificial Sequence: Synthetic oligonucleotide
  Target: ATXN1; (+) strand; PAM type: YTN; PAM sequence: TTT
ttccatccggcagaccccct

SEQ ID NO: 297150 - DNA, 20 bp, Artificial Sequence
  Description of Artificial Sequence: Synthetic oligonucleotide
  Target: ATXN1; (+) strand; PAM type: YTN; PAM sequence: TTT
tccatccggcagaccccctt

SEQ ID NO: 297151 - DNA, 20 bp, Artificial Sequence
  Description of Artificial Sequence: Synthetic oligonucleotide
  Target: ATXN1; (+) strand; PAM type: YTN; PAM sequence: TTT
ccatccggcagacccccttg

SEQ ID NO: 297152 - DNA, 20 bp, Artificial Sequence
  Description of Artificial Sequence: Synthetic oligonucleotide
  Target: ATXN1; (+) strand; PAM type: YTN; PAM sequence: TTC
catccggcagacccccttgg

SEQ ID NO: 297153 - DNA, 20 bp, Artificial Sequence
  Description of Artificial Sequence: Synthetic oligonucleotide
  Target: ATXN1; (+) strand; PAM type: YTN; PAM sequence: CTT
ggtgtgctctactacaaaag

SEQ ID NO: 297154 - DNA, 20 bp, Artificial Sequence
  Description of Artificial Sequence: Synthetic oligonucleotide
  Target: ATXN1; (+) strand; PAM type: YTN; PAM sequence: TTG
gtgtgctctactacaaaagg

SEQ ID NO: 297155 - DNA, 20 bp, Artificial Sequence
  Description of Artificial Sequence: Synthetic oligonucleotide
  Target: ATXN1; (+) strand; PAM type: YTN; PAM sequence: CTC
tactacaaaaggcagttttc

SEQ ID NO: 297156 - DNA, 20 bp, Artificial Sequence
  Description of Artificial Sequence: Synthetic oligonucleotide
  Target: ATXN1; (+) strand; PAM type: YTN; PAM sequence: CTA
ctacaaaaggcagttttctg

SEQ ID NO: 297157 - DNA, 20 bp, Artificial Sequence
  Description of Artificial Sequence: Synthetic oligonucleotide
  Target: ATXN1; (+) strand; PAM type: YTN; PAM sequence: CTA
caaaaggcagttttctgaat

SEQ ID NO: 297158 - DNA, 20 bp, Artificial Sequence
  Description of Artificial Sequence: Synthetic oligonucleotide
  Target: ATXN1; (+) strand; PAM type: YTN; PAM sequence: TTT
tctgaatcactgctattaat

SEQ ID NO: 297159 - DNA, 20 bp, Artificial Sequence
  Description of Artificial Sequence: Synthetic oligonucleotide
  Target: ATXN1; (+) strand; PAM type: YTN; PAM sequence: TTT
ctgaatcactgctattaatc

SEQ ID NO: 297160 - DNA, 20 bp, Artificial Sequence
  Description of Artificial Sequence: Synthetic oligonucleotide
  Target: ATXN1; (+) strand; PAM type: YTN; PAM sequence: TTC
tgaatcactgctattaatca

SEQ ID NO: 297161 - DNA, 20 bp, Artificial Sequence
  Description of Artificial Sequence: Synthetic oligonucleotide
  Target: ATXN1; (+) strand; PAM type: YTN; PAM sequence: CTG
aatcactgctattaatcagt

SEQ ID NO: 297162 - DNA, 20 bp, Artificial Sequence
  Description of Artificial Sequence: Synthetic oligonucleotide
  Target: ATXN1; (+) strand; PAM type: YTN; PAM sequence: CTG
ctattaatcagtaaagaatt

SEQ ID NO: 297163 - DNA, 20 bp, Artificial Sequence
  Description of Artificial Sequence: Synthetic oligonucleotide
  Target: ATXN1; (+) strand; PAM type: YTN; PAM sequence: CTA
ttaatcagtaaagaattgat

SEQ ID NO: 297164 - DNA, 20 bp, Artificial Sequence
  Description of Artificial Sequence: Synthetic oligonucleotide
  Target: ATXN1; (+) strand; PAM type: YTN; PAM sequence: TTA
atcagtaaagaattgatgtc

SEQ ID NO: 297165 - DNA, 20 bp, Artificial Sequence
  Description of Artificial Sequence: Synthetic oligonucleotide
  Target: ATXN1; (+) strand; PAM type: YTN; PAM sequence: TTG
atgtccctatttggtgaata

SEQ ID NO: 297166 - DNA, 20 bp, Artificial Sequence
  Description of Artificial Sequence: Synthetic oligonucleotide
  Target: ATXN1; (+) strand; PAM type: YTN; PAM sequence: CTA
tttggtgaatagcaaactgc

SEQ ID NO: 297167 - DNA, 20 bp, Artificial Sequence
  Description of Artificial Sequence: Synthetic oligonucleotide
  Target: ATXN1; (+) strand; PAM type: YTN; PAM sequence: TTT
ggtgaatagcaaactgctcc

SEQ ID NO: 297168 - DNA, 20 bp, Artificial Sequence
  Description of Artificial Sequence: Synthetic oligonucleotide
  Target: ATXN1; (+) strand; PAM type: YTN; PAM sequence: TTG
gtgaatagcaaactgctcct

SEQ ID NO: 297169 - DNA, 20 bp, Artificial Sequence
  Description of Artificial Sequence: Synthetic oligonucleotide
  Target: ATXN1; (+) strand; PAM type: YTN; PAM sequence: CTG
ctcctattgctctctgaact

SEQ ID NO: 297170 - DNA, 20 bp, Artificial Sequence
  Description of Artificial Sequence: Synthetic oligonucleotide
  Target: ATXN1; (+) strand; PAM type: YTN; PAM sequence: CTC
ctattgctctctgaactgaa

SEQ ID NO: 297171 - DNA, 20 bp, Artificial Sequence
  Description of Artificial Sequence: Synthetic oligonucleotide
  Target: ATXN1; (+) strand; PAM type: YTN; PAM sequence: CTA
ttgctctctgaactgaactg

SEQ ID NO: 297172 - DNA, 20 bp, Artificial Sequence
  Description of Artificial Sequence: Synthetic oligonucleotide
  Target: ATXN1; (+) strand; PAM type: YTN; PAM sequence: TTG
ctctctgaactgaactgaac

SEQ ID NO: 297173 - DNA, 20 bp, Artificial Sequence
  Description of Artificial Sequence: Synthetic oligonucleotide
  Target: ATXN1; (+) strand; PAM type: YTN; PAM sequence: CTC
tctgaactgaactgaacaat

SEQ ID NO: 297174 - DNA, 20 bp, Artificial Sequence
  Description of Artificial Sequence: Synthetic oligonucleotide
  Target: ATXN1; (+) strand; PAM type: YTN; PAM sequence: CTC
tgaactgaactgaacaatct

SEQ ID NO: 297175 - DNA, 20 bp, Artificial Sequence
  Description of Artificial Sequence: Synthetic oligonucleotide
  Target: ATXN1; (+) strand; PAM type: YTN; PAM sequence: CTG
aactgaactgaacaatcttt

SEQ ID NO: 297176 - DNA, 20 bp, Artificial Sequence
  Description of Artificial Sequence: Synthetic oligonucleotide
  Target: ATXN1; (+) strand; PAM type: YTN; PAM sequence: CTG
aactgaacaatctttttttt

SEQ ID NO: 297177 - DNA, 20 bp, Artificial Sequence
  Description of Artificial Sequence: Synthetic oligonucleotide
  Target: ATXN1; (+) strand; PAM type: YTN; PAM sequence: CTG
aacaatcttttttttttttt

SEQ ID NO: 297178 - DNA, 20 bp, Artificial Sequence
  Description of Artificial Sequence: Synthetic oligonucleotide
  Target: ATXN1; (+) strand; PAM type: YTN; PAM sequence: CTT
tttttttttttttttttttt

SEQ ID NO: 297179 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttttta

SEQ ID NO: 297180 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttttac

SEQ ID NO: 297181 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttact

SEQ ID NO: 297182 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttactt

SEQ ID NO: 297183 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttacttt

SEQ ID NO: 297184 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttacttta

SEQ ID NO: 297185 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttactttaa

SEQ ID NO: 297186 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttactttaag

SEQ ID NO: 297187 - DNA, 20 bp, Artificial Sequence
  Description of Artificial Sequence: Synthetic oligonucleotide
  Target: ATXN1; (+) strand; PAM type: YTN; PAM sequence: TTT
tttttttttttactttaagt

SEQ ID NO: 297188 - DNA, 20 bp, Artificial Sequence
  Description of Artificial Sequence: Synthetic oligonucleotide
  Target: ATXN1; (+) strand; PAM type: YTN; PAM sequence: TTT
ttttttttttactttaagtt

SEQ ID NO: 297189 - DNA, 20 bp, Artificial Sequence
  Description of Artificial Sequence: Synthetic oligonucleotide
  Target: ATXN1; (+) strand; PAM type: YTN; PAM sequence: TTT
tttttttttactttaagttc

SEQ ID NO: 297190 - DNA, 20 bp, Artificial Sequence
  Description of Artificial Sequence: Synthetic oligonucleotide
  Target: ATXN1; (+) strand; PAM type: YTN; PAM sequence: TTT
ttttttttactttaagttct

SEQ ID NO: 297191 - DNA, 20 bp, Artificial Sequence
  Description of Artificial Sequence: Synthetic oligonucleotide
  Target: ATXN1; (+) strand; PAM type: YTN; PAM sequence: TTT
tttttttactttaagttctg

SEQ ID NO: 297192 - DNA, 20 bp, Artificial Sequence
  Description of Artificial Sequence: Synthetic oligonucleotide
  Target: ATXN1; (+) strand; PAM type: YTN; PAM sequence: TTT
ttttttactttaagttctgg

SEQ ID NO: 297193 - DNA, 20 bp, Artificial Sequence
  Description of Artificial Sequence: Synthetic oligonucleotide
  Target: ATXN1; (+) strand; PAM type: YTN; PAM sequence: TTT
tttttactttaagttctggg

SEQ ID NO: 297194 - DNA, 20 bp, Artificial Sequence
  Description of Artificial Sequence: Synthetic oligonucleotide
  Target: ATXN1; (+) strand; PAM type: YTN; PAM sequence: TTT
ttttactttaagttctggga

SEQ ID NO: 297195 - DNA, 20 bp, Artificial Sequence
  Description of Artificial Sequence: Synthetic oligonucleotide
  Target: ATXN1; (+) strand; PAM type: YTN; PAM sequence: TTT
tttactttaagttctgggac

SEQ ID NO: 297196 - DNA, 20 bp, Artificial Sequence
  Description of Artificial Sequence: Synthetic oligonucleotide
  Target: ATXN1; (+) strand; PAM type: YTN; PAM sequence: TTT
ttactttaagttctgggaca

SEQ ID NO: 297197 - DNA, 20 bp, Artificial Sequence
  Description of Artificial Sequence: Synthetic oligonucleotide
  Target: ATXN1; (+) strand; PAM type: YTN; PAM sequence: TTT
tactttaagttctgggacaa

SEQ ID NO: 297198 - DNA, 20 bp, Artificial Sequence
  Description of Artificial Sequence: Synthetic oligonucleotide
  Target: ATXN1; (+) strand; PAM type: YTN; PAM sequence: TTT
actttaagttctgggacaaa

SEQ ID NO: 297199 - DNA, 20 bp, Artificial Sequence
  Description of Artificial Sequence: Synthetic oligonucleotide
  Target: ATXN1; (+) strand; PAM type: YTN; PAM sequence: TTA
ctttaagttctgggacaaat

SEQ ID NO: 297200 - DNA, 20 bp, Artificial Sequence
  Description of Artificial Sequence: Synthetic oligonucleotide
  Target: ATXN1; (+) strand; PAM type: YTN; PAM sequence: CTT
taagttctgggacaaatgtg

SEQ ID NO: 297201 - DNA, 20 bp, Artificial Sequence
  Description of Artificial Sequence: Synthetic oligonucleotide
  Target: ATXN1; (+) strand; PAM type: YTN; PAM sequence: TTT
aagttctgggacaaatgtgc

SEQ ID NO: 297202 - DNA, 20 bp, Artificial Sequence
  Description of Artificial Sequence: Synthetic oligonucleotide
  Target: ATXN1; (+) strand; PAM type: YTN; PAM sequence: TTA
agttctgggacaaatgtgca

SEQ ID NO: 297203 - DNA, 20 bp, Artificial Sequence
  Description of Artificial Sequence: Synthetic oligonucleotide
  Target: ATXN1; (+) strand; PAM type: YTN; PAM sequence: TTC
tgggacaaatgtgcagaacg

SEQ ID NO: 297204 - DNA, 20 bp, Artificial Sequence
  Description of Artificial Sequence: Synthetic oligonucleotide
  Target: ATXN1; (+) strand; PAM type: YTN; PAM sequence: CTG
ggacaaatgtgcagaacgtg

SEQ ID NO: 297205 - DNA, 20 bp, Artificial Sequence
  Description of Artificial Sequence: Synthetic oligonucleotide
  Target: ATXN1; (+) strand; PAM type: YTN; PAM sequence: TTT
gttacataagtatacatgta

SEQ ID NO: 297206 - DNA, 20 bp, Artificial Sequence
  Description of Artificial Sequence: Synthetic oligonucleotide
  Target: ATXN1; (+) strand; PAM type: YTN; PAM sequence: TTG
ttacataagtatacatgtat

SEQ ID NO: 297207 - DNA, 20 bp, Artificial Sequence
  Description of Artificial Sequence: Synthetic oligonucleotide
  Target: ATXN1; (+) strand; PAM type: YTN; PAM sequence: TTA
cataagtatacatgtatcac

SEQ ID NO: 297208 - DNA, 20 bp, Artificial Sequence
  Description of Artificial Sequence: Synthetic oligonucleotide
  Target: ATXN1; (+) strand; PAM type: YTN; PAM sequence: TTT
gttgtacccttcaacccgtc

SEQ ID NO: 297209 - DNA, 20 bp, Artificial Sequence
  Description of Artificial Sequence: Synthetic oligonucleotide
  Target: ATXN1; (+) strand; PAM type: YTN; PAM sequence: TTG
ttgtacccttcaacccgtca

SEQ ID NO: 297210 - DNA, 20 bp, Artificial Sequence
  Description of Artificial Sequence: Synthetic oligonucleotide
  Target: ATXN1; (+) strand; PAM type: YTN; PAM sequence: TTG
tacccttcaacccgtcatct

SEQ ID NO: 297211 - DNA, 20 bp, Artificial Sequence
  Description of Artificial Sequence: Synthetic oligonucleotide
  Target: ATXN1; (+) strand; PAM type: YTN; PAM sequence: CTT
caacccgtcatctaggtttt

SEQ ID NO: 297212 - DNA, 20 bp, Artificial Sequence
  Description of Artificial Sequence: Synthetic oligonucleotide
  Target: ATXN1; (+) strand; PAM type: YTN; PAM sequence: TTC
aacccgtcatctaggtttta

SEQ ID NO: 297213 - DNA, 20 bp, Artificial Sequence
  Description of Artificial Sequence: Synthetic oligonucleotide
  Target: ATXN1; (+) strand; PAM type: YTN; PAM sequence: CTA
ggttttaagccccaaatgca

SEQ ID NO: 297214 - DNA, 20 bp, Artificial Sequence
  Description of Artificial Sequence: Synthetic oligonucleotide
  Target: ATXN1; (+) strand; PAM type: YTN; PAM sequence: TTT
taagccccaaatgcattagg

SEQ ID NO: 297215 - DNA, 20 bp, Artificial Sequence
  Description of Artificial Sequence: Synthetic oligonucleotide
  Target: ATXN1; (+) strand; PAM type: YTN; PAM sequence: TTT
aagccccaaatgcattaggt

SEQ ID NO: 297216 - DNA, 20 bp, Artificial Sequence
  Description of Artificial Sequence: Synthetic oligonucleotide
  Target: ATXN1; (+) strand; PAM type: YTN; PAM sequence: TTA
agccccaaatgcattaggta

SEQ ID NO: 297217 - DNA, 20 bp, Artificial Sequence
  Description of Artificial Sequence: Synthetic oligonucleotide
  Target: ATXN1; (+) strand; PAM type: YTN; PAM sequence: TTA
ggtatttgtccaaatggaac

SEQ ID NO: 297218 - DNA, 20 bp, Artificial Sequence
  Description of Artificial Sequence: Synthetic oligonucleotide
  Target: ATXN1; (+) strand; PAM type: YTN; PAM sequence: TTT
gtccaaatggaactcagcag

SEQ ID NO: 297219 - DNA, 20 bp, Artificial Sequence
  Description of Artificial Sequence: Synthetic oligonucleotide
  Target: ATXN1; (+) strand; PAM type: YTN; PAM sequence: TTG
tccaaatggaactcagcagt

SEQ ID NO: 297220 - DNA, 20 bp, Artificial Sequence
  Description of Artificial Sequence: Synthetic oligonucleotide
  Target: ATXN1; (+) strand; PAM type: YTN; PAM sequence: CTC
agcagtcagcaaaatatatt

SEQ ID NO: 297221 - DNA, 20 bp, Artificial Sequence
  Description of Artificial Sequence: Synthetic oligonucleotide
  Target: ATXN1; (+) strand; PAM type: YTN; PAM sequence: TTA
aatttgtcagttctagaata

SEQ ID NO: 297222 - DNA, 20 bp, Artificial Sequence
  Description of Artificial Sequence: Synthetic oligonucleotide
  Target: ATXN1; (+) strand; PAM type: YTN; PAM sequence: TTT
gtcagttctagaataactct

SEQ ID NO: 297223 - DNA, 20 bp, Artificial Sequence
  Description of Artificial Sequence: Synthetic oligonucleotide
  Target: ATXN1; (+) strand; PAM type: YTN; PAM sequence: TTG
tcagttctagaataactctt

SEQ ID NO: 297224 - DNA, 20 bp, Artificial Sequence
  Description of Artificial Sequence: Synthetic oligonucleotide
  Target: ATXN1; (+) strand; PAM type: YTN; PAM sequence: TTC
tagaataactcttgttgcct

SEQ ID NO: 297225 - DNA, 20 bp, Artificial Sequence
  Description of Artificial Sequence: Synthetic oligonucleotide
  Target: ATXN1; (+) strand; PAM type: YTN; PAM sequence: CTA
gaataactcttgttgcctac

SEQ ID NO: 297226 - DNA, 20 bp, Artificial Sequence
  Description of Artificial Sequence: Synthetic oligonucleotide
  Target: ATXN1; (+) strand; PAM type: YTN; PAM sequence: CTC
ttgttgcctacctccacatt

SEQ ID NO: 297227 - DNA, 20 bp, Artificial Sequence
  Description of Artificial Sequence: Synthetic oligonucleotide
  Target: ATXN1; (+) strand; PAM type: YTN; PAM sequence: CTT
gttgcctacctccacattca

SEQ ID NO: 297228 - DNA, 20 bp, Artificial Sequence
  Description of Artificial Sequence: Synthetic oligonucleotide
  Target: ATXN1; (+) strand; PAM type: YTN; PAM sequence: TTG
ttgcctacctccacattcac

SEQ ID NO: 297229 - DNA, 20 bp, Artificial Sequence
  Description of Artificial Sequence: Synthetic oligonucleotide
  Target: ATXN1; (+) strand; PAM type: YTN; PAM sequence: TTG
cctacctccacattcacatt

SEQ ID NO: 297230 - DNA, 20 bp, Artificial Sequence
  Description of Artificial Sequence: Synthetic oligonucleotide
  Target: ATXN1; (+) strand; PAM type: YTN; PAM sequence: CTA
cctccacattcacattggtg

SEQ ID NO: 297231 - DNA, 20 bp, Artificial Sequence
  Description of Artificial Sequence: Synthetic oligonucleotide
  Target: ATXN1; (+) strand; PAM type: YTN; PAM sequence: CTC
cacattcacattggtgatgt

SEQ ID NO: 297232 - DNA, 20 bp, Artificial Sequence
  Description of Artificial Sequence: Synthetic oligonucleotide
  Target: ATXN1; (+) strand; PAM type: YTN; PAM sequence: TTC
acattggtgatgtctactcc

SEQ ID NO: 297233 - DNA, 20 bp, Artificial Sequence
  Description of Artificial Sequence: Synthetic oligonucleotide
  Target: ATXN1; (+) strand; PAM type: YTN; PAM sequence: TTG
gtgatgtctactccctgtcc

SEQ ID NO: 297234 - DNA, 20 bp, Artificial Sequence
  Description of Artificial Sequence: Synthetic oligonucleotide
  Target: ATXN1; (+) strand; PAM type: YTN; PAM sequence: CTA
ctccctgtcctcactcctga

SEQ ID NO: 297235 - DNA, 20 bp, Artificial Sequence
  Description of Artificial Sequence: Synthetic oligonucleotide
  Target: ATXN1; (+) strand; PAM type: YTN; PAM sequence: CTC
cctgtcctcactcctgagca

SEQ ID NO: 297236 - DNA, 20 bp, Artificial Sequence
  Description of Artificial Sequence: Synthetic oligonucleotide
  Target: ATXN1; (+) strand; PAM type: YTN; PAM sequence: CTG
tcctcactcctgagcacctg

SEQ ID NO: 297237 - DNA, 20 bp, Artificial Sequence
  Description of Artificial Sequence: Synthetic oligonucleotide
  Target: ATXN1; (+) strand; PAM type: YTN; PAM sequence: CTC
actcctgagcacctgtcacc

SEQ ID NO: 297238 - DNA, 20 bp, Artificial Sequence
  Description of Artificial Sequence: Synthetic oligonucleotide
  Target: ATXN1; (+) strand; PAM type: YTN; PAM sequence: CTC
ctgagcacctgtcacctcag

SEQ ID NO: 297239 - DNA, 20 bp, Artificial Sequence
  Description of Artificial Sequence: Synthetic oligonucleotide
  Target: ATXN1; (+) strand; PAM type: YTN; PAM sequence: CTG
agcacctgtcacctcagacc

SEQ ID NO: 297240 - DNA, 20 bp, Artificial Sequence
  Description of Artificial Sequence: Synthetic oligonucleotide
  Target: ATXN1; (+) strand; PAM type: YTN; PAM sequence: CTG
tcacctcagaccacaccact

SEQ ID NO: 297241 - DNA, 20 bp, Artificial Sequence
  Description of Artificial Sequence: Synthetic oligonucleotide
  Target: ATXN1; (+) strand; PAM type: YTN; PAM sequence: CTC
agaccacaccactgaagctg

SEQ ID NO: 297242 - DNA, 20 bp, Artificial Sequence
  Description of Artificial Sequence: Synthetic oligonucleotide
  Target: ATXN1; (+) strand; PAM type: YTN; PAM sequence: CTG
aagctgaccaccccatgacc

SEQ ID NO: 297243 - DNA, 20 bp, Artificial Sequence
  Description of Artificial Sequence: Synthetic oligonucleotide
  Target: ATXN1; (+) strand; PAM type: YTN; PAM sequence: CTG
accaccccatgacccccaac

SEQ ID NO: 297244 - DNA, 20 bp, Artificial Sequence
  Description of Artificial Sequence: Synthetic oligonucleotide
  Target: ATXN1; (+) strand; PAM type: YTN; PAM sequence: CTC
agagagactcctgggtctgg

SEQ ID NO: 297245 - DNA, 20 bp, Artificial Sequence
  Description of Artificial Sequence: Synthetic oligonucleotide
  Target: ATXN1; (+) strand; PAM type: YTN; PAM sequence: CTC
ctgggtctggtcacttctgt

SEQ ID NO: 297246 - DNA, 20 bp, Artificial Sequence
  Description of Artificial Sequence: Synthetic oligonucleotide
  Target: ATXN1; (+) strand; PAM type: YTN; PAM sequence: CTG
ggtctggtcacttctgtggg

SEQ ID NO: 297247 - DNA, 20 bp, Artificial Sequence
  Description of Artificial Sequence: Synthetic oligonucleotide
  Target: ATXN1; (+) strand; PAM type: YTN; PAM sequence: CTG
gtcacttctgtgggtccact

SEQ ID NO: 297248 - DNA, 20 bp, Artificial Sequence
  Description of Artificial Sequence: Synthetic oligonucleotide
  Target: ATXN1; (+) strand; PAM type: YTN; PAM sequence: CTT
ctgtgggtccactaagcctg

SEQ ID NO: 297249 - DNA, 20 bp, Artificial Sequence
  Description of Artificial Sequence: Synthetic oligonucleotide
  Target: ATXN1; (+) strand; PAM type: YTN; PAM sequence: TTC
tgtgggtccactaagcctgt

SEQ ID NO: 297250 - DNA, 20 bp, Artificial Sequence
  Description of Artificial Sequence: Synthetic oligonucleotide
  Target: ATXN1; (+) strand; PAM type: YTN; PAM sequence: CTG
tgggtccactaagcctgttc

SEQ ID NO: 297251 - DNA, 20 bp, Artificial Sequence
  Description of Artificial Sequence: Synthetic oligonucleotide
  Target: ATXN1; (+) strand; PAM type: YTN; PAM sequence: CTA
agcctgttcctggtacccca

SEQ ID NO: 297252 - DNA, 20 bp, Artificial Sequence
  Description of Artificial Sequence: Synthetic oligonucleotide
  Target: ATXN1; (+) strand; PAM type: YTN; PAM sequence: CTG
ttcctggtaccccaatatca

SEQ ID NO: 297253 - DNA, 20 bp, Artificial Sequence
  Description of Artificial Sequence: Synthetic oligonucleotide
  Target: ATXN1; (+) strand; PAM type: YTN; PAM sequence: TTC
ctggtaccccaatatcacta

SEQ ID NO: 297254 - DNA, 20 bp, Artificial Sequence
  Description of Artificial Sequence: Synthetic oligonucleotide
  Target: ATXN1; (+) strand; PAM type: YTN; PAM sequence: CTG
gtaccccaatatcactaagt

SEQ ID NO: 297255 - DNA, 20 bp, Artificial Sequence
  Description of Artificial Sequence: Synthetic oligonucleotide
  Target: ATXN1; (+) strand; PAM type: YTN; PAM sequence: CTA
agtggcccaacttagaaata

SEQ ID NO: 297256 - DNA, 20 bp, Artificial Sequence
  Description of Artificial Sequence: Synthetic oligonucleotide
  Target: ATXN1; (+) strand; PAM type: YTN; PAM sequence: CTT
agaaatactagaatcaactc

SEQ ID NO: 297257 - DNA, 20 bp, Artificial Sequence
  Description of Artificial Sequence: Synthetic oligonucleotide
  Target: ATXN1; (+) strand; PAM type: YTN; PAM sequence: TTA
gaaatactagaatcaactcc

SEQ ID NO: 297258 - DNA, 20 bp, Artificial Sequence
  Description of Artificial Sequence: Synthetic oligonucleotide
  Target: ATXN1; (+) strand; PAM type: YTN; PAM sequence: CTA
gaatcaactcctctgccttc

SEQ ID NO: 297259 - DNA, 20 bp, Artificial Sequence
  Description of Artificial Sequence: Synthetic oligonucleotide
  Target: ATXN1; (+) strand; PAM type: YTN; PAM sequence: CTC
ctctgccttcccccttattc

SEQ ID NO: 297260 - DNA, 20 bp, Artificial Sequence
  Description of Artificial Sequence: Synthetic oligonucleotide
  Target: ATXN1; (+) strand; PAM type: YTN; PAM sequence: CTC
tgccttcccccttattccac

SEQ ID NO: 297261 - DNA, 20 bp, Artificial Sequence
  Description of Artificial Sequence: Synthetic oligonucleotide
  Target: ATXN1; (+) strand; PAM type: YTN; PAM sequence: CTG
ccttcccccttattccacag

SEQ ID NO: 297262 - DNA, 20 bp, Artificial Sequence
  Description of Artificial Sequence: Synthetic oligonucleotide
  Target: ATXN1; (+) strand; PAM type: YTN; PAM sequence: CTT
cccccttattccacaggtca

SEQ ID NO: 297263 - DNA, 20 bp, Artificial Sequence
  Description of Artificial Sequence: Synthetic oligonucleotide
  Target: ATXN1; (+) strand; PAM type: YTN; PAM sequence: TTC
ccccttattccacaggtcag

SEQ ID NO: 297264 - DNA, 20 bp, Artificial Sequence
  Description of Artificial Sequence: Synthetic oligonucleotide
  Target: ATXN1; (+) strand; PAM type: YTN; PAM sequence: CTT
attccacaggtcagcaggga

SEQ ID NO: 297265 - DNA, 20 bp, Artificial Sequence
  Description of Artificial Sequence: Synthetic oligonucleotide
  Target: ATXN1; (+) strand; PAM type: YTN; PAM sequence: TTA
ttccacaggtcagcagggac

SEQ ID NO: 297266 - DNA, 20 bp, Artificial Sequence
  Description of Artificial Sequence: Synthetic oligonucleotide
  Target: ATXN1; (+) strand; PAM type: YTN; PAM sequence: TTC
cacaggtcagcagggaccaa

SEQ ID NO: 297267 - DNA, 20 bp, Artificial Sequence
  Description of Artificial Sequence: Synthetic oligonucleotide
  Target: ATXN1; (+) strand; PAM type: YTN; PAM sequence: CTA
tcaattctatttcctggtta

SEQ ID NO: 297268 - DNA, 20 bp, Artificial Sequence
  Description of Artificial Sequence: Synthetic oligonucleotide
  Target: ATXN1; (+) strand; PAM type: YTN; PAM sequence: TTC
tatttcctggttatgctact

SEQ ID NO: 297269 - DNA, 20 bp, Artificial Sequence
  Description of Artificial Sequence: Synthetic oligonucleotide
  Target: ATXN1; (+) strand; PAM type: YTN; PAM sequence: CTA
tttcctggttatgctacttg

SEQ ID NO: 297270 - DNA, 20 bp, Artificial Sequence
  Description of Artificial Sequence: Synthetic oligonucleotide
  Target: ATXN1; (+) strand; PAM type: YTN; PAM sequence: TTT
cctggttatgctacttgaat

SEQ ID NO: 297271 - DNA, 20 bp, Artificial Sequence
  Description of Artificial Sequence: Synthetic oligonucleotide
  Target: ATXN1; (+) strand; PAM type: YTN; PAM sequence: TTC
ctggttatgctacttgaatc

SEQ ID NO: 297272 - DNA, 20 bp, Artificial Sequence
  Description of Artificial Sequence: Synthetic oligonucleotide
  Target: ATXN1; (+) strand; PAM type: YTN; PAM sequence: CTG
gttatgctacttgaatcctt

SEQ ID NO: 297273 - DNA, 20 bp, Artificial Sequence
  Description of Artificial Sequence: Synthetic oligonucleotide
  Target: ATXN1; (+) strand; PAM type: YTN; PAM sequence: TTA
tgctacttgaatccttccct

SEQ ID NO: 297274 - DNA, 20 bp, Artificial Sequence
  Description of Artificial Sequence: Synthetic oligonucleotide
  Target: ATXN1; (+) strand; PAM type: YTN; PAM sequence: CTA
cttgaatccttccctttctg

SEQ ID NO: 297275 - DNA, 20 bp, Artificial Sequence
  Description of Artificial Sequence: Synthetic oligonucleotide
  Target: ATXN1; (+) strand; PAM type: YTN; PAM sequence: CTT
gaatccttccctttctgcct

SEQ ID NO: 297276 - DNA, 20 bp, Artificial Sequence
  Description of Artificial Sequence: Synthetic oligonucleotide
  Target: ATXN1; (+) strand; PAM type: YTN; PAM sequence: TTG
aatccttccctttctgcctc

SEQ ID NO: 297277 - DNA, 20 bp, Artificial Sequence
  Description of Artificial Sequence: Synthetic oligonucleotide
  Target: ATXN1; (+) strand; PAM type: YTN; PAM sequence: CTT
ccctttctgcctctccagca

SEQ ID NO: 297278 - DNA, 20 bp, Artificial Sequence
  Description of Artificial Sequence: Synthetic oligonucleotide
  Target: ATXN1; (+) strand; PAM type: YTN; PAM sequence: TTC
cctttctgcctctccagcaa

SEQ ID NO: 297279 - DNA, 20 bp, Artificial Sequence
  Description of Artificial Sequence: Synthetic oligonucleotide
  Target: ATXN1; (+) strand; PAM type: YTN; PAM sequence: CTT
tctgcctctccagcaagtct

SEQ ID NO: 297280 - DNA, 20 bp, Artificial Sequence
  Description of Artificial Sequence: Synthetic oligonucleotide
  Target: ATXN1; (+) strand; PAM type: YTN; PAM sequence: TTT
ctgcctctccagcaagtctg

SEQ ID NO: 297281 - DNA, 20 bp, Artificial Sequence
  Description of Artificial Sequence: Synthetic oligonucleotide
  Target: ATXN1; (+) strand; PAM type: YTN; PAM sequence: TTC
tgcctctccagcaagtctgg

SEQ ID NO: 297282 - DNA, 20 bp, Artificial Sequence
  Description of Artificial Sequence: Synthetic oligonucleotide
  Target: ATXN1; (+) strand; PAM type: YTN; PAM sequence: CTG
cctctccagcaagtctggct

SEQ ID NO: 297283 - DNA, 20 bp, Artificial Sequence
  Description of Artificial Sequence: Synthetic oligonucleotide
  Target: ATXN1; (+) strand; PAM type: YTN; PAM sequence: CTC
tccagcaagtctggctctgc

SEQ ID NO: 297284 - DNA, 20 bp, Artificial Sequence
  Description of Artificial Sequence: Synthetic oligonucleotide
  Target: ATXN1; (+) strand; PAM type: YTN; PAM sequence: CTC
cagcaagtctggctctgccg

SEQ ID NO: 297285 - DNA, 20 bp, Artificial Sequence
  Description of Artificial Sequence: Synthetic oligonucleotide
  Target: ATXN1; (+) strand; PAM type: YTN; PAM sequence: CTG
gctctgccgtcactcacccc

SEQ ID NO: 297286 - DNA, 20 bp, Artificial Sequence
  Description of Artificial Sequence: Synthetic oligonucleotide
  Target: ATXN1; (+) strand; PAM type: YTN; PAM sequence: CTC
tgccgtcactcacccctcgt

SEQ ID NO: 297287 - DNA, 20 bp, Artificial Sequence
  Description of Artificial Sequence: Synthetic oligonucleotide
  Target: ATXN1; (+) strand; PAM type: YTN; PAM sequence: CTG
ccgtcactcacccctcgtgc

SEQ ID NO: 297288 - DNA, 20 bp, Artificial Sequence
  Description of Artificial Sequence: Synthetic oligonucleotide
  Target: ATXN1; (+) strand; PAM type: YTN; PAM sequence: CTC
acccctcgtgccctctcacc

SEQ ID NO: 297289 - DNA, 20 bp, Artificial Sequence
  Description of Artificial Sequence: Synthetic oligonucleotide
  Target: ATXN1; (+) strand; PAM type: YTN; PAM sequence: CTC
gtgccctctcacccagatgt

SEQ ID NO: 297290 - DNA, 20 bp, Artificial Sequence
  Description of Artificial Sequence: Synthetic oligonucleotide
  Target: ATXN1; (+) strand; PAM type: YTN; PAM sequence: CTC
tcacccagatgtctgcctgc

SEQ ID NO: 297291 - DNA, 20 bp, Artificial Sequence
  Description of Artificial Sequence: Synthetic oligonucleotide
  Target: ATXN1; (+) strand; PAM type: YTN; PAM sequence: CTC
acccagatgtctgcctgctc

SEQ ID NO: 297292 - DNA, 20 bp, Artificial Sequence
  Description of Artificial Sequence: Synthetic oligonucleotide
  Target: ATXN1; (+) strand; PAM type: YTN; PAM sequence: CTG
cctgctctcatggttctcca

SEQ ID NO: 297293 - DNA, 20 bp, Artificial Sequence
  Description of Artificial Sequence: Synthetic oligonucleotide
  Target: ATXN1; (+) strand; PAM type: YTN; PAM sequence: CTG
ctctcatggttctccaatca

SEQ ID NO: 297294 - DNA, 20 bp, Artificial Sequence
  Description of Artificial Sequence: Synthetic oligonucleotide
  Target: ATXN1; (+) strand; PAM type: YTN; PAM sequence: CTC
tcatggttctccaatcacct

SEQ ID NO: 297295 - DNA, 20 bp, Artificial Sequence
  Description of Artificial Sequence: Synthetic oligonucleotide
  Target: ATXN1; (+) strand; PAM type: YTN; PAM sequence: CTC
atggttctccaatcacctct

SEQ ID NO: 297296 - DNA, 20 bp, Artificial Sequence
  Description of Artificial Sequence: Synthetic oligonucleotide
  Target: ATXN1; (+) strand; PAM type: YTN; PAM sequence: TTC
tccaatcacctctccagaat

SEQ ID NO: 297297 - DNA, 20 bp, Artificial Sequence
  Description of Artificial Sequence: Synthetic oligonucleotide
  Target: ATXN1; (+) strand; PAM type: YTN; PAM sequence: CTC
caatcacctctccagaatgc

SEQ ID NO: 297298 - DNA, 20 bp, Artificial Sequence
  Description of Artificial Sequence: Synthetic oligonucleotide
  Target: ATXN1; (+) strand; PAM type: YTN; PAM sequence: CTC
tccagaatgccacaaaagct

SEQ ID NO: 297299 - DNA, 20 bp, Artificial Sequence
  Description of Artificial Sequence: Synthetic oligonucleotide
  Target: ATXN1; (+) strand; PAM type: YTN; PAM sequence: CTC
cagaatgccacaaaagctgg

SEQ ID NO: 297300 - DNA, 20 bp, Artificial Sequence
  Description of Artificial Sequence: Synthetic oligonucleotide
  Target: ATXN1; (+) strand; PAM type: YTN; PAM sequence: CTG
gctctagaaaatacagatct

SEQ ID NO: 297301 - DNA, 20 bp, Artificial Sequence
  Description of Artificial Sequence: Synthetic oligonucleotide
  Target: ATXN1; (+) strand; PAM type: YTN; PAM sequence: CTC
tagaaaatacagatctgatc

SEQ ID NO: 297302 - DNA, 20 bp, Artificial Sequence
  Description of Artificial Sequence: Synthetic oligonucleotide
  Target: ATXN1; (+) strand; PAM type: YTN; PAM sequence: CTA
gaaaatacagatctgatcct

SEQ ID NO: 297303 - DNA, 20 bp, Artificial Sequence
  Description of Artificial Sequence: Synthetic oligonucleotide
  Target: ATXN1; (+) strand; PAM type: YTN; PAM sequence: CTG
atccttgtactctccaaact

SEQ ID NO: 297304 - DNA, 20 bp, Artificial Sequence
  Description of Artificial Sequence: Synthetic oligonucleotide
  Target: ATXN1; (+) strand; PAM type: YTN; PAM sequence: CTT
gtactctccaaactgaaaac

SEQ ID NO: 297305 - DNA, 20 bp, Artificial Sequence
  Description of Artificial Sequence: Synthetic oligonucleotide
  Target: ATXN1; (+) strand; PAM type: YTN; PAM sequence: TTG
tactctccaaactgaaaacc

SEQ ID NO: 297306 - DNA, 20 bp, Artificial Sequence
  Description of Artificial Sequence: Synthetic oligonucleotide
  Target: ATXN1; (+) strand; PAM type: YTN; PAM sequence: CTC
tccaaactgaaaaccatggt

SEQ ID NO: 297307 - DNA, 20 bp, Artificial Sequence
  Description of Artificial Sequence: Synthetic oligonucleotide
  Target: ATXN1; (+) strand; PAM type: YTN; PAM sequence: CTC
caaactgaaaaccatggtga

SEQ ID NO: 297308 - DNA, 20 bp, Artificial Sequence
  Description of Artificial Sequence: Synthetic oligonucleotide
  Target: ATXN1; (+) strand; PAM type: YTN; PAM sequence: CTG
aaaaccatggtgactgcagt

SEQ ID NO: 297309 - DNA, 20 bp, Artificial Sequence
  Description of Artificial Sequence: Synthetic oligonucleotide
  Target: ATXN1; (+) strand; PAM type: YTN; PAM sequence: CTG
cagtatactctccaaactat

SEQ ID NO: 297310 - DNA, 20 bp, Artificial Sequence
  Description of Artificial Sequence: Synthetic oligonucleotide
  Target: ATXN1; (+) strand; PAM type: YTN; PAM sequence: CTC
tccaaactatcactaaagag

SEQ ID NO: 297311 - DNA, 20 bp, Artificial Sequence
  Description of Artificial Sequence: Synthetic oligonucleotide
  Target: ATXN1; (+) strand; PAM type: YTN; PAM sequence: CTC
caaactatcactaaagagga

SEQ ID NO: 297312 - DNA, 20 bp, Artificial Sequence
  Description of Artificial Sequence: Synthetic oligonucleotide
  Target: ATXN1; (+) strand; PAM type: YTN; PAM sequence: CTA
tcactaaagaggaaggggga

SEQ ID NO: 297313 - DNA, 20 bp, Artificial Sequence
  Description of Artificial Sequence: Synthetic oligonucleotide
  Target: ATXN1; (+) strand; PAM type: YTN; PAM sequence: CTA
aagaggaagggggatgtgaa

SEQ ID NO: 297314 - DNA, 20 bp, Artificial Sequence
  Description of Artificial Sequence: Synthetic oligonucleotide
  Target: ATXN1; (+) strand; PAM type: YTN; PAM sequence: TTA
ctctctgcgatcttcctctg

SEQ ID NO: 297315 - DNA, 20 bp, Artificial Sequence
  Description of Artificial Sequence: Synthetic oligonucleotide
  Target: ATXN1; (+) strand; PAM type: YTN; PAM sequence: CTC
tctgcgatcttcctctgtgc

SEQ ID NO: 297316 - DNA, 20 bp, Artificial Sequence
  Description of Artificial Sequence: Synthetic oligonucleotide
  Target: ATXN1; (+) strand; PAM type: YTN; PAM sequence: CTC
tgcgatcttcctctgtgcta

SEQ ID NO: 297317 - DNA, 20 bp, Artificial Sequence
  Description of Artificial Sequence: Synthetic oligonucleotide
  Target: ATXN1; (+) strand; PAM type: YTN; PAM sequence: CTG
cgatcttcctctgtgctatc

SEQ ID NO: 297318 - DNA, 20 bp, Artificial Sequence
  Description of Artificial Sequence: Synthetic oligonucleotide
  Target: ATXN1; (+) strand; PAM type: YTN; PAM sequence: CTT
cctctgtgctatcaacaagc

SEQ ID NO: 297319 - DNA, 20 bp, Artificial Sequence
  Description of Artificial Sequence: Synthetic oligonucleotide
  Target: ATXN1; (+) strand; PAM type: YTN; PAM sequence: TTC
ctctgtgctatcaacaagca

SEQ ID NO: 297320 - DNA, 20 bp, Artificial Sequence
  Description of Artificial Sequence: Synthetic oligonucleotide
  Target: ATXN1; (+) strand; PAM type: YTN; PAM sequence: CTC
tgtgctatcaacaagcaaga

SEQ ID NO: 297321 - DNA, 20 bp, Artificial Sequence
  Description of Artificial Sequence: Synthetic oligonucleotide
  Target: ATXN1; (+) strand; PAM type: YTN; PAM sequence: CTG
tgctatcaacaagcaagaaa

SEQ ID NO: 297322 - DNA, 20 bp, Artificial Sequence
  Description of Artificial Sequence: Synthetic oligonucleotide
  Target: ATXN1; (+) strand; PAM type: YTN; PAM sequence: CTA
tcaacaagcaagaaaaaaga

SEQ ID NO: 297323 - DNA, 20 bp, Artificial Sequence
  Description of Artificial Sequence: Synthetic oligonucleotide
  Target: ATXN1; (+) strand; PAM type: YTN; PAM sequence: CTG
gagaaaacagatgtggagga

SEQ ID NO: 297324 - DNA, 20 bp, Artificial Sequence
  Description of Artificial Sequence: Synthetic oligonucleotide
  Target: ATXN1; (+) strand; PAM type: YTN; PAM sequence: TTT
tattcagatttccttccgtt

SEQ ID NO: 297325 - DNA, 20 bp, Artificial Sequence
  Description of Artificial Sequence: Synthetic oligonucleotide
  Target: ATXN1; (+) strand; PAM type: YTN; PAM sequence: TTT
attcagatttccttccgttt

SEQ ID NO: 297326 - DNA, 20 bp, Artificial Sequence
  Description of Artificial Sequence: Synthetic oligonucleotide
  Target: ATXN1; (+) strand; PAM type: YTN; PAM sequence: TTA
ttcagatttccttccgtttt

SEQ ID NO: 297327 - DNA, 20 bp, Artificial Sequence
  Description of Artificial Sequence: Synthetic oligonucleotide
  Target: ATXN1; (+) strand; PAM type: YTN; PAM sequence: TTC
agatttccttccgtttttac

SEQ ID NO: 297328 - DNA, 20 bp, Artificial Sequence
  Description of Artificial Sequence: Synthetic oligonucleotide
  Target: ATXN1; (+) strand; PAM type: YTN; PAM sequence: TTT
ccttccgtttttacttggct

SEQ ID NO: 297329 - DNA, 20 bp, Artificial Sequence
  Description of Artificial Sequence: Synthetic oligonucleotide
  Target: ATXN1; (+) strand; PAM type: YTN; PAM sequence: TTC
cttccgtttttacttggctc

SEQ ID NO: 297330 - DNA, 20 bp, Artificial Sequence
  Description of Artificial Sequence: Synthetic oligonucleotide
  Target: ATXN1; (+) strand; PAM type: YTN; PAM sequence: CTT
ccgtttttacttggctcatc

SEQ ID NO: 297331 - DNA, 20 bp, Artificial Sequence
  Description of Artificial Sequence: Synthetic oligonucleotide
  Target: ATXN1; (+) strand; PAM type: YTN; PAM sequence: TTC
cgtttttacttggctcatct

SEQ ID NO: 297332 - DNA, 20 bp, Artificial Sequence
  Description of Artificial Sequence: Synthetic oligonucleotide
  Target: ATXN1; (+) strand; PAM type: YTN; PAM sequence: TTT
ttacttggctcatctatatt

SEQ ID NO: 297333 - DNA, 20 bp, Artificial Sequence
  Description of Artificial Sequence: Synthetic oligonucleotide
  Target: ATXN1; (+) strand; PAM type: YTN; PAM sequence: TTT
tacttggctcatctatattt

SEQ ID NO: 297334 - DNA, 20 bp, Artificial Sequence
  Description of Artificial Sequence: Synthetic oligonucleotide
  Target: ATXN1; (+) strand; PAM type: YTN; PAM sequence: TTT
acttggctcatctatatttt

SEQ ID NO: 297335 - DNA, 20 bp, Artificial Sequence
  Description of Artificial Sequence: Synthetic oligonucleotide
  Target: ATXN1; (+) strand; PAM type: YTN; PAM sequence: TTA
cttggctcatctatattttg

SEQ ID NO: 297336 - DNA, 20 bp, Artificial Sequence
  Description of Artificial Sequence: Synthetic oligonucleotide
  Target: ATXN1; (+) strand; PAM type: YTN; PAM sequence: CTT
ggctcatctatattttgggt

SEQ ID NO: 297337 - DNA, 20 bp, Artificial Sequence
  Description of Artificial Sequence: Synthetic oligonucleotide
  Target: ATXN1; (+) strand; PAM type: YTN; PAM sequence: TTG
gctcatctatattttgggtc

SEQ ID NO: 297338 - DNA, 20 bp, Artificial Sequence
  Description of Artificial Sequence: Synthetic oligonucleotide
  Target: ATXN1; (+) strand; PAM type: YTN; PAM sequence: CTC
atctatattttgggtcagtt

SEQ ID NO: 297339 - DNA, 20 bp, Artificial Sequence
  Description of Artificial Sequence: Synthetic oligonucleotide
  Target: ATXN1; (+) strand; PAM type: YTN; PAM sequence: CTA
tattttgggtcagtttttta

SEQ ID NO: 297340 - DNA, 20 bp, Artificial Sequence
  Description of Artificial Sequence: Synthetic oligonucleotide
  Target: ATXN1; (+) strand; PAM type: YTN; PAM sequence: TTT
tgggtcagttttttagaact

SEQ ID NO: 297341 - DNA, 20 bp, Artificial Sequence
  Description of Artificial Sequence: Synthetic oligonucleotide
  Target: ATXN1; (+) strand; PAM type: YTN; PAM sequence: TTT
gggtcagttttttagaactc

SEQ ID NO: 297342 - DNA, 20 bp, Artificial Sequence
  Description of Artificial Sequence: Synthetic oligonucleotide
  Target: ATXN1; (+) strand; PAM type: YTN; PAM sequence: TTG
ggtcagttttttagaactca

SEQ ID NO: 297343 - DNA, 20 bp, Artificial Sequence
  Description of Artificial Sequence: Synthetic oligonucleotide
  Target: ATXN1; (+) strand; PAM type: YTN; PAM sequence: TTT
tttagaactcaatttgactt

SEQ ID NO: 297344 - DNA, 20 bp, Artificial Sequence
  Description of Artificial Sequence: Synthetic oligonucleotide
  Target: ATXN1; (+) strand; PAM type: YTN; PAM sequence: TTT
ttagaactcaatttgacttt

SEQ ID NO: 297345 - DNA, 20 bp, Artificial Sequence
  Description of Artificial Sequence: Synthetic oligonucleotide
  Target: ATXN1; (+) strand; PAM type: YTN; PAM sequence: TTT
tagaactcaatttgactttt

SEQ ID NO: 297346 - DNA, 20 bp, Artificial Sequence
  Description of Artificial Sequence: Synthetic oligonucleotide
  Target: ATXN1; (+) strand; PAM type: YTN; PAM sequence: TTT
agaactcaatttgactttta

SEQ ID NO: 297347 - DNA, 20 bp, Artificial Sequence
  Description of Artificial Sequence: Synthetic oligonucleotide
  Target: ATXN1; (+) strand; PAM type: YTN; PAM sequence: TTA
gaactcaatttgacttttaa

SEQ ID NO: 297348 - DNA, 20 bp, Artificial Sequence
  Description of Artificial Sequence: Synthetic oligonucleotide
  Target: ATXN1; (+) strand; PAM type: YTN; PAM sequence: CTC
aatttgacttttaatcatta

SEQ ID NO: 297349 - DNA, 20 bp, Artificial Sequence
  Description of Artificial Sequence: Synthetic oligonucleotide
  Target: ATXN1; (+) strand; PAM type: YTN; PAM sequence: TTT
gacttttaatcattaaaaat

SEQ ID NO: 297350 - DNA, 20 bp, Artificial Sequence
  Description of Artificial Sequence: Synthetic oligonucleotide
  Target: ATXN1; (+) strand; PAM type: YTN; PAM sequence: TTG
acttttaatcattaaaaatg

SEQ ID NO: 297351 - DNA, 20 bp, Artificial Sequence
  Description of Artificial Sequence: Synthetic oligonucleotide
  Target: ATXN1; (+) strand; PAM type: YTN; PAM sequence: CTT
ttaatcattaaaaatgatcc

SEQ ID NO: 297352 - DNA, 20 bp, Artificial Sequence
  Description of Artificial Sequence: Synthetic oligonucleotide
  Target: ATXN1; (+) strand; PAM type: YTN; PAM sequence: TTT
taatcattaaaaatgatcct

SEQ ID NO: 297353 - DNA, 20 bp, Artificial Sequence
  Description of Artificial Sequence: Synthetic oligonucleotide
  Target: ATXN1; (+) strand; PAM type: YTN; PAM sequence: TTT
aatcattaaaaatgatccta

SEQ ID NO: 297354 - DNA, 20 bp, Artificial Sequence
  Description of Artificial Sequence: Synthetic oligonucleotide
  Target: ATXN1; (+) strand; PAM type: YTN; PAM sequence: TTA
atcattaaaaatgatcctag

SEQ ID NO: 297355 - DNA, 20 bp, Artificial Sequence
  Description of Artificial Sequence: Synthetic oligonucleotide
  Target: ATXN1; (+) strand; PAM type: YTN; PAM sequence: TTA
aaaatgatcctagaagcatg

SEQ ID NO: 297356 - DNA, 20 bp, Artificial Sequence
  Description of Artificial Sequence: Synthetic oligonucleotide
  Target: ATXN1; (+) strand; PAM type: YTN; PAM sequence: CTA
gaagcatgtcctgtgaggca

SEQ ID NO: 297357 - DNA, 20 bp, Artificial Sequence
  Description of Artificial Sequence: Synthetic oligonucleotide
  Target: ATXN1; (+) strand; PAM type: YTN; PAM sequence: CTG
tgaggcactgccaagtcgca

SEQ ID NO: 297358 - DNA, 20 bp, Artificial Sequence
  Description of Artificial Sequence: Synthetic oligonucleotide
  Target: ATXN1; (+) strand; PAM type: YTN; PAM sequence: CTG
ccaagtcgcattgatgcatt

SEQ ID NO: 297359 - DNA, 20 bp, Artificial Sequence
  Description of Artificial Sequence: Synthetic oligonucleotide
  Target: ATXN1; (+) strand; PAM type: YTN; PAM sequence: TTG
atgcatttcattactgcttg

SEQ ID NO: 297360 - DNA, 20 bp, Artificial Sequence
  Description of Artificial Sequence: Synthetic oligonucleotide
  Target: ATXN1; (+) strand; PAM type: YTN; PAM sequence: TTT
cattactgcttgaaaggcca

SEQ ID NO: 297361 - DNA, 20 bp, Artificial Sequence
  Description of Artificial Sequence: Synthetic oligonucleotide
  Target: ATXN1; (+) strand; PAM type: YTN; PAM sequence: TTC
attactgcttgaaaggccac

SEQ ID NO: 297362 - DNA, 20 bp, Artificial Sequence
  Description of Artificial Sequence: Synthetic oligonucleotide
  Target: ATXN1; (+) strand; PAM type: YTN; PAM sequence: TTA
ctgcttgaaaggccacatat

SEQ ID NO: 297363 - DNA, 20 bp, Artificial Sequence
  Description of Artificial Sequence: Synthetic oligonucleotide
  Target: ATXN1; (+) strand; PAM type: YTN; PAM sequence: CTG
cttgaaaggccacatattca

SEQ ID NO: 297364 - DNA, 20 bp, Artificial Sequence
  Description of Artificial Sequence: Synthetic oligonucleotide
  Target: ATXN1; (+) strand; PAM type: YTN; PAM sequence: CTT
gaaaggccacatattcaaaa

SEQ ID NO: 297365 - DNA, 20 bp, Artificial Sequence
  Description of Artificial Sequence: Synthetic oligonucleotide
  Target: ATXN1; (+) strand; PAM type: YTN; PAM sequence: TTG
aaaggccacatattcaaaac

SEQ ID NO: 297366 - DNA, 20 bp, Artificial Sequence
  Description of Artificial Sequence: Synthetic oligonucleotide
  Target: ATXN1; (+) strand; PAM type: YTN; PAM sequence: TTC
aaaacactactagaagtcag

SEQ ID NO: 297367 - DNA, 20 bp, Artificial Sequence
  Description of Artificial Sequence: Synthetic oligonucleotide
  Target: ATXN1; (+) strand; PAM type: YTN; PAM sequence: CTA
ctagaagtcaggctaaagaa

SEQ ID NO: 297368 - DNA, 20 bp, Artificial Sequence
  Description of Artificial Sequence: Synthetic oligonucleotide
  Target: ATXN1; (+) strand; PAM type: YTN; PAM sequence: CTA
gaagtcaggctaaagaaaat

SEQ ID NO: 297369 - DNA, 20 bp, Artificial Sequence
  Description of Artificial Sequence: Synthetic oligonucleotide
  Target: ATXN1; (+) strand; PAM type: YTN; PAM sequence: CTA
aagaaaataaaatgattttg

SEQ ID NO: 297370 - DNA, 20 bp, Artificial Sequence
  Description of Artificial Sequence: Synthetic oligonucleotide
  Target: ATXN1; (+) strand; PAM type: YTN; PAM sequence: TTT
tggatatttttaagcagtta

SEQ ID NO: 297371 - DNA, 20 bp, Artificial Sequence
  Description of Artificial Sequence: Synthetic oligonucleotide
  Target: ATXN1; (+) strand; PAM type: YTN; PAM sequence: TTT
ggatatttttaagcagttac

SEQ ID NO: 297372 - DNA, 20 bp, Artificial Sequence
  Description of Artificial Sequence: Synthetic oligonucleotide
  Target: ATXN1; (+) strand; PAM type: YTN; PAM sequence: TTG
gatatttttaagcagttact

SEQ ID NO: 297373 - DNA, 20 bp, Artificial Sequence
  Description of Artificial Sequence: Synthetic oligonucleotide
  Target: ATXN1; (+) strand; PAM type: YTN; PAM sequence: TTT
ttaagcagttactaaaacag

SEQ ID NO: 297374 - DNA, 20 bp, Artificial Sequence
  Description of Artificial Sequence: Synthetic oligonucleotide
  Target: ATXN1; (+) strand; PAM type: YTN; PAM sequence: TTT
taagcagttactaaaacaga

SEQ ID NO: 297375 - DNA, 20 bp, Artificial Sequence
  Description of Artificial Sequence: Synthetic oligonucleotide
  Target: ATXN1; (+) strand; PAM type: YTN; PAM sequence: TTT
aagcagttactaaaacagaa

SEQ ID NO: 297376 - DNA, 20 bp, Artificial Sequence
  Description of Artificial Sequence: Synthetic oligonucleotide
  Target: ATXN1; (+) strand; PAM type: YTN; PAM sequence: TTA
agcagttactaaaacagaaa

SEQ ID NO: 297377 - DNA, 20 bp, Artificial Sequence
  Description of Artificial Sequence: Synthetic oligonucleotide
  Target: ATXN1; (+) strand; PAM type: YTN; PAM sequence: TTA
ctaaaacagaaacaaatgtt

SEQ ID NO: 297378 - DNA, 20 bp, Artificial Sequence
  Description of Artificial Sequence: Synthetic oligonucleotide
  Target: ATXN1; (+) strand; PAM type: YTN; PAM sequence: CTA
aaacagaaacaaatgttatt

SEQ ID NO: 297379 - DNA, 20 bp, Artificial Sequence
  Description of Artificial Sequence: Synthetic oligonucleotide
  Target: ATXN1; (+) strand; PAM type: YTN; PAM sequence: TTA
tttttaatctctggctcact

SEQ ID NO: 297380 - DNA, 20 bp, Artificial Sequence
  Description of Artificial Sequence: Synthetic oligonucleotide
  Target: ATXN1; (+) strand; PAM type: YTN; PAM sequence: TTT
ttaatctctggctcactgta

SEQ ID NO: 297381 - DNA, 20 bp, Artificial Sequence
  Description of Artificial Sequence: Synthetic oligonucleotide
  Target: ATXN1; (+) strand; PAM type: YTN; PAM sequence: TTT
taatctctggctcactgtaa

SEQ ID NO: 297382 - DNA, 20 bp, Artificial Sequence
  Description of Artificial Sequence: Synthetic oligonucleotide
  Target: ATXN1; (+) strand; PAM type: YTN; PAM sequence: TTT
aatctctggctcactgtaaa

SEQ ID NO: 297383 - DNA, 20 bp, Artificial Sequence
  Description of Artificial Sequence: Synthetic oligonucleotide
  Target: ATXN1; (+) strand; PAM type: YTN; PAM sequence: TTA
atctctggctcactgtaaac

SEQ ID NO: 297384 - DNA, 20 bp, Artificial Sequence
  Description of Artificial Sequence: Synthetic oligonucleotide
  Target: ATXN1; (+) strand; PAM type: YTN; PAM sequence: CTC
tggctcactgtaaactgaca

SEQ ID NO: 297385 - DNA, 20 bp, Artificial Sequence
  Description of Artificial Sequence: Synthetic oligonucleotide
  Target: ATXN1; (+) strand; PAM type: YTN; PAM sequence: CTG
gctcactgtaaactgacaag

SEQ ID NO: 297386 - DNA, 20 bp, Artificial Sequence
  Description of Artificial Sequence: Synthetic oligonucleotide
  Target: ATXN1; (+) strand; PAM type: YTN; PAM sequence: CTC
actgtaaactgacaagatat

SEQ ID NO: 297387 - DNA, 20 bp, Artificial Sequence
  Description of Artificial Sequence: Synthetic oligonucleotide
  Target: ATXN1; (+) strand; PAM type: YTN; PAM sequence: CTG
taaactgacaagatatgaat

SEQ ID NO: 297388 - DNA, 20 bp, Artificial Sequence
  Description of Artificial Sequence: Synthetic oligonucleotide
  Target: ATXN1; (+) strand; PAM type: YTN; PAM sequence: CTG
acaagatatgaatatgaatt

SEQ ID NO: 297389 - DNA, 20 bp, Artificial Sequence
  Description of Artificial Sequence: Synthetic oligonucleotide
  Target: ATXN1; (+) strand; PAM type: YTN; PAM sequence: TTT
taccaagtaatgtataataa

SEQ ID NO: 297390 - DNA, 20 bp, Artificial Sequence
  Description of Artificial Sequence: Synthetic oligonucleotide
  Target: ATXN1; (+) strand; PAM type: YTN; PAM sequence: TTT
accaagtaatgtataataac

SEQ ID NO: 297391 - DNA, 20 bp, Artificial Sequence
  Description of Artificial Sequence: Synthetic oligonucleotide
  Target: ATXN1; (+) strand; PAM type: YTN; PAM sequence: TTA
ccaagtaatgtataataact

SEQ ID NO: 297392 - DNA, 20 bp, Artificial Sequence
  Description of Artificial Sequence: Synthetic oligonucleotide
  Target: ATXN1; (+) strand; PAM type: YTN; PAM sequence: CTG
cttctgctcaccacaaccac

SEQ ID NO: 297393 - DNA, 20 bp, Artificial Sequence
  Description of Artificial Sequence: Synthetic oligonucleotide
  Target: ATXN1; (+) strand; PAM type: YTN; PAM sequence: CTT
ctgctcaccacaaccacatg

SEQ ID NO: 297394 - DNA, 20 bp, Artificial Sequence
  Description of Artificial Sequence: Synthetic oligonucleotide
  Target: ATXN1; (+) strand; PAM type: YTN; PAM sequence: TTC
tgctcaccacaaccacatgc

SEQ ID NO: 297395 - DNA, 20 bp, Artificial Sequence
  Description of Artificial Sequence: Synthetic oligonucleotide
  Target: ATXN1; (+) strand; PAM type: YTN; PAM sequence: CTG
ctcaccacaaccacatgcca

SEQ ID NO: 297396 - DNA, 20 bp, Artificial Sequence
  Description of Artificial Sequence: Synthetic oligonucleotide
  Target: ATXN1; (+) strand; PAM type: YTN; PAM sequence: CTC
accacaaccacatgccaaca

SEQ ID NO: 297397 - DNA, 20 bp, Artificial Sequence
  Description of Artificial Sequence: Synthetic oligonucleotide
  Target: ATXN1; (+) strand; PAM type: YTN; PAM sequence: CTC
aattttatatttcatttcga

SEQ ID NO: 297398 - DNA, 20 bp, Artificial Sequence
  Description of Artificial Sequence: Synthetic oligonucleotide
  Target: ATXN1; (+) strand; PAM type: YTN; PAM sequence: TTT
tatatttcatttcgatgtta

SEQ ID NO: 297399 - DNA, 20 bp, Artificial Sequence
  Description of Artificial Sequence: Synthetic oligonucleotide
  Target: ATXN1; (+) strand; PAM type: YTN; PAM sequence: TTT
atatttcatttcgatgttac

SEQ ID NO: 297400 - DNA, 20 bp, Artificial Sequence
  Description of Artificial Sequence: Synthetic oligonucleotide
  Target: ATXN1; (+) strand; PAM type: YTN; PAM sequence: TTA
tatttcatttcgatgttaca

SEQ ID NO: 297401 - DNA, 20 bp, Artificial Sequence
  Description of Artificial Sequence: Synthetic oligonucleotide
  Target: ATXN1; (+) strand; PAM type: YTN; PAM sequence: TTT
catttcgatgttacatgtgg

SEQ ID NO: 297402 - DNA, 20 bp, Artificial Sequence
  Description of Artificial Sequence: Synthetic oligonucleotide
  Target: ATXN1; (+) strand; PAM type: YTN; PAM sequence: TTC
atttcgatgttacatgtgga

SEQ ID NO: 297403 - DNA, 20 bp, Artificial Sequence
  Description of Artificial Sequence: Synthetic oligonucleotide
  Target: ATXN1; (+) strand; PAM type: YTN; PAM sequence: TTT
cgatgttacatgtggaacat

SEQ ID NO: 297404 - DNA, 20 bp, Artificial Sequence
  Description of Artificial Sequence: Synthetic oligonucleotide
  Target: ATXN1; (+) strand; PAM type: YTN; PAM sequence: TTC
gatgttacatgtggaacata

SEQ ID NO: 297405 - DNA, 20 bp, Artificial Sequence
  Description of Artificial Sequence: Synthetic oligonucleotide
  Target: ATXN1; (+) strand; PAM type: YTN; PAM sequence: TTA
catgtggaacatataatcta

SEQ ID NO: 297406 - DNA, 20 bp, Artificial Sequence
  Description of Artificial Sequence: Synthetic oligonucleotide
  Target: ATXN1; (+) strand; PAM type: YTN; PAM sequence: CTA
gattacaaaccatcctcatt

SEQ ID NO: 297407 - DNA, 20 bp, Artificial Sequence
  Description of Artificial Sequence: Synthetic oligonucleotide
  Target: ATXN1; (+) strand; PAM type: YTN; PAM sequence: TTA
caaaccatcctcattacagt

SEQ ID NO: 297408 - DNA, 20 bp, Artificial Sequence
  Description of Artificial Sequence: Synthetic oligonucleotide
  Target: ATXN1; (+) strand; PAM type: YTN; PAM sequence: CTC
attacagtccatttactcta

SEQ ID NO: 297409 - DNA, 20 bp, Artificial Sequence
  Description of Artificial Sequence: Synthetic oligonucleotide
  Target: ATXN1; (+) strand; PAM type: YTN; PAM sequence: TTA
cagtccatttactctagcta

SEQ ID NO: 297410 - DNA, 20 bp, Artificial Sequence
  Description of Artificial Sequence: Synthetic oligonucleotide
  Target: ATXN1; (+) strand; PAM type: YTN; PAM sequence: TTT
actctagctaatttttgata

SEQ ID NO: 297411 - DNA, 20 bp, Artificial Sequence
  Description of Artificial Sequence: Synthetic oligonucleotide
  Target: ATXN1; (+) strand; PAM type: YTN; PAM sequence: TTA
ctctagctaatttttgatag

SEQ ID NO: 297412 - DNA, 20 bp, Artificial Sequence
  Description of Artificial Sequence: Synthetic oligonucleotide
  Target: ATXN1; (+) strand; PAM type: YTN; PAM sequence: CTC
tagctaatttttgatagcat

SEQ ID NO: 297413 - DNA, 20 bp, Artificial Sequence
  Description of Artificial Sequence: Synthetic oligonucleotide
  Target: ATXN1; (+) strand; PAM type: YTN; PAM sequence: CTA
gctaatttttgatagcatga

SEQ ID NO: 297414 - DNA, 20 bp, Artificial Sequence
  Description of Artificial Sequence: Synthetic oligonucleotide
  Target: ATXN1; (+) strand; PAM type: YTN; PAM sequence: CTA
atttttgatagcatgacatc

SEQ ID NO: 297415 - DNA, 20 bp, Artificial Sequence
  Description of Artificial Sequence: Synthetic oligonucleotide
  Target: ATXN1; (+) strand; PAM type: YTN; PAM sequence: TTT
ttgatagcatgacatcatta

SEQ ID NO: 297416 - DNA, 20 bp, Artificial Sequence
  Description of Artificial Sequence: Synthetic oligonucleotide
  Target: ATXN1; (+) strand; PAM type: YTN; PAM sequence: TTT
tgatagcatgacatcattag

SEQ ID NO: 297417 - DNA, 20 bp, Artificial Sequence
  Description of Artificial Sequence: Synthetic oligonucleotide
  Target: ATXN1; (+) strand; PAM type: YTN; PAM sequence: TTT
gatagcatgacatcattagc

SEQ ID NO: 297418 - DNA, 20 bp, Artificial Sequence
  Description of Artificial Sequence: Synthetic oligonucleotide
  Target: ATXN1; (+) strand; PAM type: YTN; PAM sequence: TTG
atagcatgacatcattagca

SEQ ID NO: 297419 - DNA, 20 bp, Artificial Sequence
  Description of Artificial Sequence: Synthetic oligonucleotide
  Target: ATXN1; (+) strand; PAM type: YTN; PAM sequence: TTA
gcataaaaaagcttagtgaa

SEQ ID NO: 297420 - DNA, 20 bp, Artificial Sequence
  Description of Artificial Sequence: Synthetic oligonucleotide
  Target: ATXN1; (+) strand; PAM type: YTN; PAM sequence: CTT
agtgaataactattctgaaa

SEQ ID NO: 297421 - DNA, 20 bp, Artificial Sequence
  Description of Artificial Sequence: Synthetic oligonucleotide
  Target: ATXN1; (+) strand; PAM type: YTN; PAM sequence: TTA
gtgaataactattctgaaat

SEQ ID NO: 297422 - DNA, 20 bp, Artificial Sequence
  Description of Artificial Sequence: Synthetic oligonucleotide
  Target: ATXN1; (+) strand; PAM type: YTN; PAM sequence: CTA
ttctgaaatttgcttttata

SEQ ID NO: 297423 - DNA, 20 bp, Artificial Sequence
  Description of Artificial Sequence: Synthetic oligonucleotide
  Target: ATXN1; (+) strand; PAM type: YTN; PAM sequence: TTC
tgaaatttgcttttataaaa

SEQ ID NO: 297424 - DNA, 20 bp, Artificial Sequence
  Description of Artificial Sequence: Synthetic oligonucleotide
  Target: ATXN1; (+) strand; PAM type: YTN; PAM sequence: CTG
aaatttgcttttataaaagt

SEQ ID NO: 297425 - DNA, 20 bp, Artificial Sequence
  Description of Artificial Sequence: Synthetic oligonucleotide
  Target: ATXN1; (+) strand; PAM type: YTN; PAM sequence: TTT
gcttttataaaagtccttgc

SEQ ID NO: 297426 - DNA, 20 bp, Artificial Sequence
  Description of Artificial Sequence: Synthetic oligonucleotide
  Target: ATXN1; (+) strand; PAM type: YTN; PAM sequence: TTG
cttttataaaagtccttgca

SEQ ID NO: 297427 - DNA, 20 bp, Artificial Sequence
  Description of Artificial Sequence: Synthetic oligonucleotide
  Target: ATXN1; (+) strand; PAM type: YTN; PAM sequence: CTT
ttataaaagtccttgcaaag

SEQ ID NO: 297428 - DNA, 20 bp, Artificial Sequence
  Description of Artificial Sequence: Synthetic oligonucleotide
  Target: ATXN1; (+) strand; PAM type: YTN; PAM sequence: TTT
tataaaagtccttgcaaagt

SEQ ID NO: 297429 - DNA, 20 bp, Artificial Sequence
  Description of Artificial Sequence: Synthetic oligonucleotide
  Target: ATXN1; (+) strand; PAM type: YTN; PAM sequence: TTT
ataaaagtccttgcaaagtt

SEQ ID NO: 297430 - DNA, 20 bp, Artificial Sequence
  Description of Artificial Sequence: Synthetic oligonucleotide
  Target: ATXN1; (+) strand; PAM type: YTN; PAM sequence: TTA
taaaagtccttgcaaagttt

SEQ ID NO: 297431 - DNA, 20 bp, Artificial Sequence
  Description of Artificial Sequence: Synthetic oligonucleotide
  Target: ATXN1; (+) strand; PAM type: YTN; PAM sequence: CTT
gcaaagttttacatttctaa

SEQ ID NO: 297432 - DNA, 20 bp, Artificial Sequence
  Description of Artificial Sequence: Synthetic oligonucleotide
  Target: ATXN1; (+) strand; PAM type: YTN; PAM sequence: TTG
caaagttttacatttctaaa

SEQ ID NO: 297433 - DNA, 20 bp, Artificial Sequence
  Description of Artificial Sequence: Synthetic oligonucleotide
  Target: ATXN1; (+) strand; PAM type: YTN; PAM sequence: TTT
tacatttctaaacaagtgaa

SEQ ID NO: 297434 - DNA, 20 bp, Artificial Sequence
  Description of Artificial Sequence: Synthetic oligonucleotide
  Target: ATXN1; (+) strand; PAM type: YTN; PAM sequence: TTT
acatttctaaacaagtgaaa

SEQ ID NO: 297435 - DNA, 20 bp, Artificial Sequence
  Description of Artificial Sequence: Synthetic oligonucleotide
  Target: ATXN1; (+) strand; PAM type: YTN; PAM sequence: TTA
catttctaaacaagtgaaaa

SEQ ID NO: 297436 - DNA, 20 bp, Artificial Sequence
  Description of Artificial Sequence: Synthetic oligonucleotide
  Target: ATXN1; (+) strand; PAM type: YTN; PAM sequence: TTT
ctaaacaagtgaaaaccaat

SEQ ID NO: 297437 - DNA, 20 bp, Artificial Sequence
  Description of Artificial Sequence: Synthetic oligonucleotide
  Target: ATXN1; (+) strand; PAM type: YTN; PAM sequence: TTC
taaacaagtgaaaaccaata

SEQ ID NO: 297438 - DNA, 20 bp, Artificial Sequence
  Description of Artificial Sequence: Synthetic oligonucleotide
  Target: ATXN1; (+) strand; PAM type: YTN; PAM sequence: CTA
aacaagtgaaaaccaatagc

SEQ ID NO: 297439 - DNA, 20 bp, Artificial Sequence
  Description of Artificial Sequence: Synthetic oligonucleotide
  Target: ATXN1; (+) strand; PAM type: YTN; PAM sequence: CTG
aaaaattgtaagatgatgcc

SEQ ID NO: 297440 - DNA, 20 bp, Artificial Sequence
  Description of Artificial Sequence: Synthetic oligonucleotide
  Target: ATXN1; (+) strand; PAM type: YTN; PAM sequence: TTG
taagatgatgccataattgt

SEQ ID NO: 297441 - DNA, 20 bp, Artificial Sequence
  Description of Artificial Sequence: Synthetic oligonucleotide
  Target: ATXN1; (+) strand; PAM type: YTN; PAM sequence: TTG
tccaaatgttgctcagttca

SEQ ID NO: 297442 - DNA, 20 bp, Artificial Sequence
  Description of Artificial Sequence: Synthetic oligonucleotide
  Target: ATXN1; (+) strand; PAM type: YTN; PAM sequence: TTG
ctcagttcaccaacaggctt

SEQ ID NO: 297443 - DNA, 20 bp, Artificial Sequence
  Description of Artificial Sequence: Synthetic oligonucleotide
  Target: ATXN1; (+) strand; PAM type: YTN; PAM sequence: CTC
agttcaccaacaggcttact

SEQ ID NO: 297444 - DNA, 20 bp, Artificial Sequence
  Description of Artificial Sequence: Synthetic oligonucleotide
  Target: ATXN1; (+) strand; PAM type: YTN; PAM sequence: TTC
accaacaggcttactgagta

SEQ ID NO: 297445 - DNA, 20 bp, Artificial Sequence
  Description of Artificial Sequence: Synthetic oligonucleotide
  Target: ATXN1; (+) strand; PAM type: YTN; PAM sequence: CTT
actgagtaggttctttagaa

SEQ ID NO: 297446 - DNA, 20 bp, Artificial Sequence
  Description of Artificial Sequence: Synthetic oligonucleotide
  Target: ATXN1; (+) strand; PAM type: YTN; PAM sequence: TTA
ctgagtaggttctttagaaa

SEQ ID NO: 297447 - DNA, 20 bp, Artificial Sequence
  Description of Artificial Sequence: Synthetic oligonucleotide
  Target: ATXN1; (+) strand; PAM type: YTN; PAM sequence: CTG
agtaggttctttagaaagaa

SEQ ID NO: 297448 - DNA, 20 bp, Artificial Sequence
  Description of Artificial Sequence: Synthetic oligonucleotide
  Target: ATXN1; (+) strand; PAM type: YTN; PAM sequence: TTC
tttagaaagaaattctgcca

SEQ ID NO: 297449 - DNA, 20 bp, Artificial Sequence
  Description of Artificial Sequence: Synthetic oligonucleotide
  Target: ATXN1; (+) strand; PAM type: YTN; PAM sequence: CTT
tagaaagaaattctgccagg

SEQ ID NO: 297450 - DNA, 20 bp, Artificial Sequence
  Description of Artificial Sequence: Synthetic oligonucleotide
  Target: ATXN1; (+) strand; PAM type: YTN; PAM sequence: TTT
agaaagaaattctgccaggt

SEQ ID NO: 297451 - DNA, 20 bp, Artificial Sequence
  Description of Artificial Sequence: Synthetic oligonucleotide
  Target: ATXN1; (+) strand; PAM type: YTN; PAM sequence: TTA
gaaagaaattctgccaggta

SEQ ID NO: 297452 - DNA, 20 bp, Artificial Sequence
  Description of Artificial Sequence: Synthetic oligonucleotide
  Target: ATXN1; (+) strand; PAM type: YTN; PAM sequence: TTC
tgccaggtagtttgtaataa

SEQ ID NO: 297453 - DNA, 20 bp, Artificial Sequence
  Description of Artificial Sequence: Synthetic oligonucleotide
  Target: ATXN1; (+) strand; PAM type: YTN; PAM sequence: CTG
ccaggtagtttgtaataaga

SEQ ID NO: 297454 - DNA, 20 bp, Artificial Sequence
  Description of Artificial Sequence: Synthetic oligonucleotide
  Target: ATXN1; (+) strand; PAM type: YTN; PAM sequence: TTT
gtaataagaagtatctgcta

SEQ ID NO: 297455 - DNA, 20 bp, Artificial Sequence
  Description of Artificial Sequence: Synthetic oligonucleotide
  Target: ATXN1; (+) strand; PAM type: YTN; PAM sequence: TTG
taataagaagtatctgctat

SEQ ID NO: 297456 - DNA, 20 bp, Artificial Sequence
  Description of Artificial Sequence: Synthetic oligonucleotide
  Target: ATXN1; (+) strand; PAM type: YTN; PAM sequence: CTG
ctatggatcatgcctttaca

SEQ ID NO: 297457 - DNA, 20 bp, Artificial Sequence
  Description of Artificial Sequence: Synthetic oligonucleotide
  Target: ATXN1; (+) strand; PAM type: YTN; PAM sequence: CTA
tggatcatgcctttacaaag

SEQ ID NO: 297458 - DNA, 20 bp, Artificial Sequence
  Description of Artificial Sequence: Synthetic oligonucleotide
  Target: ATXN1; (+) strand; PAM type: YTN; PAM sequence: CTT
tacaaagtttacattccagc

SEQ ID NO: 297459 - DNA, 20 bp, Artificial Sequence
  Description of Artificial Sequence: Synthetic oligonucleotide
  Target: ATXN1; (+) strand; PAM type: YTN; PAM sequence: TTT
acaaagtttacattccagca

SEQ ID NO: 297460 - DNA, 20 bp, Artificial Sequence
  Description of Artificial Sequence: Synthetic oligonucleotide
  Target: ATXN1; (+) strand; PAM type: YTN; PAM sequence: TTA
caaagtttacattccagcag

SEQ ID NO: 297461 - DNA, 20 bp, Artificial Sequence
  Description of Artificial Sequence: Synthetic oligonucleotide
  Target: ATXN1; (+) strand; PAM type: YTN; PAM sequence: TTT
acattccagcagggaggaaa

SEQ ID NO: 297462 - DNA, 20 bp, Artificial Sequence
  Description of Artificial Sequence: Synthetic oligonucleotide
  Target: ATXN1; (+) strand; PAM type: YTN; PAM sequence: TTA
cattccagcagggaggaaag

SEQ ID NO: 297463 - DNA, 20 bp, Artificial Sequence
  Description of Artificial Sequence: Synthetic oligonucleotide
  Target: ATXN1; (+) strand; PAM type: YTN; PAM sequence: TTC
cagcagggaggaaagcatgt

SEQ ID NO: 297464 - DNA, 20 bp, Artificial Sequence
  Description of Artificial Sequence: Synthetic oligonucleotide
  Target: ATXN1; (+) strand; PAM type: YTN; PAM sequence: TTG
gcacttttcttttctttctt

SEQ ID NO: 297465 - DNA, 20 bp, Artificial Sequence
  Description of Artificial Sequence: Synthetic oligonucleotide
  Target: ATXN1; (+) strand; PAM type: YTN; PAM sequence: CTT
ttcttttctttctttttttt

SEQ ID NO: 297466 - DNA, 20 bp, Artificial Sequence
  Description of Artificial Sequence: Synthetic oligonucleotide
  Target: ATXN1; (+) strand; PAM type: YTN; PAM sequence: TTT
tcttttctttcttttttttt

SEQ ID NO: 297467 - DNA, 20 bp, Artificial Sequence
  Description of Artificial Sequence: Synthetic oligonucleotide
  Target: ATXN1; (+) strand; PAM type: YTN; PAM sequence: TTT
cttttctttctttttttttt

SEQ ID NO: 297468 - DNA, 20 bp, Artificial Sequence
  Description of Artificial Sequence: Synthetic oligonucleotide
  Target: ATXN1; (+) strand; PAM type: YTN; PAM sequence: TTC
ttttctttcttttttttttt

SEQ ID NO: 297469 - DNA, 20 bp, Artificial Sequence
  Description of Artificial Sequence: Synthetic oligonucleotide
  Target: ATXN1; (+) strand; PAM type: YTN; PAM sequence: CTT
ttctttcttttttttttttt

SEQ ID NO: 297470 - DNA, 20 bp, Artificial Sequence
  Description of Artificial Sequence: Synthetic oligonucleotide
  Target: ATXN1; (+) strand; PAM type: YTN; PAM sequence: TTT
tctttctttttttttttttt

SEQ ID NO: 297471 - DNA, 20 bp, Artificial Sequence
  Description of Artificial Sequence: Synthetic oligonucleotide
  Target: ATXN1; (+) strand; PAM type: YTN; PAM sequence: TTT
ctttcttttttttttttttt

SEQ ID NO: 297472 - DNA, 20 bp, Artificial Sequence
  Description of Artificial Sequence: Synthetic oligonucleotide
  Target: ATXN1; (+) strand; PAM type: YTN; PAM sequence: TTC
tttctttttttttttttttg

SEQ ID NO: 297473 - DNA, 20 bp, Artificial Sequence
  Description of Artificial Sequence: Synthetic oligonucleotide
  Target: ATXN1; (+) strand; PAM type: YTN; PAM sequence: CTT
tctttttttttttttttgca

SEQ ID NO: 297474 - DNA, 20 bp, Artificial Sequence
  Description of Artificial Sequence: Synthetic oligonucleotide
  Target: ATXN1; (+) strand; PAM type: YTN; PAM sequence: TTT
ctttttttttttttttgcag

SEQ ID NO: 297475 - DNA, 20 bp, Artificial Sequence
  Description of Artificial Sequence: Synthetic oligonucleotide
  Target: ATXN1; (+) strand; PAM type: YTN; PAM sequence: TTC
tttttttttttttttgcagt

SEQ ID NO: 297476 - DNA, 20 bp, Artificial Sequence
  Description of Artificial Sequence: Synthetic oligonucleotide
  Target: ATXN1; (+) strand; PAM type: YTN; PAM sequence: CTT
tttttttttttttgcagtaa

SEQ ID NO: 297477 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgcagtaac

SEQ ID NO: 297478 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgcagtaacg

SEQ ID NO: 297479 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgcagtaacgt

SEQ ID NO: 297480 - DNA, 20 bp, Artificial Sequence
  Description of Artificial Sequence: Synthetic oligonucleotide
  Target: ATXN1; (+) strand; PAM type: YTN; PAM sequence: TTT
tttttttttgcagtaacgta

SEQ ID NO: 297481 - DNA, 20 bp, Artificial Sequence
  Description of Artificial Sequence: Synthetic oligonucleotide
  Target: ATXN1; (+) strand; PAM type: YTN; PAM sequence: TTT
ttttttttgcagtaacgtaa

SEQ ID NO: 297482 - DNA, 20 bp, Artificial Sequence
  Description of Artificial Sequence: Synthetic oligonucleotide
  Target: ATXN1; (+) strand; PAM type: YTN; PAM sequence: TTT
tttttttgcagtaacgtaac

SEQ ID NO: 297483 - DNA, 20 bp, Artificial Sequence
  Description of Artificial Sequence: Synthetic oligonucleotide
  Target: ATXN1; (+) strand; PAM type: YTN; PAM sequence: TTT
ttttttgcagtaacgtaaca

SEQ ID NO: 297484 - DNA, 20 bp, Artificial Sequence
  Description of Artificial Sequence: Synthetic oligonucleotide
  Target: ATXN1; (+) strand; PAM type: YTN; PAM sequence: TTT
tttttgcagtaacgtaacag

SEQ ID NO: 297485 - DNA, 20 bp, Artificial Sequence
  Description of Artificial Sequence: Synthetic oligonucleotide
  Target: ATXN1; (+) strand; PAM type: YTN; PAM sequence: TTT
ttttgcagtaacgtaacaga

SEQ ID NO: 297486 - DNA, 20 bp, Artificial Sequence
  Description of Artificial Sequence: Synthetic oligonucleotide
  Target: ATXN1; (+) strand; PAM type: YTN; PAM sequence: TTT
tttgcagtaacgtaacagaa

SEQ ID NO: 297487 - DNA, 20 bp, Artificial Sequence
  Description of Artificial Sequence: Synthetic oligonucleotide
  Target: ATXN1; (+) strand; PAM type: YTN; PAM sequence: TTT
ttgcagtaacgtaacagaat

SEQ ID NO: 297488 - DNA, 20 bp, Artificial Sequence
  Description of Artificial Sequence: Synthetic oligonucleotide
  Target: ATXN1; (+) strand; PAM type: YTN; PAM sequence: TTT
tgcagtaacgtaacagaata

SEQ ID NO: 297489 - DNA, 20 bp, Artificial Sequence
  Description of Artificial Sequence: Synthetic oligonucleotide
  Target: ATXN1; (+) strand; PAM type: YTN; PAM sequence: TTT
gcagtaacgtaacagaataa

SEQ ID NO: 297490 - DNA, 20 bp, Artificial Sequence
  Description of Artificial Sequence: Synthetic oligonucleotide
  Target: ATXN1; (+) strand; PAM type: YTN; PAM sequence: TTG
cagtaacgtaacagaataag

SEQ ID NO: 297491 - DNA, 20 bp, Artificial Sequence
  Description of Artificial Sequence: Synthetic oligonucleotide
  Target: ATXN1; (+) strand; PAM type: YTN; PAM sequence: CTA
caaagtctcaaaagaggaac

SEQ ID NO: 297492 - DNA, 20 bp, Artificial Sequence
  Description of Artificial Sequence: Synthetic oligonucleotide
  Target: ATXN1; (+) strand; PAM type: YTN; PAM sequence: CTC
aaaagaggaaccattttatg

SEQ ID NO: 297493 - DNA, 20 bp, Artificial Sequence
  Description of Artificial Sequence: Synthetic oligonucleotide
  Target: ATXN1; (+) strand; PAM type: YTN; PAM sequence: TTT
tatgcaggagagggtatcag

SEQ ID NO: 297494 - DNA, 20 bp, Artificial Sequence
  Description of Artificial Sequence: Synthetic oligonucleotide
  Target: ATXN1; (+) strand; PAM type: YTN; PAM sequence: TTT
atgcaggagagggtatcagg

SEQ ID NO: 297495 - DNA, 20 bp, Artificial Sequence
  Description of Artificial Sequence: Synthetic oligonucleotide
  Target: ATXN1; (+) strand; PAM type: YTN; PAM sequence: TTA
tgcaggagagggtatcagga

SEQ ID NO: 297496 - DNA, 20 bp, Artificial Sequence
  Description of Artificial Sequence: Synthetic oligonucleotide
  Target: ATXN1; (+) strand; PAM type: YTN; PAM sequence: TTC
tggtaagaaagtgggcctca

SEQ ID NO: 297497 - DNA, 20 bp, Artificial Sequence
  Description of Artificial Sequence: Synthetic oligonucleotide
  Target: ATXN1; (+) strand; PAM type: YTN; PAM sequence: CTG
gtaagaaagtgggcctcagg

SEQ ID NO: 297498 - DNA, 20 bp, Artificial Sequence
  Description of Artificial Sequence: Synthetic oligonucleotide
  Target: ATXN1; (+) strand; PAM type: YTN; PAM sequence: CTC
aggagctaggcagatgggaa

SEQ ID NO: 297499 - DNA, 20 bp, Artificial Sequence
  Description of Artificial Sequence: Synthetic oligonucleotide
  Target: ATXN1; (+) strand; PAM type: YTN; PAM sequence: CTA
ggcagatgggaattttgaac

SEQ ID NO: 297500 - DNA, 20 bp, Artificial Sequence
  Description of Artificial Sequence: Synthetic oligonucleotide
  Target: ATXN1; (+) strand; PAM type: YTN; PAM sequence: TTT
tgaactctaagtgtctattt

SEQ ID NO: 297501 - DNA, 20 bp, Artificial Sequence
  Description of Artificial Sequence: Synthetic oligonucleotide
  Target: ATXN1; (+) strand; PAM type: YTN; PAM sequence: TTT
gaactctaagtgtctatttc

SEQ ID NO: 297502 - DNA, 20 bp, Artificial Sequence
  Description of Artificial Sequence: Synthetic oligonucleotide
  Target: ATXN1; (+) strand; PAM type: YTN; PAM sequence: TTG
aactctaagtgtctatttct

SEQ ID NO: 297503 - DNA, 20 bp, Artificial Sequence
  Description of Artificial Sequence: Synthetic oligonucleotide
  Target: ATXN1; (+) strand; PAM type: YTN; PAM sequence: CTC
taagtgtctatttctgaagt

SEQ ID NO: 297504 - DNA, 20 bp, Artificial Sequence
  Description of Artificial Sequence: Synthetic oligonucleotide
  Target: ATXN1; (+) strand; PAM type: YTN; PAM sequence: CTA
agtgtctatttctgaagtga

SEQ ID NO: 297505 - DNA, 20 bp, Artificial Sequence
  Description of Artificial Sequence: Synthetic oligonucleotide
  Target: ATXN1; (+) strand; PAM type: YTN; PAM sequence: CTA
tttctgaagtgaaactaatc

SEQ ID NO: 297506 - DNA, 20 bp, Artificial Sequence
  Description of Artificial Sequence: Synthetic oligonucleotide
  Target: ATXN1; (+) strand; PAM type: YTN; PAM sequence: TTT
ctgaagtgaaactaatcaat

SEQ ID NO: 297507 - DNA, 20 bp, Artificial Sequence
  Description of Artificial Sequence: Synthetic oligonucleotide
  Target: ATXN1; (+) strand; PAM type: YTN; PAM sequence: TTC
tgaagtgaaactaatcaatg

SEQ ID NO: 297508 - DNA, 20 bp, Artificial Sequence
  Description of Artificial Sequence: Synthetic oligonucleotide
  Target: ATXN1; (+) strand; PAM type: YTN; PAM sequence: CTG
aagtgaaactaatcaatgtg

SEQ ID NO: 297509 - DNA, 20 bp, Artificial Sequence
  Description of Artificial Sequence: Synthetic oligonucleotide
  Target: ATXN1; (+) strand; PAM type: YTN; PAM sequence: CTA
atcaatgtgtttctacagtt

SEQ ID NO: 297510 - DNA, 20 bp, Artificial Sequence
  Description of Artificial Sequence: Synthetic oligonucleotide
  Target: ATXN1; (+) strand; PAM type: YTN; PAM sequence: TTT
ctacagttaacatttattga

SEQ ID NO: 297511 - DNA, 20 bp, Artificial Sequence
  Description of Artificial Sequence: Synthetic oligonucleotide
  Target: ATXN1; (+) strand; PAM type: YTN; PAM sequence: TTC
tacagttaacatttattgag

SEQ ID NO: 297512 - DNA, 20 bp, Artificial Sequence
  Description of Artificial Sequence: Synthetic oligonucleotide
  Target: ATXN1; (+) strand; PAM type: YTN; PAM sequence: CTA
cagttaacatttattgagca

SEQ ID NO: 297513 - DNA, 20 bp, Artificial Sequence
  Description of Artificial Sequence: Synthetic oligonucleotide
  Target: ATXN1; (+) strand; PAM type: YTN; PAM sequence: TTA
acatttattgagcaactact

SEQ ID NO: 297514 - DNA, 20 bp, Artificial Sequence
  Description of Artificial Sequence: Synthetic oligonucleotide
  Target: ATXN1; (+) strand; PAM type: YTN; PAM sequence: TTT
attgagcaactactatgtgt

SEQ ID NO: 297515 - DNA, 20 bp, Artificial Sequence
  Description of Artificial Sequence: Synthetic oligonucleotide
  Target: ATXN1; (+) strand; PAM type: YTN; PAM sequence: TTA
ttgagcaactactatgtgtc

SEQ ID NO: 297516 - DNA, 20 bp, Artificial Sequence
  Description of Artificial Sequence: Synthetic oligonucleotide
  Target: ATXN1; (+) strand; PAM type: YTN; PAM sequence: TTG
agcaactactatgtgtcaca

SEQ ID NO: 297517 - DNA, 20 bp, Artificial Sequence
  Description of Artificial Sequence: Synthetic oligonucleotide
  Target: ATXN1; (+) strand; PAM type: YTN; PAM sequence: CTA
ctatgtgtcacaaagttcat

SEQ ID NO: 297518 - DNA, 20 bp, Artificial Sequence
  Description of Artificial Sequence: Synthetic oligonucleotide
  Target: ATXN1; (+) strand; PAM type: YTN; PAM sequence: CTA
tgtgtcacaaagttcataaa

SEQ ID NO: 297519 - DNA, 20 bp, Artificial Sequence
  Description of Artificial Sequence: Synthetic oligonucleotide
  Target: ATXN1; (+) strand; PAM type: YTN; PAM sequence: TTC
ataaatgttatctctaagct

SEQ ID NO: 297520 - DNA, 20 bp, Artificial Sequence
  Description of Artificial Sequence: Synthetic oligonucleotide
  Target: ATXN1; (+) strand; PAM type: YTN; PAM sequence: TTA
tctctaagcttccaaacaaa

SEQ ID NO: 297521 - DNA, 20 bp, Artificial Sequence
  Description of Artificial Sequence: Synthetic oligonucleotide
  Target: ATXN1; (+) strand; PAM type: YTN; PAM sequence: CTC
taagcttccaaacaaacatg

SEQ ID NO: 297522 - DNA, 20 bp, Artificial Sequence
  Description of Artificial Sequence: Synthetic oligonucleotide
  Target: ATXN1; (+) strand; PAM type: YTN; PAM sequence: CTA
agcttccaaacaaacatgga

SEQ ID NO: 297523 - DNA, 20 bp, Artificial Sequence
  Description of Artificial Sequence: Synthetic oligonucleotide
  Target: ATXN1; (+) strand; PAM type: YTN; PAM sequence: CTT
ccaaacaaacatggaatgac

SEQ ID NO: 297524 - DNA, 20 bp, Artificial Sequence
  Description of Artificial Sequence: Synthetic oligonucleotide
  Target: ATXN1; (+) strand; PAM type: YTN; PAM sequence: TTC
caaacaaacatggaatgaca

SEQ ID NO: 297525 - DNA, 20 bp, Artificial Sequence
  Description of Artificial Sequence: Synthetic oligonucleotide
  Target: ATXN1; (+) strand; PAM type: YTN; PAM sequence: CTG
gttacaaatgattaaaaagg

SEQ ID NO: 297526 - DNA, 20 bp, Artificial Sequence
  Description of Artificial Sequence: Synthetic oligonucleotide
  Target: ATXN1; (+) strand; PAM type: YTN; PAM sequence: TTA
caaatgattaaaaagggact

SEQ ID NO: 297527 - DNA, 20 bp, Artificial Sequence
  Description of Artificial Sequence: Synthetic oligonucleotide
  Target: ATXN1; (+) strand; PAM type: YTN; PAM sequence: TTA
aaaagggactcacagagtct

SEQ ID NO: 297528 - DNA, 20 bp, Artificial Sequence
  Description of Artificial Sequence: Synthetic oligonucleotide
  Target: ATXN1; (+) strand; PAM type: YTN; PAM sequence: CTC
acagagtctattaacattcc

SEQ ID NO: 297529 - DNA, 20 bp, Artificial Sequence
  Description of Artificial Sequence: Synthetic oligonucleotide
  Target: ATXN1; (+) strand; PAM type: YTN; PAM sequence: CTA
ttaacattcccaagagtcat

SEQ ID NO: 297530 - DNA, 20 bp, Artificial Sequence
  Description of Artificial Sequence: Synthetic oligonucleotide
  Target: ATXN1; (+) strand; PAM type: YTN; PAM sequence: TTA
acattcccaagagtcattag

SEQ ID NO: 297531 - DNA, 20 bp, Artificial Sequence
  Description of Artificial Sequence: Synthetic oligonucleotide
  Target: ATXN1; (+) strand; PAM type: YTN; PAM sequence: TTC
ccaagagtcattagttctta

SEQ ID NO: 297532 - DNA, 20 bp, Artificial Sequence
  Description of Artificial Sequence: Synthetic oligonucleotide
  Target: ATXN1; (+) strand; PAM type: YTN; PAM sequence: TTA
gttcttactgaacattagta

SEQ ID NO: 297533 - DNA, 20 bp, Artificial Sequence
  Description of Artificial Sequence: Synthetic oligonucleotide
  Target: ATXN1; (+) strand; PAM type: YTN; PAM sequence: TTC
ttactgaacattagtaagcc

SEQ ID NO: 297534 - DNA, 20 bp, Artificial Sequence
  Description of Artificial Sequence: Synthetic oligonucleotide
  Target: ATXN1; (+) strand; PAM type: YTN; PAM sequence: CTT
actgaacattagtaagccaa

SEQ ID NO: 297535 - DNA, 20 bp, Artificial Sequence
  Description of Artificial Sequence: Synthetic oligonucleotide
  Target: ATXN1; (+) strand; PAM type: YTN; PAM sequence: TTA
ctgaacattagtaagccaaa

SEQ ID NO: 297536 - DNA, 20 bp, Artificial Sequence
  Description of Artificial Sequence: Synthetic oligonucleotide
  Target: ATXN1; (+) strand; PAM type: YTN; PAM sequence: CTG
aacattagtaagccaaaggc

SEQ ID NO: 297537 - DNA, 20 bp, Artificial Sequence
  Description of Artificial Sequence: Synthetic oligonucleotide
  Target: ATXN1; (+) strand; PAM type: YTN; PAM sequence: TTA
gtaagccaaaggcatattta

SEQ ID NO: 297538 - DNA, 20 bp, Artificial Sequence
  Description of Artificial Sequence: Synthetic oligonucleotide
  Target: ATXN1; (+) strand; PAM type: YTN; PAM sequence: TTT
atatcaacacaagagttaat

SEQ ID NO: 297539 - DNA, 20 bp, Artificial Sequence
  Description of Artificial Sequence: Synthetic oligonucleotide
  Target: ATXN1; (+) strand; PAM type: YTN; PAM sequence: TTA
tatcaacacaagagttaatc

SEQ ID NO: 297540 - DNA, 20 bp, Artificial Sequence
  Description of Artificial Sequence: Synthetic oligonucleotide
  Target: ATXN1; (+) strand; PAM type: YTN; PAM sequence: TTA
atcacacagaaaagatgaca

SEQ ID NO: 297541 - DNA, 20 bp, Artificial Sequence
  Description of Artificial Sequence: Synthetic oligonucleotide
  Target: ATXN1; (+) strand; PAM type: YTN; PAM sequence: CTT
aattcgaacaatcaagggtc

SEQ ID NO: 297542 - DNA, 20 bp, Artificial Sequence
  Description of Artificial Sequence: Synthetic oligonucleotide
  Target: ATXN1; (+) strand; PAM type: YTN; PAM sequence: TTA
attcgaacaatcaagggtca

SEQ ID NO: 297543 - DNA, 20 bp, Artificial Sequence
  Description of Artificial Sequence: Synthetic oligonucleotide
  Target: ATXN1; (+) strand; PAM type: YTN; PAM sequence: TTC
gaacaatcaagggtcaaaat

SEQ ID NO: 297544 - DNA, 20 bp, Artificial Sequence
  Description of Artificial Sequence: Synthetic oligonucleotide
  Target: ATXN1; (+) strand; PAM type: YTN; PAM sequence: TTA
tatattttgaatacgaatat

SEQ ID NO: 297545 - DNA, 20 bp, Artificial Sequence
  Description of Artificial Sequence: Synthetic oligonucleotide
  Target: ATXN1; (+) strand; PAM type: YTN; PAM sequence: TTT
tgaatacgaatatggttgaa

SEQ ID NO: 297546 - DNA, 20 bp, Artificial Sequence
  Description of Artificial Sequence: Synthetic oligonucleotide
  Target: ATXN1; (+) strand; PAM type: YTN; PAM sequence: TTT
gaatacgaatatggttgaat

SEQ ID NO: 297547 - DNA, 20 bp, Artificial Sequence
  Description of Artificial Sequence: Synthetic oligonucleotide
  Target: ATXN1; (+) strand; PAM type: YTN; PAM sequence: TTG
aatacgaatatggttgaata

SEQ ID NO: 297548 - DNA, 20 bp, Artificial Sequence
  Description of Artificial Sequence: Synthetic oligonucleotide
  Target: ATXN1; (+) strand; PAM type: YTN; PAM sequence: TTG
aatatgacaaggatttgaat

SEQ ID NO: 297549 - DNA, 20 bp, Artificial Sequence
  Description of Artificial Sequence: Synthetic oligonucleotide
  Target: ATXN1; (+) strand; PAM type: YTN; PAM sequence: TTT
gaatacgtcaaaacacaaat

SEQ ID NO: 297550 - DNA, 20 bp, Artificial Sequence
  Description of Artificial Sequence: Synthetic oligonucleotide
  Target: ATXN1; (+) strand; PAM type: YTN; PAM sequence: TTG
aatacgtcaaaacacaaatc

SEQ ID NO: 297551 - DNA, 20 bp, Artificial Sequence
  Description of Artificial Sequence: Synthetic oligonucleotide
  Target: ATXN1; (+) strand; PAM type: YTN; PAM sequence: TTC
cctgacatgtaactgaaatg

SEQ ID NO: 297552 - DNA, 20 bp, Artificial Sequence
  Description of Artificial Sequence: Synthetic oligonucleotide
  Target: ATXN1; (+) strand; PAM type: YTN; PAM sequence: CTG
acatgtaactgaaatgacaa

SEQ ID NO: 297553 - DNA, 20 bp, Artificial Sequence
  Description of Artificial Sequence: Synthetic oligonucleotide
  Target: ATXN1; (+) strand; PAM type: YTN; PAM sequence: CTG
aaatgacaagaatatcaaga

SEQ ID NO: 297554 - DNA, 20 bp, Artificial Sequence
  Description of Artificial Sequence: Synthetic oligonucleotide
  Target: ATXN1; (+) strand; PAM type: YTN; PAM sequence: CTT
aagtacatgtttattctaac

SEQ ID NO: 297555 - DNA, 20 bp, Artificial Sequence
  Description of Artificial Sequence: Synthetic oligonucleotide
  Target: ATXN1; (+) strand; PAM type: YTN; PAM sequence: TTA
agtacatgtttattctaacc

SEQ ID NO: 297556 - DNA, 20 bp, Artificial Sequence
  Description of Artificial Sequence: Synthetic oligonucleotide
  Target: ATXN1; (+) strand; PAM type: YTN; PAM sequence: TTT
attctaacctctaacatcag

SEQ ID NO: 297557 - DNA, 20 bp, Artificial Sequence
  Description of Artificial Sequence: Synthetic oligonucleotide
  Target: ATXN1; (+) strand; PAM type: YTN; PAM sequence: TTA
ttctaacctctaacatcagt

SEQ ID NO: 297558 - DNA, 20 bp, Artificial Sequence
  Description of Artificial Sequence: Synthetic oligonucleotide
  Target: ATXN1; (+) strand; PAM type: YTN; PAM sequence: TTC
taacctctaacatcagtatt

SEQ ID NO: 297559 - DNA, 20 bp, Artificial Sequence
  Description of Artificial Sequence: Synthetic oligonucleotide
  Target: ATXN1; (+) strand; PAM type: YTN; PAM sequence: CTA
acctctaacatcagtattat

SEQ ID NO: 297560 - DNA, 20 bp, Artificial Sequence
  Description of Artificial Sequence: Synthetic oligonucleotide
  Target: ATXN1; (+) strand; PAM type: YTN; PAM sequence: CTC
taacatcagtattatgcaat

SEQ ID NO: 297561 - DNA, 20 bp, Artificial Sequence
  Description of Artificial Sequence: Synthetic oligonucleotide
  Target: ATXN1; (+) strand; PAM type: YTN; PAM sequence: CTA
acatcagtattatgcaatga

SEQ ID NO: 297562 - DNA, 20 bp, Artificial Sequence
  Description of Artificial Sequence: Synthetic oligonucleotide
  Target: ATXN1; (+) strand; PAM type: YTN; PAM sequence: TTA
tgcaatgatttcattttaaa

SEQ ID NO: 297563 - DNA, 20 bp, Artificial Sequence
  Description of Artificial Sequence: Synthetic oligonucleotide
  Target: ATXN1; (+) strand; PAM type: YTN; PAM sequence: TTT
cattttaaactaaatgatta

SEQ ID NO: 297564 - DNA, 20 bp, Artificial Sequence
  Description of Artificial Sequence: Synthetic oligonucleotide
  Target: ATXN1; (+) strand; PAM type: YTN; PAM sequence: TTC
attttaaactaaatgattaa

SEQ ID NO: 297565 - DNA, 20 bp, Artificial Sequence
  Description of Artificial Sequence: Synthetic oligonucleotide
  Target: ATXN1; (+) strand; PAM type: YTN; PAM sequence: TTT
taaactaaatgattaaaatg

SEQ ID NO: 297566 - DNA, 20 bp, Artificial Sequence
  Description of Artificial Sequence: Synthetic oligonucleotide
  Target: ATXN1; (+) strand; PAM type: YTN; PAM sequence: TTT
aaactaaatgattaaaatgt

SEQ ID NO: 297567 - DNA, 20 bp, Artificial Sequence
  Description of Artificial Sequence: Synthetic oligonucleotide
  Target: ATXN1; (+) strand; PAM type: YTN; PAM sequence: TTA
aactaaatgattaaaatgta

SEQ ID NO: 297568 - DNA, 20 bp, Artificial Sequence
  Description of Artificial Sequence: Synthetic oligonucleotide
  Target: ATXN1; (+) strand; PAM type: YTN; PAM sequence: CTA
aatgattaaaatgtaccttt

SEQ ID NO: 297569 - DNA, 20 bp, Artificial Sequence
  Description of Artificial Sequence: Synthetic oligonucleotide
  Target: ATXN1; (+) strand; PAM type: YTN; PAM sequence: TTA
aaatgtacctttgttttaaa

SEQ ID NO: 297570 - DNA, 20 bp, Artificial Sequence
  Description of Artificial Sequence: Synthetic oligonucleotide
  Target: ATXN1; (+) strand; PAM type: YTN; PAM sequence: CTT
tgttttaaaataggtatttg

SEQ ID NO: 297571 - DNA, 20 bp, Artificial Sequence
  Description of Artificial Sequence: Synthetic oligonucleotide
  Target: ATXN1; (+) strand; PAM type: YTN; PAM sequence: TTT
gttttaaaataggtatttga

SEQ ID NO: 297572 - DNA, 20 bp, Artificial Sequence
  Description of Artificial Sequence: Synthetic oligonucleotide
  Target: ATXN1; (+) strand; PAM type: YTN; PAM sequence: TTG
ttttaaaataggtatttgag

SEQ ID NO: 297573 - DNA, 20 bp, Artificial Sequence
  Description of Artificial Sequence: Synthetic oligonucleotide
  Target: ATXN1; (+) strand; PAM type: YTN; PAM sequence: TTT
taaaataggtatttgagttt

SEQ ID NO: 297574 - DNA, 20 bp, Artificial Sequence
  Description of Artificial Sequence: Synthetic oligonucleotide
  Target: ATXN1; (+) strand; PAM type: YTN; PAM sequence: TTT
aaaataggtatttgagtttc

SEQ ID NO: 297575 - DNA, 20 bp, Artificial Sequence
  Description of Artificial Sequence: Synthetic oligonucleotide
  Target: ATXN1; (+) strand; PAM type: YTN; PAM sequence: TTA
aaataggtatttgagtttct

SEQ ID NO: 297576 - DNA, 20 bp, Artificial Sequence
  Description of Artificial Sequence: Synthetic oligonucleotide
  Target: ATXN1; (+) strand; PAM type: YTN; PAM sequence: TTT
gagtttctacagcagtgttt

SEQ ID NO: 297577 - DNA, 20 bp, Artificial Sequence
  Description of Artificial Sequence: Synthetic oligonucleotide
  Target: ATXN1; (+) strand; PAM type: YTN; PAM sequence: TTG
agtttctacagcagtgtttc

SEQ ID NO: 297578 - DNA, 20 bp, Artificial Sequence
  Description of Artificial Sequence: Synthetic oligonucleotide
  Target: ATXN1; (+) strand; PAM type: YTN; PAM sequence: TTT
ctacagcagtgtttctccaa

SEQ ID NO: 297579 - DNA, 20 bp, Artificial Sequence
  Description of Artificial Sequence: Synthetic oligonucleotide
  Target: ATXN1; (+) strand; PAM type: YTN; PAM sequence: TTC
tacagcagtgtttctccaag

SEQ ID NO: 297580 - DNA, 20 bp, Artificial Sequence
  Description of Artificial Sequence: Synthetic oligonucleotide
  Target: ATXN1; (+) strand; PAM type: YTN; PAM sequence: CTA
cagcagtgtttctccaagtg

SEQ ID NO: 297581 - DNA, 20 bp, Artificial Sequence
  Description of Artificial Sequence: Synthetic oligonucleotide
  Target: ATXN1; (+) strand; PAM type: YTN; PAM sequence: TTT
ctccaagtgtgagccaagga

SEQ ID NO: 297582 - DNA, 20 bp, Artificial Sequence
  Description of Artificial Sequence: Synthetic oligonucleotide
  Target: ATXN1; (+) strand; PAM type: YTN; PAM sequence: TTC
tccaagtgtgagccaaggac

SEQ ID NO: 297583 - DNA, 20 bp, Artificial Sequence
  Description of Artificial Sequence: Synthetic oligonucleotide
  Target: ATXN1; (+) strand; PAM type: YTN; PAM sequence: CTC
caagtgtgagccaaggacct

SEQ ID NO: 297584 - DNA, 20 bp, Artificial Sequence
  Description of Artificial Sequence: Synthetic oligonucleotide
  Target: ATXN1; (+) strand; PAM type: YTN; PAM sequence: CTT
ttatgttaaatgaatcacag

SEQ ID NO: 297585 - DNA, 20 bp, Artificial Sequence
  Description of Artificial Sequence: Synthetic oligonucleotide
  Target: ATXN1; (+) strand; PAM type: YTN; PAM sequence: TTT
tatgttaaatgaatcacagg

SEQ ID NO: 297586 - DNA, 20 bp, Artificial Sequence
  Description of Artificial Sequence: Synthetic oligonucleotide
  Target: ATXN1; (+) strand; PAM type: YTN; PAM sequence: TTT
atgttaaatgaatcacagga

SEQ ID NO: 297587 - DNA, 20 bp, Artificial Sequence
  Description of Artificial Sequence: Synthetic oligonucleotide
  Target: ATXN1; (+) strand; PAM type: YTN; PAM sequence: TTA
tgttaaatgaatcacaggag

SEQ ID NO: 297588 - DNA, 20 bp, Artificial Sequence
  Description of Artificial Sequence: Synthetic oligonucleotide
  Target: ATXN1; (+) strand; PAM type: YTN; PAM sequence: TTA
aatgaatcacaggagggtgc

SEQ ID NO: 297589 - DNA, 20 bp, Artificial Sequence
  Description of Artificial Sequence: Synthetic oligonucleotide
  Target: ATXN1; (+) strand; PAM type: YTN; PAM sequence: CTC
gttaaaagtacaactcctgg

SEQ ID NO: 297590 - DNA, 20 bp, Artificial Sequence
  Description of Artificial Sequence: Synthetic oligonucleotide
  Target: ATXN1; (+) strand; PAM type: YTN; PAM sequence: TTA
aaagtacaactcctgggccc

SEQ ID NO: 297591 - DNA, 20 bp, Artificial Sequence
  Description of Artificial Sequence: Synthetic oligonucleotide
  Target: ATXN1; (+) strand; PAM type: YTN; PAM sequence: CTC
ctgggccccacccctgacct

SEQ ID NO: 297592 - DNA, 20 bp, Artificial Sequence
  Description of Artificial Sequence: Synthetic oligonucleotide
  Target: ATXN1; (+) strand; PAM type: YTN; PAM sequence: CTG
ggccccacccctgacctatt

SEQ ID NO: 297593 - DNA, 20 bp, Artificial Sequence
  Description of Artificial Sequence: Synthetic oligonucleotide
  Target: ATXN1; (+) strand; PAM type: YTN; PAM sequence: CTG
acctatttaacatactttaa

SEQ ID NO: 297594 - DNA, 20 bp, Artificial Sequence
  Description of Artificial Sequence: Synthetic oligonucleotide
  Target: ATXN1; (+) strand; PAM type: YTN; PAM sequence: CTA
tttaacatactttaaggccc

SEQ ID NO: 297595 - DNA, 20 bp, Artificial Sequence
  Description of Artificial Sequence: Synthetic oligonucleotide
  Target: ATXN1; (+) strand; PAM type: YTN; PAM sequence: TTT
aacatactttaaggcccagg

SEQ ID NO: 297596 - DNA, 20 bp, Artificial Sequence
  Description of Artificial Sequence: Synthetic oligonucleotide
  Target: ATXN1; (+) strand; PAM type: YTN; PAM sequence: TTA
acatactttaaggcccagga

SEQ ID NO: 297597 - DNA, 20 bp, Artificial Sequence
  Description of Artificial Sequence: Synthetic oligonucleotide
  Target: ATXN1; (+) strand; PAM type: YTN; PAM sequence: CTT
taaggcccaggaatctgaat

SEQ ID NO: 297598 - DNA, 20 bp, Artificial Sequence
  Description of Artificial Sequence: Synthetic oligonucleotide
  Target: ATXN1; (+) strand; PAM type: YTN; PAM sequence: TTT
aaggcccaggaatctgaatt

SEQ ID NO: 297599 - DNA, 20 bp, Artificial Sequence
  Description of Artificial Sequence: Synthetic oligonucleotide
  Target: ATXN1; (+) strand; PAM type: YTN; PAM sequence: TTA
aggcccaggaatctgaattt

SEQ ID NO: 297600 - DNA, 20 bp, Artificial Sequence
  Description of Artificial Sequence: Synthetic oligonucleotide
  Target: ATXN1; (+) strand; PAM type: YTN; PAM sequence: CTG
aattttcaacaggactaagt

SEQ ID NO: 297601 - DNA, 20 bp, Artificial Sequence
  Description of Artificial Sequence: Synthetic oligonucleotide
  Target: ATXN1; (+) strand; PAM type: YTN; PAM sequence: TTT
tcaacaggactaagttgtat

SEQ ID NO: 297602 - DNA, 20 bp, Artificial Sequence
  Description of Artificial Sequence: Synthetic oligonucleotide
  Target: ATXN1; (+) strand; PAM type: YTN; PAM sequence: TTT
caacaggactaagttgtata

SEQ ID NO: 297603 - DNA, 20 bp, Artificial Sequence
  Description of Artificial Sequence: Synthetic oligonucleotide
  Target: ATXN1; (+) strand; PAM type: YTN; PAM sequence: TTC
aacaggactaagttgtatat

SEQ ID NO: 297604 - DNA, 20 bp, Artificial Sequence
  Description of Artificial Sequence: Synthetic oligonucleotide
  Target: ATXN1; (+) strand; PAM type: YTN; PAM sequence: CTA
agttgtatattcaagtccta

SEQ ID NO: 297605 - DNA, 20 bp, Artificial Sequence
  Description of Artificial Sequence: Synthetic oligonucleotide
  Target: ATXN1; (+) strand; PAM type: YTN; PAM sequence: TTG
tatattcaagtcctagggcc

SEQ ID NO: 297606 - DNA, 20 bp, Artificial Sequence
  Description of Artificial Sequence: Synthetic oligonucleotide
  Target: ATXN1; (+) strand; PAM type: YTN; PAM sequence: TTC
aagtcctagggcctctggtc

SEQ ID NO: 297607 - DNA, 20 bp, Artificial Sequence
  Description of Artificial Sequence: Synthetic oligonucleotide
  Target: ATXN1; (+) strand; PAM type: YTN; PAM sequence: CTA
gggcctctggtctagagttt

SEQ ID NO: 297608 - DNA, 20 bp, Artificial Sequence
  Description of Artificial Sequence: Synthetic oligonucleotide
  Target: ATXN1; (+) strand; PAM type: YTN; PAM sequence: CTC
tggtctagagtttcctcccc

SEQ ID NO: 297609 - DNA, 20 bp, Artificial Sequence
  Description of Artificial Sequence: Synthetic oligonucleotide
  Target: ATXN1; (+) strand; PAM type: YTN; PAM sequence: CTG
gtctagagtttcctccccac

SEQ ID NO: 297610 - DNA, 20 bp, Artificial Sequence
  Description of Artificial Sequence: Synthetic oligonucleotide
  Target: ATXN1; (+) strand; PAM type: YTN; PAM sequence: CTA
gagtttcctccccacacctt

SEQ ID NO: 297611 - DNA, 20 bp, Artificial Sequence
  Description of Artificial Sequence: Synthetic oligonucleotide
  Target: ATXN1; (+) strand; PAM type: YTN; PAM sequence: TTT
cctccccacacctttccccc

SEQ ID NO: 297612 - DNA, 20 bp, Artificial Sequence
  Description of Artificial Sequence: Synthetic oligonucleotide
  Target: ATXN1; (+) strand; PAM type: YTN; PAM sequence: TTC
ctccccacacctttcccccc

SEQ ID NO: 297613 - DNA, 20 bp, Artificial Sequence
  Description of Artificial Sequence: Synthetic oligonucleotide
  Target: ATXN1; (+) strand; PAM type: YTN; PAM sequence: CTC
cccacacctttccccccaac

SEQ ID NO: 297614 - DNA, 20 bp, Artificial Sequence
  Description of Artificial Sequence: Synthetic oligonucleotide
  Target: ATXN1; (+) strand; PAM type: YTN; PAM sequence: CTT
tccccccaacacgtttccct

SEQ ID NO: 297615 - DNA, 20 bp, Artificial Sequence
  Description of Artificial Sequence: Synthetic oligonucleotide
  Target: ATXN1; (+) strand; PAM type: YTN; PAM sequence: TTT
ccccccaacacgtttccctc

SEQ ID NO: 297616 - DNA, 20 bp, Artificial Sequence
  Description of Artificial Sequence: Synthetic oligonucleotide
  Target: ATXN1; (+) strand; PAM type: YTN; PAM sequence: TTC
cccccaacacgtttccctct

SEQ ID NO: 297617 - DNA, 20 bp, Artificial Sequence
  Description of Artificial Sequence: Synthetic oligonucleotide
  Target: ATXN1; (+) strand; PAM type: YTN; PAM sequence: TTT
ccctcttgtttactccctta

SEQ ID NO: 297618 - DNA, 20 bp, Artificial Sequence
  Description of Artificial Sequence: Synthetic oligonucleotide
  Target: ATXN1; (+) strand; PAM type: YTN; PAM sequence: TTC
cctcttgtttactcccttac

SEQ ID NO: 297619 - DNA, 20 bp, Artificial Sequence
  Description of Artificial Sequence: Synthetic oligonucleotide
  Target: ATXN1; (+) strand; PAM type: YTN; PAM sequence: CTC
ttgtttactcccttactgaa

SEQ ID NO: 297620 - DNA, 20 bp, Artificial Sequence
  Description of Artificial Sequence: Synthetic oligonucleotide
  Target: ATXN1; (+) strand; PAM type: YTN; PAM sequence: CTT
gtttactcccttactgaaat

SEQ ID NO: 297621 - DNA, 20 bp, Artificial Sequence
  Description of Artificial Sequence: Synthetic oligonucleotide
  Target: ATXN1; (+) strand; PAM type: YTN; PAM sequence: TTG
tttactcccttactgaaatg

SEQ ID NO: 297622 - DNA, 20 bp, Artificial Sequence
  Description of Artificial Sequence: Synthetic oligonucleotide
  Target: ATXN1; (+) strand; PAM type: YTN; PAM sequence: TTT
actcccttactgaaatgtgt

SEQ ID NO: 297623 - DNA, 20 bp, Artificial Sequence
  Description of Artificial Sequence: Synthetic oligonucleotide
  Target: ATXN1; (+) strand; PAM type: YTN; PAM sequence: TTA
ctcccttactgaaatgtgtc

SEQ ID NO: 297624 - DNA, 20 bp, Artificial Sequence
  Description of Artificial Sequence: Synthetic oligonucleotide
  Target: ATXN1; (+) strand; PAM type: YTN; PAM sequence: CTC
ccttactgaaatgtgtcttt

SEQ ID NO: 297625 - DNA, 20 bp, Artificial Sequence
  Description of Artificial Sequence: Synthetic oligonucleotide
  Target: ATXN1; (+) strand; PAM type: YTN; PAM sequence: CTT
actgaaatgtgtctttgcca

SEQ ID NO: 297626 - DNA, 20 bp, Artificial Sequence
  Description of Artificial Sequence: Synthetic oligonucleotide
  Target: ATXN1; (+) strand; PAM type: YTN; PAM sequence: TTA
ctgaaatgtgtctttgccaa

SEQ ID NO: 297627 - DNA, 20 bp, Artificial Sequence
  Description of Artificial Sequence: Synthetic oligonucleotide
  Target: ATXN1; (+) strand; PAM type: YTN; PAM sequence: CTG
aaatgtgtctttgccaattt

SEQ ID NO: 297628 - DNA, 20 bp, Artificial Sequence
  Description of Artificial Sequence: Synthetic oligonucleotide
  Target: ATXN1; (+) strand; PAM type: YTN; PAM sequence: CTT
tgccaatttaaacaattact

SEQ ID NO: 297629 - DNA, 20 bp, Artificial Sequence
  Description of Artificial Sequence: Synthetic oligonucleotide
  Target: ATXN1; (+) strand; PAM type: YTN; PAM sequence: TTT
gccaatttaaacaattactt

SEQ ID NO: 297630 - DNA, 20 bp, Artificial Sequence
  Description of Artificial Sequence: Synthetic oligonucleotide
  Target: ATXN1; (+) strand; PAM type: YTN; PAM sequence: TTG
ccaatttaaacaattacttt

SEQ ID NO: 297631 - DNA, 20 bp, Artificial Sequence
  Description of Artificial Sequence: Synthetic oligonucleotide
  Target: ATXN1; (+) strand; PAM type: YTN; PAM sequence: TTT
aaacaattacttttcaacat

SEQ ID NO: 297632 - DNA, 20 bp, Artificial Sequence
  Description of Artificial Sequence: Synthetic oligonucleotide
  Target: ATXN1; (+) strand; PAM type: YTN; PAM sequence: TTA
aacaattacttttcaacatc

SEQ ID NO: 297633 - DNA, 20 bp, Artificial Sequence
  Description of Artificial Sequence: Synthetic oligonucleotide
  Target: ATXN1; (+) strand; PAM type: YTN; PAM sequence: TTA
cttttcaacatcctccaaat

SEQ ID NO: 297634 - DNA, 20 bp, Artificial Sequence
  Description of Artificial Sequence: Synthetic oligonucleotide
  Target: ATXN1; (+) strand; PAM type: YTN; PAM sequence: CTT
ttcaacatcctccaaatgtt

SEQ ID NO: 297635 - DNA, 20 bp, Artificial Sequence
  Description of Artificial Sequence: Synthetic oligonucleotide
  Target: ATXN1; (+) strand; PAM type: YTN; PAM sequence: TTT
tcaacatcctccaaatgttt

SEQ ID NO: 297636 - DNA, 20 bp, Artificial Sequence
  Description of Artificial Sequence: Synthetic oligonucleotide
  Target: ATXN1; (+) strand; PAM type: YTN; PAM sequence: TTT
caacatcctccaaatgtttt

SEQ ID NO: 297637 - DNA, 20 bp, Artificial Sequence
  Description of Artificial Sequence: Synthetic oligonucleotide
  Target: ATXN1; (+) strand; PAM type: YTN; PAM sequence: TTC
aacatcctccaaatgttttc

SEQ ID NO: 297638 - DNA, 20 bp, Artificial Sequence
  Description of Artificial Sequence: Synthetic oligonucleotide
  Target: ATXN1; (+) strand; PAM type: YTN; PAM sequence: CTC
caaatgttttctgtgtcata

SEQ ID NO: 297639 - DNA, 20 bp, Artificial Sequence
  Description of Artificial Sequence: Synthetic oligonucleotide
  Target: ATXN1; (+) strand; PAM type: YTN; PAM sequence: TTT
tctgtgtcatactgcattaa

SEQ ID NO: 297640 - DNA, 20 bp, Artificial Sequence
  Description of Artificial Sequence: Synthetic oligonucleotide
  Target: ATXN1; (+) strand; PAM type: YTN; PAM sequence: TTT
ctgtgtcatactgcattaaa

SEQ ID NO: 297641 - DNA, 20 bp, Artificial Sequence
  Description of Artificial Sequence: Synthetic oligonucleotide
  Target: ATXN1; (+) strand; PAM type: YTN; PAM sequence: TTC
tgtgtcatactgcattaaaa

SEQ ID NO: 297642 - DNA, 20 bp, Artificial Sequence
  Description of Artificial Sequence: Synthetic oligonucleotide
  Target: ATXN1; (+) strand; PAM type: YTN; PAM sequence: CTG
tgtcatactgcattaaaaga

SEQ ID NO: 297643 - DNA, 20 bp, Artificial Sequence
  Description of Artificial Sequence: Synthetic oligonucleotide
  Target: ATXN1; (+) strand; PAM type: YTN; PAM sequence: CTG
cattaaaagaaaaattactt

SEQ ID NO: 297644 - DNA, 20 bp, Artificial Sequence
  Description of Artificial Sequence: Synthetic oligonucleotide
  Target: ATXN1; (+) strand; PAM type: YTN; PAM sequence: TTA
aaagaaaaattacttctaaa

SEQ ID NO: 297645 - DNA, 20 bp, Artificial Sequence
  Description of Artificial Sequence: Synthetic oligonucleotide
  Target: ATXN1; (+) strand; PAM type: YTN; PAM sequence: TTA
cttctaaacactaaaattat

SEQ ID NO: 297646 - DNA, 20 bp, Artificial Sequence
  Description of Artificial Sequence: Synthetic oligonucleotide
  Target: ATXN1; (+) strand; PAM type: YTN; PAM sequence: CTT
ctaaacactaaaattatacc

SEQ ID NO: 297647 - DNA, 20 bp, Artificial Sequence
  Description of Artificial Sequence: Synthetic oligonucleotide
  Target: ATXN1; (+) strand; PAM type: YTN; PAM sequence: TTC
taaacactaaaattatacca

SEQ ID NO: 297648 - DNA, 20 bp, Artificial Sequence
  Description of Artificial Sequence: Synthetic oligonucleotide
  Target: ATXN1; (+) strand; PAM type: YTN; PAM sequence: CTA
aacactaaaattataccaca

SEQ ID NO: 297649 - DNA, 20 bp, Artificial Sequence
  Description of Artificial Sequence: Synthetic oligonucleotide
  Target: ATXN1; (+) strand; PAM type: YTN; PAM sequence: CTA
aaattataccacaggaaaaa

SEQ ID NO: 297650 - DNA, 20 bp, Artificial Sequence
  Description of Artificial Sequence: Synthetic oligonucleotide
  Target: ATXN1; (+) strand; PAM type: YTN; PAM sequence: TTA
taccacaggaaaaaaaaagg

SEQ ID NO: 297651 - DNA, 20 bp, Artificial Sequence
  Description of Artificial Sequence: Synthetic oligonucleotide
  Target: ATXN1; (+) strand; PAM type: YTN; PAM sequence: CTT
ttttaaaaacccatttttat

SEQ ID NO: 297652 - DNA, 20 bp, Artificial Sequence
  Description of Artificial Sequence: Synthetic oligonucleotide
  Target: ATXN1; (+) strand; PAM type: YTN; PAM sequence: TTT
tttaaaaacccatttttata

SEQ ID NO: 297653 - DNA, 20 bp, Artificial Sequence
  Description of Artificial Sequence: Synthetic oligonucleotide
  Target: ATXN1; (+) strand; PAM type: YTN; PAM sequence: TTT
ttaaaaacccatttttataa

SEQ ID NO: 297654 - DNA, 20 bp, Artificial Sequence
  Description of Artificial Sequence: Synthetic oligonucleotide
  Target: ATXN1; (+) strand; PAM type: YTN; PAM sequence: TTT
taaaaacccatttttataac

SEQ ID NO: 297655 - DNA, 20 bp, Artificial Sequence
  Description of Artificial Sequence: Synthetic oligonucleotide
  Target: ATXN1; (+) strand; PAM type: YTN; PAM sequence: TTT
aaaaacccatttttataaca

SEQ ID NO: 297656 - DNA, 20 bp, Artificial Sequence
  Description of Artificial Sequence: Synthetic oligonucleotide
  Target: ATXN1; (+) strand; PAM type: YTN; PAM sequence: TTA
aaaacccatttttataacac

SEQ ID NO: 297657 - DNA, 20 bp, Artificial Sequence
  Description of Artificial Sequence: Synthetic oligonucleotide
  Target: ATXN1; (+) strand; PAM type: YTN; PAM sequence: TTT
ttataacacttcttttgcta

SEQ ID NO: 297658 - DNA, 20 bp, Artificial Sequence
  Description of Artificial Sequence: Synthetic oligonucleotide
  Target: ATXN1; (+) strand; PAM type: YTN; PAM sequence: TTT
tataacacttcttttgctac

SEQ ID NO: 297659 - DNA, 20 bp, Artificial Sequence
  Description of Artificial Sequence: Synthetic oligonucleotide
  Target: ATXN1; (+) strand; PAM type: YTN; PAM sequence: TTT
ataacacttcttttgctaca

SEQ ID NO: 297660 - DNA, 20 bp, Artificial Sequence
  Description of Artificial Sequence: Synthetic oligonucleotide
  Target: ATXN1; (+) strand; PAM type: YTN; PAM sequence: TTA
taacacttcttttgctacat

SEQ ID NO: 297661 - DNA, 20 bp, Artificial Sequence
  Description of Artificial Sequence: Synthetic oligonucleotide
  Target: ATXN1; (+) strand; PAM type: YTN; PAM sequence: CTT
cttttgctacatctagctca

SEQ ID NO: 297662 - DNA, 20 bp, Artificial Sequence
  Description of Artificial Sequence: Synthetic oligonucleotide
  Target: ATXN1; (+) strand; PAM type: YTN; PAM sequence: TTC
ttttgctacatctagctcaa

SEQ ID NO: 297663 - DNA, 20 bp, Artificial Sequence
  Description of Artificial Sequence: Synthetic oligonucleotide
  Target: ATXN1; (+) strand; PAM type: YTN; PAM sequence: CTT
ttgctacatctagctcaagt

SEQ ID NO: 297664 - DNA, 20 bp, Artificial Sequence
  Description of Artificial Sequence: Synthetic oligonucleotide
  Target: ATXN1; (+) strand; PAM type: YTN; PAM sequence: TTT
tgctacatctagctcaagtc

SEQ ID NO: 297665 - DNA, 20 bp, Artificial Sequence
  Description of Artificial Sequence: Synthetic oligonucleotide
  Target: ATXN1; (+) strand; PAM type: YTN; PAM sequence: TTT
gctacatctagctcaagtca

SEQ ID NO: 297666 - DNA, 20 bp, Artificial Sequence
  Description of Artificial Sequence: Synthetic oligonucleotide
  Target: ATXN1; (+) strand; PAM type: YTN; PAM sequence: TTG
ctacatctagctcaagtcag

SEQ ID NO: 297667 - DNA, 20 bp, Artificial Sequence
  Description of Artificial Sequence: Synthetic oligonucleotide
  Target: ATXN1; (+) strand; PAM type: YTN; PAM sequence: CTA
catctagctcaagtcagcaa

SEQ ID NO: 297668 - DNA, 20 bp, Artificial Sequence
  Description of Artificial Sequence: Synthetic oligonucleotide
  Target: ATXN1; (+) strand; PAM type: YTN; PAM sequence: CTA
gctcaagtcagcaaaatgtg

SEQ ID NO: 297669 - DNA, 20 bp, Artificial Sequence
  Description of Artificial Sequence: Synthetic oligonucleotide
  Target: ATXN1; (+) strand; PAM type: YTN; PAM sequence: CTC
aagtcagcaaaatgtggctc

SEQ ID NO: 297670 - DNA, 20 bp, Artificial Sequence
  Description of Artificial Sequence: Synthetic oligonucleotide
  Target: ATXN1; (+) strand; PAM type: YTN; PAM sequence: CTC
tagtaaatgccttggagtct

SEQ ID NO: 297671 - DNA, 20 bp, Artificial Sequence
  Description of Artificial Sequence: Synthetic oligonucleotide
  Target: ATXN1; (+) strand; PAM type: YTN; PAM sequence: CTA
gtaaatgccttggagtctgt

SEQ ID NO: 297672 - DNA, 20 bp, Artificial Sequence
  Description of Artificial Sequence: Synthetic oligonucleotide
  Target: ATXN1; (+) strand; PAM type: YTN; PAM sequence: CTT
ggagtctgtggtaggcacaa

SEQ ID NO: 297673 - DNA, 20 bp, Artificial Sequence
  Description of Artificial Sequence: Synthetic oligonucleotide
  Target: ATXN1; (+) strand; PAM type: YTN; PAM sequence: TTG
gagtctgtggtaggcacaac

SEQ ID NO: 297674 - DNA, 20 bp, Artificial Sequence
  Description of Artificial Sequence: Synthetic oligonucleotide
  Target: ATXN1; (+) strand; PAM type: YTN; PAM sequence: CTG
tggtaggcacaacaagggac

SEQ ID NO: 297675 - DNA, 20 bp, Artificial Sequence
  Description of Artificial Sequence: Synthetic oligonucleotide
  Target: ATXN1; (+) strand; PAM type: YTN; PAM sequence: CTT
caaacatacccacgtcctaa

SEQ ID NO: 297676 - DNA, 20 bp, Artificial Sequence
  Description of Artificial Sequence: Synthetic oligonucleotide
  Target: ATXN1; (+) strand; PAM type: YTN; PAM sequence: TTC
aaacatacccacgtcctaat

SEQ ID NO: 297677 - DNA, 20 bp, Artificial Sequence
  Description of Artificial Sequence: Synthetic oligonucleotide
  Target: ATXN1; (+) strand; PAM type: YTN; PAM sequence: CTA
atccccagaatcagtctgtg

SEQ ID NO: 297678 - DNA, 20 bp, Artificial Sequence
  Description of Artificial Sequence: Synthetic oligonucleotide
  Target: ATXN1; (+) strand; PAM type: YTN; PAM sequence: CTG
tgaattcgtggtaaaagcga

SEQ ID NO: 297679 - DNA, 20 bp, Artificial Sequence
  Description of Artificial Sequence: Synthetic oligonucleotide
  Target: ATXN1; (+) strand; PAM type: YTN; PAM sequence: TTC
gtggtaaaagcgatttcaca

SEQ ID NO: 297680 - DNA, 20 bp, Artificial Sequence
  Description of Artificial Sequence: Synthetic oligonucleotide
  Target: ATXN1; (+) strand; PAM type: YTN; PAM sequence: TTT
cacagatgtgatgacattaa

SEQ ID NO: 297681 - DNA, 20 bp, Artificial Sequence
  Description of Artificial Sequence: Synthetic oligonucleotide
  Target: ATXN1; (+) strand; PAM type: YTN; PAM sequence: TTC
acagatgtgatgacattaag

SEQ ID NO: 297682 - DNA, 20 bp, Artificial Sequence
  Description of Artificial Sequence: Synthetic oligonucleotide
  Target: ATXN1; (+) strand; PAM type: YTN; PAM sequence: TTA
aggatctggagatggggaga

SEQ ID NO: 297683 - DNA, 20 bp, Artificial Sequence
  Description of Artificial Sequence: Synthetic oligonucleotide
  Target: ATXN1; (+) strand; PAM type: YTN; PAM sequence: CTG
gagatggggagatgatacag

SEQ ID NO: 297684 - DNA, 20 bp, Artificial Sequence
  Description of Artificial Sequence: Synthetic oligonucleotide
  Target: ATXN1; (+) strand; PAM type: YTN; PAM sequence: TTT
aaaagtctgagaaggaggaa

SEQ ID NO: 297685 - DNA, 20 bp, Artificial Sequence
  Description of Artificial Sequence: Synthetic oligonucleotide
  Target: ATXN1; (+) strand; PAM type: YTN; PAM sequence: TTA
aaagtctgagaaggaggaag

SEQ ID NO: 297686 - DNA, 20 bp, Artificial Sequence
  Description of Artificial Sequence: Synthetic oligonucleotide
  Target: ATXN1; (+) strand; PAM type: YTN; PAM sequence: CTG
agaaggaggaagaagtgtca

SEQ ID NO: 297687 - DNA, 20 bp, Artificial Sequence
  Description of Artificial Sequence: Synthetic oligonucleotide
  Target: ATXN1; (+) strand; PAM type: YTN; PAM sequence: TTC
aactatggaaacacagcaca

SEQ ID NO: 297688 - DNA, 20 bp, Artificial Sequence
  Description of Artificial Sequence: Synthetic oligonucleotide
  Target: ATXN1; (+) strand; PAM type: YTN; PAM sequence: CTA
tggaaacacagcacagagag

SEQ ID NO: 297689 - DNA, 20 bp, Artificial Sequence
  Description of Artificial Sequence: Synthetic oligonucleotide
  Target: ATXN1; (+) strand; PAM type: YTN; PAM sequence: TTG
atggctttgaagatagggga

SEQ ID NO: 297690 - DNA, 20 bp, Artificial Sequence
  Description of Artificial Sequence: Synthetic oligonucleotide
  Target: ATXN1; (+) strand; PAM type: YTN; PAM sequence: CTT
tgaagataggggaaggggcc

SEQ ID NO: 297691 - DNA, 20 bp, Artificial Sequence
  Description of Artificial Sequence: Synthetic oligonucleotide
  Target: ATXN1; (+) strand; PAM type: YTN; PAM sequence: TTT
gaagataggggaaggggcca

SEQ ID NO: 297692 - DNA, 20 bp, Artificial Sequence
  Description of Artificial Sequence: Synthetic oligonucleotide
  Target: ATXN1; (+) strand; PAM type: YTN; PAM sequence: TTG
aagataggggaaggggccag

SEQ ID NO: 297693 - DNA, 20 bp, Artificial Sequence
  Description of Artificial Sequence: Synthetic oligonucleotide
  Target: ATXN1; (+) strand; PAM type: YTN; PAM sequence: CTA
gacaatggaaaaaggtgggc

SEQ ID NO: 297694 - DNA, 20 bp, Artificial Sequence
  Description of Artificial Sequence: Synthetic oligonucleotide
  Target: ATXN1; (+) strand; PAM type: YTN; PAM sequence: TTC
atgcctgtgatcccagcact

SEQ ID NO: 297695 - DNA, 20 bp, Artificial Sequence
  Description of Artificial Sequence: Synthetic oligonucleotide
  Target: ATXN1; (+) strand; PAM type: YTN; PAM sequence: CTG
tgatcccagcactctgggag

SEQ ID NO: 297696 - DNA, 20 bp, Artificial Sequence
  Description of Artificial Sequence: Synthetic oligonucleotide
  Target: ATXN1; (+) strand; PAM type: YTN; PAM sequence: CTC
tgggaggccgaggcgggtgg

SEQ ID NO: 297697 - DNA, 20 bp, Artificial Sequence
  Description of Artificial Sequence: Synthetic oligonucleotide
  Target: ATXN1; (+) strand; PAM type: YTN; PAM sequence: CTG
ggaggccgaggcgggtggat

SEQ ID NO: 297698 - DNA, 20 bp, Artificial Sequence
  Description of Artificial Sequence: Synthetic oligonucleotide
  Target: ATXN1; (+) strand; PAM type: YTN; PAM sequence: CTG
aggtcgagagttcgagacca

SEQ ID NO: 297699 - DNA, 20 bp, Artificial Sequence
  Description of Artificial Sequence: Synthetic oligonucleotide
  Target: ATXN1; (+) strand; PAM type: YTN; PAM sequence: TTC
gagaccagcctggccaacat

SEQ ID NO: 297700 - DNA, 20 bp, Artificial Sequence
  Description of Artificial Sequence: Synthetic oligonucleotide
  Target: ATXN1; (+) strand; PAM type: YTN; PAM sequence: CTG
gccaacatggagaaacccca

SEQ ID NO: 297701 - DNA, 20 bp, Artificial Sequence
  Description of Artificial Sequence: Synthetic oligonucleotide
  Target: ATXN1; (+) strand; PAM type: YTN; PAM sequence: CTC
tagtaaaaatataaaattta

SEQ ID NO: 297702 - DNA, 20 bp, Artificial Sequence
  Description of Artificial Sequence: Synthetic oligonucleotide
  Target: ATXN1; (+) strand; PAM type: YTN; PAM sequence: CTA
gtaaaaatataaaatttagt

SEQ ID NO: 297703 - DNA, 20 bp, Artificial Sequence
  Description of Artificial Sequence: Synthetic oligonucleotide
  Target: ATXN1; (+) strand; PAM type: YTN; PAM sequence: TTT
agttgggtatggtgctgggc

SEQ ID NO: 297704 - DNA, 20 bp, Artificial Sequence
  Description of Artificial Sequence: Synthetic oligonucleotide
  Target: ATXN1; (+) strand; PAM type: YTN; PAM sequence: TTA
gttgggtatggtgctgggct

SEQ ID NO: 297705 - DNA, 20 bp, Artificial Sequence
  Description of Artificial Sequence: Synthetic oligonucleotide
  Target: ATXN1; (+) strand; PAM type: YTN; PAM sequence: TTG
ggtatggtgctgggctactc

SEQ ID NO: 297706 - DNA, 20 bp, Artificial Sequence
  Description of Artificial Sequence: Synthetic oligonucleotide
  Target: ATXN1; (+) strand; PAM type: YTN; PAM sequence: CTG
ggctactcccagctacttgg

SEQ ID NO: 297707 - DNA, 20 bp, Artificial Sequence
  Description of Artificial Sequence: Synthetic oligonucleotide
  Target: ATXN1; (+) strand; PAM type: YTN; PAM sequence: CTA
ctcccagctacttgggaggc

SEQ ID NO: 297708 - DNA, 20 bp, Artificial Sequence
  Description of Artificial Sequence: Synthetic oligonucleotide
  Target: ATXN1; (+) strand; PAM type: YTN; PAM sequence: CTC
ccagctacttgggaggctga

SEQ ID NO: 297709 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgaggcagga

SEQ ID NO: 297710 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggcaggagaa

SEQ ID NO: 297711 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcaggagaat

SEQ ID NO: 297712 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaattgcttgaa

SEQ ID NO: 297713 - DNA, 20 bp, Artificial Sequence
  Description of Artificial Sequence: Synthetic oligonucleotide
  Target: ATXN1; (+) strand; PAM type: YTN; PAM sequence: TTG
cttgaaccttggagacggag

SEQ ID NO: 297714 - DNA, 20 bp, Artificial Sequence
  Description of Artificial Sequence: Synthetic oligonucleotide
  Target: ATXN1; (+) strand; PAM type: YTN; PAM sequence: CTT
gaaccttggagacggaggtg

SEQ ID NO: 297715 - DNA, 20 bp, Artificial Sequence
  Description of Artificial Sequence: Synthetic oligonucleotide
  Target: ATXN1; (+) strand; PAM type: YTN; PAM sequence: TTG
aaccttggagacggaggtgg

SEQ ID NO: 297716 - DNA, 20 bp, Artificial Sequence
  Description of Artificial Sequence: Synthetic oligonucleotide
  Target: ATXN1; (+) strand; PAM type: YTN; PAM sequence: CTT
ggagacggaggtggcactga

SEQ ID NO: 297717 - DNA, 20 bp, Artificial Sequence
  Description of Artificial Sequence: Synthetic oligonucleotide
  Target: ATXN1; (+) strand; PAM type: YTN; PAM sequence: TTG
gagacggaggtggcactgag

SEQ ID NO: 297718 - DNA, 20 bp, Artificial Sequence
  Description of Artificial Sequence: Synthetic oligonucleotide
  Target: ATXN1; (+) strand; PAM type: YTN; PAM sequence: CTG
agccaatatgtgccactgca

SEQ ID NO: 297719 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggcgacag

SEQ ID NO: 297720 - DNA, 20 bp, Artificial Sequence
  Description of Artificial Sequence: Synthetic oligonucleotide
  Target: ATXN1; (+) strand; PAM type: YTN; PAM sequence: CTC
cagcctgggcgacagaatga

SEQ ID NO: 297721 - DNA, 20 bp, Artificial Sequence
  Description of Artificial Sequence: Synthetic oligonucleotide
  Target: ATXN1; (+) strand; PAM type: YTN; PAM sequence: CTG
ggcgacagaatgagactccg

SEQ ID NO: 297722 - DNA, 20 bp, Artificial Sequence
  Description of Artificial Sequence: Synthetic oligonucleotide
  Target: ATXN1; (+) strand; PAM type: YTN; PAM sequence: CTC
cgttcccccccgccaaaaaa

SEQ ID NO: 297723 - DNA, 20 bp, Artificial Sequence
  Description of Artificial Sequence: Synthetic oligonucleotide
  Target: ATXN1; (+) strand; PAM type: YTN; PAM sequence: TTC
ccccccgccaaaaaaaaaaa

SEQ ID NO: 297724 - DNA, 20 bp, Artificial Sequence
  Description of Artificial Sequence: Synthetic oligonucleotide
  Target: ATXN1; (+) strand; PAM type: YTN; PAM sequence: TTA
ttctctagagtccctacaga

SEQ ID NO: 297725 - DNA, 20 bp, Artificial Sequence
  Description of Artificial Sequence: Synthetic oligonucleotide
  Target: ATXN1; (+) strand; PAM type: YTN; PAM sequence: TTC
tctagagtccctacagagaa

SEQ ID NO: 297726 - DNA, 20 bp, Artificial Sequence
  Description of Artificial Sequence: Synthetic oligonucleotide
  Target: ATXN1; (+) strand; PAM type: YTN; PAM sequence: CTC
tagagtccctacagagaatg

SEQ ID NO: 297727 - DNA, 20 bp, Artificial Sequence
  Description of Artificial Sequence: Synthetic oligonucleotide
  Target: ATXN1; (+) strand; PAM type: YTN; PAM sequence: CTA
gagtccctacagagaatgag

SEQ ID NO: 297728 - DNA, 20 bp, Artificial Sequence
  Description of Artificial Sequence: Synthetic oligonucleotide
  Target: ATXN1; (+) strand; PAM type: YTN; PAM sequence: CTA
cagagaatgagcctggctga

SEQ ID NO: 297729 - DNA, 20 bp, Artificial Sequence
  Description of Artificial Sequence: Synthetic oligonucleotide
  Target: ATXN1; (+) strand; PAM type: YTN; PAM sequence: CTG
gctgacactttgatttcagc

SEQ ID NO: 297730 - DNA, 20 bp, Artificial Sequence
  Description of Artificial Sequence: Synthetic oligonucleotide
  Target: ATXN1; (+) strand; PAM type: YTN; PAM sequence: CTG
acactttgatttcagcctgg

SEQ ID NO: 297731 - DNA, 20 bp, Artificial Sequence
  Description of Artificial Sequence: Synthetic oligonucleotide
  Target: ATXN1; (+) strand; PAM type: YTN; PAM sequence: CTT
tgatttcagcctggtgagac

SEQ ID NO: 297732 - DNA, 20 bp, Artificial Sequence
  Description of Artificial Sequence: Synthetic oligonucleotide
  Target: ATXN1; (+) strand; PAM type: YTN; PAM sequence: TTT
gatttcagcctggtgagacc

SEQ ID NO: 297733 - DNA, 20 bp, Artificial Sequence
  Description of Artificial Sequence: Synthetic oligonucleotide
  Target: ATXN1; (+) strand; PAM type: YTN; PAM sequence: TTG
atttcagcctggtgagacct

SEQ ID NO: 297734 - DNA, 20 bp, Artificial Sequence
  Description of Artificial Sequence: Synthetic oligonucleotide
  Target: ATXN1; (+) strand; PAM type: YTN; PAM sequence: TTT
cagcctggtgagacctgtat

SEQ ID NO: 297735 - DNA, 20 bp, Artificial Sequence
  Description of Artificial Sequence: Synthetic oligonucleotide
  Target: ATXN1; (+) strand; PAM type: YTN; PAM sequence: TTC
agcctggtgagacctgtatt

SEQ ID NO: 297736 - DNA, 20 bp, Artificial Sequence
  Description of Artificial Sequence: Synthetic oligonucleotide
  Target: ATXN1; (+) strand; PAM type: YTN; PAM sequence: CTG
gtgagacctgtattggattt

SEQ ID NO: 297737 - DNA, 20 bp, Artificial Sequence
  Description of Artificial Sequence: Synthetic oligonucleotide
  Target: ATXN1; (+) strand; PAM type: YTN; PAM sequence: CTG
tattggatttctgacctgca

SEQ ID NO: 297738 - DNA, 20 bp, Artificial Sequence
  Description of Artificial Sequence: Synthetic oligonucleotide
  Target: ATXN1; (+) strand; PAM type: YTN; PAM sequence: TTG
gatttctgacctgcagaact

SEQ ID NO: 297739 - DNA, 20 bp, Artificial Sequence
  Description of Artificial Sequence: Synthetic oligonucleotide
  Target: ATXN1; (+) strand; PAM type: YTN; PAM sequence: TTT
ctgacctgcagaactgtcag

SEQ ID NO: 297740 - DNA, 20 bp, Artificial Sequence
  Description of Artificial Sequence: Synthetic oligonucleotide
  Target: ATXN1; (+) strand; PAM type: YTN; PAM sequence: TTC
tgacctgcagaactgtcaga

SEQ ID NO: 297741 - DNA, 20 bp, Artificial Sequence
  Description of Artificial Sequence: Synthetic oligonucleotide
  Target: ATXN1; (+) strand; PAM type: YTN; PAM sequence: CTG
acctgcagaactgtcagata

SEQ ID NO: 297742 - DNA, 20 bp, Artificial Sequence
  Description of Artificial Sequence: Synthetic oligonucleotide
  Target: ATXN1; (+) strand; PAM type: YTN; PAM sequence: CTG
cagaactgtcagataaaaac

SEQ ID NO: 297743 - DNA, 20 bp, Artificial Sequence
  Description of Artificial Sequence: Synthetic oligonucleotide
  Target: ATXN1; (+) strand; PAM type: YTN; PAM sequence: CTG
tcagataaaaacagttgctt

SEQ ID NO: 297744 - DNA, 20 bp, Artificial Sequence
  Description of Artificial Sequence: Synthetic oligonucleotide
  Target: ATXN1; (+) strand; PAM type: YTN; PAM sequence: TTG
ctttaagccacaaagttcct

SEQ ID NO: 297745 - DNA, 20 bp, Artificial Sequence
  Description of Artificial Sequence: Synthetic oligonucleotide
  Target: ATXN1; (+) strand; PAM type: YTN; PAM sequence: CTT
taagccacaaagttcctgat

SEQ ID NO: 297746 - DNA, 20 bp, Artificial Sequence
  Description of Artificial Sequence: Synthetic oligonucleotide
  Target: ATXN1; (+) strand; PAM type: YTN; PAM sequence: TTT
aagccacaaagttcctgata

SEQ ID NO: 297747 - DNA, 20 bp, Artificial Sequence
  Description of Artificial Sequence: Synthetic oligonucleotide
  Target: ATXN1; (+) strand; PAM type: YTN; PAM sequence: TTA
agccacaaagttcctgataa

SEQ ID NO: 297748 - DNA, 20 bp, Artificial Sequence
  Description of Artificial Sequence: Synthetic oligonucleotide
  Target: ATXN1; (+) strand; PAM type: YTN; PAM sequence: TTC
ctgataagttgttacagcag

SEQ ID NO: 297749 - DNA, 20 bp, Artificial Sequence
  Description of Artificial Sequence: Synthetic oligonucleotide
  Target: ATXN1; (+) strand; PAM type: YTN; PAM sequence: CTG
ataagttgttacagcagcaa

SEQ ID NO: 297750 - DNA, 20 bp, Artificial Sequence
  Description of Artificial Sequence: Synthetic oligonucleotide
  Target: ATXN1; (+) strand; PAM type: YTN; PAM sequence: TTG
ttacagcagcaatgaaaaac

SEQ ID NO: 297751 - DNA, 20 bp, Artificial Sequence
  Description of Artificial Sequence: Synthetic oligonucleotide
  Target: ATXN1; (+) strand; PAM type: YTN; PAM sequence: TTA
cagcagcaatgaaaaactaa

SEQ ID NO: 297752 - DNA, 20 bp, Artificial Sequence
  Description of Artificial Sequence: Synthetic oligonucleotide
  Target: ATXN1; (+) strand; PAM type: YTN; PAM sequence: CTA
acacaggtgctttgaagaaa

SEQ ID NO: 297753 - DNA, 20 bp, Artificial Sequence
  Description of Artificial Sequence: Synthetic oligonucleotide
  Target: ATXN1; (+) strand; PAM type: YTN; PAM sequence: CTT
tgaagaaactcaggtcacct

SEQ ID NO: 297754 - DNA, 20 bp, Artificial Sequence
  Description of Artificial Sequence: Synthetic oligonucleotide
  Target: ATXN1; (+) strand; PAM type: YTN; PAM sequence: TTT
gaagaaactcaggtcacctc

SEQ ID NO: 297755 - DNA, 20 bp, Artificial Sequence
  Description of Artificial Sequence: Synthetic oligonucleotide
  Target: ATXN1; (+) strand; PAM type: YTN; PAM sequence: TTG
aagaaactcaggtcacctct

SEQ ID NO: 297756 - DNA, 20 bp, Artificial Sequence
  Description of Artificial Sequence: Synthetic oligonucleotide
  Target: ATXN1; (+) strand; PAM type: YTN; PAM sequence: CTC
aggtcacctctaacacaaag

SEQ ID NO: 297757 - DNA, 20 bp, Artificial Sequence
  Description of Artificial Sequence: Synthetic oligonucleotide
  Target: ATXN1; (+) strand; PAM type: YTN; PAM sequence: CTC
taacacaaaggccatggccc

SEQ ID NO: 297758 - DNA, 20 bp, Artificial Sequence
  Description of Artificial Sequence: Synthetic oligonucleotide
  Target: ATXN1; (+) strand; PAM type: YTN; PAM sequence: CTA
acacaaaggccatggcccag

SEQ ID NO: 297759 - DNA, 20 bp, Artificial Sequence
  Description of Artificial Sequence: Synthetic oligonucleotide
  Target: ATXN1; (+) strand; PAM type: YTN; PAM sequence: CTT
tccggctttaccaaacacat

SEQ ID NO: 297760 - DNA, 20 bp, Artificial Sequence
  Description of Artificial Sequence: Synthetic oligonucleotide
  Target: ATXN1; (+) strand; PAM type: YTN; PAM sequence: TTT
ccggctttaccaaacacata

SEQ ID NO: 297761 - DNA, 20 bp, Artificial Sequence
  Description of Artificial Sequence: Synthetic oligonucleotide
  Target: ATXN1; (+) strand; PAM type: YTN; PAM sequence: TTC
cggctttaccaaacacataa

SEQ ID NO: 297762 - DNA, 20 bp, Artificial Sequence
  Description of Artificial Sequence: Synthetic oligonucleotide
  Target: ATXN1; (+) strand; PAM type: YTN; PAM sequence: CTT
taccaaacacataaagacag

SEQ ID NO: 297763 - DNA, 20 bp, Artificial Sequence
  Description of Artificial Sequence: Synthetic oligonucleotide
  Target: ATXN1; (+) strand; PAM type: YTN; PAM sequence: TTT
accaaacacataaagacaga

SEQ ID NO: 297764 - DNA, 20 bp, Artificial Sequence
  Description of Artificial Sequence: Synthetic oligonucleotide
  Target: ATXN1; (+) strand; PAM type: YTN; PAM sequence: TTA
ccaaacacataaagacagaa

SEQ ID NO: 297765 - DNA, 20 bp, Artificial Sequence
  Description of Artificial Sequence: Synthetic oligonucleotide
  Target: ATXN1; (+) strand; PAM type: YTN; PAM sequence: TTA
atttggcacaaatgggatat

SEQ ID NO: 297766 - DNA, 20 bp, Artificial Sequence
  Description of Artificial Sequence: Synthetic oligonucleotide
  Target: ATXN1; (+) strand; PAM type: YTN; PAM sequence: TTT
ggcacaaatgggatatggcc

SEQ ID NO: 297767 - DNA, 20 bp, Artificial Sequence
  Description of Artificial Sequence: Synthetic oligonucleotide
  Target: ATXN1; (+) strand; PAM type: YTN; PAM sequence: TTG
gcacaaatgggatatggccc

SEQ ID NO: 297768 - DNA, 20 bp, Artificial Sequence
  Description of Artificial Sequence: Synthetic oligonucleotide
  Target: ATXN1; (+) strand; PAM type: YTN; PAM sequence: TTT
attttcatgcaatgctgcta

SEQ ID NO: 297769 - DNA, 20 bp, Artificial Sequence
  Description of Artificial Sequence: Synthetic oligonucleotide
  Target: ATXN1; (+) strand; PAM type: YTN; PAM sequence: TTA
ttttcatgcaatgctgctac

SEQ ID NO: 297770 - DNA, 20 bp, Artificial Sequence
  Description of Artificial Sequence: Synthetic oligonucleotide
  Target: ATXN1; (+) strand; PAM type: YTN; PAM sequence: TTT
tcatgcaatgctgctacctc

SEQ ID NO: 297771 - DNA, 20 bp, Artificial Sequence
  Description of Artificial Sequence: Synthetic oligonucleotide
  Target: ATXN1; (+) strand; PAM type: YTN; PAM sequence: TTT
catgcaatgctgctacctct

SEQ ID NO: 297772 - DNA, 20 bp, Artificial Sequence
  Description of Artificial Sequence: Synthetic oligonucleotide
  Target: ATXN1; (+) strand; PAM type: YTN; PAM sequence: TTC
atgcaatgctgctacctctt

SEQ ID NO: 297773 - DNA, 20 bp, Artificial Sequence
  Description of Artificial Sequence: Synthetic oligonucleotide
  Target: ATXN1; (+) strand; PAM type: YTN; PAM sequence: CTG
ctacctcttttctccgtttc

SEQ ID NO: 297774 - DNA, 20 bp, Artificial Sequence
  Description of Artificial Sequence: Synthetic oligonucleotide
  Target: ATXN1; (+) strand; PAM type: YTN; PAM sequence: CTA
cctcttttctccgtttcctt

SEQ ID NO: 297775 - DNA, 20 bp, Artificial Sequence
  Description of Artificial Sequence: Synthetic oligonucleotide
  Target: ATXN1; (+) strand; PAM type: YTN; PAM sequence: CTC
ttttctccgtttccttcctt

SEQ ID NO: 297776 - DNA, 20 bp, Artificial Sequence
  Description of Artificial Sequence: Synthetic oligonucleotide
  Target: ATXN1; (+) strand; PAM type: YTN; PAM sequence: CTT
ttctccgtttccttccttat

SEQ ID NO: 297777 - DNA, 20 bp, Artificial Sequence
  Description of Artificial Sequence: Synthetic oligonucleotide
  Target: ATXN1; (+) strand; PAM type: YTN; PAM sequence: TTT
tctccgtttccttccttatc

SEQ ID NO: 297778 - DNA, 20 bp, Artificial Sequence
  Description of Artificial Sequence: Synthetic oligonucleotide
  Target: ATXN1; (+) strand; PAM type: YTN; PAM sequence: TTT
ctccgtttccttccttatcc

SEQ ID NO: 297779 - DNA, 20 bp, Artificial Sequence
  Description of Artificial Sequence: Synthetic oligonucleotide
  Target: ATXN1; (+) strand; PAM type: YTN; PAM sequence: TTC
tccgtttccttccttatcct

SEQ ID NO: 297780 - DNA, 20 bp, Artificial Sequence
  Description of Artificial Sequence: Synthetic oligonucleotide
  Target: ATXN1; (+) strand; PAM type: YTN; PAM sequence: CTC
cgtttccttccttatcctgc

SEQ ID NO: 297781 - DNA, 20 bp, Artificial Sequence
  Description of Artificial Sequence: Synthetic oligonucleotide
  Target: ATXN1; (+) strand; PAM type: YTN; PAM sequence: TTT
ccttccttatcctgctcttc

SEQ ID NO: 297782 - DNA, 20 bp, Artificial Sequence
  Description of Artificial Sequence: Synthetic oligonucleotide
  Target: ATXN1; (+) strand; PAM type: YTN; PAM sequence: TTC
cttccttatcctgctcttcc

SEQ ID NO: 297783 - DNA, 20 bp, Artificial Sequence
  Description of Artificial Sequence: Synthetic oligonucleotide
  Target: ATXN1; (+) strand; PAM type: YTN; PAM sequence: CTT
ccttatcctgctcttcccac

SEQ ID NO: 297784 - DNA, 20 bp, Artificial Sequence
  Description of Artificial Sequence: Synthetic oligonucleotide
  Target: ATXN1; (+) strand; PAM type: YTN; PAM sequence: TTC
cttatcctgctcttcccact

SEQ ID NO: 297785 - DNA, 20 bp, Artificial Sequence
  Description of Artificial Sequence: Synthetic oligonucleotide
  Target: ATXN1; (+) strand; PAM type: YTN; PAM sequence: CTT
atcctgctcttcccactcac

SEQ ID NO: 297786 - DNA, 20 bp, Artificial Sequence
  Description of Artificial Sequence: Synthetic oligonucleotide
  Target: ATXN1; (+) strand; PAM type: YTN; PAM sequence: TTA
tcctgctcttcccactcacg

SEQ ID NO: 297787 - DNA, 20 bp, Artificial Sequence
  Description of Artificial Sequence: Synthetic oligonucleotide
  Target: ATXN1; (+) strand; PAM type: YTN; PAM sequence: CTG
ctcttcccactcacgcctgc

SEQ ID NO: 297788 - DNA, 20 bp, Artificial Sequence
  Description of Artificial Sequence: Synthetic oligonucleotide
  Target: ATXN1; (+) strand; PAM type: YTN; PAM sequence: CTC
ttcccactcacgcctgcagc

SEQ ID NO: 297789 - DNA, 20 bp, Artificial Sequence
  Description of Artificial Sequence: Synthetic oligonucleotide
  Target: ATXN1; (+) strand; PAM type: YTN; PAM sequence: CTT
cccactcacgcctgcagctt

SEQ ID NO: 297790 - DNA, 20 bp, Artificial Sequence
  Description of Artificial Sequence: Synthetic oligonucleotide
  Target: ATXN1; (+) strand; PAM type: YTN; PAM sequence: TTC
ccactcacgcctgcagctta

SEQ ID NO: 297791 - DNA, 20 bp, Artificial Sequence
  Description of Artificial Sequence: Synthetic oligonucleotide
  Target: ATXN1; (+) strand; PAM type: YTN; PAM sequence: CTC
acgcctgcagcttacctcct

SEQ ID NO: 297792 - DNA, 20 bp, Artificial Sequence
  Description of Artificial Sequence: Synthetic oligonucleotide
  Target: ATXN1; (+) strand; PAM type: YTN; PAM sequence: CTG
cagcttacctcctcaccttt

SEQ ID NO: 297793 - DNA, 20 bp, Artificial Sequence
  Description of Artificial Sequence: Synthetic oligonucleotide
  Target: ATXN1; (+) strand; PAM type: YTN; PAM sequence: CTT
acctcctcacctttgtcaag

SEQ ID NO: 297794 - DNA, 20 bp, Artificial Sequence
  Description of Artificial Sequence: Synthetic oligonucleotide
  Target: ATXN1; (+) strand; PAM type: YTN; PAM sequence: TTA
cctcctcacctttgtcaagg

SEQ ID NO: 297795 - DNA, 20 bp, Artificial Sequence
  Description of Artificial Sequence: Synthetic oligonucleotide
  Target: ATXN1; (+) strand; PAM type: YTN; PAM sequence: CTC
ctcacctttgtcaaggcagg

SEQ ID NO: 297796 - DNA, 20 bp, Artificial Sequence
  Description of Artificial Sequence: Synthetic oligonucleotide
  Target: ATXN1; (+) strand; PAM type: YTN; PAM sequence: CTC
acctttgtcaaggcaggctg

SEQ ID NO: 297797 - DNA, 20 bp, Artificial Sequence
  Description of Artificial Sequence: Synthetic oligonucleotide
  Target: ATXN1; (+) strand; PAM type: YTN; PAM sequence: CTT
tgtcaaggcaggctgattta

SEQ ID NO: 297798 - DNA, 20 bp, Artificial Sequence
  Description of Artificial Sequence: Synthetic oligonucleotide
  Target: ATXN1; (+) strand; PAM type: YTN; PAM sequence: TTT
gtcaaggcaggctgatttat

SEQ ID NO: 297799 - DNA, 20 bp, Artificial Sequence
  Description of Artificial Sequence: Synthetic oligonucleotide
  Target: ATXN1; (+) strand; PAM type: YTN; PAM sequence: TTG
tcaaggcaggctgatttatc

SEQ ID NO: 297800 - DNA, 20 bp, Artificial Sequence
  Description of Artificial Sequence: Synthetic oligonucleotide
  Target: ATXN1; (+) strand; PAM type: YTN; PAM sequence: CTG
atttatcagcttggaaacta

SEQ ID NO: 297801 - DNA, 20 bp, Artificial Sequence
  Description of Artificial Sequence: Synthetic oligonucleotide
  Target: ATXN1; (+) strand; PAM type: YTN; PAM sequence: TTT
atcagcttggaaactatgag

SEQ ID NO: 297802 - DNA, 20 bp, Artificial Sequence
  Description of Artificial Sequence: Synthetic oligonucleotide
  Target: ATXN1; (+) strand; PAM type: YTN; PAM sequence: TTA
tcagcttggaaactatgaga

SEQ ID NO: 297803 - DNA, 20 bp, Artificial Sequence
  Description of Artificial Sequence: Synthetic oligonucleotide
  Target: ATXN1; (+) strand; PAM type: YTN; PAM sequence: CTT
ggaaactatgagaaggaaag

SEQ ID NO: 297804 - DNA, 20 bp, Artificial Sequence
  Description of Artificial Sequence: Synthetic oligonucleotide
  Target: ATXN1; (+) strand; PAM type: YTN; PAM sequence: TTG
gaaactatgagaaggaaagg

SEQ ID NO: 297805 - DNA, 20 bp, Artificial Sequence
  Description of Artificial Sequence: Synthetic oligonucleotide
  Target: ATXN1; (+) strand; PAM type: YTN; PAM sequence: CTA
tgagaaggaaagggtctaag

SEQ ID NO: 297806 - DNA, 20 bp, Artificial Sequence
  Description of Artificial Sequence: Synthetic oligonucleotide
  Target: ATXN1; (+) strand; PAM type: YTN; PAM sequence: CTA
aggcagggtttctcaactcc

SEQ ID NO: 297807 - DNA, 20 bp, Artificial Sequence
  Description of Artificial Sequence: Synthetic oligonucleotide
  Target: ATXN1; (+) strand; PAM type: YTN; PAM sequence: TTT
ctcaactccagcactattaa

SEQ ID NO: 297808 - DNA, 20 bp, Artificial Sequence
  Description of Artificial Sequence: Synthetic oligonucleotide
  Target: ATXN1; (+) strand; PAM type: YTN; PAM sequence: TTC
tcaactccagcactattaac

SEQ ID NO: 297809 - DNA, 20 bp, Artificial Sequence
  Description of Artificial Sequence: Synthetic oligonucleotide
  Target: ATXN1; (+) strand; PAM type: YTN; PAM sequence: CTC
aactccagcactattaacat

SEQ ID NO: 297810 - DNA, 20 bp, Artificial Sequence
  Description of Artificial Sequence: Synthetic oligonucleotide
  Target: ATXN1; (+) strand; PAM type: YTN; PAM sequence: CTC
cagcactattaacattttgg

SEQ ID NO: 297811 - DNA, 20 bp, Artificial Sequence
  Description of Artificial Sequence: Synthetic oligonucleotide
  Target: ATXN1; (+) strand; PAM type: YTN; PAM sequence: CTA
ttaacattttgggccagatg

SEQ ID NO: 297812 - DNA, 20 bp, Artificial Sequence
  Description of Artificial Sequence: Synthetic oligonucleotide
  Target: ATXN1; (+) strand; PAM type: YTN; PAM sequence: TTA
acattttgggccagatgatc

SEQ ID NO: 297813 - DNA, 20 bp, Artificial Sequence
  Description of Artificial Sequence: Synthetic oligonucleotide
  Target: ATXN1; (+) strand; PAM type: YTN; PAM sequence: TTT
tgggccagatgatccttggt

SEQ ID NO: 297814 - DNA, 20 bp, Artificial Sequence
  Description of Artificial Sequence: Synthetic oligonucleotide
  Target: ATXN1; (+) strand; PAM type: YTN; PAM sequence: TTT
gggccagatgatccttggtt

SEQ ID NO: 297815 - DNA, 20 bp, Artificial Sequence
  Description of Artificial Sequence: Synthetic oligonucleotide
  Target: ATXN1; (+) strand; PAM type: YTN; PAM sequence: TTG
ggccagatgatccttggttg

SEQ ID NO: 297816 - DNA, 20 bp, Artificial Sequence
  Description of Artificial Sequence: Synthetic oligonucleotide
  Target: ATXN1; (+) strand; PAM type: YTN; PAM sequence: CTT
ggttgaggcagaggactgtt

SEQ ID NO: 297817 - DNA, 20 bp, Artificial Sequence
  Description of Artificial Sequence: Synthetic oligonucleotide
  Target: ATXN1; (+) strand; PAM type: YTN; PAM sequence: TTG
gttgaggcagaggactgttt

SEQ ID NO: 297818 - DNA, 20 bp, Artificial Sequence
  Description of Artificial Sequence: Synthetic oligonucleotide
  Target: ATXN1; (+) strand; PAM type: YTN; PAM sequence: TTG
aggcagaggactgtttggtg

SEQ ID NO: 297819 - DNA, 20 bp, Artificial Sequence
  Description of Artificial Sequence: Synthetic oligonucleotide
  Target: ATXN1; (+) strand; PAM type: YTN; PAM sequence: CTG
tttggtgcattgtaggatat

SEQ ID NO: 297820 - DNA, 20 bp, Artificial Sequence
  Description of Artificial Sequence: Synthetic oligonucleotide
  Target: ATXN1; (+) strand; PAM type: YTN; PAM sequence: TTT
ggtgcattgtaggatatgat

SEQ ID NO: 297821 - DNA, 20 bp, Artificial Sequence
  Description of Artificial Sequence: Synthetic oligonucleotide
  Target: ATXN1; (+) strand; PAM type: YTN; PAM sequence: TTG
gtgcattgtaggatatgata

SEQ ID NO: 297822 - DNA, 20 bp, Artificial Sequence
  Description of Artificial Sequence: Synthetic oligonucleotide
  Target: ATXN1; (+) strand; PAM type: YTN; PAM sequence: TTG
taggatatgatattgattga

SEQ ID NO: 297823 - DNA, 20 bp, Artificial Sequence
  Description of Artificial Sequence: Synthetic oligonucleotide
  Target: ATXN1; (+) strand; PAM type: YTN; PAM sequence: TTG
attgattgattgatttttaa

SEQ ID NO: 297824 - DNA, 20 bp, Artificial Sequence
  Description of Artificial Sequence: Synthetic oligonucleotide
  Target: ATXN1; (+) strand; PAM type: YTN; PAM sequence: TTG
attgattgatttttaaaaat

SEQ ID NO: 297825 - DNA, 20 bp, Artificial Sequence
  Description of Artificial Sequence: Synthetic oligonucleotide
  Target: ATXN1; (+) strand; PAM type: YTN; PAM sequence: TTG
attgatttttaaaaatcatt

SEQ ID NO: 297826 - DNA, 20 bp, Artificial Sequence
  Description of Artificial Sequence: Synthetic oligonucleotide
  Target: ATXN1; (+) strand; PAM type: YTN; PAM sequence: TTG
atttttaaaaatcattcatt

SEQ ID NO: 297827 - DNA, 20 bp, Artificial Sequence
  Description of Artificial Sequence: Synthetic oligonucleotide
  Target: ATXN1; (+) strand; PAM type: YTN; PAM sequence: TTT
ttaaaaatcattcattcatt

SEQ ID NO: 297828 - DNA, 20 bp, Artificial Sequence
  Description of Artificial Sequence: Synthetic oligonucleotide
  Target: ATXN1; (+) strand; PAM type: YTN; PAM sequence: TTT
taaaaatcattcattcattc

SEQ ID NO: 297829 - DNA, 20 bp, Artificial Sequence
  Description of Artificial Sequence: Synthetic oligonucleotide
  Target: ATXN1; (+) strand; PAM type: YTN; PAM sequence: TTT
aaaaatcattcattcattca

SEQ ID NO: 297830 - DNA, 20 bp, Artificial Sequence
  Description of Artificial Sequence: Synthetic oligonucleotide
  Target: ATXN1; (+) strand; PAM type: YTN; PAM sequence: TTA
aaaatcattcattcattcat

SEQ ID NO: 297831 - DNA, 20 bp, Artificial Sequence
  Description of Artificial Sequence: Synthetic oligonucleotide
  Target: ATXN1; (+) strand; PAM type: YTN; PAM sequence: TTC
attcattcattcattcaaga

SEQ ID NO: 297832 - DNA, 20 bp, Artificial Sequence
  Description of Artificial Sequence: Synthetic oligonucleotide
  Target: ATXN1; (+) strand; PAM type: YTN; PAM sequence: TTC
attcattcattcaagagacc

SEQ ID NO: 297833 - DNA, 20 bp, Artificial Sequence
  Description of Artificial Sequence: Synthetic oligonucleotide
  Target: ATXN1; (+) strand; PAM type: YTN; PAM sequence: TTC
attcattcaagagacccctg

SEQ ID NO: 297834 - DNA, 20 bp, Artificial Sequence
  Description of Artificial Sequence: Synthetic oligonucleotide
  Target: ATXN1; (+) strand; PAM type: YTN; PAM sequence: TTC
attcaagagacccctgactc

SEQ ID NO: 297835 - DNA, 20 bp, Artificial Sequence
  Description of Artificial Sequence: Synthetic oligonucleotide
  Target: ATXN1; (+) strand; PAM type: YTN; PAM sequence: TTC
aagagacccctgactctgct

SEQ ID NO: 297836 - DNA, 20 bp, Artificial Sequence
  Description of Artificial Sequence: Synthetic oligonucleotide
  Target: ATXN1; (+) strand; PAM type: YTN; PAM sequence: CTG
actctgctgcccaggctgga

SEQ ID NO: 297837 - DNA, 20 bp, Artificial Sequence
  Description of Artificial Sequence: Synthetic oligonucleotide
  Target: ATXN1; (+) strand; PAM type: YTN; PAM sequence: CTC
tgctgcccaggctggagtgt

SEQ ID NO: 297838 - DNA, 20 bp, Artificial Sequence
  Description of Artificial Sequence: Synthetic oligonucleotide
  Target: ATXN1; (+) strand; PAM type: YTN; PAM sequence: CTG
ctgcccaggctggagtgtag

SEQ ID NO: 297839 - DNA, 20 bp, Artificial Sequence
  Description of Artificial Sequence: Synthetic oligonucleotide
  Target: ATXN1; (+) strand; PAM type: YTN; PAM sequence: CTG
cccaggctggagtgtagtga

SEQ ID NO: 297840 - DNA, 20 bp, Artificial Sequence
  Description of Artificial Sequence: Synthetic oligonucleotide
  Target: ATXN1; (+) strand; PAM type: YTN; PAM sequence: CTG
gagtgtagtgacgccatcac

SEQ ID NO: 297841 - DNA, 20 bp, Artificial Sequence
  Description of Artificial Sequence: Synthetic oligonucleotide
  Target: ATXN1; (+) strand; PAM type: YTN; PAM sequence: CTC
actgcagcctcaaactcctg

SEQ ID NO: 297842 - DNA, 20 bp, Artificial Sequence
  Description of Artificial Sequence: Synthetic oligonucleotide
  Target: ATXN1; (+) strand; PAM type: YTN; PAM sequence: CTG
cagcctcaaactcctgagct

SEQ ID NO: 297843 - DNA, 20 bp, Artificial Sequence
  Description of Artificial Sequence: Synthetic oligonucleotide
  Target: ATXN1; (+) strand; PAM type: YTN; PAM sequence: CTC
aaactcctgagctcaggcga

SEQ ID NO: 297844 - DNA, 20 bp, Artificial Sequence
  Description of Artificial Sequence: Synthetic oligonucleotide
  Target: ATXN1; (+) strand; PAM type: YTN; PAM sequence: CTC
ctgagctcaggcgatcctcc

SEQ ID NO: 297845 - DNA, 20 bp, Artificial Sequence
  Description of Artificial Sequence: Synthetic oligonucleotide
  Target: ATXN1; (+) strand; PAM type: YTN; PAM sequence: CTG
agctcaggcgatcctcctgc

SEQ ID NO: 297846 - DNA, 20 bp, Artificial Sequence
  Description of Artificial Sequence: Synthetic oligonucleotide
  Target: ATXN1; (+) strand; PAM type: YTN; PAM sequence: CTC
aggcgatcctcctgcctcga

SEQ ID NO: 297847 - DNA, 20 bp, Artificial Sequence
  Description of Artificial Sequence: Synthetic oligonucleotide
  Target: ATXN1; (+) strand; PAM type: YTN; PAM sequence: CTC
ctgcctcgacctcctaaagt

SEQ ID NO: 297848 - DNA, 20 bp, Artificial Sequence
  Description of Artificial Sequence: Synthetic oligonucleotide
  Target: ATXN1; (+) strand; PAM type: YTN; PAM sequence: CTG
cctcgacctcctaaagtgct

SEQ ID NO: 297849 - DNA, 20 bp, Artificial Sequence
  Description of Artificial Sequence: Synthetic oligonucleotide
  Target: ATXN1; (+) strand; PAM type: YTN; PAM sequence: CTC
gacctcctaaagtgctggga

SEQ ID NO: 297850 - DNA, 20 bp, Artificial Sequence
  Description of Artificial Sequence: Synthetic oligonucleotide
  Target: ATXN1; (+) strand; PAM type: YTN; PAM sequence: CTC
ctaaagtgctgggattacag

SEQ ID NO: 297851 - DNA, 20 bp, Artificial Sequence
  Description of Artificial Sequence: Synthetic oligonucleotide
  Target: ATXN1; (+) strand; PAM type: YTN; PAM sequence: CTA
aagtgctgggattacaggtg

SEQ ID NO: 297852 - DNA, 20 bp, Artificial Sequence
  Description of Artificial Sequence: Synthetic oligonucleotide
  Target: ATXN1; (+) strand; PAM type: YTN; PAM sequence: CTG
ggattacaggtgtgagccaa

SEQ ID NO: 297853 - DNA, 20 bp, Artificial Sequence
  Description of Artificial Sequence: Synthetic oligonucleotide
  Target: ATXN1; (+) strand; PAM type: YTN; PAM sequence: TTA
caggtgtgagccaatgcccc

SEQ ID NO: 297854 - DNA, 20 bp, Artificial Sequence
  Description of Artificial Sequence: Synthetic oligonucleotide
  Target: ATXN1; (+) strand; PAM type: YTN; PAM sequence: TTG
caggatgttcagcagcattt

SEQ ID NO: 297855 - DNA, 20 bp, Artificial Sequence
  Description of Artificial Sequence: Synthetic oligonucleotide
  Target: ATXN1; (+) strand; PAM type: YTN; PAM sequence: TTC
agcagcatttctggcctcta

SEQ ID NO: 297856 - DNA, 20 bp, Artificial Sequence
  Description of Artificial Sequence: Synthetic oligonucleotide
  Target: ATXN1; (+) strand; PAM type: YTN; PAM sequence: TTT
ctggcctctactcactagat

SEQ ID NO: 297857 - DNA, 20 bp, Artificial Sequence
  Description of Artificial Sequence: Synthetic oligonucleotide
  Target: ATXN1; (+) strand; PAM type: YTN; PAM sequence: TTC
tggcctctactcactagatg

SEQ ID NO: 297858 - DNA, 20 bp, Artificial Sequence
  Description of Artificial Sequence: Synthetic oligonucleotide
  Target: ATXN1; (+) strand; PAM type: YTN; PAM sequence: CTG
gcctctactcactagatgcc

SEQ ID NO: 297859 - DNA, 20 bp, Artificial Sequence
  Description of Artificial Sequence: Synthetic oligonucleotide
  Target: ATXN1; (+) strand; PAM type: YTN; PAM sequence: CTC
tactcactagatgccagtat

SEQ ID NO: 297860 - DNA, 20 bp, Artificial Sequence
  Description of Artificial Sequence: Synthetic oligonucleotide
  Target: ATXN1; (+) strand; PAM type: YTN; PAM sequence: CTA
ctcactagatgccagtattg

SEQ ID NO: 297861 - DNA, 20 bp, Artificial Sequence
  Description of Artificial Sequence: Synthetic oligonucleotide
  Target: ATXN1; (+) strand; PAM type: YTN; PAM sequence: CTC
actagatgccagtattgcta

SEQ ID NO: 297862 - DNA, 20 bp, Artificial Sequence
  Description of Artificial Sequence: Synthetic oligonucleotide
  Target: ATXN1; (+) strand; PAM type: YTN; PAM sequence: CTA
gatgccagtattgctacctt

SEQ ID NO: 297863 - DNA, 20 bp, Artificial Sequence
  Description of Artificial Sequence: Synthetic oligonucleotide
  Target: ATXN1; (+) strand; PAM type: YTN; PAM sequence: TTG
ctaccttgttttcccatttg

SEQ ID NO: 297864 - DNA, 20 bp, Artificial Sequence
  Description of Artificial Sequence: Synthetic oligonucleotide
  Target: ATXN1; (+) strand; PAM type: YTN; PAM sequence: CTA
ccttgttttcccatttggga

SEQ ID NO: 297865 - DNA, 20 bp, Artificial Sequence
  Description of Artificial Sequence: Synthetic oligonucleotide
  Target: ATXN1; (+) strand; PAM type: YTN; PAM sequence: CTT
gttttcccatttgggacgat

SEQ ID NO: 297866 - DNA, 20 bp, Artificial Sequence
  Description of Artificial Sequence: Synthetic oligonucleotide
  Target: ATXN1; (+) strand; PAM type: YTN; PAM sequence: TTG
ttttcccatttgggacgatc

SEQ ID NO: 297867 - DNA, 20 bp, Artificial Sequence
  Description of Artificial Sequence: Synthetic oligonucleotide
  Target: ATXN1; (+) strand; PAM type: YTN; PAM sequence: TTT
tcccatttgggacgatcaaa

SEQ ID NO: 297868 - DNA, 20 bp, Artificial Sequence
  Description of Artificial Sequence: Synthetic oligonucleotide
  Target: ATXN1; (+) strand; PAM type: YTN; PAM sequence: TTT
cccatttgggacgatcaaaa

SEQ ID NO: 297869 - DNA, 20 bp, Artificial Sequence
  Description of Artificial Sequence: Synthetic oligonucleotide
  Target: ATXN1; (+) strand; PAM type: YTN; PAM sequence: TTC
ccatttgggacgatcaaaaa

SEQ ID NO: 297870 - DNA, 20 bp, Artificial Sequence
  Description of Artificial Sequence: Synthetic oligonucleotide
  Target: ATXN1; (+) strand; PAM type: YTN; PAM sequence: TTT
gggacgatcaaaaagtgtct

SEQ ID NO: 297871 - DNA, 20 bp, Artificial Sequence
  Description of Artificial Sequence: Synthetic oligonucleotide
  Target: ATXN1; (+) strand; PAM type: YTN; PAM sequence: TTG
ggacgatcaaaaagtgtctc

SEQ ID NO: 297872 - DNA, 20 bp, Artificial Sequence
  Description of Artificial Sequence: Synthetic oligonucleotide
  Target: ATXN1; (+) strand; PAM type: YTN; PAM sequence: CTC
caaacattgccaaatgtcct

SEQ ID NO: 297873 - DNA, 20 bp, Artificial Sequence
  Description of Artificial Sequence: Synthetic oligonucleotide
  Target: ATXN1; (+) strand; PAM type: YTN; PAM sequence: TTG
ccaaatgtcctgagagggca

SEQ ID NO: 297874 - DNA, 20 bp, Artificial Sequence
  Description of Artificial Sequence: Synthetic oligonucleotide
  Target: ATXN1; (+) strand; PAM type: YTN; PAM sequence: CTG
agagggcaaaatggtcccca

SEQ ID NO: 297875 - DNA, 20 bp, Artificial Sequence
  Description of Artificial Sequence: Synthetic oligonucleotide
  Target: ATXN1; (+) strand; PAM type: YTN; PAM sequence: TTG
agatccactggttgacagca

SEQ ID NO: 297876 - DNA, 20 bp, Artificial Sequence
  Description of Artificial Sequence: Synthetic oligonucleotide
  Target: ATXN1; (+) strand; PAM type: YTN; PAM sequence: CTG
gttgacagcatgtggcagtt

SEQ ID NO: 297877 - DNA, 20 bp, Artificial Sequence
  Description of Artificial Sequence: Synthetic oligonucleotide
  Target: ATXN1; (+) strand; PAM type: YTN; PAM sequence: TTG
acagcatgtggcagttaatg

SEQ ID NO: 297878 - DNA, 20 bp, Artificial Sequence
  Description of Artificial Sequence: Synthetic oligonucleotide
  Target: ATXN1; (+) strand; PAM type: YTN; PAM sequence: TTA
atgtggtggtctgtgttctc

SEQ ID NO: 297879 - DNA, 20 bp, Artificial Sequence
  Description of Artificial Sequence: Synthetic oligonucleotide
  Target: ATXN1; (+) strand; PAM type: YTN; PAM sequence: CTG
tgttctctccatcagttccc

SEQ ID NO: 297880 - DNA, 20 bp, Artificial Sequence
  Description of Artificial Sequence: Synthetic oligonucleotide
  Target: ATXN1; (+) strand; PAM type: YTN; PAM sequence: TTC
tctccatcagttccctccca

SEQ ID NO: 297881 - DNA, 20 bp, Artificial Sequence
  Description of Artificial Sequence: Synthetic oligonucleotide
  Target: ATXN1; (+) strand; PAM type: YTN; PAM sequence: CTC
tccatcagttccctcccata

SEQ ID NO: 297882 - DNA, 20 bp, Artificial Sequence
  Description of Artificial Sequence: Synthetic oligonucleotide
  Target: ATXN1; (+) strand; PAM type: YTN; PAM sequence: CTC
catcagttccctcccataca

SEQ ID NO: 297883 - DNA, 20 bp, Artificial Sequence
  Description of Artificial Sequence: Synthetic oligonucleotide
  Target: ATXN1; (+) strand; PAM type: YTN; PAM sequence: TTC
cctcccatacatggaaatgc

SEQ ID NO: 297884 - DNA, 20 bp, Artificial Sequence
  Description of Artificial Sequence: Synthetic oligonucleotide
  Target: ATXN1; (+) strand; PAM type: YTN; PAM sequence: CTC
ccatacatggaaatgctcta

SEQ ID NO: 297885 - DNA, 20 bp, Artificial Sequence
  Description of Artificial Sequence: Synthetic oligonucleotide
  Target: ATXN1; (+) strand; PAM type: YTN; PAM sequence: CTC
taacgtgttttatatatata

SEQ ID NO: 297886 - DNA, 20 bp, Artificial Sequence
  Description of Artificial Sequence: Synthetic oligonucleotide
  Target: ATXN1; (+) strand; PAM type: YTN; PAM sequence: CTA
acgtgttttatatatatata

SEQ ID NO: 297887 - DNA, 20 bp, Artificial Sequence
  Description of Artificial Sequence: Synthetic oligonucleotide
  Target: ATXN1; (+) strand; PAM type: YTN; PAM sequence: TTT
tatatatatatatattctta

SEQ ID NO: 297888 - DNA, 20 bp, Artificial Sequence
  Description of Artificial Sequence: Synthetic oligonucleotide
  Target: ATXN1; (+) strand; PAM type: YTN; PAM sequence: TTT
atatatatatatattcttac

SEQ ID NO: 297889 - DNA, 20 bp, Artificial Sequence
  Description of Artificial Sequence: Synthetic oligonucleotide
  Target: ATXN1; (+) strand; PAM type: YTN; PAM sequence: TTA
tatatatatatattcttaca

SEQ ID NO: 297890 - DNA, 20 bp, Artificial Sequence
  Description of Artificial Sequence: Synthetic oligonucleotide
  Target: ATXN1; (+) strand; PAM type: YTN; PAM sequence: TTC
ttacattgctgctggtctca

SEQ ID NO: 297891 - DNA, 20 bp, Artificial Sequence
  Description of Artificial Sequence: Synthetic oligonucleotide
  Target: ATXN1; (+) strand; PAM type: YTN; PAM sequence: CTT
acattgctgctggtctcatt

SEQ ID NO: 297892 - DNA, 20 bp, Artificial Sequence
  Description of Artificial Sequence: Synthetic oligonucleotide
  Target: ATXN1; (+) strand; PAM type: YTN; PAM sequence: TTA
cattgctgctggtctcattc

SEQ ID NO: 297893 - DNA, 20 bp, Artificial Sequence
  Description of Artificial Sequence: Synthetic oligonucleotide
  Target: ATXN1; (+) strand; PAM type: YTN; PAM sequence: TTG
ctgctggtctcattcaaatg

SEQ ID NO: 297894 - DNA, 20 bp, Artificial Sequence
  Description of Artificial Sequence: Synthetic oligonucleotide
  Target: ATXN1; (+) strand; PAM type: YTN; PAM sequence: CTG
ctggtctcattcaaatgagt

SEQ ID NO: 297895 - DNA, 20 bp, Artificial Sequence
  Description of Artificial Sequence: Synthetic oligonucleotide
  Target: ATXN1; (+) strand; PAM type: YTN; PAM sequence: CTG
gtctcattcaaatgagtctc

SEQ ID NO: 297896 - DNA, 20 bp, Artificial Sequence
  Description of Artificial Sequence: Synthetic oligonucleotide
  Target: ATXN1; (+) strand; PAM type: YTN; PAM sequence: CTC
attcaaatgagtctcccaag

SEQ ID NO: 297897 - DNA, 20 bp, Artificial Sequence
  Description of Artificial Sequence: Synthetic oligonucleotide
  Target: ATXN1; (+) strand; PAM type: YTN; PAM sequence: TTC
aaatgagtctcccaaggatt

SEQ ID NO: 297898 - DNA, 20 bp, Artificial Sequence
  Description of Artificial Sequence: Synthetic oligonucleotide
  Target: ATXN1; (+) strand; PAM type: YTN; PAM sequence: CTC
ccaaggattcagtctgtttg

SEQ ID NO: 297899 - DNA, 20 bp, Artificial Sequence
  Description of Artificial Sequence: Synthetic oligonucleotide
  Target: ATXN1; (+) strand; PAM type: YTN; PAM sequence: TTC
agtctgtttgacattttaaa

SEQ ID NO: 297900 - DNA, 20 bp, Artificial Sequence
  Description of Artificial Sequence: Synthetic oligonucleotide
  Target: ATXN1; (+) strand; PAM type: YTN; PAM sequence: CTG
tttgacattttaaaacagct

SEQ ID NO: 297901 - DNA, 20 bp, Artificial Sequence
  Description of Artificial Sequence: Synthetic oligonucleotide
  Target: ATXN1; (+) strand; PAM type: YTN; PAM sequence: TTT
gacattttaaaacagctcaa

SEQ ID NO: 297902 - DNA, 20 bp, Artificial Sequence
  Description of Artificial Sequence: Synthetic oligonucleotide
  Target: ATXN1; (+) strand; PAM type: YTN; PAM sequence: TTG
acattttaaaacagctcaaa

SEQ ID NO: 297903 - DNA, 20 bp, Artificial Sequence
  Description of Artificial Sequence: Synthetic oligonucleotide
  Target: ATXN1; (+) strand; PAM type: YTN; PAM sequence: TTT
taaaacagctcaaactcaga

SEQ ID NO: 297904 - DNA, 20 bp, Artificial Sequence
  Description of Artificial Sequence: Synthetic oligonucleotide
  Target: ATXN1; (+) strand; PAM type: YTN; PAM sequence: TTT
aaaacagctcaaactcagaa

SEQ ID NO: 297905 - DNA, 20 bp, Artificial Sequence
  Description of Artificial Sequence: Synthetic oligonucleotide
  Target: ATXN1; (+) strand; PAM type: YTN; PAM sequence: TTA
aaacagctcaaactcagaat

SEQ ID NO: 297906 - DNA, 20 bp, Artificial Sequence
  Description of Artificial Sequence: Synthetic oligonucleotide
  Target: ATXN1; (+) strand; PAM type: YTN; PAM sequence: CTC
aaactcagaattcaaccaca

SEQ ID NO: 297907 - DNA, 20 bp, Artificial Sequence
  Description of Artificial Sequence: Synthetic oligonucleotide
  Target: ATXN1; (+) strand; PAM type: YTN; PAM sequence: CTC
agaattcaaccacaggactt

SEQ ID NO: 297908 - DNA, 20 bp, Artificial Sequence
  Description of Artificial Sequence: Synthetic oligonucleotide
  Target: ATXN1; (+) strand; PAM type: YTN; PAM sequence: TTC
aaccacaggactttttttta

SEQ ID NO: 297909 - DNA, 20 bp, Artificial Sequence
  Description of Artificial Sequence: Synthetic oligonucleotide
  Target: ATXN1; (+) strand; PAM type: YTN; PAM sequence: CTT
ttttttaaaatggccccact

SEQ ID NO: 297910 - DNA, 20 bp, Artificial Sequence
  Description of Artificial Sequence: Synthetic oligonucleotide
  Target: ATXN1; (+) strand; PAM type: YTN; PAM sequence: TTT
tttttaaaatggccccacta

SEQ ID NO: 297911 - DNA, 20 bp, Artificial Sequence
  Description of Artificial Sequence: Synthetic oligonucleotide
  Target: ATXN1; (+) strand; PAM type: YTN; PAM sequence: TTT
ttttaaaatggccccactat

SEQ ID NO: 297912 - DNA, 20 bp, Artificial Sequence
  Description of Artificial Sequence: Synthetic oligonucleotide
  Target: ATXN1; (+) strand; PAM type: YTN; PAM sequence: TTT
tttaaaatggccccactata

SEQ ID NO: 297913 - DNA, 20 bp, Artificial Sequence
  Description of Artificial Sequence: Synthetic oligonucleotide
  Target: ATXN1; (+) strand; PAM type: YTN; PAM sequence: TTT
ttaaaatggccccactatac

SEQ ID NO: 297914 - DNA, 20 bp, Artificial Sequence
  Description of Artificial Sequence: Synthetic oligonucleotide
  Target: ATXN1; (+) strand; PAM type: YTN; PAM sequence: TTT
taaaatggccccactatact

SEQ ID NO: 297915 - DNA, 20 bp, Artificial Sequence
  Description of Artificial Sequence: Synthetic oligonucleotide
  Target: ATXN1; (+) strand; PAM type: YTN; PAM sequence: TTT
aaaatggccccactatactt

SEQ ID NO: 297916 - DNA, 20 bp, Artificial Sequence
  Description of Artificial Sequence: Synthetic oligonucleotide
  Target: ATXN1; (+) strand; PAM type: YTN; PAM sequence: TTA
aaatggccccactatactta

SEQ ID NO: 297917 - DNA, 20 bp, Artificial Sequence
  Description of Artificial Sequence: Synthetic oligonucleotide
  Target: ATXN1; (+) strand; PAM type: YTN; PAM sequence: CTA
tacttattcccagccacagg

SEQ ID NO: 297918 - DNA, 20 bp, Artificial Sequence
  Description of Artificial Sequence: Synthetic oligonucleotide
  Target: ATXN1; (+) strand; PAM type: YTN; PAM sequence: CTT
attcccagccacaggcaagg

SEQ ID NO: 297919 - DNA, 20 bp, Artificial Sequence
  Description of Artificial Sequence: Synthetic oligonucleotide
  Target: ATXN1; (+) strand; PAM type: YTN; PAM sequence: TTA
ttcccagccacaggcaaggg

SEQ ID NO: 297920 - DNA, 20 bp, Artificial Sequence
  Description of Artificial Sequence: Synthetic oligonucleotide
  Target: ATXN1; (+) strand; PAM type: YTN; PAM sequence: TTC
ccagccacaggcaagggaaa

SEQ ID NO: 297921 - DNA, 20 bp, Artificial Sequence
  Description of Artificial Sequence: Synthetic oligonucleotide
  Target: ATXN1; (+) strand; PAM type: YTN; PAM sequence: CTT
ttccacaatgacccgcagcc

SEQ ID NO: 297922 - DNA, 20 bp, Artificial Sequence
  Description of Artificial Sequence: Synthetic oligonucleotide
  Target: ATXN1; (+) strand; PAM type: YTN; PAM sequence: TTT
tccacaatgacccgcagccc

SEQ ID NO: 297923 - DNA, 20 bp, Artificial Sequence
  Description of Artificial Sequence: Synthetic oligonucleotide
  Target: ATXN1; (+) strand; PAM type: YTN; PAM sequence: TTT
ccacaatgacccgcagccca

SEQ ID NO: 297924 - DNA, 20 bp, Artificial Sequence
  Description of Artificial Sequence: Synthetic oligonucleotide
  Target: ATXN1; (+) strand; PAM type: YTN; PAM sequence: TTC
cacaatgacccgcagcccaa

SEQ ID NO: 297925 - DNA, 20 bp, Artificial Sequence
  Description of Artificial Sequence: Synthetic oligonucleotide
  Target: ATXN1; (+) strand; PAM type: YTN; PAM sequence: CTA
gccaacaagctcacaattca

SEQ ID NO: 297926 - DNA, 20 bp, Artificial Sequence
  Description of Artificial Sequence: Synthetic oligonucleotide
  Target: ATXN1; (+) strand; PAM type: YTN; PAM sequence: CTC
acaattcatccatactgctg

SEQ ID NO: 297927 - DNA, 20 bp, Artificial Sequence
  Description of Artificial Sequence: Synthetic oligonucleotide
  Target: ATXN1; (+) strand; PAM type: YTN; PAM sequence: TTC
atccatactgctgctacaga

SEQ ID NO: 297928 - DNA, 20 bp, Artificial Sequence
  Description of Artificial Sequence: Synthetic oligonucleotide
  Target: ATXN1; (+) strand; PAM type: YTN; PAM sequence: CTG
ctgctacagaggcgacagag

SEQ ID NO: 297929 - DNA, 20 bp, Artificial Sequence
  Description of Artificial Sequence: Synthetic oligonucleotide
  Target: ATXN1; (+) strand; PAM type: YTN; PAM sequence: CTG
ctacagaggcgacagaggtc

SEQ ID NO: 297930 - DNA, 20 bp, Artificial Sequence
  Description of Artificial Sequence: Synthetic oligonucleotide
  Target: ATXN1; (+) strand; PAM type: YTN; PAM sequence: CTA
cagaggcgacagaggtcagc

SEQ ID NO: 297931 - DNA, 20 bp, Artificial Sequence
  Description of Artificial Sequence: Synthetic oligonucleotide
  Target: ATXN1; (+) strand; PAM type: YTN; PAM sequence: CTT
gctatttgactgttacagag

SEQ ID NO: 297932 - DNA, 20 bp, Artificial Sequence
  Description of Artificial Sequence: Synthetic oligonucleotide
  Target: ATXN1; (+) strand; PAM type: YTN; PAM sequence: TTG
ctatttgactgttacagaga

SEQ ID NO: 297933 - DNA, 20 bp, Artificial Sequence
  Description of Artificial Sequence: Synthetic oligonucleotide
  Target: ATXN1; (+) strand; PAM type: YTN; PAM sequence: CTA
tttgactgttacagagaact

SEQ ID NO: 297934 - DNA, 20 bp, Artificial Sequence
  Description of Artificial Sequence: Synthetic oligonucleotide
  Target: ATXN1; (+) strand; PAM type: YTN; PAM sequence: TTT
gactgttacagagaactttc

SEQ ID NO: 297935 - DNA, 20 bp, Artificial Sequence
  Description of Artificial Sequence: Synthetic oligonucleotide
  Target: ATXN1; (+) strand; PAM type: YTN; PAM sequence: TTG
actgttacagagaactttct

SEQ ID NO: 297936 - DNA, 20 bp, Artificial Sequence
  Description of Artificial Sequence: Synthetic oligonucleotide
  Target: ATXN1; (+) strand; PAM type: YTN; PAM sequence: CTG
ttacagagaactttcttttt

SEQ ID NO: 297937 - DNA, 20 bp, Artificial Sequence
  Description of Artificial Sequence: Synthetic oligonucleotide
  Target: ATXN1; (+) strand; PAM type: YTN; PAM sequence: TTA
cagagaactttctttttttt

SEQ ID NO: 297938 - DNA, 20 bp, Artificial Sequence
  Description of Artificial Sequence: Synthetic oligonucleotide
  Target: ATXN1; (+) strand; PAM type: YTN; PAM sequence: CTT
tctttttttttttttttttt

SEQ ID NO: 297939 - DNA, 20 bp, Artificial Sequence
  Description of Artificial Sequence: Synthetic oligonucleotide
  Target: ATXN1; (+) strand; PAM type: YTN; PAM sequence: TTT
cttttttttttttttttttt

SEQ ID NO: 297940 - DNA, 20 bp, Artificial Sequence
  Description of Artificial Sequence: Synthetic oligonucleotide
  Target: ATXN1; (+) strand; PAM type: YTN; PAM sequence: TTC
tttttttttttttttttttt

SEQ ID NO: 297941 - DNA, 20 bp, Artificial Sequence
  Description of Artificial Sequence: Synthetic oligonucleotide
  Target: ATXN1; (+) strand; PAM type: YTN; PAM sequence: CTT
tttttttttttttttttttt

SEQ ID NO: 297942 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 297943 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttt

SEQ ID NO: 297944 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttttg

SEQ ID NO: 297945 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttttga

SEQ ID NO: 297946 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttttgag

SEQ ID NO: 297947 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttttgaga

SEQ ID NO: 297948 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttttgagac

SEQ ID NO: 297949 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttttgagacg

SEQ ID NO: 297950 - DNA, 20 bp, Artificial Sequence
  Description of Artificial Sequence: Synthetic oligonucleotide
  Target: ATXN1; (+) strand; PAM type: YTN; PAM sequence: TTT
tttttttttttttgagacgg

SEQ ID NO: 297951 - DNA, 20 bp, Artificial Sequence
  Description of Artificial Sequence: Synthetic oligonucleotide
  Target: ATXN1; (+) strand; PAM type: YTN; PAM sequence: TTT
ttttttttttttgagacgga

SEQ ID NO: 297952 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgagacggag

SEQ ID NO: 297953 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgagacggagt

SEQ ID NO: 297954 - DNA, 20 bp, Artificial Sequence
  Description of Artificial Sequence: Synthetic oligonucleotide
  Target: ATXN1; (+) strand; PAM type: YTN; PAM sequence: TTT
tttttttttgagacggagtc

SEQ ID NO: 297955 - DNA, 20 bp, Artificial Sequence
  Description of Artificial Sequence: Synthetic oligonucleotide
  Target: ATXN1; (+) strand; PAM type: YTN; PAM sequence: TTT
ttttttttgagacggagtct

SEQ ID NO: 297956 - DNA, 20 bp, Artificial Sequence
  Description of Artificial Sequence: Synthetic oligonucleotide
  Target: ATXN1; (+) strand; PAM type: YTN; PAM sequence: TTT
tttttttgagacggagtctc

SEQ ID NO: 297957 - DNA, 20 bp, Artificial Sequence
  Description of Artificial Sequence: Synthetic oligonucleotide
  Target: ATXN1; (+) strand; PAM type: YTN; PAM sequence: TTT
ttttttgagacggagtctcg

SEQ ID NO: 297958 - DNA, 20 bp, Artificial Sequence
  Description of Artificial Sequence: Synthetic oligonucleotide
  Target: ATXN1; (+) strand; PAM type: YTN; PAM sequence: TTT
tttttgagacggagtctcgc

SEQ ID NO: 297959 - DNA, 20 bp, Artificial Sequence
  Description of Artificial Sequence: Synthetic oligonucleotide
  Target: ATXN1; (+) strand; PAM type: YTN; PAM sequence: TTT
ttttgagacggagtctcgct

SEQ ID NO: 297960 - DNA, 20 bp, Artificial Sequence
  Description of Artificial Sequence: Synthetic oligonucleotide
  Target: ATXN1; (+) strand; PAM type: YTN; PAM sequence: TTT
tttgagacggagtctcgctc

SEQ ID NO: 297961 - DNA, 20 bp, Artificial Sequence
  Description of Artificial Sequence: Synthetic oligonucleotide
  Target: ATXN1; (+) strand; PAM type: YTN; PAM sequence: TTT
ttgagacggagtctcgctct

SEQ ID NO: 297962 - DNA, 20 bp, Artificial Sequence
  Description of Artificial Sequence: Synthetic oligonucleotide
  Target: ATXN1; (+) strand; PAM type: YTN; PAM sequence: TTT
tgagacggagtctcgctctg

SEQ ID NO: 297963 - DNA, 20 bp, Artificial Sequence
  Description of Artificial Sequence: Synthetic oligonucleotide
  Target: ATXN1; (+) strand; PAM type: YTN; PAM sequence: TTT
gagacggagtctcgctctgt

SEQ ID NO: 297964 - DNA, 20 bp, Artificial Sequence
  Description of Artificial Sequence: Synthetic oligonucleotide
  Target: ATXN1; (+) strand; PAM type: YTN; PAM sequence: TTG
agacggagtctcgctctgtt

SEQ ID NO: 297965 - DNA, 20 bp, Artificial Sequence
  Description of Artificial Sequence: Synthetic oligonucleotide
  Target: ATXN1; (+) strand; PAM type: YTN; PAM sequence: CTC
gctctgttgccaggctggag

SEQ ID NO: 297966 - DNA, 20 bp, Artificial Sequence
  Description of Artificial Sequence: Synthetic oligonucleotide
  Target: ATXN1; (+) strand; PAM type: YTN; PAM sequence: CTC
tgttgccaggctggagtgca

SEQ ID NO: 297967 - DNA, 20 bp, Artificial Sequence
  Description of Artificial Sequence: Synthetic oligonucleotide
  Target: ATXN1; (+) strand; PAM type: YTN; PAM sequence: CTG
ttgccaggctggagtgcagt

SEQ ID NO: 297968 - DNA, 20 bp, Artificial Sequence
  Description of Artificial Sequence: Synthetic oligonucleotide
  Target: ATXN1; (+) strand; PAM type: YTN; PAM sequence: TTG
ccaggctggagtgcagtggt

SEQ ID NO: 297969 - DNA, 20 bp, Artificial Sequence
  Description of Artificial Sequence: Synthetic oligonucleotide
  Target: ATXN1; (+) strand; PAM type: YTN; PAM sequence: CTG
gagtgcagtggtgtgatctc

SEQ ID NO: 297970 - DNA, 20 bp, Artificial Sequence
  Description of Artificial Sequence: Synthetic oligonucleotide
  Target: ATXN1; (+) strand; PAM type: YTN; PAM sequence: CTC
ggctcactgcaacactgcaa

SEQ ID NO: 297971 - DNA, 20 bp, Artificial Sequence
  Description of Artificial Sequence: Synthetic oligonucleotide
  Target: ATXN1; (+) strand; PAM type: YTN; PAM sequence: CTC
actgcaacactgcaagctcc

SEQ ID NO: 297972 - DNA, 20 bp, Artificial Sequence
  Description of Artificial Sequence: Synthetic oligonucleotide
  Target: ATXN1; (+) strand; PAM type: YTN; PAM sequence: CTG
caacactgcaagctccgcct

SEQ ID NO: 297973 - DNA, 20 bp, Artificial Sequence
  Description of Artificial Sequence: Synthetic oligonucleotide
  Target: ATXN1; (+) strand; PAM type: YTN; PAM sequence: CTG
caagctccgcctcatgggtt

SEQ ID NO: 297974 - DNA, 20 bp, Artificial Sequence
  Description of Artificial Sequence: Synthetic oligonucleotide
  Target: ATXN1; (+) strand; PAM type: YTN; PAM sequence: CTC
cgcctcatgggttcaagcga

SEQ ID NO: 297975 - DNA, 20 bp, Artificial Sequence
  Description of Artificial Sequence: Synthetic oligonucleotide
  Target: ATXN1; (+) strand; PAM type: YTN; PAM sequence: CTC
atgggttcaagcgattctcc

SEQ ID NO: 297976 - DNA, 20 bp, Artificial Sequence
  Description of Artificial Sequence: Synthetic oligonucleotide
  Target: ATXN1; (+) strand; PAM type: YTN; PAM sequence: TTC
aagcgattctcctgcctcag

SEQ ID NO: 297977 - DNA, 20 bp, Artificial Sequence
  Description of Artificial Sequence: Synthetic oligonucleotide
  Target: ATXN1; (+) strand; PAM type: YTN; PAM sequence: TTC
tcctgcctcagcctcccaag

SEQ ID NO: 297978 - DNA, 20 bp, Artificial Sequence
  Description of Artificial Sequence: Synthetic oligonucleotide
  Target: ATXN1; (+) strand; PAM type: YTN; PAM sequence: CTC
ctgcctcagcctcccaagta

SEQ ID NO: 297979 - DNA, 20 bp, Artificial Sequence
  Description of Artificial Sequence: Synthetic oligonucleotide
  Target: ATXN1; (+) strand; PAM type: YTN; PAM sequence: CTG
cctcagcctcccaagtagct

SEQ ID NO: 297980 - DNA, 20 bp, Artificial Sequence
  Description of Artificial Sequence: Synthetic oligonucleotide
  Target: ATXN1; (+) strand; PAM type: YTN; PAM sequence: CTC
agcctcccaagtagctggga

SEQ ID NO: 297981 - DNA, 20 bp, Artificial Sequence
  Description of Artificial Sequence: Synthetic oligonucleotide
  Target: ATXN1; (+) strand; PAM type: YTN; PAM sequence: CTC
ccaagtagctgggattacag

SEQ ID NO: 297982 - DNA, 20 bp, Artificial Sequence
  Description of Artificial Sequence: Synthetic oligonucleotide
  Target: ATXN1; (+) strand; PAM type: YTN; PAM sequence: CTG
ggattacaggcgcccaccac

SEQ ID NO: 297983 - DNA, 20 bp, Artificial Sequence
  Description of Artificial Sequence: Synthetic oligonucleotide
  Target: ATXN1; (+) strand; PAM type: YTN; PAM sequence: TTA
caggcgcccaccaccacgcc

SEQ ID NO: 297984 - DNA, 20 bp, Artificial Sequence
  Description of Artificial Sequence: Synthetic oligonucleotide
  Target: ATXN1; (+) strand; PAM type: YTN; PAM sequence: CTA
attttttttttttttgtatt

SEQ ID NO: 297985 - DNA, 20 bp, Artificial Sequence
  Description of Artificial Sequence: Synthetic oligonucleotide
  Target: ATXN1; (+) strand; PAM type: YTN; PAM sequence: TTT
tttttttttttgtattttta

SEQ ID NO: 297986 - DNA, 20 bp, Artificial Sequence
  Description of Artificial Sequence: Synthetic oligonucleotide
  Target: ATXN1; (+) strand; PAM type: YTN; PAM sequence: TTT
ttttttttttgtatttttag

SEQ ID NO: 297987 - DNA, 20 bp, Artificial Sequence
  Description of Artificial Sequence: Synthetic oligonucleotide
  Target: ATXN1; (+) strand; PAM type: YTN; PAM sequence: TTT
tttttttttgtatttttagt

SEQ ID NO: 297988 - DNA, 20 bp, Artificial Sequence
  Description of Artificial Sequence: Synthetic oligonucleotide
  Target: ATXN1; (+) strand; PAM type: YTN; PAM sequence: TTT
ttttttttgtatttttagta

SEQ ID NO: 297989 - DNA, 20 bp, Artificial Sequence
  Description of Artificial Sequence: Synthetic oligonucleotide
  Target: ATXN1; (+) strand; PAM type: YTN; PAM sequence: TTT
tttttttgtatttttagtag

SEQ ID NO: 297990 - DNA, 20 bp, Artificial Sequence
  Description of Artificial Sequence: Synthetic oligonucleotide
  Target: ATXN1; (+) strand; PAM type: YTN; PAM sequence: TTT
ttttttgtatttttagtaga

SEQ ID NO: 297991 - DNA, 20 bp, Artificial Sequence
  Description of Artificial Sequence: Synthetic oligonucleotide
  Target: ATXN1; (+) strand; PAM type: YTN; PAM sequence: TTT
tttttgtatttttagtagag

SEQ ID NO: 297992 - DNA, 20 bp, Artificial Sequence
  Description of Artificial Sequence: Synthetic oligonucleotide
  Target: ATXN1; (+) strand; PAM type: YTN; PAM sequence: TTT
ttttgtatttttagtagaga

SEQ ID NO: 297993 - DNA, 20 bp, Artificial Sequence
  Description of Artificial Sequence: Synthetic oligonucleotide
  Target: ATXN1; (+) strand; PAM type: YTN; PAM sequence: TTT
tttgtatttttagtagagac

SEQ ID NO: 297994 - DNA, 20 bp, Artificial Sequence
  Description of Artificial Sequence: Synthetic oligonucleotide
  Target: ATXN1; (+) strand; PAM type: YTN; PAM sequence: TTT
ttgtatttttagtagagacg

SEQ ID NO: 297995 - DNA, 20 bp, Artificial Sequence
  Description of Artificial Sequence: Synthetic oligonucleotide
  Target: ATXN1; (+) strand; PAM type: YTN; PAM sequence: TTT
tgtatttttagtagagacgg

SEQ ID NO: 297996 - DNA, 20 bp, Artificial Sequence
  Description of Artificial Sequence: Synthetic oligonucleotide
  Target: ATXN1; (+) strand; PAM type: YTN; PAM sequence: TTT
gtatttttagtagagacggg

SEQ ID NO: 297997 - DNA, 20 bp, Artificial Sequence
  Description of Artificial Sequence: Synthetic oligonucleotide
  Target: ATXN1; (+) strand; PAM type: YTN; PAM sequence: TTG
tatttttagtagagacgggg

SEQ ID NO: 297998 - DNA, 20 bp, Artificial Sequence
  Description of Artificial Sequence: Synthetic oligonucleotide
  Target: ATXN1; (+) strand; PAM type: YTN; PAM sequence: TTT
ttagtagagacggggtttca

SEQ ID NO: 297999 - DNA, 20 bp, Artificial Sequence
  Description of Artificial Sequence: Synthetic oligonucleotide
  Target: ATXN1; (+) strand; PAM type: YTN; PAM sequence: TTT
tagtagagacggggtttcac

SEQ ID NO: 298000 - DNA, 20 bp, Artificial Sequence
  Description of Artificial Sequence: Synthetic oligonucleotide
  Target: ATXN1; (+) strand; PAM type: YTN; PAM sequence: TTT
agtagagacggggtttcact

SEQ ID NO: 298001 - DNA, 20 bp, Artificial Sequence
  Description of Artificial Sequence: Synthetic oligonucleotide
  Target: ATXN1; (+) strand; PAM type: YTN; PAM sequence: TTA
gtagagacggggtttcactg

SEQ ID NO: 298002 - DNA, 20 bp, Artificial Sequence
  Description of Artificial Sequence: Synthetic oligonucleotide
  Target: ATXN1; (+) strand; PAM type: YTN; PAM sequence: TTT
cactgtattagctaggctgg

SEQ ID NO: 298003 - DNA, 20 bp, Artificial Sequence
  Description of Artificial Sequence: Synthetic oligonucleotide
  Target: ATXN1; (+) strand; PAM type: YTN; PAM sequence: TTC
actgtattagctaggctggt

SEQ ID NO: 298004 - DNA, 20 bp, Artificial Sequence
  Description of Artificial Sequence: Synthetic oligonucleotide
  Target: ATXN1; (+) strand; PAM type: YTN; PAM sequence: CTG
tattagctaggctggtctca

SEQ ID NO: 298005 - DNA, 20 bp, Artificial Sequence
  Description of Artificial Sequence: Synthetic oligonucleotide
  Target: ATXN1; (+) strand; PAM type: YTN; PAM sequence: TTA
gctaggctggtctcaaactc

SEQ ID NO: 298006 - DNA, 20 bp, Artificial Sequence
  Description of Artificial Sequence: Synthetic oligonucleotide
  Target: ATXN1; (+) strand; PAM type: YTN; PAM sequence: CTA
ggctggtctcaaactcctca

SEQ ID NO: 298007 - DNA, 20 bp, Artificial Sequence
  Description of Artificial Sequence: Synthetic oligonucleotide
  Target: ATXN1; (+) strand; PAM type: YTN; PAM sequence: CTG
gtctcaaactcctcacctca

SEQ ID NO: 298008 - DNA, 20 bp, Artificial Sequence
  Description of Artificial Sequence: Synthetic oligonucleotide
  Target: ATXN1; (+) strand; PAM type: YTN; PAM sequence: CTC
aaactcctcacctcatgatc

SEQ ID NO: 298009 - DNA, 20 bp, Artificial Sequence
  Description of Artificial Sequence: Synthetic oligonucleotide
  Target: ATXN1; (+) strand; PAM type: YTN; PAM sequence: CTC
ctcacctcatgatctgccca

SEQ ID NO: 298010 - DNA, 20 bp, Artificial Sequence
  Description of Artificial Sequence: Synthetic oligonucleotide
  Target: ATXN1; (+) strand; PAM type: YTN; PAM sequence: CTC
acctcatgatctgcccacct

SEQ ID NO: 298011 - DNA, 20 bp, Artificial Sequence
  Description of Artificial Sequence: Synthetic oligonucleotide
  Target: ATXN1; (+) strand; PAM type: YTN; PAM sequence: CTC
atgatctgcccaccttggcc

SEQ ID NO: 298012 - DNA, 20 bp, Artificial Sequence
  Description of Artificial Sequence: Synthetic oligonucleotide
  Target: ATXN1; (+) strand; PAM type: YTN; PAM sequence: CTG
cccaccttggcctccgaaaa

SEQ ID NO: 298013 - DNA, 20 bp, Artificial Sequence
  Description of Artificial Sequence: Synthetic oligonucleotide
  Target: ATXN1; (+) strand; PAM type: YTN; PAM sequence: CTT
ggcctccgaaaatgctggga

SEQ ID NO: 298014 - DNA, 20 bp, Artificial Sequence
  Description of Artificial Sequence: Synthetic oligonucleotide
  Target: ATXN1; (+) strand; PAM type: YTN; PAM sequence: TTG
gcctccgaaaatgctgggat

SEQ ID NO: 298015 - DNA, 20 bp, Artificial Sequence
  Description of Artificial Sequence: Synthetic oligonucleotide
  Target: ATXN1; (+) strand; PAM type: YTN; PAM sequence: CTC
cgaaaatgctgggattatag

SEQ ID NO: 298016 - DNA, 20 bp, Artificial Sequence
  Description of Artificial Sequence: Synthetic oligonucleotide
  Target: ATXN1; (+) strand; PAM type: YTN; PAM sequence: CTG
ggattataggcttgagccac

SEQ ID NO: 298017 - DNA, 20 bp, Artificial Sequence
  Description of Artificial Sequence: Synthetic oligonucleotide
  Target: ATXN1; (+) strand; PAM type: YTN; PAM sequence: TTA
taggcttgagccaccacgcc

SEQ ID NO: 298018 - DNA, 20 bp, Artificial Sequence
  Description of Artificial Sequence: Synthetic oligonucleotide
  Target: ATXN1; (+) strand; PAM type: YTN; PAM sequence: CTT
gagccaccacgccctgccta

SEQ ID NO: 298019 - DNA, 20 bp, Artificial Sequence
  Description of Artificial Sequence: Synthetic oligonucleotide
  Target: ATXN1; (+) strand; PAM type: YTN; PAM sequence: TTG
agccaccacgccctgcctac

SEQ ID NO: 298020 - DNA, 20 bp, Artificial Sequence
  Description of Artificial Sequence: Synthetic oligonucleotide
  Target: ATXN1; (+) strand; PAM type: YTN; PAM sequence: CTG
cctacagagaacttcctaaa

SEQ ID NO: 298021 - DNA, 20 bp, Artificial Sequence
  Description of Artificial Sequence: Synthetic oligonucleotide
  Target: ATXN1; (+) strand; PAM type: YTN; PAM sequence: CTA
cagagaacttcctaaagttc

SEQ ID NO: 298022 - DNA, 20 bp, Artificial Sequence
  Description of Artificial Sequence: Synthetic oligonucleotide
  Target: ATXN1; (+) strand; PAM type: YTN; PAM sequence: CTT
cctaaagttcactgcaactt

SEQ ID NO: 298023 - DNA, 20 bp, Artificial Sequence
  Description of Artificial Sequence: Synthetic oligonucleotide
  Target: ATXN1; (+) strand; PAM type: YTN; PAM sequence: TTC
ctaaagttcactgcaacttt

SEQ ID NO: 298024 - DNA, 20 bp, Artificial Sequence
  Description of Artificial Sequence: Synthetic oligonucleotide
  Target: ATXN1; (+) strand; PAM type: YTN; PAM sequence: CTA
aagttcactgcaactttatt

SEQ ID NO: 298025 - DNA, 20 bp, Artificial Sequence
  Description of Artificial Sequence: Synthetic oligonucleotide
  Target: ATXN1; (+) strand; PAM type: YTN; PAM sequence: TTC
actgcaactttattacctag

SEQ ID NO: 298026 - DNA, 20 bp, Artificial Sequence
  Description of Artificial Sequence: Synthetic oligonucleotide
  Target: ATXN1; (+) strand; PAM type: YTN; PAM sequence: CTG
caactttattacctagattt

SEQ ID NO: 298027 - DNA, 20 bp, Artificial Sequence
  Description of Artificial Sequence: Synthetic oligonucleotide
  Target: ATXN1; (+) strand; PAM type: YTN; PAM sequence: CTT
tattacctagatttcattaa

SEQ ID NO: 298028 - DNA, 20 bp, Artificial Sequence
  Description of Artificial Sequence: Synthetic oligonucleotide
  Target: ATXN1; (+) strand; PAM type: YTN; PAM sequence: TTT
attacctagatttcattaat

SEQ ID NO: 298029 - DNA, 20 bp, Artificial Sequence
  Description of Artificial Sequence: Synthetic oligonucleotide
  Target: ATXN1; (+) strand; PAM type: YTN; PAM sequence: TTA
ttacctagatttcattaata

SEQ ID NO: 298030 - DNA, 20 bp, Artificial Sequence
  Description of Artificial Sequence: Synthetic oligonucleotide
  Target: ATXN1; (+) strand; PAM type: YTN; PAM sequence: TTA
cctagatttcattaataaaa

SEQ ID NO: 298031 - DNA, 20 bp, Artificial Sequence
  Description of Artificial Sequence: Synthetic oligonucleotide
  Target: ATXN1; (+) strand; PAM type: YTN; PAM sequence: CTA
gatttcattaataaaaatcc

SEQ ID NO: 298032 - DNA, 20 bp, Artificial Sequence
  Description of Artificial Sequence: Synthetic oligonucleotide
  Target: ATXN1; (+) strand; PAM type: YTN; PAM sequence: TTT
cattaataaaaatcctttca

SEQ ID NO: 298033 - DNA, 20 bp, Artificial Sequence
  Description of Artificial Sequence: Synthetic oligonucleotide
  Target: ATXN1; (+) strand; PAM type: YTN; PAM sequence: TTC
attaataaaaatcctttcaa

SEQ ID NO: 298034 - DNA, 20 bp, Artificial Sequence
  Description of Artificial Sequence: Synthetic oligonucleotide
  Target: ATXN1; (+) strand; PAM type: YTN; PAM sequence: TTA
ataaaaatcctttcaatcag

SEQ ID NO: 298035 - DNA, 20 bp, Artificial Sequence
  Description of Artificial Sequence: Synthetic oligonucleotide
  Target: ATXN1; (+) strand; PAM type: YTN; PAM sequence: CTT
tcaatcagaaggtttagcac

SEQ ID NO: 298036 - DNA, 20 bp, Artificial Sequence
  Description of Artificial Sequence: Synthetic oligonucleotide
  Target: ATXN1; (+) strand; PAM type: YTN; PAM sequence: TTT
caatcagaaggtttagcaca

SEQ ID NO: 298037 - DNA, 20 bp, Artificial Sequence
  Description of Artificial Sequence: Synthetic oligonucleotide
  Target: ATXN1; (+) strand; PAM type: YTN; PAM sequence: TTC
aatcagaaggtttagcacag

SEQ ID NO: 298038 - DNA, 20 bp, Artificial Sequence
  Description of Artificial Sequence: Synthetic oligonucleotide
  Target: ATXN1; (+) strand; PAM type: YTN; PAM sequence: TTT
agcacagtgtagaccaaaga

SEQ ID NO: 298039 - DNA, 20 bp, Artificial Sequence
  Description of Artificial Sequence: Synthetic oligonucleotide
  Target: ATXN1; (+) strand; PAM type: YTN; PAM sequence: TTA
gcacagtgtagaccaaagag

SEQ ID NO: 298040 - DNA, 20 bp, Artificial Sequence
  Description of Artificial Sequence: Synthetic oligonucleotide
  Target: ATXN1; (+) strand; PAM type: YTN; PAM sequence: TTC
actgaaaggctggctctgat

SEQ ID NO: 298041 - DNA, 20 bp, Artificial Sequence
  Description of Artificial Sequence: Synthetic oligonucleotide
  Target: ATXN1; (+) strand; PAM type: YTN; PAM sequence: CTG
aaaggctggctctgatggca

SEQ ID NO: 298042 - DNA, 20 bp, Artificial Sequence
  Description of Artificial Sequence: Synthetic oligonucleotide
  Target: ATXN1; (+) strand; PAM type: YTN; PAM sequence: CTG
gctctgatggcaaaacagat

SEQ ID NO: 298043 - DNA, 20 bp, Artificial Sequence
  Description of Artificial Sequence: Synthetic oligonucleotide
  Target: ATXN1; (+) strand; PAM type: YTN; PAM sequence: CTC
tgatggcaaaacagatggtt

SEQ ID NO: 298044 - DNA, 20 bp, Artificial Sequence
  Description of Artificial Sequence: Synthetic oligonucleotide
  Target: ATXN1; (+) strand; PAM type: YTN; PAM sequence: CTG
atggcaaaacagatggtttg

SEQ ID NO: 298045 - DNA, 20 bp, Artificial Sequence
  Description of Artificial Sequence: Synthetic oligonucleotide
  Target: ATXN1; (+) strand; PAM type: YTN; PAM sequence: TTT
ggaatgagatcctgggaaat

SEQ ID NO: 298046 - DNA, 20 bp, Artificial Sequence
  Description of Artificial Sequence: Synthetic oligonucleotide
  Target: ATXN1; (+) strand; PAM type: YTN; PAM sequence: TTG
gaatgagatcctgggaaatg

SEQ ID NO: 298047 - DNA, 20 bp, Artificial Sequence
  Description of Artificial Sequence: Synthetic oligonucleotide
  Target: ATXN1; (+) strand; PAM type: YTN; PAM sequence: CTG
ggaaatggccactgtactgg

SEQ ID NO: 298048 - DNA, 20 bp, Artificial Sequence
  Description of Artificial Sequence: Synthetic oligonucleotide
  Target: ATXN1; (+) strand; PAM type: YTN; PAM sequence: CTG
tactggagtaagaaatcaat

SEQ ID NO: 298049 - DNA, 20 bp, Artificial Sequence
  Description of Artificial Sequence: Synthetic oligonucleotide
  Target: ATXN1; (+) strand; PAM type: YTN; PAM sequence: CTG
gagtaagaaatcaatgctcc

SEQ ID NO: 298050 - DNA, 20 bp, Artificial Sequence
  Description of Artificial Sequence: Synthetic oligonucleotide
  Target: ATXN1; (+) strand; PAM type: YTN; PAM sequence: CTC
ctagagaaacagatcatttc

SEQ ID NO: 298051 - DNA, 20 bp, Artificial Sequence
  Description of Artificial Sequence: Synthetic oligonucleotide
  Target: ATXN1; (+) strand; PAM type: YTN; PAM sequence: CTA
gagaaacagatcatttcctc

SEQ ID NO: 298052 - DNA, 20 bp, Artificial Sequence
  Description of Artificial Sequence: Synthetic oligonucleotide
  Target: ATXN1; (+) strand; PAM type: YTN; PAM sequence: TTT
cctcagcaagtttttgccaa

SEQ ID NO: 298053 - DNA, 20 bp, Artificial Sequence
  Description of Artificial Sequence: Synthetic oligonucleotide
  Target: ATXN1; (+) strand; PAM type: YTN; PAM sequence: TTC
ctcagcaagtttttgccaag

SEQ ID NO: 298054 - DNA, 20 bp, Artificial Sequence
  Description of Artificial Sequence: Synthetic oligonucleotide
  Target: ATXN1; (+) strand; PAM type: YTN; PAM sequence: CTC
agcaagtttttgccaagaac

SEQ ID NO: 298055 - DNA, 20 bp, Artificial Sequence
  Description of Artificial Sequence: Synthetic oligonucleotide
  Target: ATXN1; (+) strand; PAM type: YTN; PAM sequence: TTT
ttgccaagaacatgacttaa

SEQ ID NO: 298056 - DNA, 20 bp, Artificial Sequence
  Description of Artificial Sequence: Synthetic oligonucleotide
  Target: ATXN1; (+) strand; PAM type: YTN; PAM sequence: TTT
tgccaagaacatgacttaaa

SEQ ID NO: 298057 - DNA, 20 bp, Artificial Sequence
  Description of Artificial Sequence: Synthetic oligonucleotide
  Target: ATXN1; (+) strand; PAM type: YTN; PAM sequence: TTT
gccaagaacatgacttaaac

SEQ ID NO: 298058 - DNA, 20 bp, Artificial Sequence
  Description of Artificial Sequence: Synthetic oligonucleotide
  Target: ATXN1; (+) strand; PAM type: YTN; PAM sequence: TTG
ccaagaacatgacttaaaca

SEQ ID NO: 298059 - DNA, 20 bp, Artificial Sequence
  Description of Artificial Sequence: Synthetic oligonucleotide
  Target: ATXN1; (+) strand; PAM type: YTN; PAM sequence: CTT
aaacaaacatgtgaaaagat

SEQ ID NO: 298060 - DNA, 20 bp, Artificial Sequence
  Description of Artificial Sequence: Synthetic oligonucleotide
  Target: ATXN1; (+) strand; PAM type: YTN; PAM sequence: TTA
aacaaacatgtgaaaagatc

SEQ ID NO: 298061 - DNA, 20 bp, Artificial Sequence
  Description of Artificial Sequence: Synthetic oligonucleotide
  Target: ATXN1; (+) strand; PAM type: YTN; PAM sequence: CTG
ttttgtgtagttctgaattc

SEQ ID NO: 298062 - DNA, 20 bp, Artificial Sequence
  Description of Artificial Sequence: Synthetic oligonucleotide
  Target: ATXN1; (+) strand; PAM type: YTN; PAM sequence: TTT
tgtgtagttctgaattctgc

SEQ ID NO: 298063 - DNA, 20 bp, Artificial Sequence
  Description of Artificial Sequence: Synthetic oligonucleotide
  Target: ATXN1; (+) strand; PAM type: YTN; PAM sequence: TTT
gtgtagttctgaattctgct

SEQ ID NO: 298064 - DNA, 20 bp, Artificial Sequence
  Description of Artificial Sequence: Synthetic oligonucleotide
  Target: ATXN1; (+) strand; PAM type: YTN; PAM sequence: TTG
tgtagttctgaattctgctc

SEQ ID NO: 298065 - DNA, 20 bp, Artificial Sequence
  Description of Artificial Sequence: Synthetic oligonucleotide
  Target: ATXN1; (+) strand; PAM type: YTN; PAM sequence: TTC
tgaattctgctcagactttc

SEQ ID NO: 298066 - DNA, 20 bp, Artificial Sequence
  Description of Artificial Sequence: Synthetic oligonucleotide
  Target: ATXN1; (+) strand; PAM type: YTN; PAM sequence: CTG
aattctgctcagactttcaa

SEQ ID NO: 298067 - DNA, 20 bp, Artificial Sequence
  Description of Artificial Sequence: Synthetic oligonucleotide
  Target: ATXN1; (+) strand; PAM type: YTN; PAM sequence: TTC
tgctcagactttcaatttca

SEQ ID NO: 298068 - DNA, 20 bp, Artificial Sequence
  Description of Artificial Sequence: Synthetic oligonucleotide
  Target: ATXN1; (+) strand; PAM type: YTN; PAM sequence: CTG
ctcagactttcaatttcaaa

SEQ ID NO: 298069 - DNA, 20 bp, Artificial Sequence
  Description of Artificial Sequence: Synthetic oligonucleotide
  Target: ATXN1; (+) strand; PAM type: YTN; PAM sequence: CTC
agactttcaatttcaaaata

SEQ ID NO: 298070 - DNA, 20 bp, Artificial Sequence
  Description of Artificial Sequence: Synthetic oligonucleotide
  Target: ATXN1; (+) strand; PAM type: YTN; PAM sequence: CTT
tcaatttcaaaataacaaag

SEQ ID NO: 298071 - DNA, 20 bp, Artificial Sequence
  Description of Artificial Sequence: Synthetic oligonucleotide
  Target: ATXN1; (+) strand; PAM type: YTN; PAM sequence: TTT
caatttcaaaataacaaagc

SEQ ID NO: 298072 - DNA, 20 bp, Artificial Sequence
  Description of Artificial Sequence: Synthetic oligonucleotide
  Target: ATXN1; (+) strand; PAM type: YTN; PAM sequence: TTC
aatttcaaaataacaaagca

SEQ ID NO: 298073 - DNA, 20 bp, Artificial Sequence
  Description of Artificial Sequence: Synthetic oligonucleotide
  Target: ATXN1; (+) strand; PAM type: YTN; PAM sequence: TTT
caaaataacaaagcagtaaa

SEQ ID NO: 298074 - DNA, 20 bp, Artificial Sequence
  Description of Artificial Sequence: Synthetic oligonucleotide
  Target: ATXN1; (+) strand; PAM type: YTN; PAM sequence: TTC
aaaataacaaagcagtaaac

SEQ ID NO: 298075 - DNA, 20 bp, Artificial Sequence
  Description of Artificial Sequence: Synthetic oligonucleotide
  Target: ATXN1; (+) strand; PAM type: YTN; PAM sequence: CTG
gaaacatagcccccattctt

SEQ ID NO: 298076 - DNA, 20 bp, Artificial Sequence
  Description of Artificial Sequence: Synthetic oligonucleotide
  Target: ATXN1; (+) strand; PAM type: YTN; PAM sequence: TTC
tttctgaaatcttaaacaga

SEQ ID NO: 298077 - DNA, 20 bp, Artificial Sequence
  Description of Artificial Sequence: Synthetic oligonucleotide
  Target: ATXN1; (+) strand; PAM type: YTN; PAM sequence: CTT
tctgaaatcttaaacagact

SEQ ID NO: 298078 - DNA, 20 bp, Artificial Sequence
  Description of Artificial Sequence: Synthetic oligonucleotide
  Target: ATXN1; (+) strand; PAM type: YTN; PAM sequence: TTT
ctgaaatcttaaacagactg

SEQ ID NO: 298079 - DNA, 20 bp, Artificial Sequence
  Description of Artificial Sequence: Synthetic oligonucleotide
  Target: ATXN1; (+) strand; PAM type: YTN; PAM sequence: TTC
tgaaatcttaaacagactgc

SEQ ID NO: 298080 - DNA, 20 bp, Artificial Sequence
  Description of Artificial Sequence: Synthetic oligonucleotide
  Target: ATXN1; (+) strand; PAM type: YTN; PAM sequence: CTG
aaatcttaaacagactgcag

SEQ ID NO: 298081 - DNA, 20 bp, Artificial Sequence
  Description of Artificial Sequence: Synthetic oligonucleotide
  Target: ATXN1; (+) strand; PAM type: YTN; PAM sequence: CTT
aaacagactgcagcttccaa

SEQ ID NO: 298082 - DNA, 20 bp, Artificial Sequence
  Description of Artificial Sequence: Synthetic oligonucleotide
  Target: ATXN1; (+) strand; PAM type: YTN; PAM sequence: TTA
aacagactgcagcttccaag

SEQ ID NO: 298083 - DNA, 20 bp, Artificial Sequence
  Description of Artificial Sequence: Synthetic oligonucleotide
  Target: ATXN1; (+) strand; PAM type: YTN; PAM sequence: CTG
cagcttccaaggttggatgt

SEQ ID NO: 298084 - DNA, 20 bp, Artificial Sequence
  Description of Artificial Sequence: Synthetic oligonucleotide
  Target: ATXN1; (+) strand; PAM type: YTN; PAM sequence: CTT
ccaaggttggatgtgaaatt

SEQ ID NO: 298085 - DNA, 20 bp, Artificial Sequence
  Description of Artificial Sequence: Synthetic oligonucleotide
  Target: ATXN1; (+) strand; PAM type: YTN; PAM sequence: TTC
caaggttggatgtgaaattc

SEQ ID NO: 298086 - DNA, 20 bp, Artificial Sequence
  Description of Artificial Sequence: Synthetic oligonucleotide
  Target: ATXN1; (+) strand; PAM type: YTN; PAM sequence: TTG
gatgtgaaattcagaggcac

SEQ ID NO: 298087 - DNA, 20 bp, Artificial Sequence
  Description of Artificial Sequence: Synthetic oligonucleotide
  Target: ATXN1; (+) strand; PAM type: YTN; PAM sequence: TTC
agaggcacacaactcttttg

SEQ ID NO: 298088 - DNA, 20 bp, Artificial Sequence
  Description of Artificial Sequence: Synthetic oligonucleotide
  Target: ATXN1; (+) strand; PAM type: YTN; PAM sequence: CTC
ttttggtagaaagctgcagc

SEQ ID NO: 298089 - DNA, 20 bp, Artificial Sequence
  Description of Artificial Sequence: Synthetic oligonucleotide
  Target: ATXN1; (+) strand; PAM type: YTN; PAM sequence: CTT
ttggtagaaagctgcagccc

SEQ ID NO: 298090 - DNA, 20 bp, Artificial Sequence
  Description of Artificial Sequence: Synthetic oligonucleotide
  Target: ATXN1; (+) strand; PAM type: YTN; PAM sequence: TTT
tggtagaaagctgcagccca

SEQ ID NO: 298091 - DNA, 20 bp, Artificial Sequence
  Description of Artificial Sequence: Synthetic oligonucleotide
  Target: ATXN1; (+) strand; PAM type: YTN; PAM sequence: TTT
ggtagaaagctgcagcccag

SEQ ID NO: 298092 - DNA, 20 bp, Artificial Sequence
  Description of Artificial Sequence: Synthetic oligonucleotide
  Target: ATXN1; (+) strand; PAM type: YTN; PAM sequence: TTG
gtagaaagctgcagcccagc

SEQ ID NO: 298093 - DNA, 20 bp, Artificial Sequence
  Description of Artificial Sequence: Synthetic oligonucleotide
  Target: ATXN1; (+) strand; PAM type: YTN; PAM sequence: CTG
cagcccagcagagctctctg

SEQ ID NO: 298094 - DNA, 20 bp, Artificial Sequence
  Description of Artificial Sequence: Synthetic oligonucleotide
  Target: ATXN1; (+) strand; PAM type: YTN; PAM sequence: CTC
tctgaagtctagggggaggt

SEQ ID NO: 298095 - DNA, 20 bp, Artificial Sequence
  Description of Artificial Sequence: Synthetic oligonucleotide
  Target: ATXN1; (+) strand; PAM type: YTN; PAM sequence: CTC
tgaagtctagggggaggtgg

SEQ ID NO: 298096 - DNA, 20 bp, Artificial Sequence
  Description of Artificial Sequence: Synthetic oligonucleotide
  Target: ATXN1; (+) strand; PAM type: YTN; PAM sequence: CTG
aagtctagggggaggtgggt

SEQ ID NO: 298097 - DNA, 20 bp, Artificial Sequence
  Description of Artificial Sequence: Synthetic oligonucleotide
  Target: ATXN1; (+) strand; PAM type: YTN; PAM sequence: CTA
gggggaggtgggtgtctgtg

SEQ ID NO: 298098 - DNA, 20 bp, Artificial Sequence
  Description of Artificial Sequence: Synthetic oligonucleotide
  Target: ATXN1; (+) strand; PAM type: YTN; PAM sequence: CTG
tgttgtagattggtgacttt

SEQ ID NO: 298099 - DNA, 20 bp, Artificial Sequence
  Description of Artificial Sequence: Synthetic oligonucleotide
  Target: ATXN1; (+) strand; PAM type: YTN; PAM sequence: TTG
tagattggtgactttataga

SEQ ID NO: 298100 - DNA, 20 bp, Artificial Sequence
  Description of Artificial Sequence: Synthetic oligonucleotide
  Target: ATXN1; (+) strand; PAM type: YTN; PAM sequence: TTG
gtgactttatagaatgtgct

SEQ ID NO: 298101 - DNA, 20 bp, Artificial Sequence
  Description of Artificial Sequence: Synthetic oligonucleotide
  Target: ATXN1; (+) strand; PAM type: YTN; PAM sequence: CTT
tatagaatgtgcttccagga

SEQ ID NO: 298102 - DNA, 20 bp, Artificial Sequence
  Description of Artificial Sequence: Synthetic oligonucleotide
  Target: ATXN1; (+) strand; PAM type: YTN; PAM sequence: TTT
atagaatgtgcttccaggaa

SEQ ID NO: 298103 - DNA, 20 bp, Artificial Sequence
  Description of Artificial Sequence: Synthetic oligonucleotide
  Target: ATXN1; (+) strand; PAM type: YTN; PAM sequence: TTA
tagaatgtgcttccaggaat

SEQ ID NO: 298104 - DNA, 20 bp, Artificial Sequence
  Description of Artificial Sequence: Synthetic oligonucleotide
  Target: ATXN1; (+) strand; PAM type: YTN; PAM sequence: CTT
ccaggaatgtgagcatacac

SEQ ID NO: 298105 - DNA, 20 bp, Artificial Sequence
  Description of Artificial Sequence: Synthetic oligonucleotide
  Target: ATXN1; (+) strand; PAM type: YTN; PAM sequence: TTC
caggaatgtgagcatacaca

SEQ ID NO: 298106 - DNA, 20 bp, Artificial Sequence
  Description of Artificial Sequence: Synthetic oligonucleotide
  Target: ATXN1; (+) strand; PAM type: YTN; PAM sequence: CTG
gcaactgaaagtaaccaatg

SEQ ID NO: 298107 - DNA, 20 bp, Artificial Sequence
  Description of Artificial Sequence: Synthetic oligonucleotide
  Target: ATXN1; (+) strand; PAM type: YTN; PAM sequence: CTG
aaagtaaccaatggcttttt

SEQ ID NO: 298108 - DNA, 20 bp, Artificial Sequence
  Description of Artificial Sequence: Synthetic oligonucleotide
  Target: ATXN1; (+) strand; PAM type: YTN; PAM sequence: CTT
tttaacagatccactttatt

SEQ ID NO: 298109 - DNA, 20 bp, Artificial Sequence
  Description of Artificial Sequence: Synthetic oligonucleotide
  Target: ATXN1; (+) strand; PAM type: YTN; PAM sequence: TTT
ttaacagatccactttattt

SEQ ID NO: 298110 - DNA, 20 bp, Artificial Sequence
  Description of Artificial Sequence: Synthetic oligonucleotide
  Target: ATXN1; (+) strand; PAM type: YTN; PAM sequence: TTT
taacagatccactttatttc

SEQ ID NO: 298111 - DNA, 20 bp, Artificial Sequence
  Description of Artificial Sequence: Synthetic oligonucleotide
  Target: ATXN1; (+) strand; PAM type: YTN; PAM sequence: TTT
aacagatccactttatttca

SEQ ID NO: 298112 - DNA, 20 bp, Artificial Sequence
  Description of Artificial Sequence: Synthetic oligonucleotide
  Target: ATXN1; (+) strand; PAM type: YTN; PAM sequence: TTA
acagatccactttatttcaa

SEQ ID NO: 298113 - DNA, 20 bp, Artificial Sequence
  Description of Artificial Sequence: Synthetic oligonucleotide
  Target: ATXN1; (+) strand; PAM type: YTN; PAM sequence: CTT
tatttcaacgtttggagatt

SEQ ID NO: 298114 - DNA, 20 bp, Artificial Sequence
  Description of Artificial Sequence: Synthetic oligonucleotide
  Target: ATXN1; (+) strand; PAM type: YTN; PAM sequence: TTT
atttcaacgtttggagatta

SEQ ID NO: 298115 - DNA, 20 bp, Artificial Sequence
  Description of Artificial Sequence: Synthetic oligonucleotide
  Target: ATXN1; (+) strand; PAM type: YTN; PAM sequence: TTA
tttcaacgtttggagattaa

SEQ ID NO: 298116 - DNA, 20 bp, Artificial Sequence
  Description of Artificial Sequence: Synthetic oligonucleotide
  Target: ATXN1; (+) strand; PAM type: YTN; PAM sequence: TTT
caacgtttggagattaaccc

SEQ ID NO: 298117 - DNA, 20 bp, Artificial Sequence
  Description of Artificial Sequence: Synthetic oligonucleotide
  Target: ATXN1; (+) strand; PAM type: YTN; PAM sequence: TTC
aacgtttggagattaacccg

SEQ ID NO: 298118 - DNA, 20 bp, Artificial Sequence
  Description of Artificial Sequence: Synthetic oligonucleotide
  Target: ATXN1; (+) strand; PAM type: YTN; PAM sequence: TTT
ggagattaacccgcaatcaa

SEQ ID NO: 298119 - DNA, 20 bp, Artificial Sequence
  Description of Artificial Sequence: Synthetic oligonucleotide
  Target: ATXN1; (+) strand; PAM type: YTN; PAM sequence: TTG
gagattaacccgcaatcaaa

SEQ ID NO: 298120 - DNA, 20 bp, Artificial Sequence
  Description of Artificial Sequence: Synthetic oligonucleotide
  Target: ATXN1; (+) strand; PAM type: YTN; PAM sequence: TTA
acccgcaatcaaatactgcc

SEQ ID NO: 298121 - DNA, 20 bp, Artificial Sequence
  Description of Artificial Sequence: Synthetic oligonucleotide
  Target: ATXN1; (+) strand; PAM type: YTN; PAM sequence: CTG
ccgtatgagtccgtgctaag

SEQ ID NO: 298122 - DNA, 20 bp, Artificial Sequence
  Description of Artificial Sequence: Synthetic oligonucleotide
  Target: ATXN1; (+) strand; PAM type: YTN; PAM sequence: CTA
agacttcatcatttcacatt

SEQ ID NO: 298123 - DNA, 20 bp, Artificial Sequence
  Description of Artificial Sequence: Synthetic oligonucleotide
  Target: ATXN1; (+) strand; PAM type: YTN; PAM sequence: CTT
catcatttcacattttctgt

SEQ ID NO: 298124 - DNA, 20 bp, Artificial Sequence
  Description of Artificial Sequence: Synthetic oligonucleotide
  Target: ATXN1; (+) strand; PAM type: YTN; PAM sequence: TTC
atcatttcacattttctgtc

SEQ ID NO: 298125 - DNA, 20 bp, Artificial Sequence
  Description of Artificial Sequence: Synthetic oligonucleotide
  Target: ATXN1; (+) strand; PAM type: YTN; PAM sequence: TTT
cacattttctgtcaaaagcc

SEQ ID NO: 298126 - DNA, 20 bp, Artificial Sequence
  Description of Artificial Sequence: Synthetic oligonucleotide
  Target: ATXN1; (+) strand; PAM type: YTN; PAM sequence: TTC
acattttctgtcaaaagcct

SEQ ID NO: 298127 - DNA, 20 bp, Artificial Sequence
  Description of Artificial Sequence: Synthetic oligonucleotide
  Target: ATXN1; (+) strand; PAM type: YTN; PAM sequence: TTT
tctgtcaaaagcctttcttc

SEQ ID NO: 298128 - DNA, 20 bp, Artificial Sequence
  Description of Artificial Sequence: Synthetic oligonucleotide
  Target: ATXN1; (+) strand; PAM type: YTN; PAM sequence: TTT
ctgtcaaaagcctttcttca

SEQ ID NO: 298129 - DNA, 20 bp, Artificial Sequence
  Description of Artificial Sequence: Synthetic oligonucleotide
  Target: ATXN1; (+) strand; PAM type: YTN; PAM sequence: TTC
tgtcaaaagcctttcttcaa

SEQ ID NO: 298130 - DNA, 20 bp, Artificial Sequence
  Description of Artificial Sequence: Synthetic oligonucleotide
  Target: ATXN1; (+) strand; PAM type: YTN; PAM sequence: CTG
tcaaaagcctttcttcaatt

SEQ ID NO: 298131 - DNA, 20 bp, Artificial Sequence
  Description of Artificial Sequence: Synthetic oligonucleotide
  Target: ATXN1; (+) strand; PAM type: YTN; PAM sequence: CTT
tcttcaattgcaccatagtc

SEQ ID NO: 298132 - DNA, 20 bp, Artificial Sequence
  Description of Artificial Sequence: Synthetic oligonucleotide
  Target: ATXN1; (+) strand; PAM type: YTN; PAM sequence: TTT
cttcaattgcaccatagtcc

SEQ ID NO: 298133 - DNA, 20 bp, Artificial Sequence
  Description of Artificial Sequence: Synthetic oligonucleotide
  Target: ATXN1; (+) strand; PAM type: YTN; PAM sequence: TTC
ttcaattgcaccatagtccc

SEQ ID NO: 298134 - DNA, 20 bp, Artificial Sequence
  Description of Artificial Sequence: Synthetic oligonucleotide
  Target: ATXN1; (+) strand; PAM type: YTN; PAM sequence: CTT
caattgcaccatagtcccat

SEQ ID NO: 298135 - DNA, 20 bp, Artificial Sequence
  Description of Artificial Sequence: Synthetic oligonucleotide
  Target: ATXN1; (+) strand; PAM type: YTN; PAM sequence: TTC
aattgcaccatagtcccata

SEQ ID NO: 298136 - DNA, 20 bp, Artificial Sequence
  Description of Artificial Sequence: Synthetic oligonucleotide
  Target: ATXN1; (+) strand; PAM type: YTN; PAM sequence: TTG
caccatagtcccataaaatc

SEQ ID NO: 298137 - DNA, 20 bp, Artificial Sequence
  Description of Artificial Sequence: Synthetic oligonucleotide
  Target: ATXN1; (+) strand; PAM type: YTN; PAM sequence: CTG
aaaatatcacatgactgagg

SEQ ID NO: 298138 - DNA, 20 bp, Artificial Sequence
  Description of Artificial Sequence: Synthetic oligonucleotide
  Target: ATXN1; (+) strand; PAM type: YTN; PAM sequence: CTG
aggatctaagagccaaggtc

SEQ ID NO: 298139 - DNA, 20 bp, Artificial Sequence
  Description of Artificial Sequence: Synthetic oligonucleotide
  Target: ATXN1; (+) strand; PAM type: YTN; PAM sequence: CTA
agagccaaggtcctgaatca

SEQ ID NO: 298140 - DNA, 20 bp, Artificial Sequence
  Description of Artificial Sequence: Synthetic oligonucleotide
  Target: ATXN1; (+) strand; PAM type: YTN; PAM sequence: CTG
aatcacacaacatactcatt

SEQ ID NO: 298141 - DNA, 20 bp, Artificial Sequence
  Description of Artificial Sequence: Synthetic oligonucleotide
  Target: ATXN1; (+) strand; PAM type: YTN; PAM sequence: CTC
attagggaatcttctccctt

SEQ ID NO: 298142 - DNA, 20 bp, Artificial Sequence
  Description of Artificial Sequence: Synthetic oligonucleotide
  Target: ATXN1; (+) strand; PAM type: YTN; PAM sequence: TTA
gggaatcttctccctttccc

SEQ ID NO: 298143 - DNA, 20 bp, Artificial Sequence
  Description of Artificial Sequence: Synthetic oligonucleotide
  Target: ATXN1; (+) strand; PAM type: YTN; PAM sequence: CTT
ctccctttccccctttcaga

SEQ ID NO: 298144 - DNA, 20 bp, Artificial Sequence
  Description of Artificial Sequence: Synthetic oligonucleotide
  Target: ATXN1; (+) strand; PAM type: YTN; PAM sequence: TTC
tccctttccccctttcagat

SEQ ID NO: 298145 - DNA, 20 bp, Artificial Sequence
  Description of Artificial Sequence: Synthetic oligonucleotide
  Target: ATXN1; (+) strand; PAM type: YTN; PAM sequence: CTC
cctttccccctttcagatat

SEQ ID NO: 298146 - DNA, 20 bp, Artificial Sequence
  Description of Artificial Sequence: Synthetic oligonucleotide
  Target: ATXN1; (+) strand; PAM type: YTN; PAM sequence: CTT
tccccctttcagatatttta

SEQ ID NO: 298147 - DNA, 20 bp, Artificial Sequence
  Description of Artificial Sequence: Synthetic oligonucleotide
  Target: ATXN1; (+) strand; PAM type: YTN; PAM sequence: TTT
ccccctttcagatattttaa

SEQ ID NO: 298148 - DNA, 20 bp, Artificial Sequence
  Description of Artificial Sequence: Synthetic oligonucleotide
  Target: ATXN1; (+) strand; PAM type: YTN; PAM sequence: TTC
cccctttcagatattttaaa

SEQ ID NO: 298149 - DNA, 20 bp, Artificial Sequence
  Description of Artificial Sequence: Synthetic oligonucleotide
  Target: ATXN1; (+) strand; PAM type: YTN; PAM sequence: CTT
tcagatattttaaaattaaa

SEQ ID NO: 298150 - DNA, 20 bp, Artificial Sequence
  Description of Artificial Sequence: Synthetic oligonucleotide
  Target: ATXN1; (+) strand; PAM type: YTN; PAM sequence: TTT
cagatattttaaaattaaaa

SEQ ID NO: 298151 - DNA, 20 bp, Artificial Sequence
  Description of Artificial Sequence: Synthetic oligonucleotide
  Target: ATXN1; (+) strand; PAM type: YTN; PAM sequence: TTC
agatattttaaaattaaaac

SEQ ID NO: 298152 - DNA, 20 bp, Artificial Sequence
  Description of Artificial Sequence: Synthetic oligonucleotide
  Target: ATXN1; (+) strand; PAM type: YTN; PAM sequence: TTT
taaaattaaaacgaagggtg

SEQ ID NO: 298153 - DNA, 20 bp, Artificial Sequence
  Description of Artificial Sequence: Synthetic oligonucleotide
  Target: ATXN1; (+) strand; PAM type: YTN; PAM sequence: TTT
aaaattaaaacgaagggtgg

SEQ ID NO: 298154 - DNA, 20 bp, Artificial Sequence
  Description of Artificial Sequence: Synthetic oligonucleotide
  Target: ATXN1; (+) strand; PAM type: YTN; PAM sequence: TTA
aaattaaaacgaagggtgga

SEQ ID NO: 298155 - DNA, 20 bp, Artificial Sequence
  Description of Artificial Sequence: Synthetic oligonucleotide
  Target: ATXN1; (+) strand; PAM type: YTN; PAM sequence: TTA
aaacgaagggtggagggaat

SEQ ID NO: 298156 - DNA, 20 bp, Artificial Sequence
  Description of Artificial Sequence: Synthetic oligonucleotide
  Target: ATXN1; (+) strand; PAM type: YTN; PAM sequence: TTT
atatgtaatgatattggcct

SEQ ID NO: 298157 - DNA, 20 bp, Artificial Sequence
  Description of Artificial Sequence: Synthetic oligonucleotide
  Target: ATXN1; (+) strand; PAM type: YTN; PAM sequence: TTA
tatgtaatgatattggcctg

SEQ ID NO: 298158 - DNA, 20 bp, Artificial Sequence
  Description of Artificial Sequence: Synthetic oligonucleotide
  Target: ATXN1; (+) strand; PAM type: YTN; PAM sequence: TTG
gcctgatggcagtcaactta

SEQ ID NO: 298159 - DNA, 20 bp, Artificial Sequence
  Description of Artificial Sequence: Synthetic oligonucleotide
  Target: ATXN1; (+) strand; PAM type: YTN; PAM sequence: CTG
atggcagtcaacttatggca

SEQ ID NO: 298160 - DNA, 20 bp, Artificial Sequence
  Description of Artificial Sequence: Synthetic oligonucleotide
  Target: ATXN1; (+) strand; PAM type: YTN; PAM sequence: CTT
atggcacacatgaaggcgaa

SEQ ID NO: 298161 - DNA, 20 bp, Artificial Sequence
  Description of Artificial Sequence: Synthetic oligonucleotide
  Target: ATXN1; (+) strand; PAM type: YTN; PAM sequence: TTA
tggcacacatgaaggcgaaa

SEQ ID NO: 298162 - DNA, 20 bp, Artificial Sequence
  Description of Artificial Sequence: Synthetic oligonucleotide
  Target: ATXN1; (+) strand; PAM type: YTN; PAM sequence: TTT
tttcagggagaggtggagat

SEQ ID NO: 298163 - DNA, 20 bp, Artificial Sequence
  Description of Artificial Sequence: Synthetic oligonucleotide
  Target: ATXN1; (+) strand; PAM type: YTN; PAM sequence: TTT
ttcagggagaggtggagatg

SEQ ID NO: 298164 - DNA, 20 bp, Artificial Sequence
  Description of Artificial Sequence: Synthetic oligonucleotide
  Target: ATXN1; (+) strand; PAM type: YTN; PAM sequence: TTT
tcagggagaggtggagatgg

SEQ ID NO: 298165 - DNA, 20 bp, Artificial Sequence
  Description of Artificial Sequence: Synthetic oligonucleotide
  Target: ATXN1; (+) strand; PAM type: YTN; PAM sequence: TTT
cagggagaggtggagatgga

SEQ ID NO: 298166 - DNA, 20 bp, Artificial Sequence
  Description of Artificial Sequence: Synthetic oligonucleotide
  Target: ATXN1; (+) strand; PAM type: YTN; PAM sequence: TTC
agggagaggtggagatggag

SEQ ID NO: 298167 - DNA, 20 bp, Artificial Sequence
  Description of Artificial Sequence: Synthetic oligonucleotide
  Target: ATXN1; (+) strand; PAM type: YTN; PAM sequence: CTA
catatatttaaaattggagg

SEQ ID NO: 298168 - DNA, 20 bp, Artificial Sequence
  Description of Artificial Sequence: Synthetic oligonucleotide
  Target: ATXN1; (+) strand; PAM type: YTN; PAM sequence: TTT
aaaattggaggccaggtgcg

SEQ ID NO: 298169 - DNA, 20 bp, Artificial Sequence
  Description of Artificial Sequence: Synthetic oligonucleotide
  Target: ATXN1; (+) strand; PAM type: YTN; PAM sequence: TTA
aaattggaggccaggtgcgg

SEQ ID NO: 298170 - DNA, 20 bp, Artificial Sequence
  Description of Artificial Sequence: Synthetic oligonucleotide
  Target: ATXN1; (+) strand; PAM type: YTN; PAM sequence: TTG
gaggccaggtgcggtggctc

SEQ ID NO: 298171 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 298172 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 298173 - DNA, 20 bp, Artificial Sequence
  Description of Artificial Sequence: Synthetic oligonucleotide
  Target: ATXN1; (+) strand; PAM type: YTN; PAM sequence: CTT
tgggaggctgaggctggcgg

SEQ ID NO: 298174 - DNA, 20 bp, Artificial Sequence
  Description of Artificial Sequence: Synthetic oligonucleotide
  Target: ATXN1; (+) strand; PAM type: YTN; PAM sequence: TTT
gggaggctgaggctggcgga

SEQ ID NO: 298175 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggctggcggat

SEQ ID NO: 298176 - DNA, 20 bp, Artificial Sequence
  Description of Artificial Sequence: Synthetic oligonucleotide
  Target: ATXN1; (+) strand; PAM type: YTN; PAM sequence: CTG
aggctggcggatcatttgag

SEQ ID NO: 298177 - DNA, 20 bp, Artificial Sequence
  Description of Artificial Sequence: Synthetic oligonucleotide
  Target: ATXN1; (+) strand; PAM type: YTN; PAM sequence: CTG
gcggatcatttgaggtcagg

SEQ ID NO: 298178 - DNA, 20 bp, Artificial Sequence
  Description of Artificial Sequence: Synthetic oligonucleotide
  Target: ATXN1; (+) strand; PAM type: YTN; PAM sequence: TTT
gaggtcaggagttcaagacc

SEQ ID NO: 298179 - DNA, 20 bp, Artificial Sequence
  Description of Artificial Sequence: Synthetic oligonucleotide
  Target: ATXN1; (+) strand; PAM type: YTN; PAM sequence: TTG
aggtcaggagttcaagacca

SEQ ID NO: 298180 - DNA, 20 bp, Artificial Sequence
  Description of Artificial Sequence: Synthetic oligonucleotide
  Target: ATXN1; (+) strand; PAM type: YTN; PAM sequence: TTC
aagaccagtctgactgacat

SEQ ID NO: 298181 - DNA, 20 bp, Artificial Sequence
  Description of Artificial Sequence: Synthetic oligonucleotide
  Target: ATXN1; (+) strand; PAM type: YTN; PAM sequence: CTG
actgacatggtgaagcccca

SEQ ID NO: 298182 - DNA, 20 bp, Artificial Sequence
  Description of Artificial Sequence: Synthetic oligonucleotide
  Target: ATXN1; (+) strand; PAM type: YTN; PAM sequence: CTG
acatggtgaagccccatctc

SEQ ID NO: 298183 - DNA, 20 bp, Artificial Sequence
  Description of Artificial Sequence: Synthetic oligonucleotide
  Target: ATXN1; (+) strand; PAM type: YTN; PAM sequence: CTC
tactaaaaaaaatatataaa

SEQ ID NO: 298184 - DNA, 20 bp, Artificial Sequence
  Description of Artificial Sequence: Synthetic oligonucleotide
  Target: ATXN1; (+) strand; PAM type: YTN; PAM sequence: CTA
ctaaaaaaaatatataaaaa

SEQ ID NO: 298185 - DNA, 20 bp, Artificial Sequence
  Description of Artificial Sequence: Synthetic oligonucleotide
  Target: ATXN1; (+) strand; PAM type: YTN; PAM sequence: CTA
aaaaaaatatataaaaaaaa

SEQ ID NO: 298186 - DNA, 20 bp, Artificial Sequence
  Description of Artificial Sequence: Synthetic oligonucleotide
  Target: ATXN1; (+) strand; PAM type: YTN; PAM sequence: TTA
gccaggcattgtggtgcata

SEQ ID NO: 298187 - DNA, 20 bp, Artificial Sequence
  Description of Artificial Sequence: Synthetic oligonucleotide
  Target: ATXN1; (+) strand; PAM type: YTN; PAM sequence: TTG
tggtgcatacctgtagtccc

SEQ ID NO: 298188 - DNA, 20 bp, Artificial Sequence
  Description of Artificial Sequence: Synthetic oligonucleotide
  Target: ATXN1; (+) strand; PAM type: YTN; PAM sequence: CTG
tagtcccagcgactcgggag

SEQ ID NO: 298189 - DNA, 20 bp, Artificial Sequence
  Description of Artificial Sequence: Synthetic oligonucleotide
  Target: ATXN1; (+) strand; PAM type: YTN; PAM sequence: CTC
gggaggctgaggcaggagaa

SEQ ID NO: 298190 - DNA, 20 bp, Artificial Sequence
  Description of Artificial Sequence: Synthetic oligonucleotide
  Target: ATXN1; (+) strand; PAM type: YTN; PAM sequence: CTG
aggcaggagaatcacttgaa

SEQ ID NO: 298191 - DNA, 20 bp, Artificial Sequence
  Description of Artificial Sequence: Synthetic oligonucleotide
  Target: ATXN1; (+) strand; PAM type: YTN; PAM sequence: CTT
gaacctgggaggtggaggct

SEQ ID NO: 298192 - DNA, 20 bp, Artificial Sequence
  Description of Artificial Sequence: Synthetic oligonucleotide
  Target: ATXN1; (+) strand; PAM type: YTN; PAM sequence: TTG
aacctgggaggtggaggctg

SEQ ID NO: 298193 - DNA, 20 bp, Artificial Sequence
  Description of Artificial Sequence: Synthetic oligonucleotide
  Target: ATXN1; (+) strand; PAM type: YTN; PAM sequence: CTG
ggaggtggaggctgcagtga

SEQ ID NO: 298194 - DNA, 20 bp, Artificial Sequence
  Description of Artificial Sequence: Synthetic oligonucleotide
  Target: ATXN1; (+) strand; PAM type: YTN; PAM sequence: CTG
cagtgagccaagattgcacc

SEQ ID NO: 298195 - DNA, 20 bp, Artificial Sequence
  Description of Artificial Sequence: Synthetic oligonucleotide
  Target: ATXN1; (+) strand; PAM type: YTN; PAM sequence: TTG
caccactgcactccagcctg

SEQ ID NO: 298196 - DNA, 20 bp, Artificial Sequence
  Description of Artificial Sequence: Synthetic oligonucleotide
  Target: ATXN1; (+) strand; PAM type: YTN; PAM sequence: CTG
cactccagcctgggtgacgg

SEQ ID NO: 298197 - DNA, 20 bp, Artificial Sequence
  Description of Artificial Sequence: Synthetic oligonucleotide
  Target: ATXN1; (+) strand; PAM type: YTN; PAM sequence: CTC
cagcctgggtgacggagtga

SEQ ID NO: 298198 - DNA, 20 bp, Artificial Sequence
  Description of Artificial Sequence: Synthetic oligonucleotide
  Target: ATXN1; (+) strand; PAM type: YTN; PAM sequence: CTG
ggtgacggagtgagactctt

SEQ ID NO: 298199 - DNA, 20 bp, Artificial Sequence
  Description of Artificial Sequence: Synthetic oligonucleotide
  Target: ATXN1; (+) strand; PAM type: YTN; PAM sequence: CTC
tttctcaaaaaataaataaa

SEQ ID NO: 298200 - DNA, 20 bp, Artificial Sequence
  Description of Artificial Sequence: Synthetic oligonucleotide
  Target: ATXN1; (+) strand; PAM type: YTN; PAM sequence: CTT
tctcaaaaaataaataaata

SEQ ID NO: 298201 - DNA, 20 bp, Artificial Sequence
  Description of Artificial Sequence: Synthetic oligonucleotide
  Target: ATXN1; (+) strand; PAM type: YTN; PAM sequence: TTT
ctcaaaaaataaataaataa

SEQ ID NO: 298202 - DNA, 20 bp, Artificial Sequence
  Description of Artificial Sequence: Synthetic oligonucleotide
  Target: ATXN1; (+) strand; PAM type: YTN; PAM sequence: TTC
tcaaaaaataaataaataaa

SEQ ID NO: 298203 - DNA, 20 bp, Artificial Sequence
  Description of Artificial Sequence: Synthetic oligonucleotide
  Target: ATXN1; (+) strand; PAM type: YTN; PAM sequence: CTC
aaaaaataaataaataaata

SEQ ID NO: 298204 - DNA, 20 bp, Artificial Sequence
  Description of Artificial Sequence: Synthetic oligonucleotide
  Target: ATXN1; (+) strand; PAM type: YTN; PAM sequence: TTG
tgatgcaagacactgccaaa

SEQ ID NO: 298205 - DNA, 20 bp, Artificial Sequence
  Description of Artificial Sequence: Synthetic oligonucleotide
  Target: ATXN1; (+) strand; PAM type: YTN; PAM sequence: CTG
ccaaaggagaagcggacagg

SEQ ID NO: 298206 - DNA, 20 bp, Artificial Sequence
  Description of Artificial Sequence: Synthetic oligonucleotide
  Target: ATXN1; (+) strand; PAM type: YTN; PAM sequence: TTA
tggggaaggaacatacacat

SEQ ID NO: 298207 - DNA, 20 bp, Artificial Sequence
  Description of Artificial Sequence: Synthetic oligonucleotide
  Target: ATXN1; (+) strand; PAM type: YTN; PAM sequence: CTC
caatatagaaaaatgctgca

SEQ ID NO: 298208 - DNA, 20 bp, Artificial Sequence
  Description of Artificial Sequence: Synthetic oligonucleotide
  Target: ATXN1; (+) strand; PAM type: YTN; PAM sequence: CTG
cattcccaaatgctgcatta

SEQ ID NO: 298209 - DNA, 20 bp, Artificial Sequence
  Description of Artificial Sequence: Synthetic oligonucleotide
  Target: ATXN1; (+) strand; PAM type: YTN; PAM sequence: TTC
ccaaatgctgcattatgaat

SEQ ID NO: 298210 - DNA, 20 bp, Artificial Sequence
  Description of Artificial Sequence: Synthetic oligonucleotide
  Target: ATXN1; (+) strand; PAM type: YTN; PAM sequence: CTG
cattatgaatgaaaacatca

SEQ ID NO: 298211 - DNA, 20 bp, Artificial Sequence
  Description of Artificial Sequence: Synthetic oligonucleotide
  Target: ATXN1; (+) strand; PAM type: YTN; PAM sequence: TTA
tgaatgaaaacatcaaggca

SEQ ID NO: 298212 - DNA, 20 bp, Artificial Sequence
  Description of Artificial Sequence: Synthetic oligonucleotide
  Target: ATXN1; (+) strand; PAM type: YTN; PAM sequence: CTG
tgtctctaatctggctaccc

SEQ ID NO: 298213 - DNA, 20 bp, Artificial Sequence
  Description of Artificial Sequence: Synthetic oligonucleotide
  Target: ATXN1; (+) strand; PAM type: YTN; PAM sequence: CTC
taatctggctacccaaataa

SEQ ID NO: 298214 - DNA, 20 bp, Artificial Sequence
  Description of Artificial Sequence: Synthetic oligonucleotide
  Target: ATXN1; (+) strand; PAM type: YTN; PAM sequence: CTA
atctggctacccaaataagg

SEQ ID NO: 298215 - DNA, 20 bp, Artificial Sequence
  Description of Artificial Sequence: Synthetic oligonucleotide
  Target: ATXN1; (+) strand; PAM type: YTN; PAM sequence: CTG
gctacccaaataaggctact

SEQ ID NO: 298216 - DNA, 20 bp, Artificial Sequence
  Description of Artificial Sequence: Synthetic oligonucleotide
  Target: ATXN1; (+) strand; PAM type: YTN; PAM sequence: CTA
cccaaataaggctactaatg

SEQ ID NO: 298217 - DNA, 20 bp, Artificial Sequence
  Description of Artificial Sequence: Synthetic oligonucleotide
  Target: ATXN1; (+) strand; PAM type: YTN; PAM sequence: CTA
ctaatgctcatcaacagggt

SEQ ID NO: 298218 - DNA, 20 bp, Artificial Sequence
  Description of Artificial Sequence: Synthetic oligonucleotide
  Target: ATXN1; (+) strand; PAM type: YTN; PAM sequence: CTA
atgctcatcaacagggtagt

SEQ ID NO: 298219 - DNA, 20 bp, Artificial Sequence
  Description of Artificial Sequence: Synthetic oligonucleotide
  Target: ATXN1; (+) strand; PAM type: YTN; PAM sequence: CTC
atcaacagggtagtattaca

SEQ ID NO: 298220 - DNA, 20 bp, Artificial Sequence
  Description of Artificial Sequence: Synthetic oligonucleotide
  Target: ATXN1; (+) strand; PAM type: YTN; PAM sequence: TTA
cattggtaagtgtgagtgag

SEQ ID NO: 298221 - DNA, 20 bp, Artificial Sequence
  Description of Artificial Sequence: Synthetic oligonucleotide
  Target: ATXN1; (+) strand; PAM type: YTN; PAM sequence: TTG
gtaagtgtgagtgagtttgc

SEQ ID NO: 298222 - DNA, 20 bp, Artificial Sequence
  Description of Artificial Sequence: Synthetic oligonucleotide
  Target: ATXN1; (+) strand; PAM type: YTN; PAM sequence: TTT
gcaattcgatgaaaaaaata

SEQ ID NO: 298223 - DNA, 20 bp, Artificial Sequence
  Description of Artificial Sequence: Synthetic oligonucleotide
  Target: ATXN1; (+) strand; PAM type: YTN; PAM sequence: TTG
caattcgatgaaaaaaatat

SEQ ID NO: 298224 - DNA, 20 bp, Artificial Sequence
  Description of Artificial Sequence: Synthetic oligonucleotide
  Target: ATXN1; (+) strand; PAM type: YTN; PAM sequence: TTC
gatgaaaaaaatatatatac

SEQ ID NO: 298225 - DNA, 20 bp, Artificial Sequence
  Description of Artificial Sequence: Synthetic oligonucleotide
  Target: ATXN1; (+) strand; PAM type: YTN; PAM sequence: CTG
aagatttctaaaagataatt

SEQ ID NO: 298226 - DNA, 20 bp, Artificial Sequence
  Description of Artificial Sequence: Synthetic oligonucleotide
  Target: ATXN1; (+) strand; PAM type: YTN; PAM sequence: TTT
ctaaaagataattcactaac

SEQ ID NO: 298227 - DNA, 20 bp, Artificial Sequence
  Description of Artificial Sequence: Synthetic oligonucleotide
  Target: ATXN1; (+) strand; PAM type: YTN; PAM sequence: TTC
taaaagataattcactaact

SEQ ID NO: 298228 - DNA, 20 bp, Artificial Sequence
  Description of Artificial Sequence: Synthetic oligonucleotide
  Target: ATXN1; (+) strand; PAM type: YTN; PAM sequence: CTA
aaagataattcactaactta

SEQ ID NO: 298229 - DNA, 20 bp, Artificial Sequence
  Description of Artificial Sequence: Synthetic oligonucleotide
  Target: ATXN1; (+) strand; PAM type: YTN; PAM sequence: TTC
actaacttacattcaccctt

SEQ ID NO: 298230 - DNA, 20 bp, Artificial Sequence
  Description of Artificial Sequence: Synthetic oligonucleotide
  Target: ATXN1; (+) strand; PAM type: YTN; PAM sequence: CTA
acttacattcacccttttac

SEQ ID NO: 298231 - DNA, 20 bp, Artificial Sequence
  Description of Artificial Sequence: Synthetic oligonucleotide
  Target: ATXN1; (+) strand; PAM type: YTN; PAM sequence: CTT
acattcacccttttacatgg

SEQ ID NO: 298232 - DNA, 20 bp, Artificial Sequence
  Description of Artificial Sequence: Synthetic oligonucleotide
  Target: ATXN1; (+) strand; PAM type: YTN; PAM sequence: TTA
cattcacccttttacatggc

SEQ ID NO: 298233 - DNA, 20 bp, Artificial Sequence
  Description of Artificial Sequence: Synthetic oligonucleotide
  Target: ATXN1; (+) strand; PAM type: YTN; PAM sequence: TTC
acccttttacatggctagtc

SEQ ID NO: 298234 - DNA, 20 bp, Artificial Sequence
  Description of Artificial Sequence: Synthetic oligonucleotide
  Target: ATXN1; (+) strand; PAM type: YTN; PAM sequence: CTT
ttacatggctagtcaagaag

SEQ ID NO: 298235 - DNA, 20 bp, Artificial Sequence
  Description of Artificial Sequence: Synthetic oligonucleotide
  Target: ATXN1; (+) strand; PAM type: YTN; PAM sequence: TTT
tacatggctagtcaagaaga

SEQ ID NO: 298236 - DNA, 20 bp, Artificial Sequence
  Description of Artificial Sequence: Synthetic oligonucleotide
  Target: ATXN1; (+) strand; PAM type: YTN; PAM sequence: TTT
acatggctagtcaagaagag

SEQ ID NO: 298237 - DNA, 20 bp, Artificial Sequence
  Description of Artificial Sequence: Synthetic oligonucleotide
  Target: ATXN1; (+) strand; PAM type: YTN; PAM sequence: TTA
catggctagtcaagaagagc

SEQ ID NO: 298238 - DNA, 20 bp, Artificial Sequence
  Description of Artificial Sequence: Synthetic oligonucleotide
  Target: ATXN1; (+) strand; PAM type: YTN; PAM sequence: CTA
gtcaagaagagcaaaagaat

SEQ ID NO: 298239 - DNA, 20 bp, Artificial Sequence
  Description of Artificial Sequence: Synthetic oligonucleotide
  Target: ATXN1; (+) strand; PAM type: YTN; PAM sequence: CTC
ttacatggactgagactcag

SEQ ID NO: 298240 - DNA, 20 bp, Artificial Sequence
  Description of Artificial Sequence: Synthetic oligonucleotide
  Target: ATXN1; (+) strand; PAM type: YTN; PAM sequence: CTT
acatggactgagactcaggt

SEQ ID NO: 298241 - DNA, 20 bp, Artificial Sequence
  Description of Artificial Sequence: Synthetic oligonucleotide
  Target: ATXN1; (+) strand; PAM type: YTN; PAM sequence: TTA
catggactgagactcaggtt

SEQ ID NO: 298242 - DNA, 20 bp, Artificial Sequence
  Description of Artificial Sequence: Synthetic oligonucleotide
  Target: ATXN1; (+) strand; PAM type: YTN; PAM sequence: CTG
agactcaggttttaagaccc

SEQ ID NO: 298243 - DNA, 20 bp, Artificial Sequence
  Description of Artificial Sequence: Synthetic oligonucleotide
  Target: ATXN1; (+) strand; PAM type: YTN; PAM sequence: CTC
aggttttaagaccctgccag

SEQ ID NO: 298244 - DNA, 20 bp, Artificial Sequence
  Description of Artificial Sequence: Synthetic oligonucleotide
  Target: ATXN1; (+) strand; PAM type: YTN; PAM sequence: TTT
taagaccctgccagatttaa

SEQ ID NO: 298245 - DNA, 20 bp, Artificial Sequence
  Description of Artificial Sequence: Synthetic oligonucleotide
  Target: ATXN1; (+) strand; PAM type: YTN; PAM sequence: TTT
aagaccctgccagatttaat

SEQ ID NO: 298246 - DNA, 20 bp, Artificial Sequence
  Description of Artificial Sequence: Synthetic oligonucleotide
  Target: ATXN1; (+) strand; PAM type: YTN; PAM sequence: TTA
agaccctgccagatttaata

SEQ ID NO: 298247 - DNA, 20 bp, Artificial Sequence
  Description of Artificial Sequence: Synthetic oligonucleotide
  Target: ATXN1; (+) strand; PAM type: YTN; PAM sequence: CTG
ccagatttaataacctctaa

SEQ ID NO: 298248 - DNA, 20 bp, Artificial Sequence
  Description of Artificial Sequence: Synthetic oligonucleotide
  Target: ATXN1; (+) strand; PAM type: YTN; PAM sequence: TTT
aataacctctaactttttac

SEQ ID NO: 298249 - DNA, 20 bp, Artificial Sequence
  Description of Artificial Sequence: Synthetic oligonucleotide
  Target: ATXN1; (+) strand; PAM type: YTN; PAM sequence: TTA
ataacctctaactttttacc

SEQ ID NO: 298250 - DNA, 20 bp, Artificial Sequence
  Description of Artificial Sequence: Synthetic oligonucleotide
  Target: ATXN1; (+) strand; PAM type: YTN; PAM sequence: CTC
taactttttaccttgaaagt

SEQ ID NO: 298251 - DNA, 20 bp, Artificial Sequence
  Description of Artificial Sequence: Synthetic oligonucleotide
  Target: ATXN1; (+) strand; PAM type: YTN; PAM sequence: CTA
actttttaccttgaaagtta

SEQ ID NO: 298252 - DNA, 20 bp, Artificial Sequence
  Description of Artificial Sequence: Synthetic oligonucleotide
  Target: ATXN1; (+) strand; PAM type: YTN; PAM sequence: CTT
tttaccttgaaagttactga

SEQ ID NO: 298253 - DNA, 20 bp, Artificial Sequence
  Description of Artificial Sequence: Synthetic oligonucleotide
  Target: ATXN1; (+) strand; PAM type: YTN; PAM sequence: TTT
ttaccttgaaagttactgaa

SEQ ID NO: 298254 - DNA, 20 bp, Artificial Sequence
  Description of Artificial Sequence: Synthetic oligonucleotide
  Target: ATXN1; (+) strand; PAM type: YTN; PAM sequence: TTT
taccttgaaagttactgaag

SEQ ID NO: 298255 - DNA, 20 bp, Artificial Sequence
  Description of Artificial Sequence: Synthetic oligonucleotide
  Target: ATXN1; (+) strand; PAM type: YTN; PAM sequence: TTT
accttgaaagttactgaagt

SEQ ID NO: 298256 - DNA, 20 bp, Artificial Sequence
  Description of Artificial Sequence: Synthetic oligonucleotide
  Target: ATXN1; (+) strand; PAM type: YTN; PAM sequence: TTA
ccttgaaagttactgaagta

SEQ ID NO: 298257 - DNA, 20 bp, Artificial Sequence
  Description of Artificial Sequence: Synthetic oligonucleotide
  Target: ATXN1; (+) strand; PAM type: YTN; PAM sequence: CTT
gaaagttactgaagtatata

SEQ ID NO: 298258 - DNA, 20 bp, Artificial Sequence
  Description of Artificial Sequence: Synthetic oligonucleotide
  Target: ATXN1; (+) strand; PAM type: YTN; PAM sequence: TTG
aaagttactgaagtatataa

SEQ ID NO: 298259 - DNA, 20 bp, Artificial Sequence
  Description of Artificial Sequence: Synthetic oligonucleotide
  Target: ATXN1; (+) strand; PAM type: YTN; PAM sequence: TTA
ctgaagtatataacacagtt

SEQ ID NO: 298260 - DNA, 20 bp, Artificial Sequence
  Description of Artificial Sequence: Synthetic oligonucleotide
  Target: ATXN1; (+) strand; PAM type: YTN; PAM sequence: CTG
aagtatataacacagttgta

SEQ ID NO: 298261 - DNA, 20 bp, Artificial Sequence
  Description of Artificial Sequence: Synthetic oligonucleotide
  Target: ATXN1; (+) strand; PAM type: YTN; PAM sequence: TTG
tataaaatcaatgtacaaag

SEQ ID NO: 298262 - DNA, 20 bp, Artificial Sequence
  Description of Artificial Sequence: Synthetic oligonucleotide
  Target: ATXN1; (+) strand; PAM type: YTN; PAM sequence: TTA
tttcaaaacccacaattaac

SEQ ID NO: 298263 - DNA, 20 bp, Artificial Sequence
  Description of Artificial Sequence: Synthetic oligonucleotide
  Target: ATXN1; (+) strand; PAM type: YTN; PAM sequence: TTT
caaaacccacaattaacagc

SEQ ID NO: 298264 - DNA, 20 bp, Artificial Sequence
  Description of Artificial Sequence: Synthetic oligonucleotide
  Target: ATXN1; (+) strand; PAM type: YTN; PAM sequence: TTC
aaaacccacaattaacagcc

SEQ ID NO: 298265 - DNA, 20 bp, Artificial Sequence
  Description of Artificial Sequence: Synthetic oligonucleotide
  Target: ATXN1; (+) strand; PAM type: YTN; PAM sequence: TTA
acagcctatgaaaaccaact

SEQ ID NO: 298266 - DNA, 20 bp, Artificial Sequence
  Description of Artificial Sequence: Synthetic oligonucleotide
  Target: ATXN1; (+) strand; PAM type: YTN; PAM sequence: CTA
tgaaaaccaactctttctgg

SEQ ID NO: 298267 - DNA, 20 bp, Artificial Sequence
  Description of Artificial Sequence: Synthetic oligonucleotide
  Target: ATXN1; (+) strand; PAM type: YTN; PAM sequence: CTC
tttctggtattagcactagt

SEQ ID NO: 298268 - DNA, 20 bp, Artificial Sequence
  Description of Artificial Sequence: Synthetic oligonucleotide
  Target: ATXN1; (+) strand; PAM type: YTN; PAM sequence: CTT
tctggtattagcactagttt

SEQ ID NO: 298269 - DNA, 20 bp, Artificial Sequence
  Description of Artificial Sequence: Synthetic oligonucleotide
  Target: ATXN1; (+) strand; PAM type: YTN; PAM sequence: TTT
ctggtattagcactagtttc

SEQ ID NO: 298270 - DNA, 20 bp, Artificial Sequence
  Description of Artificial Sequence: Synthetic oligonucleotide
  Target: ATXN1; (+) strand; PAM type: YTN; PAM sequence: TTC
tggtattagcactagtttca

SEQ ID NO: 298271 - DNA, 20 bp, Artificial Sequence
  Description of Artificial Sequence: Synthetic oligonucleotide
  Target: ATXN1; (+) strand; PAM type: YTN; PAM sequence: CTG
gtattagcactagtttcata

SEQ ID NO: 298272 - DNA, 20 bp, Artificial Sequence
  Description of Artificial Sequence: Synthetic oligonucleotide
  Target: ATXN1; (+) strand; PAM type: YTN; PAM sequence: TTA
gcactagtttcatacatcct

SEQ ID NO: 298273 - DNA, 20 bp, Artificial Sequence
  Description of Artificial Sequence: Synthetic oligonucleotide
  Target: ATXN1; (+) strand; PAM type: YTN; PAM sequence: CTA
gtttcatacatccttttaaa

SEQ ID NO: 298274 - DNA, 20 bp, Artificial Sequence
  Description of Artificial Sequence: Synthetic oligonucleotide
  Target: ATXN1; (+) strand; PAM type: YTN; PAM sequence: TTT
catacatccttttaaatgtt

SEQ ID NO: 298275 - DNA, 20 bp, Artificial Sequence
  Description of Artificial Sequence: Synthetic oligonucleotide
  Target: ATXN1; (+) strand; PAM type: YTN; PAM sequence: TTC
atacatccttttaaatgtta

SEQ ID NO: 298276 - DNA, 20 bp, Artificial Sequence
  Description of Artificial Sequence: Synthetic oligonucleotide
  Target: ATXN1; (+) strand; PAM type: YTN; PAM sequence: CTT
ttaaatgttagggacattga

SEQ ID NO: 298277 - DNA, 20 bp, Artificial Sequence
  Description of Artificial Sequence: Synthetic oligonucleotide
  Target: ATXN1; (+) strand; PAM type: YTN; PAM sequence: TTT
taaatgttagggacattgaa

SEQ ID NO: 298278 - DNA, 20 bp, Artificial Sequence
  Description of Artificial Sequence: Synthetic oligonucleotide
  Target: ATXN1; (+) strand; PAM type: YTN; PAM sequence: TTT
aaatgttagggacattgaaa

SEQ ID NO: 298279 - DNA, 20 bp, Artificial Sequence
  Description of Artificial Sequence: Synthetic oligonucleotide
  Target: ATXN1; (+) strand; PAM type: YTN; PAM sequence: TTA
aatgttagggacattgaaac

SEQ ID NO: 298280 - DNA, 20 bp, Artificial Sequence
  Description of Artificial Sequence: Synthetic oligonucleotide
  Target: ATXN1; (+) strand; PAM type: YTN; PAM sequence: TTA
gggacattgaaacatcttac

SEQ ID NO: 298281 - DNA, 20 bp, Artificial Sequence
  Description of Artificial Sequence: Synthetic oligonucleotide
  Target: ATXN1; (+) strand; PAM type: YTN; PAM sequence: TTG
aaacatcttacttcttcatt

SEQ ID NO: 298282 - DNA, 20 bp, Artificial Sequence
  Description of Artificial Sequence: Synthetic oligonucleotide
  Target: ATXN1; (+) strand; PAM type: YTN; PAM sequence: CTT
acttcttcattactgagtgc

SEQ ID NO: 298283 - DNA, 20 bp, Artificial Sequence
  Description of Artificial Sequence: Synthetic oligonucleotide
  Target: ATXN1; (+) strand; PAM type: YTN; PAM sequence: TTA
cttcttcattactgagtgcc

SEQ ID NO: 298284 - DNA, 20 bp, Artificial Sequence
  Description of Artificial Sequence: Synthetic oligonucleotide
  Target: ATXN1; (+) strand; PAM type: YTN; PAM sequence: CTT
cttcattactgagtgcctac

SEQ ID NO: 298285 - DNA, 20 bp, Artificial Sequence
  Description of Artificial Sequence: Synthetic oligonucleotide
  Target: ATXN1; (+) strand; PAM type: YTN; PAM sequence: TTC
ttcattactgagtgcctact

SEQ ID NO: 298286 - DNA, 20 bp, Artificial Sequence
  Description of Artificial Sequence: Synthetic oligonucleotide
  Target: ATXN1; (+) strand; PAM type: YTN; PAM sequence: CTT
cattactgagtgcctacttt

SEQ ID NO: 298287 - DNA, 20 bp, Artificial Sequence
  Description of Artificial Sequence: Synthetic oligonucleotide
  Target: ATXN1; (+) strand; PAM type: YTN; PAM sequence: TTC
attactgagtgcctactttg

SEQ ID NO: 298288 - DNA, 20 bp, Artificial Sequence
  Description of Artificial Sequence: Synthetic oligonucleotide
  Target: ATXN1; (+) strand; PAM type: YTN; PAM sequence: TTA
ctgagtgcctactttgtgct

SEQ ID NO: 298289 - DNA, 20 bp, Artificial Sequence
  Description of Artificial Sequence: Synthetic oligonucleotide
  Target: ATXN1; (+) strand; PAM type: YTN; PAM sequence: CTG
agtgcctactttgtgctagg

SEQ ID NO: 298290 - DNA, 20 bp, Artificial Sequence
  Description of Artificial Sequence: Synthetic oligonucleotide
  Target: ATXN1; (+) strand; PAM type: YTN; PAM sequence: CTA
ctttgtgctaggccctgagg

SEQ ID NO: 298291 - DNA, 20 bp, Artificial Sequence
  Description of Artificial Sequence: Synthetic oligonucleotide
  Target: ATXN1; (+) strand; PAM type: YTN; PAM sequence: CTT
tgtgctaggccctgaggata

SEQ ID NO: 298292 - DNA, 20 bp, Artificial Sequence
  Description of Artificial Sequence: Synthetic oligonucleotide
  Target: ATXN1; (+) strand; PAM type: YTN; PAM sequence: TTT
gtgctaggccctgaggatac

SEQ ID NO: 298293 - DNA, 20 bp, Artificial Sequence
  Description of Artificial Sequence: Synthetic oligonucleotide
  Target: ATXN1; (+) strand; PAM type: YTN; PAM sequence: TTG
tgctaggccctgaggataca

SEQ ID NO: 298294 - DNA, 20 bp, Artificial Sequence
  Description of Artificial Sequence: Synthetic oligonucleotide
  Target: ATXN1; (+) strand; PAM type: YTN; PAM sequence: CTA
ggccctgaggatacacatga

SEQ ID NO: 298295 - DNA, 20 bp, Artificial Sequence
  Description of Artificial Sequence: Synthetic oligonucleotide
  Target: ATXN1; (+) strand; PAM type: YTN; PAM sequence: CTG
aggatacacatgagtaaaat

SEQ ID NO: 298296 - DNA, 20 bp, Artificial Sequence
  Description of Artificial Sequence: Synthetic oligonucleotide
  Target: ATXN1; (+) strand; PAM type: YTN; PAM sequence: CTT
gcactctccatctagttgtg

SEQ ID NO: 298297 - DNA, 20 bp, Artificial Sequence
  Description of Artificial Sequence: Synthetic oligonucleotide
  Target: ATXN1; (+) strand; PAM type: YTN; PAM sequence: TTG
cactctccatctagttgtgg

SEQ ID NO: 298298 - DNA, 20 bp, Artificial Sequence
  Description of Artificial Sequence: Synthetic oligonucleotide
  Target: ATXN1; (+) strand; PAM type: YTN; PAM sequence: CTC
tccatctagttgtggggaaa

SEQ ID NO: 298299 - DNA, 20 bp, Artificial Sequence
  Description of Artificial Sequence: Synthetic oligonucleotide
  Target: ATXN1; (+) strand; PAM type: YTN; PAM sequence: CTC
catctagttgtggggaaaat

SEQ ID NO: 298300 - DNA, 20 bp, Artificial Sequence
  Description of Artificial Sequence: Synthetic oligonucleotide
  Target: ATXN1; (+) strand; PAM type: YTN; PAM sequence: CTA
gttgtggggaaaataaacaa

SEQ ID NO: 298301 - DNA, 20 bp, Artificial Sequence
  Description of Artificial Sequence: Synthetic oligonucleotide
  Target: ATXN1; (+) strand; PAM type: YTN; PAM sequence: TTG
tggggaaaataaacaaacaa

SEQ ID NO: 298302 - DNA, 20 bp, Artificial Sequence
  Description of Artificial Sequence: Synthetic oligonucleotide
  Target: ATXN1; (+) strand; PAM type: YTN; PAM sequence: TTA
tgaaagaggaaagcagtctg

SEQ ID NO: 298303 - DNA, 20 bp, Artificial Sequence
  Description of Artificial Sequence: Synthetic oligonucleotide
  Target: ATXN1; (+) strand; PAM type: YTN; PAM sequence: CTG
agtggtggaatggattcttc

SEQ ID NO: 298304 - DNA, 20 bp, Artificial Sequence
  Description of Artificial Sequence: Synthetic oligonucleotide
  Target: ATXN1; (+) strand; PAM type: YTN; PAM sequence: TTC
ttcttcctataaaaagaata

SEQ ID NO: 298305 - DNA, 20 bp, Artificial Sequence
  Description of Artificial Sequence: Synthetic oligonucleotide
  Target: ATXN1; (+) strand; PAM type: YTN; PAM sequence: CTT
cttcctataaaaagaatata

SEQ ID NO: 298306 - DNA, 20 bp, Artificial Sequence
  Description of Artificial Sequence: Synthetic oligonucleotide
  Target: ATXN1; (+) strand; PAM type: YTN; PAM sequence: TTC
ttcctataaaaagaatataa

SEQ ID NO: 298307 - DNA, 20 bp, Artificial Sequence
  Description of Artificial Sequence: Synthetic oligonucleotide
  Target: ATXN1; (+) strand; PAM type: YTN; PAM sequence: CTT
cctataaaaagaatataaaa

SEQ ID NO: 298308 - DNA, 20 bp, Artificial Sequence
  Description of Artificial Sequence: Synthetic oligonucleotide
  Target: ATXN1; (+) strand; PAM type: YTN; PAM sequence: TTC
ctataaaaagaatataaaat

SEQ ID NO: 298309 - DNA, 20 bp, Artificial Sequence
  Description of Artificial Sequence: Synthetic oligonucleotide
  Target: ATXN1; (+) strand; PAM type: YTN; PAM sequence: CTA
taaaaagaatataaaattgg

SEQ ID NO: 298310 - DNA, 20 bp, Artificial Sequence
  Description of Artificial Sequence: Synthetic oligonucleotide
  Target: ATXN1; (+) strand; PAM type: YTN; PAM sequence: TTG
ggtttcctatcctgattccc

SEQ ID NO: 298311 - DNA, 20 bp, Artificial Sequence
  Description of Artificial Sequence: Synthetic oligonucleotide
  Target: ATXN1; (+) strand; PAM type: YTN; PAM sequence: TTT
cctatcctgattcccaactc

SEQ ID NO: 298312 - DNA, 20 bp, Artificial Sequence
  Description of Artificial Sequence: Synthetic oligonucleotide
  Target: ATXN1; (+) strand; PAM type: YTN; PAM sequence: TTC
ctatcctgattcccaactca

SEQ ID NO: 298313 - DNA, 20 bp, Artificial Sequence
  Description of Artificial Sequence: Synthetic oligonucleotide
  Target: ATXN1; (+) strand; PAM type: YTN; PAM sequence: CTA
tcctgattcccaactcacaa

SEQ ID NO: 298314 - DNA, 20 bp, Artificial Sequence
  Description of Artificial Sequence: Synthetic oligonucleotide
  Target: ATXN1; (+) strand; PAM type: YTN; PAM sequence: CTG
attcccaactcacaaattaa

SEQ ID NO: 298315 - DNA, 20 bp, Artificial Sequence
  Description of Artificial Sequence: Synthetic oligonucleotide
  Target: ATXN1; (+) strand; PAM type: YTN; PAM sequence: TTC
ccaactcacaaattaaagtt

SEQ ID NO: 298316 - DNA, 20 bp, Artificial Sequence
  Description of Artificial Sequence: Synthetic oligonucleotide
  Target: ATXN1; (+) strand; PAM type: YTN; PAM sequence: CTC
acaaattaaagtttcggtta

SEQ ID NO: 298317 - DNA, 20 bp, Artificial Sequence
  Description of Artificial Sequence: Synthetic oligonucleotide
  Target: ATXN1; (+) strand; PAM type: YTN; PAM sequence: TTA
aagtttcggttatggactgc

SEQ ID NO: 298318 - DNA, 20 bp, Artificial Sequence
  Description of Artificial Sequence: Synthetic oligonucleotide
  Target: ATXN1; (+) strand; PAM type: YTN; PAM sequence: TTT
cggttatggactgcttgttg

SEQ ID NO: 298319 - DNA, 20 bp, Artificial Sequence
  Description of Artificial Sequence: Synthetic oligonucleotide
  Target: ATXN1; (+) strand; PAM type: YTN; PAM sequence: TTC
ggttatggactgcttgttgt

SEQ ID NO: 298320 - DNA, 20 bp, Artificial Sequence
  Description of Artificial Sequence: Synthetic oligonucleotide
  Target: ATXN1; (+) strand; PAM type: YTN; PAM sequence: TTA
tggactgcttgttgtgataa

SEQ ID NO: 298321 - DNA, 20 bp, Artificial Sequence
  Description of Artificial Sequence: Synthetic oligonucleotide
  Target: ATXN1; (+) strand; PAM type: YTN; PAM sequence: CTG
cttgttgtgataaaataatt

SEQ ID NO: 298322 - DNA, 20 bp, Artificial Sequence
  Description of Artificial Sequence: Synthetic oligonucleotide
  Target: ATXN1; (+) strand; PAM type: YTN; PAM sequence: CTT
gttgtgataaaataatttta

SEQ ID NO: 298323 - DNA, 20 bp, Artificial Sequence
  Description of Artificial Sequence: Synthetic oligonucleotide
  Target: ATXN1; (+) strand; PAM type: YTN; PAM sequence: TTG
ttgtgataaaataattttag

SEQ ID NO: 298324 - DNA, 20 bp, Artificial Sequence
  Description of Artificial Sequence: Synthetic oligonucleotide
  Target: ATXN1; (+) strand; PAM type: YTN; PAM sequence: TTG
tgataaaataattttagtat

SEQ ID NO: 298325 - DNA, 20 bp, Artificial Sequence
  Description of Artificial Sequence: Synthetic oligonucleotide
  Target: ATXN1; (+) strand; PAM type: YTN; PAM sequence: TTT
tagtatgattccttctggtt

SEQ ID NO: 298326 - DNA, 20 bp, Artificial Sequence
  Description of Artificial Sequence: Synthetic oligonucleotide
  Target: ATXN1; (+) strand; PAM type: YTN; PAM sequence: TTT
agtatgattccttctggttg

SEQ ID NO: 298327 - DNA, 20 bp, Artificial Sequence
  Description of Artificial Sequence: Synthetic oligonucleotide
  Target: ATXN1; (+) strand; PAM type: YTN; PAM sequence: TTA
gtatgattccttctggttgg

SEQ ID NO: 298328 - DNA, 20 bp, Artificial Sequence
  Description of Artificial Sequence: Synthetic oligonucleotide
  Target: ATXN1; (+) strand; PAM type: YTN; PAM sequence: TTC
cttctggttggaaacatctt

SEQ ID NO: 298329 - DNA, 20 bp, Artificial Sequence
  Description of Artificial Sequence: Synthetic oligonucleotide
  Target: ATXN1; (+) strand; PAM type: YTN; PAM sequence: CTT
ctggttggaaacatcttcct

SEQ ID NO: 298330 - DNA, 20 bp, Artificial Sequence
  Description of Artificial Sequence: Synthetic oligonucleotide
  Target: ATXN1; (+) strand; PAM type: YTN; PAM sequence: TTC
tggttggaaacatcttccta

SEQ ID NO: 298331 - DNA, 20 bp, Artificial Sequence
  Description of Artificial Sequence: Synthetic oligonucleotide
  Target: ATXN1; (+) strand; PAM type: YTN; PAM sequence: CTG
gttggaaacatcttcctacc

SEQ ID NO: 298332 - DNA, 20 bp, Artificial Sequence
  Description of Artificial Sequence: Synthetic oligonucleotide
  Target: ATXN1; (+) strand; PAM type: YTN; PAM sequence: TTG
gaaacatcttcctaccagat

SEQ ID NO: 298333 - DNA, 20 bp, Artificial Sequence
  Description of Artificial Sequence: Synthetic oligonucleotide
  Target: ATXN1; (+) strand; PAM type: YTN; PAM sequence: CTT
cctaccagatttaactacaa

SEQ ID NO: 298334 - DNA, 20 bp, Artificial Sequence
  Description of Artificial Sequence: Synthetic oligonucleotide
  Target: ATXN1; (+) strand; PAM type: YTN; PAM sequence: TTC
ctaccagatttaactacaaa

SEQ ID NO: 298335 - DNA, 20 bp, Artificial Sequence
  Description of Artificial Sequence: Synthetic oligonucleotide
  Target: ATXN1; (+) strand; PAM type: YTN; PAM sequence: CTA
ccagatttaactacaaaact

SEQ ID NO: 298336 - DNA, 20 bp, Artificial Sequence
  Description of Artificial Sequence: Synthetic oligonucleotide
  Target: ATXN1; (+) strand; PAM type: YTN; PAM sequence: TTT
aactacaaaactgacctcta

SEQ ID NO: 298337 - DNA, 20 bp, Artificial Sequence
  Description of Artificial Sequence: Synthetic oligonucleotide
  Target: ATXN1; (+) strand; PAM type: YTN; PAM sequence: TTA
actacaaaactgacctctac

SEQ ID NO: 298338 - DNA, 20 bp, Artificial Sequence
  Description of Artificial Sequence: Synthetic oligonucleotide
  Target: ATXN1; (+) strand; PAM type: YTN; PAM sequence: CTA
caaaactgacctctactctg

SEQ ID NO: 298339 - DNA, 20 bp, Artificial Sequence
  Description of Artificial Sequence: Synthetic oligonucleotide
  Target: ATXN1; (+) strand; PAM type: YTN; PAM sequence: CTG
acctctactctggaatgttc

SEQ ID NO: 298340 - DNA, 20 bp, Artificial Sequence
  Description of Artificial Sequence: Synthetic oligonucleotide
  Target: ATXN1; (+) strand; PAM type: YTN; PAM sequence: CTC
tactctggaatgttcaactg

SEQ ID NO: 298341 - DNA, 20 bp, Artificial Sequence
  Description of Artificial Sequence: Synthetic oligonucleotide
  Target: ATXN1; (+) strand; PAM type: YTN; PAM sequence: CTA
ctctggaatgttcaactggc

SEQ ID NO: 298342 - DNA, 20 bp, Artificial Sequence
  Description of Artificial Sequence: Synthetic oligonucleotide
  Target: ATXN1; (+) strand; PAM type: YTN; PAM sequence: CTC
tggaatgttcaactggccaa

SEQ ID NO: 298343 - DNA, 20 bp, Artificial Sequence
  Description of Artificial Sequence: Synthetic oligonucleotide
  Target: ATXN1; (+) strand; PAM type: YTN; PAM sequence: CTG
gaatgttcaactggccaaga

SEQ ID NO: 298344 - DNA, 20 bp, Artificial Sequence
  Description of Artificial Sequence: Synthetic oligonucleotide
  Target: ATXN1; (+) strand; PAM type: YTN; PAM sequence: TTC
aactggccaagaaaagtgtt

SEQ ID NO: 298345 - DNA, 20 bp, Artificial Sequence
  Description of Artificial Sequence: Synthetic oligonucleotide
  Target: ATXN1; (+) strand; PAM type: YTN; PAM sequence: CTG
gccaagaaaagtgttacatc

SEQ ID NO: 298346 - DNA, 20 bp, Artificial Sequence
  Description of Artificial Sequence: Synthetic oligonucleotide
  Target: ATXN1; (+) strand; PAM type: YTN; PAM sequence: TTA
catcaacaccaatcactttt

SEQ ID NO: 298347 - DNA, 20 bp, Artificial Sequence
  Description of Artificial Sequence: Synthetic oligonucleotide
  Target: ATXN1; (+) strand; PAM type: YTN; PAM sequence: CTT
tttttttttctattccatca

SEQ ID NO: 298348 - DNA, 20 bp, Artificial Sequence
  Description of Artificial Sequence: Synthetic oligonucleotide
  Target: ATXN1; (+) strand; PAM type: YTN; PAM sequence: TTT
ttttttttctattccatcac

SEQ ID NO: 298349 - DNA, 20 bp, Artificial Sequence
  Description of Artificial Sequence: Synthetic oligonucleotide
  Target: ATXN1; (+) strand; PAM type: YTN; PAM sequence: TTT
tttttttctattccatcaca

SEQ ID NO: 298350 - DNA, 20 bp, Artificial Sequence
  Description of Artificial Sequence: Synthetic oligonucleotide
  Target: ATXN1; (+) strand; PAM type: YTN; PAM sequence: TTT
ttttttctattccatcacaa

SEQ ID NO: 298351 - DNA, 20 bp, Artificial Sequence
  Description of Artificial Sequence: Synthetic oligonucleotide
  Target: ATXN1; (+) strand; PAM type: YTN; PAM sequence: TTT
tttttctattccatcacaag

SEQ ID NO: 298352 - DNA, 20 bp, Artificial Sequence
  Description of Artificial Sequence: Synthetic oligonucleotide
  Target: ATXN1; (+) strand; PAM type: YTN; PAM sequence: TTT
ttttctattccatcacaaga

SEQ ID NO: 298353 - DNA, 20 bp, Artificial Sequence
  Description of Artificial Sequence: Synthetic oligonucleotide
  Target: ATXN1; (+) strand; PAM type: YTN; PAM sequence: TTT
tttctattccatcacaagat

SEQ ID NO: 298354 - DNA, 20 bp, Artificial Sequence
  Description of Artificial Sequence: Synthetic oligonucleotide
  Target: ATXN1; (+) strand; PAM type: YTN; PAM sequence: TTT
ttctattccatcacaagatt

SEQ ID NO: 298355 - DNA, 20 bp, Artificial Sequence
  Description of Artificial Sequence: Synthetic oligonucleotide
  Target: ATXN1; (+) strand; PAM type: YTN; PAM sequence: TTT
tctattccatcacaagattg

SEQ ID NO: 298356 - DNA, 20 bp, Artificial Sequence
  Description of Artificial Sequence: Synthetic oligonucleotide
  Target: ATXN1; (+) strand; PAM type: YTN; PAM sequence: TTT
ctattccatcacaagattgg

SEQ ID NO: 298357 - DNA, 20 bp, Artificial Sequence
  Description of Artificial Sequence: Synthetic oligonucleotide
  Target: ATXN1; (+) strand; PAM type: YTN; PAM sequence: TTC
tattccatcacaagattggg

SEQ ID NO: 298358 - DNA, 20 bp, Artificial Sequence
  Description of Artificial Sequence: Synthetic oligonucleotide
  Target: ATXN1; (+) strand; PAM type: YTN; PAM sequence: CTA
ttccatcacaagattgggga

SEQ ID NO: 298359 - DNA, 20 bp, Artificial Sequence
  Description of Artificial Sequence: Synthetic oligonucleotide
  Target: ATXN1; (+) strand; PAM type: YTN; PAM sequence: TTC
catcacaagattggggatat

SEQ ID NO: 298360 - DNA, 20 bp, Artificial Sequence
  Description of Artificial Sequence: Synthetic oligonucleotide
  Target: ATXN1; (+) strand; PAM type: YTN; PAM sequence: TTG
gggatatcattgtgttcctt

SEQ ID NO: 298361 - DNA, 20 bp, Artificial Sequence
  Description of Artificial Sequence: Synthetic oligonucleotide
  Target: ATXN1; (+) strand; PAM type: YTN; PAM sequence: TTG
tgttcctttcctcttatgtc

SEQ ID NO: 298362 - DNA, 20 bp, Artificial Sequence
  Description of Artificial Sequence: Synthetic oligonucleotide
  Target: ATXN1; (+) strand; PAM type: YTN; PAM sequence: TTC
ctttcctcttatgtccactg

SEQ ID NO: 298363 - DNA, 20 bp, Artificial Sequence
  Description of Artificial Sequence: Synthetic oligonucleotide
  Target: ATXN1; (+) strand; PAM type: YTN; PAM sequence: CTT
tcctcttatgtccactgaac

SEQ ID NO: 298364 - DNA, 20 bp, Artificial Sequence
  Description of Artificial Sequence: Synthetic oligonucleotide
  Target: ATXN1; (+) strand; PAM type: YTN; PAM sequence: TTT
cctcttatgtccactgaacc

SEQ ID NO: 298365 - DNA, 20 bp, Artificial Sequence
  Description of Artificial Sequence: Synthetic oligonucleotide
  Target: ATXN1; (+) strand; PAM type: YTN; PAM sequence: TTC
ctcttatgtccactgaaccc

SEQ ID NO: 298366 - DNA, 20 bp, Artificial Sequence
  Description of Artificial Sequence: Synthetic oligonucleotide
  Target: ATXN1; (+) strand; PAM type: YTN; PAM sequence: CTC
ttatgtccactgaaccctct

SEQ ID NO: 298367 - DNA, 20 bp, Artificial Sequence
  Description of Artificial Sequence: Synthetic oligonucleotide
  Target: ATXN1; (+) strand; PAM type: YTN; PAM sequence: CTT
atgtccactgaaccctctgc

SEQ ID NO: 298368 - DNA, 20 bp, Artificial Sequence
  Description of Artificial Sequence: Synthetic oligonucleotide
  Target: ATXN1; (+) strand; PAM type: YTN; PAM sequence: TTA
tgtccactgaaccctctgct

SEQ ID NO: 298369 - DNA, 20 bp, Artificial Sequence
  Description of Artificial Sequence: Synthetic oligonucleotide
  Target: ATXN1; (+) strand; PAM type: YTN; PAM sequence: CTG
aaccctctgctgtattttgt

SEQ ID NO: 298370 - DNA, 20 bp, Artificial Sequence
  Description of Artificial Sequence: Synthetic oligonucleotide
  Target: ATXN1; (+) strand; PAM type: YTN; PAM sequence: CTC
tgctgtattttgtagccttt

SEQ ID NO: 298371 - DNA, 20 bp, Artificial Sequence
  Description of Artificial Sequence: Synthetic oligonucleotide
  Target: ATXN1; (+) strand; PAM type: YTN; PAM sequence: CTG
ctgtattttgtagcctttca

SEQ ID NO: 298372 - DNA, 20 bp, Artificial Sequence
  Description of Artificial Sequence: Synthetic oligonucleotide
  Target: ATXN1; (+) strand; PAM type: YTN; PAM sequence: CTG
tattttgtagcctttcagat

SEQ ID NO: 298373 - DNA, 20 bp, Artificial Sequence
  Description of Artificial Sequence: Synthetic oligonucleotide
  Target: ATXN1; (+) strand; PAM type: YTN; PAM sequence: TTT
tgtagcctttcagatctagg

SEQ ID NO: 298374 - DNA, 20 bp, Artificial Sequence
  Description of Artificial Sequence: Synthetic oligonucleotide
  Target: ATXN1; (+) strand; PAM type: YTN; PAM sequence: TTT
gtagcctttcagatctaggc

SEQ ID NO: 298375 - DNA, 20 bp, Artificial Sequence
  Description of Artificial Sequence: Synthetic oligonucleotide
  Target: ATXN1; (+) strand; PAM type: YTN; PAM sequence: TTG
tagcctttcagatctaggcg

SEQ ID NO: 298376 - DNA, 20 bp, Artificial Sequence
  Description of Artificial Sequence: Synthetic oligonucleotide
  Target: ATXN1; (+) strand; PAM type: YTN; PAM sequence: CTT
tcagatctaggcgtttgtct

SEQ ID NO: 298377 - DNA, 20 bp, Artificial Sequence
  Description of Artificial Sequence: Synthetic oligonucleotide
  Target: ATXN1; (+) strand; PAM type: YTN; PAM sequence: TTT
cagatctaggcgtttgtctc

SEQ ID NO: 298378 - DNA, 20 bp, Artificial Sequence
  Description of Artificial Sequence: Synthetic oligonucleotide
  Target: ATXN1; (+) strand; PAM type: YTN; PAM sequence: TTC
agatctaggcgtttgtctca

SEQ ID NO: 298379 - DNA, 20 bp, Artificial Sequence
  Description of Artificial Sequence: Synthetic oligonucleotide
  Target: ATXN1; (+) strand; PAM type: YTN; PAM sequence: CTA
ggcgtttgtctcattttgct

SEQ ID NO: 298380 - DNA, 20 bp, Artificial Sequence
  Description of Artificial Sequence: Synthetic oligonucleotide
  Target: ATXN1; (+) strand; PAM type: YTN; PAM sequence: TTT
gtctcattttgctgtttcat

SEQ ID NO: 298381 - DNA, 20 bp, Artificial Sequence
  Description of Artificial Sequence: Synthetic oligonucleotide
  Target: ATXN1; (+) strand; PAM type: YTN; PAM sequence: TTG
tctcattttgctgtttcatt

SEQ ID NO: 298382 - DNA, 20 bp, Artificial Sequence
  Description of Artificial Sequence: Synthetic oligonucleotide
  Target: ATXN1; (+) strand; PAM type: YTN; PAM sequence: CTC
attttgctgtttcattttat

SEQ ID NO: 298383 - DNA, 20 bp, Artificial Sequence
  Description of Artificial Sequence: Synthetic oligonucleotide
  Target: ATXN1; (+) strand; PAM type: YTN; PAM sequence: TTT
tgctgtttcattttattttc

SEQ ID NO: 298384 - DNA, 20 bp, Artificial Sequence
  Description of Artificial Sequence: Synthetic oligonucleotide
  Target: ATXN1; (+) strand; PAM type: YTN; PAM sequence: TTT
gctgtttcattttattttca

SEQ ID NO: 298385 - DNA, 20 bp, Artificial Sequence
  Description of Artificial Sequence: Synthetic oligonucleotide
  Target: ATXN1; (+) strand; PAM type: YTN; PAM sequence: TTG
ctgtttcattttattttcac

SEQ ID NO: 298386 - DNA, 20 bp, Artificial Sequence
  Description of Artificial Sequence: Synthetic oligonucleotide
  Target: ATXN1; (+) strand; PAM type: YTN; PAM sequence: CTG
tttcattttattttcactta

SEQ ID NO: 298387 - DNA, 20 bp, Artificial Sequence
  Description of Artificial Sequence: Synthetic oligonucleotide
  Target: ATXN1; (+) strand; PAM type: YTN; PAM sequence: TTT
cattttattttcacttaact

SEQ ID NO: 298388 - DNA, 20 bp, Artificial Sequence
  Description of Artificial Sequence: Synthetic oligonucleotide
  Target: ATXN1; (+) strand; PAM type: YTN; PAM sequence: TTC
attttattttcacttaacta

SEQ ID NO: 298389 - DNA, 20 bp, Artificial Sequence
  Description of Artificial Sequence: Synthetic oligonucleotide
  Target: ATXN1; (+) strand; PAM type: YTN; PAM sequence: TTT
tattttcacttaactagtta

SEQ ID NO: 298390 - DNA, 20 bp, Artificial Sequence
  Description of Artificial Sequence: Synthetic oligonucleotide
  Target: ATXN1; (+) strand; PAM type: YTN; PAM sequence: TTT
attttcacttaactagttaa

SEQ ID NO: 298391 - DNA, 20 bp, Artificial Sequence
  Description of Artificial Sequence: Synthetic oligonucleotide
  Target: ATXN1; (+) strand; PAM type: YTN; PAM sequence: TTA
ttttcacttaactagttaac

SEQ ID NO: 298392 - DNA, 20 bp, Artificial Sequence
  Description of Artificial Sequence: Synthetic oligonucleotide
  Target: ATXN1; (+) strand; PAM type: YTN; PAM sequence: TTT
tcacttaactagttaacact

SEQ ID NO: 298393 - DNA, 20 bp, Artificial Sequence
  Description of Artificial Sequence: Synthetic oligonucleotide
  Target: ATXN1; (+) strand; PAM type: YTN; PAM sequence: TTT
cacttaactagttaacactt

SEQ ID NO: 298394 - DNA, 20 bp, Artificial Sequence
  Description of Artificial Sequence: Synthetic oligonucleotide
  Target: ATXN1; (+) strand; PAM type: YTN; PAM sequence: TTC
acttaactagttaacacttt

SEQ ID NO: 298395 - DNA, 20 bp, Artificial Sequence
  Description of Artificial Sequence: Synthetic oligonucleotide
  Target: ATXN1; (+) strand; PAM type: YTN; PAM sequence: CTT
aactagttaacacttttttt

SEQ ID NO: 298396 - DNA, 20 bp, Artificial Sequence
  Description of Artificial Sequence: Synthetic oligonucleotide
  Target: ATXN1; (+) strand; PAM type: YTN; PAM sequence: TTA
actagttaacacttttttta

SEQ ID NO: 298397 - DNA, 20 bp, Artificial Sequence
  Description of Artificial Sequence: Synthetic oligonucleotide
  Target: ATXN1; (+) strand; PAM type: YTN; PAM sequence: CTA
gttaacactttttttaaaac

SEQ ID NO: 298398 - DNA, 20 bp, Artificial Sequence
  Description of Artificial Sequence: Synthetic oligonucleotide
  Target: ATXN1; (+) strand; PAM type: YTN; PAM sequence: TTA
acactttttttaaaacaatg

SEQ ID NO: 298399 - DNA, 20 bp, Artificial Sequence
  Description of Artificial Sequence: Synthetic oligonucleotide
  Target: ATXN1; (+) strand; PAM type: YTN; PAM sequence: CTT
tttttaaaacaatgaatgaa

SEQ ID NO: 298400 - DNA, 20 bp, Artificial Sequence
  Description of Artificial Sequence: Synthetic oligonucleotide
  Target: ATXN1; (+) strand; PAM type: YTN; PAM sequence: TTT
ttttaaaacaatgaatgaat

SEQ ID NO: 298401 - DNA, 20 bp, Artificial Sequence
  Description of Artificial Sequence: Synthetic oligonucleotide
  Target: ATXN1; (+) strand; PAM type: YTN; PAM sequence: TTT
tttaaaacaatgaatgaatc

SEQ ID NO: 298402 - DNA, 20 bp, Artificial Sequence
  Description of Artificial Sequence: Synthetic oligonucleotide
  Target: ATXN1; (+) strand; PAM type: YTN; PAM sequence: TTT
ttaaaacaatgaatgaatca

SEQ ID NO: 298403 - DNA, 20 bp, Artificial Sequence
  Description of Artificial Sequence: Synthetic oligonucleotide
  Target: ATXN1; (+) strand; PAM type: YTN; PAM sequence: TTT
taaaacaatgaatgaatcat

SEQ ID NO: 298404 - DNA, 20 bp, Artificial Sequence
  Description of Artificial Sequence: Synthetic oligonucleotide
  Target: ATXN1; (+) strand; PAM type: YTN; PAM sequence: TTT
aaaacaatgaatgaatcatg

SEQ ID NO: 298405 - DNA, 20 bp, Artificial Sequence
  Description of Artificial Sequence: Synthetic oligonucleotide
  Target: ATXN1; (+) strand; PAM type: YTN; PAM sequence: TTA
aaacaatgaatgaatcatgt

SEQ ID NO: 298406 - DNA, 20 bp, Artificial Sequence
  Description of Artificial Sequence: Synthetic oligonucleotide
  Target: ATXN1; (+) strand; PAM type: YTN; PAM sequence: CTG
tagtggccactgcgagcaaa

SEQ ID NO: 298407 - DNA, 20 bp, Artificial Sequence
  Description of Artificial Sequence: Synthetic oligonucleotide
  Target: ATXN1; (+) strand; PAM type: YTN; PAM sequence: CTG
cgagcaaagcaccatgggaa

SEQ ID NO: 298408 - DNA, 20 bp, Artificial Sequence
  Description of Artificial Sequence: Synthetic oligonucleotide
  Target: ATXN1; (+) strand; PAM type: YTN; PAM sequence: TTG
tccttgtccttaaagatttc

SEQ ID NO: 298409 - DNA, 20 bp, Artificial Sequence
  Description of Artificial Sequence: Synthetic oligonucleotide
  Target: ATXN1; (+) strand; PAM type: YTN; PAM sequence: CTT
gtccttaaagatttccaacc

SEQ ID NO: 298410 - DNA, 20 bp, Artificial Sequence
  Description of Artificial Sequence: Synthetic oligonucleotide
  Target: ATXN1; (+) strand; PAM type: YTN; PAM sequence: TTG
tccttaaagatttccaacct

SEQ ID NO: 298411 - DNA, 20 bp, Artificial Sequence
  Description of Artificial Sequence: Synthetic oligonucleotide
  Target: ATXN1; (+) strand; PAM type: YTN; PAM sequence: CTT
aaagatttccaacctgagtc

SEQ ID NO: 298412 - DNA, 20 bp, Artificial Sequence
  Description of Artificial Sequence: Synthetic oligonucleotide
  Target: ATXN1; (+) strand; PAM type: YTN; PAM sequence: TTA
aagatttccaacctgagtca

SEQ ID NO: 298413 - DNA, 20 bp, Artificial Sequence
  Description of Artificial Sequence: Synthetic oligonucleotide
  Target: ATXN1; (+) strand; PAM type: YTN; PAM sequence: TTT
ccaacctgagtcagggagac

SEQ ID NO: 298414 - DNA, 20 bp, Artificial Sequence
  Description of Artificial Sequence: Synthetic oligonucleotide
  Target: ATXN1; (+) strand; PAM type: YTN; PAM sequence: TTC
caacctgagtcagggagaca

SEQ ID NO: 298415 - DNA, 20 bp, Artificial Sequence
  Description of Artificial Sequence: Synthetic oligonucleotide
  Target: ATXN1; (+) strand; PAM type: YTN; PAM sequence: CTG
agtcagggagacaaacatgt

SEQ ID NO: 298416 - DNA, 20 bp, Artificial Sequence
  Description of Artificial Sequence: Synthetic oligonucleotide
  Target: ATXN1; (+) strand; PAM type: YTN; PAM sequence: CTG
agagatgacgagcaaagaac

SEQ ID NO: 298417 - DNA, 20 bp, Artificial Sequence
  Description of Artificial Sequence: Synthetic oligonucleotide
  Target: ATXN1; (+) strand; PAM type: YTN; PAM sequence: CTC
tgctggcagagagctcccag

SEQ ID NO: 298418 - DNA, 20 bp, Artificial Sequence
  Description of Artificial Sequence: Synthetic oligonucleotide
  Target: ATXN1; (+) strand; PAM type: YTN; PAM sequence: CTG
ctggcagagagctcccagct

SEQ ID NO: 298419 - DNA, 20 bp, Artificial Sequence
  Description of Artificial Sequence: Synthetic oligonucleotide
  Target: ATXN1; (+) strand; PAM type: YTN; PAM sequence: CTG
gcagagagctcccagctgca

SEQ ID NO: 298420 - DNA, 20 bp, Artificial Sequence
  Description of Artificial Sequence: Synthetic oligonucleotide
  Target: ATXN1; (+) strand; PAM type: YTN; PAM sequence: CTC
ccagctgcaacacaggcatt

SEQ ID NO: 298421 - DNA, 20 bp, Artificial Sequence
  Description of Artificial Sequence: Synthetic oligonucleotide
  Target: ATXN1; (+) strand; PAM type: YTN; PAM sequence: CTG
caacacaggcattaattacg

SEQ ID NO: 298422 - DNA, 20 bp, Artificial Sequence
  Description of Artificial Sequence: Synthetic oligonucleotide
  Target: ATXN1; (+) strand; PAM type: YTN; PAM sequence: TTA
attacgtgtgctctgggaga

SEQ ID NO: 298423 - DNA, 20 bp, Artificial Sequence
  Description of Artificial Sequence: Synthetic oligonucleotide
  Target: ATXN1; (+) strand; PAM type: YTN; PAM sequence: TTA
cgtgtgctctgggagagggg

SEQ ID NO: 298424 - DNA, 20 bp, Artificial Sequence
  Description of Artificial Sequence: Synthetic oligonucleotide
  Target: ATXN1; (+) strand; PAM type: YTN; PAM sequence: CTC
tgggagaggggagtcttcta

SEQ ID NO: 298425 - DNA, 20 bp, Artificial Sequence
  Description of Artificial Sequence: Synthetic oligonucleotide
  Target: ATXN1; (+) strand; PAM type: YTN; PAM sequence: CTG
ggagaggggagtcttctatt

SEQ ID NO: 298426 - DNA, 20 bp, Artificial Sequence
  Description of Artificial Sequence: Synthetic oligonucleotide
  Target: ATXN1; (+) strand; PAM type: YTN; PAM sequence: CTT
ctattttttgattcccctcc

SEQ ID NO: 298427 - DNA, 20 bp, Artificial Sequence
  Description of Artificial Sequence: Synthetic oligonucleotide
  Target: ATXN1; (+) strand; PAM type: YTN; PAM sequence: TTC
tattttttgattcccctccc

SEQ ID NO: 298428 - DNA, 20 bp, Artificial Sequence
  Description of Artificial Sequence: Synthetic oligonucleotide
  Target: ATXN1; (+) strand; PAM type: YTN; PAM sequence: CTA
ttttttgattcccctcccca

SEQ ID NO: 298429 - DNA, 20 bp, Artificial Sequence
  Description of Artificial Sequence: Synthetic oligonucleotide
  Target: ATXN1; (+) strand; PAM type: YTN; PAM sequence: TTT
tttgattcccctccccagaa

SEQ ID NO: 298430 - DNA, 20 bp, Artificial Sequence
  Description of Artificial Sequence: Synthetic oligonucleotide
  Target: ATXN1; (+) strand; PAM type: YTN; PAM sequence: TTT
ttgattcccctccccagaat

SEQ ID NO: 298431 - DNA, 20 bp, Artificial Sequence
  Description of Artificial Sequence: Synthetic oligonucleotide
  Target: ATXN1; (+) strand; PAM type: YTN; PAM sequence: TTT
tgattcccctccccagaatc

SEQ ID NO: 298432 - DNA, 20 bp, Artificial Sequence
  Description of Artificial Sequence: Synthetic oligonucleotide
  Target: ATXN1; (+) strand; PAM type: YTN; PAM sequence: TTT
gattcccctccccagaatca

SEQ ID NO: 298433 - DNA, 20 bp, Artificial Sequence
  Description of Artificial Sequence: Synthetic oligonucleotide
  Target: ATXN1; (+) strand; PAM type: YTN; PAM sequence: TTG
attcccctccccagaatcag

SEQ ID NO: 298434 - DNA, 20 bp, Artificial Sequence
  Description of Artificial Sequence: Synthetic oligonucleotide
  Target: ATXN1; (+) strand; PAM type: YTN; PAM sequence: TTC
ccctccccagaatcagtgct

SEQ ID NO: 298435 - DNA, 20 bp, Artificial Sequence
  Description of Artificial Sequence: Synthetic oligonucleotide
  Target: ATXN1; (+) strand; PAM type: YTN; PAM sequence: CTC
cccagaatcagtgctatttg

SEQ ID NO: 298436 - DNA, 20 bp, Artificial Sequence
  Description of Artificial Sequence: Synthetic oligonucleotide
  Target: ATXN1; (+) strand; PAM type: YTN; PAM sequence: CTA
tttgaaaatcccacgtaggt

SEQ ID NO: 298437 - DNA, 20 bp, Artificial Sequence
  Description of Artificial Sequence: Synthetic oligonucleotide
  Target: ATXN1; (+) strand; PAM type: YTN; PAM sequence: TTT
gaaaatcccacgtaggtaag

SEQ ID NO: 298438 - DNA, 20 bp, Artificial Sequence
  Description of Artificial Sequence: Synthetic oligonucleotide
  Target: ATXN1; (+) strand; PAM type: YTN; PAM sequence: TTG
aaaatcccacgtaggtaaga

SEQ ID NO: 298439 - DNA, 20 bp, Artificial Sequence
  Description of Artificial Sequence: Synthetic oligonucleotide
  Target: ATXN1; (+) strand; PAM type: YTN; PAM sequence: CTA
gccatgttatttttacaagt

SEQ ID NO: 298440 - DNA, 20 bp, Artificial Sequence
  Description of Artificial Sequence: Synthetic oligonucleotide
  Target: ATXN1; (+) strand; PAM type: YTN; PAM sequence: TTA
tttttacaagtcaaatatgc

SEQ ID NO: 298441 - DNA, 20 bp, Artificial Sequence
  Description of Artificial Sequence: Synthetic oligonucleotide
  Target: ATXN1; (+) strand; PAM type: YTN; PAM sequence: TTT
ttacaagtcaaatatgctac

SEQ ID NO: 298442 - DNA, 20 bp, Artificial Sequence
  Description of Artificial Sequence: Synthetic oligonucleotide
  Target: ATXN1; (+) strand; PAM type: YTN; PAM sequence: TTT
tacaagtcaaatatgctact

SEQ ID NO: 298443 - DNA, 20 bp, Artificial Sequence
  Description of Artificial Sequence: Synthetic oligonucleotide
  Target: ATXN1; (+) strand; PAM type: YTN; PAM sequence: TTT
acaagtcaaatatgctactg

SEQ ID NO: 298444 - DNA, 20 bp, Artificial Sequence
  Description of Artificial Sequence: Synthetic oligonucleotide
  Target: ATXN1; (+) strand; PAM type: YTN; PAM sequence: TTA
caagtcaaatatgctactgc

SEQ ID NO: 298445 - DNA, 20 bp, Artificial Sequence
  Description of Artificial Sequence: Synthetic oligonucleotide
  Target: ATXN1; (+) strand; PAM type: YTN; PAM sequence: CTA
ctgcgtttatctaatactta

SEQ ID NO: 298446 - DNA, 20 bp, Artificial Sequence
  Description of Artificial Sequence: Synthetic oligonucleotide
  Target: ATXN1; (+) strand; PAM type: YTN; PAM sequence: CTG
cgtttatctaatacttagat

SEQ ID NO: 298447 - DNA, 20 bp, Artificial Sequence
  Description of Artificial Sequence: Synthetic oligonucleotide
  Target: ATXN1; (+) strand; PAM type: YTN; PAM sequence: TTT
atctaatacttagataaaaa

SEQ ID NO: 298448 - DNA, 20 bp, Artificial Sequence
  Description of Artificial Sequence: Synthetic oligonucleotide
  Target: ATXN1; (+) strand; PAM type: YTN; PAM sequence: TTA
tctaatacttagataaaaat

SEQ ID NO: 298449 - DNA, 20 bp, Artificial Sequence
  Description of Artificial Sequence: Synthetic oligonucleotide
  Target: ATXN1; (+) strand; PAM type: YTN; PAM sequence: CTA
atacttagataaaaattatt

SEQ ID NO: 298450 - DNA, 20 bp, Artificial Sequence
  Description of Artificial Sequence: Synthetic oligonucleotide
  Target: ATXN1; (+) strand; PAM type: YTN; PAM sequence: CTT
agataaaaattatttttcag

SEQ ID NO: 298451 - DNA, 20 bp, Artificial Sequence
  Description of Artificial Sequence: Synthetic oligonucleotide
  Target: ATXN1; (+) strand; PAM type: YTN; PAM sequence: TTA
gataaaaattatttttcagg

SEQ ID NO: 298452 - DNA, 20 bp, Artificial Sequence
  Description of Artificial Sequence: Synthetic oligonucleotide
  Target: ATXN1; (+) strand; PAM type: YTN; PAM sequence: TTA
tttttcaggccattgcttat

SEQ ID NO: 298453 - DNA, 20 bp, Artificial Sequence
  Description of Artificial Sequence: Synthetic oligonucleotide
  Target: ATXN1; (+) strand; PAM type: YTN; PAM sequence: TTT
ttcaggccattgcttattga

SEQ ID NO: 298454 - DNA, 20 bp, Artificial Sequence
  Description of Artificial Sequence: Synthetic oligonucleotide
  Target: ATXN1; (+) strand; PAM type: YTN; PAM sequence: TTT
tcaggccattgcttattgaa

SEQ ID NO: 298455 - DNA, 20 bp, Artificial Sequence
  Description of Artificial Sequence: Synthetic oligonucleotide
  Target: ATXN1; (+) strand; PAM type: YTN; PAM sequence: TTT
caggccattgcttattgaat

SEQ ID NO: 298456 - DNA, 20 bp, Artificial Sequence
  Description of Artificial Sequence: Synthetic oligonucleotide
  Target: ATXN1; (+) strand; PAM type: YTN; PAM sequence: TTC
aggccattgcttattgaatt

SEQ ID NO: 298457 - DNA, 20 bp, Artificial Sequence
  Description of Artificial Sequence: Synthetic oligonucleotide
  Target: ATXN1; (+) strand; PAM type: YTN; PAM sequence: TTG
cttattgaattttctctctg

SEQ ID NO: 298458 - DNA, 20 bp, Artificial Sequence
  Description of Artificial Sequence: Synthetic oligonucleotide
  Target: ATXN1; (+) strand; PAM type: YTN; PAM sequence: CTT
attgaattttctctctgtgt

SEQ ID NO: 298459 - DNA, 20 bp, Artificial Sequence
  Description of Artificial Sequence: Synthetic oligonucleotide
  Target: ATXN1; (+) strand; PAM type: YTN; PAM sequence: TTA
ttgaattttctctctgtgtc

SEQ ID NO: 298460 - DNA, 20 bp, Artificial Sequence
  Description of Artificial Sequence: Synthetic oligonucleotide
  Target: ATXN1; (+) strand; PAM type: YTN; PAM sequence: TTG
aattttctctctgtgtcctc

SEQ ID NO: 298461 - DNA, 20 bp, Artificial Sequence
  Description of Artificial Sequence: Synthetic oligonucleotide
  Target: ATXN1; (+) strand; PAM type: YTN; PAM sequence: TTT
tctctctgtgtcctcatcat

SEQ ID NO: 298462 - DNA, 20 bp, Artificial Sequence
  Description of Artificial Sequence: Synthetic oligonucleotide
  Target: ATXN1; (+) strand; PAM type: YTN; PAM sequence: TTT
ctctctgtgtcctcatcatt

SEQ ID NO: 298463 - DNA, 20 bp, Artificial Sequence
  Description of Artificial Sequence: Synthetic oligonucleotide
  Target: ATXN1; (+) strand; PAM type: YTN; PAM sequence: TTC
tctctgtgtcctcatcatta

SEQ ID NO: 298464 - DNA, 20 bp, Artificial Sequence
  Description of Artificial Sequence: Synthetic oligonucleotide
  Target: ATXN1; (+) strand; PAM type: YTN; PAM sequence: CTC
tctgtgtcctcatcattagg

SEQ ID NO: 298465 - DNA, 20 bp, Artificial Sequence
  Description of Artificial Sequence: Synthetic oligonucleotide
  Target: ATXN1; (+) strand; PAM type: YTN; PAM sequence: CTC
tgtgtcctcatcattaggtc

SEQ ID NO: 298466 - DNA, 20 bp, Artificial Sequence
  Description of Artificial Sequence: Synthetic oligonucleotide
  Target: ATXN1; (+) strand; PAM type: YTN; PAM sequence: CTG
tgtcctcatcattaggtcag

SEQ ID NO: 298467 - DNA, 20 bp, Artificial Sequence
  Description of Artificial Sequence: Synthetic oligonucleotide
  Target: ATXN1; (+) strand; PAM type: YTN; PAM sequence: CTC
atcattaggtcaggagtggt

SEQ ID NO: 298468 - DNA, 20 bp, Artificial Sequence
  Description of Artificial Sequence: Synthetic oligonucleotide
  Target: ATXN1; (+) strand; PAM type: YTN; PAM sequence: TTA
ggtcaggagtggtttccagt

SEQ ID NO: 298469 - DNA, 20 bp, Artificial Sequence
  Description of Artificial Sequence: Synthetic oligonucleotide
  Target: ATXN1; (+) strand; PAM type: YTN; PAM sequence: TTT
ccagtaggtgctccacaaag

SEQ ID NO: 298470 - DNA, 20 bp, Artificial Sequence
  Description of Artificial Sequence: Synthetic oligonucleotide
  Target: ATXN1; (+) strand; PAM type: YTN; PAM sequence: TTC
cagtaggtgctccacaaaga

SEQ ID NO: 298471 - DNA, 20 bp, Artificial Sequence
  Description of Artificial Sequence: Synthetic oligonucleotide
  Target: ATXN1; (+) strand; PAM type: YTN; PAM sequence: CTC
cacaaagagcaaaaagatgg

SEQ ID NO: 298472 - DNA, 20 bp, Artificial Sequence
  Description of Artificial Sequence: Synthetic oligonucleotide
  Target: ATXN1; (+) strand; PAM type: YTN; PAM sequence: CTT
gtatagtagaattttttttc

SEQ ID NO: 298473 - DNA, 20 bp, Artificial Sequence
  Description of Artificial Sequence: Synthetic oligonucleotide
  Target: ATXN1; (+) strand; PAM type: YTN; PAM sequence: TTG
tatagtagaattttttttcc

SEQ ID NO: 298474 - DNA, 20 bp, Artificial Sequence
  Description of Artificial Sequence: Synthetic oligonucleotide
  Target: ATXN1; (+) strand; PAM type: YTN; PAM sequence: TTT
tttttccaagtcctatttat

SEQ ID NO: 298475 - DNA, 20 bp, Artificial Sequence
  Description of Artificial Sequence: Synthetic oligonucleotide
  Target: ATXN1; (+) strand; PAM type: YTN; PAM sequence: TTT
ttttccaagtcctatttatc

SEQ ID NO: 298476 - DNA, 20 bp, Artificial Sequence
  Description of Artificial Sequence: Synthetic oligonucleotide
  Target: ATXN1; (+) strand; PAM type: YTN; PAM sequence: TTT
tttccaagtcctatttatct

SEQ ID NO: 298477 - DNA, 20 bp, Artificial Sequence
  Description of Artificial Sequence: Synthetic oligonucleotide
  Target: ATXN1; (+) strand; PAM type: YTN; PAM sequence: TTT
ttccaagtcctatttatctc

SEQ ID NO: 298478 - DNA, 20 bp, Artificial Sequence
  Description of Artificial Sequence: Synthetic oligonucleotide
  Target: ATXN1; (+) strand; PAM type: YTN; PAM sequence: TTT
tccaagtcctatttatctca

SEQ ID NO: 298479 - DNA, 20 bp, Artificial Sequence
  Description of Artificial Sequence: Synthetic oligonucleotide
  Target: ATXN1; (+) strand; PAM type: YTN; PAM sequence: TTT
ccaagtcctatttatctcat

SEQ ID NO: 298480 - DNA, 20 bp, Artificial Sequence
  Description of Artificial Sequence: Synthetic oligonucleotide
  Target: ATXN1; (+) strand; PAM type: YTN; PAM sequence: TTC
caagtcctatttatctcatc

SEQ ID NO: 298481 - DNA, 20 bp, Artificial Sequence
  Description of Artificial Sequence: Synthetic oligonucleotide
  Target: ATXN1; (+) strand; PAM type: YTN; PAM sequence: CTA
tttatctcatctgttttgcc

SEQ ID NO: 298482 - DNA, 20 bp, Artificial Sequence
  Description of Artificial Sequence: Synthetic oligonucleotide
  Target: ATXN1; (+) strand; PAM type: YTN; PAM sequence: TTT
atctcatctgttttgcctgt

SEQ ID NO: 298483 - DNA, 20 bp, Artificial Sequence
  Description of Artificial Sequence: Synthetic oligonucleotide
  Target: ATXN1; (+) strand; PAM type: YTN; PAM sequence: TTA
tctcatctgttttgcctgta

SEQ ID NO: 298484 - DNA, 20 bp, Artificial Sequence
  Description of Artificial Sequence: Synthetic oligonucleotide
  Target: ATXN1; (+) strand; PAM type: YTN; PAM sequence: CTC
atctgttttgcctgtatctt

SEQ ID NO: 298485 - DNA, 20 bp, Artificial Sequence
  Description of Artificial Sequence: Synthetic oligonucleotide
  Target: ATXN1; (+) strand; PAM type: YTN; PAM sequence: CTG
ttttgcctgtatcttgcttc

SEQ ID NO: 298486 - DNA, 20 bp, Artificial Sequence
  Description of Artificial Sequence: Synthetic oligonucleotide
  Target: ATXN1; (+) strand; PAM type: YTN; PAM sequence: TTT
tgcctgtatcttgcttcatt

SEQ ID NO: 298487 - DNA, 20 bp, Artificial Sequence
  Description of Artificial Sequence: Synthetic oligonucleotide
  Target: ATXN1; (+) strand; PAM type: YTN; PAM sequence: TTT
gcctgtatcttgcttcattc

SEQ ID NO: 298488 - DNA, 20 bp, Artificial Sequence
  Description of Artificial Sequence: Synthetic oligonucleotide
  Target: ATXN1; (+) strand; PAM type: YTN; PAM sequence: TTG
cctgtatcttgcttcattca

SEQ ID NO: 298489 - DNA, 20 bp, Artificial Sequence
  Description of Artificial Sequence: Synthetic oligonucleotide
  Target: ATXN1; (+) strand; PAM type: YTN; PAM sequence: CTG
tatcttgcttcattcacacc

SEQ ID NO: 298490 - DNA, 20 bp, Artificial Sequence
  Description of Artificial Sequence: Synthetic oligonucleotide
  Target: ATXN1; (+) strand; PAM type: YTN; PAM sequence: CTT
gcttcattcacaccagaaaa

SEQ ID NO: 298491 - DNA, 20 bp, Artificial Sequence
  Description of Artificial Sequence: Synthetic oligonucleotide
  Target: ATXN1; (+) strand; PAM type: YTN; PAM sequence: TTG
cttcattcacaccagaaaaa

SEQ ID NO: 298492 - DNA, 20 bp, Artificial Sequence
  Description of Artificial Sequence: Synthetic oligonucleotide
  Target: ATXN1; (+) strand; PAM type: YTN; PAM sequence: CTT
cattcacaccagaaaaagct

SEQ ID NO: 298493 - DNA, 20 bp, Artificial Sequence
  Description of Artificial Sequence: Synthetic oligonucleotide
  Target: ATXN1; (+) strand; PAM type: YTN; PAM sequence: TTC
attcacaccagaaaaagctg

SEQ ID NO: 298494 - DNA, 20 bp, Artificial Sequence
  Description of Artificial Sequence: Synthetic oligonucleotide
  Target: ATXN1; (+) strand; PAM type: YTN; PAM sequence: TTC
acaccagaaaaagctgacac

SEQ ID NO: 298495 - DNA, 20 bp, Artificial Sequence
  Description of Artificial Sequence: Synthetic oligonucleotide
  Target: ATXN1; (+) strand; PAM type: YTN; PAM sequence: CTG
acacatttgtgccgttgtct

SEQ ID NO: 298496 - DNA, 20 bp, Artificial Sequence
  Description of Artificial Sequence: Synthetic oligonucleotide
  Target: ATXN1; (+) strand; PAM type: YTN; PAM sequence: TTT
gtgccgttgtctgctgaagg

SEQ ID NO: 298497 - DNA, 20 bp, Artificial Sequence
  Description of Artificial Sequence: Synthetic oligonucleotide
  Target: ATXN1; (+) strand; PAM type: YTN; PAM sequence: TTG
tgccgttgtctgctgaaggt

SEQ ID NO: 298498 - DNA, 20 bp, Artificial Sequence
  Description of Artificial Sequence: Synthetic oligonucleotide
  Target: ATXN1; (+) strand; PAM type: YTN; PAM sequence: TTG
tctgctgaaggttagtcttc

SEQ ID NO: 298499 - DNA, 20 bp, Artificial Sequence
  Description of Artificial Sequence: Synthetic oligonucleotide
  Target: ATXN1; (+) strand; PAM type: YTN; PAM sequence: CTG
ctgaaggttagtcttcatga

SEQ ID NO: 298500 - DNA, 20 bp, Artificial Sequence
  Description of Artificial Sequence: Synthetic oligonucleotide
  Target: ATXN1; (+) strand; PAM type: YTN; PAM sequence: CTG
aaggttagtcttcatgaaat

SEQ ID NO: 298501 - DNA, 20 bp, Artificial Sequence
  Description of Artificial Sequence: Synthetic oligonucleotide
  Target: ATXN1; (+) strand; PAM type: YTN; PAM sequence: TTA
gtcttcatgaaatttaacat

SEQ ID NO: 298502 - DNA, 20 bp, Artificial Sequence
  Description of Artificial Sequence: Synthetic oligonucleotide
  Target: ATXN1; (+) strand; PAM type: YTN; PAM sequence: CTT
catgaaatttaacatgaaca

SEQ ID NO: 298503 - DNA, 20 bp, Artificial Sequence
  Description of Artificial Sequence: Synthetic oligonucleotide
  Target: ATXN1; (+) strand; PAM type: YTN; PAM sequence: TTC
atgaaatttaacatgaacat

SEQ ID NO: 298504 - DNA, 20 bp, Artificial Sequence
  Description of Artificial Sequence: Synthetic oligonucleotide
  Target: ATXN1; (+) strand; PAM type: YTN; PAM sequence: TTT
aacatgaacatttgtccttt

SEQ ID NO: 298505 - DNA, 20 bp, Artificial Sequence
  Description of Artificial Sequence: Synthetic oligonucleotide
  Target: ATXN1; (+) strand; PAM type: YTN; PAM sequence: TTA
acatgaacatttgtcctttc

SEQ ID NO: 298506 - DNA, 20 bp, Artificial Sequence
  Description of Artificial Sequence: Synthetic oligonucleotide
  Target: ATXN1; (+) strand; PAM type: YTN; PAM sequence: TTT
gtcctttcaagcagctaatt

SEQ ID NO: 298507 - DNA, 20 bp, Artificial Sequence
  Description of Artificial Sequence: Synthetic oligonucleotide
  Target: ATXN1; (+) strand; PAM type: YTN; PAM sequence: TTG
tcctttcaagcagctaattc

SEQ ID NO: 298508 - DNA, 20 bp, Artificial Sequence
  Description of Artificial Sequence: Synthetic oligonucleotide
  Target: ATXN1; (+) strand; PAM type: YTN; PAM sequence: CTT
tcaagcagctaattcctttt

SEQ ID NO: 298509 - DNA, 20 bp, Artificial Sequence
  Description of Artificial Sequence: Synthetic oligonucleotide
  Target: ATXN1; (+) strand; PAM type: YTN; PAM sequence: TTT
caagcagctaattccttttt

SEQ ID NO: 298510 - DNA, 20 bp, Artificial Sequence
  Description of Artificial Sequence: Synthetic oligonucleotide
  Target: ATXN1; (+) strand; PAM type: YTN; PAM sequence: TTC
aagcagctaattccttttta

SEQ ID NO: 298511 - DNA, 20 bp, Artificial Sequence
  Description of Artificial Sequence: Synthetic oligonucleotide
  Target: ATXN1; (+) strand; PAM type: YTN; PAM sequence: CTA
attcctttttaagcagctaa

SEQ ID NO: 298512 - DNA, 20 bp, Artificial Sequence
  Description of Artificial Sequence: Synthetic oligonucleotide
  Target: ATXN1; (+) strand; PAM type: YTN; PAM sequence: TTC
ctttttaagcagctaaatgt

SEQ ID NO: 298513 - DNA, 20 bp, Artificial Sequence
  Description of Artificial Sequence: Synthetic oligonucleotide
  Target: ATXN1; (+) strand; PAM type: YTN; PAM sequence: CTT
tttaagcagctaaatgttca

SEQ ID NO: 298514 - DNA, 20 bp, Artificial Sequence
  Description of Artificial Sequence: Synthetic oligonucleotide
  Target: ATXN1; (+) strand; PAM type: YTN; PAM sequence: TTT
ttaagcagctaaatgttcac

SEQ ID NO: 298515 - DNA, 20 bp, Artificial Sequence
  Description of Artificial Sequence: Synthetic oligonucleotide
  Target: ATXN1; (+) strand; PAM type: YTN; PAM sequence: TTT
taagcagctaaatgttcacc

SEQ ID NO: 298516 - DNA, 20 bp, Artificial Sequence
  Description of Artificial Sequence: Synthetic oligonucleotide
  Target: ATXN1; (+) strand; PAM type: YTN; PAM sequence: TTT
aagcagctaaatgttcacct

SEQ ID NO: 298517 - DNA, 20 bp, Artificial Sequence
  Description of Artificial Sequence: Synthetic oligonucleotide
  Target: ATXN1; (+) strand; PAM type: YTN; PAM sequence: TTA
agcagctaaatgttcaccta

SEQ ID NO: 298518 - DNA, 20 bp, Artificial Sequence
  Description of Artificial Sequence: Synthetic oligonucleotide
  Target: ATXN1; (+) strand; PAM type: YTN; PAM sequence: CTA
aatgttcacctatgtctttc

SEQ ID NO: 298519 - DNA, 20 bp, Artificial Sequence
  Description of Artificial Sequence: Synthetic oligonucleotide
  Target: ATXN1; (+) strand; PAM type: YTN; PAM sequence: TTC
acctatgtctttcacgggat

SEQ ID NO: 298520 - DNA, 20 bp, Artificial Sequence
  Description of Artificial Sequence: Synthetic oligonucleotide
  Target: ATXN1; (+) strand; PAM type: YTN; PAM sequence: CTA
tgtctttcacgggatgacta

SEQ ID NO: 298521 - DNA, 20 bp, Artificial Sequence
  Description of Artificial Sequence: Synthetic oligonucleotide
  Target: ATXN1; (+) strand; PAM type: YTN; PAM sequence: CTT
tcacgggatgactaattgtg

SEQ ID NO: 298522 - DNA, 20 bp, Artificial Sequence
  Description of Artificial Sequence: Synthetic oligonucleotide
  Target: ATXN1; (+) strand; PAM type: YTN; PAM sequence: TTT
cacgggatgactaattgtga

SEQ ID NO: 298523 - DNA, 20 bp, Artificial Sequence
  Description of Artificial Sequence: Synthetic oligonucleotide
  Target: ATXN1; (+) strand; PAM type: YTN; PAM sequence: TTC
acgggatgactaattgtgaa

SEQ ID NO: 298524 - DNA, 20 bp, Artificial Sequence
  Description of Artificial Sequence: Synthetic oligonucleotide
  Target: ATXN1; (+) strand; PAM type: YTN; PAM sequence: CTA
attgtgaatgtaagcaagac

SEQ ID NO: 298525 - DNA, 20 bp, Artificial Sequence
  Description of Artificial Sequence: Synthetic oligonucleotide
  Target: ATXN1; (+) strand; PAM type: YTN; PAM sequence: TTG
tgaatgtaagcaagacaact

SEQ ID NO: 298526 - DNA, 20 bp, Artificial Sequence
  Description of Artificial Sequence: Synthetic oligonucleotide
  Target: ATXN1; (+) strand; PAM type: YTN; PAM sequence: CTG
atgaaattcagatataattg

SEQ ID NO: 298527 - DNA, 20 bp, Artificial Sequence
  Description of Artificial Sequence: Synthetic oligonucleotide
  Target: ATXN1; (+) strand; PAM type: YTN; PAM sequence: TTC
agatataattgtttacaatt

SEQ ID NO: 298528 - DNA, 20 bp, Artificial Sequence
  Description of Artificial Sequence: Synthetic oligonucleotide
  Target: ATXN1; (+) strand; PAM type: YTN; PAM sequence: TTG
tttacaattttctattactg

SEQ ID NO: 298529 - DNA, 20 bp, Artificial Sequence
  Description of Artificial Sequence: Synthetic oligonucleotide
  Target: ATXN1; (+) strand; PAM type: YTN; PAM sequence: TTT
acaattttctattactgctc

SEQ ID NO: 298530 - DNA, 20 bp, Artificial Sequence
  Description of Artificial Sequence: Synthetic oligonucleotide
  Target: ATXN1; (+) strand; PAM type: YTN; PAM sequence: TTA
caattttctattactgctct

SEQ ID NO: 298531 - DNA, 20 bp, Artificial Sequence
  Description of Artificial Sequence: Synthetic oligonucleotide
  Target: ATXN1; (+) strand; PAM type: YTN; PAM sequence: TTT
tctattactgctcttaattc

SEQ ID NO: 298532 - DNA, 20 bp, Artificial Sequence
  Description of Artificial Sequence: Synthetic oligonucleotide
  Target: ATXN1; (+) strand; PAM type: YTN; PAM sequence: TTT
ctattactgctcttaattca

SEQ ID NO: 298533 - DNA, 20 bp, Artificial Sequence
  Description of Artificial Sequence: Synthetic oligonucleotide
  Target: ATXN1; (+) strand; PAM type: YTN; PAM sequence: TTC
tattactgctcttaattcat

SEQ ID NO: 298534 - DNA, 20 bp, Artificial Sequence
  Description of Artificial Sequence: Synthetic oligonucleotide
  Target: ATXN1; (+) strand; PAM type: YTN; PAM sequence: CTA
ttactgctcttaattcattc

SEQ ID NO: 298535 - DNA, 20 bp, Artificial Sequence
  Description of Artificial Sequence: Synthetic oligonucleotide
  Target: ATXN1; (+) strand; PAM type: YTN; PAM sequence: TTA
ctgctcttaattcattctgt

SEQ ID NO: 298536 - DNA, 20 bp, Artificial Sequence
  Description of Artificial Sequence: Synthetic oligonucleotide
  Target: ATXN1; (+) strand; PAM type: YTN; PAM sequence: CTG
ctcttaattcattctgtttc

SEQ ID NO: 298537 - DNA, 20 bp, Artificial Sequence
  Description of Artificial Sequence: Synthetic oligonucleotide
  Target: ATXN1; (+) strand; PAM type: YTN; PAM sequence: CTC
ttaattcattctgtttctgt

SEQ ID NO: 298538 - DNA, 20 bp, Artificial Sequence
  Description of Artificial Sequence: Synthetic oligonucleotide
  Target: ATXN1; (+) strand; PAM type: YTN; PAM sequence: CTT
aattcattctgtttctgtca

SEQ ID NO: 298539 - DNA, 20 bp, Artificial Sequence
  Description of Artificial Sequence: Synthetic oligonucleotide
  Target: ATXN1; (+) strand; PAM type: YTN; PAM sequence: TTA
attcattctgtttctgtcaa

SEQ ID NO: 298540 - DNA, 20 bp, Artificial Sequence
  Description of Artificial Sequence: Synthetic oligonucleotide
  Target: ATXN1; (+) strand; PAM type: YTN; PAM sequence: TTC
attctgtttctgtcaactat

SEQ ID NO: 298541 - DNA, 20 bp, Artificial Sequence
  Description of Artificial Sequence: Synthetic oligonucleotide
  Target: ATXN1; (+) strand; PAM type: YTN; PAM sequence: TTC
tgtttctgtcaactatcata

SEQ ID NO: 298542 - DNA, 20 bp, Artificial Sequence
  Description of Artificial Sequence: Synthetic oligonucleotide
  Target: ATXN1; (+) strand; PAM type: YTN; PAM sequence: CTG
tttctgtcaactatcatacc

SEQ ID NO: 298543 - DNA, 20 bp, Artificial Sequence
  Description of Artificial Sequence: Synthetic oligonucleotide
  Target: ATXN1; (+) strand; PAM type: YTN; PAM sequence: TTT
ctgtcaactatcatacccta

SEQ ID NO: 298544 - DNA, 20 bp, Artificial Sequence
  Description of Artificial Sequence: Synthetic oligonucleotide
  Target: ATXN1; (+) strand; PAM type: YTN; PAM sequence: TTC
tgtcaactatcataccctat

SEQ ID NO: 298545 - DNA, 20 bp, Artificial Sequence
  Description of Artificial Sequence: Synthetic oligonucleotide
  Target: ATXN1; (+) strand; PAM type: YTN; PAM sequence: CTG
tcaactatcataccctattt

SEQ ID NO: 298546 - DNA, 20 bp, Artificial Sequence
  Description of Artificial Sequence: Synthetic oligonucleotide
  Target: ATXN1; (+) strand; PAM type: YTN; PAM sequence: CTA
tcataccctattttctatat

SEQ ID NO: 298547 - DNA, 20 bp, Artificial Sequence
  Description of Artificial Sequence: Synthetic oligonucleotide
  Target: ATXN1; (+) strand; PAM type: YTN; PAM sequence: CTA
ttttctatatttacagtgca

SEQ ID NO: 298548 - DNA, 20 bp, Artificial Sequence
  Description of Artificial Sequence: Synthetic oligonucleotide
  Target: ATXN1; (+) strand; PAM type: YTN; PAM sequence: TTT
tctatatttacagtgcactt

SEQ ID NO: 298549 - DNA, 20 bp, Artificial Sequence
  Description of Artificial Sequence: Synthetic oligonucleotide
  Target: ATXN1; (+) strand; PAM type: YTN; PAM sequence: TTT
ctatatttacagtgcacttg

SEQ ID NO: 298550 - DNA, 20 bp, Artificial Sequence
  Description of Artificial Sequence: Synthetic oligonucleotide
  Target: ATXN1; (+) strand; PAM type: YTN; PAM sequence: TTC
tatatttacagtgcacttga

SEQ ID NO: 298551 - DNA, 20 bp, Artificial Sequence
  Description of Artificial Sequence: Synthetic oligonucleotide
  Target: ATXN1; (+) strand; PAM type: YTN; PAM sequence: CTA
tatttacagtgcacttgaaa

SEQ ID NO: 298552 - DNA, 20 bp, Artificial Sequence
  Description of Artificial Sequence: Synthetic oligonucleotide
  Target: ATXN1; (+) strand; PAM type: YTN; PAM sequence: TTT
acagtgcacttgaaattgtt

SEQ ID NO: 298553 - DNA, 20 bp, Artificial Sequence
  Description of Artificial Sequence: Synthetic oligonucleotide
  Target: ATXN1; (+) strand; PAM type: YTN; PAM sequence: TTA
cagtgcacttgaaattgttt

SEQ ID NO: 298554 - DNA, 20 bp, Artificial Sequence
  Description of Artificial Sequence: Synthetic oligonucleotide
  Target: ATXN1; (+) strand; PAM type: YTN; PAM sequence: CTT
gaaattgtttatgcaactta

SEQ ID NO: 298555 - DNA, 20 bp, Artificial Sequence
  Description of Artificial Sequence: Synthetic oligonucleotide
  Target: ATXN1; (+) strand; PAM type: YTN; PAM sequence: TTG
aaattgtttatgcaacttaa

SEQ ID NO: 298556 - DNA, 20 bp, Artificial Sequence
  Description of Artificial Sequence: Synthetic oligonucleotide
  Target: ATXN1; (+) strand; PAM type: YTN; PAM sequence: TTG
tttatgcaacttaaaaaaat

SEQ ID NO: 298557 - DNA, 20 bp, Artificial Sequence
  Description of Artificial Sequence: Synthetic oligonucleotide
  Target: ATXN1; (+) strand; PAM type: YTN; PAM sequence: TTT
atgcaacttaaaaaaattaa

SEQ ID NO: 298558 - DNA, 20 bp, Artificial Sequence
  Description of Artificial Sequence: Synthetic oligonucleotide
  Target: ATXN1; (+) strand; PAM type: YTN; PAM sequence: TTA
tgcaacttaaaaaaattaaa

SEQ ID NO: 298559 - DNA, 20 bp, Artificial Sequence
  Description of Artificial Sequence: Synthetic oligonucleotide
  Target: ATXN1; (+) strand; PAM type: YTN; PAM sequence: CTT
aaaaaaattaaatggtcatc

SEQ ID NO: 298560 - DNA, 20 bp, Artificial Sequence
  Description of Artificial Sequence: Synthetic oligonucleotide
  Target: ATXN1; (+) strand; PAM type: YTN; PAM sequence: TTA
aaaaaattaaatggtcatct

SEQ ID NO: 298561 - DNA, 20 bp, Artificial Sequence
  Description of Artificial Sequence: Synthetic oligonucleotide
  Target: ATXN1; (+) strand; PAM type: YTN; PAM sequence: TTA
aatggtcatctgaaaagtgt

SEQ ID NO: 298562 - DNA, 20 bp, Artificial Sequence
  Description of Artificial Sequence: Synthetic oligonucleotide
  Target: ATXN1; (+) strand; PAM type: YTN; PAM sequence: CTG
aaaagtgtttggtgcactcg

SEQ ID NO: 298563 - DNA, 20 bp, Artificial Sequence
  Description of Artificial Sequence: Synthetic oligonucleotide
  Target: ATXN1; (+) strand; PAM type: YTN; PAM sequence: TTT
ggtgcactcgaatgagattt

SEQ ID NO: 298564 - DNA, 20 bp, Artificial Sequence
  Description of Artificial Sequence: Synthetic oligonucleotide
  Target: ATXN1; (+) strand; PAM type: YTN; PAM sequence: TTG
gtgcactcgaatgagatttt

SEQ ID NO: 298565 - DNA, 20 bp, Artificial Sequence
  Description of Artificial Sequence: Synthetic oligonucleotide
  Target: ATXN1; (+) strand; PAM type: YTN; PAM sequence: CTC
gaatgagatttttttcttgc

SEQ ID NO: 298566 - DNA, 20 bp, Artificial Sequence
  Description of Artificial Sequence: Synthetic oligonucleotide
  Target: ATXN1; (+) strand; PAM type: YTN; PAM sequence: TTT
ttttcttgcaacttttatca

SEQ ID NO: 298567 - DNA, 20 bp, Artificial Sequence
  Description of Artificial Sequence: Synthetic oligonucleotide
  Target: ATXN1; (+) strand; PAM type: YTN; PAM sequence: TTT
tttcttgcaacttttatcag

SEQ ID NO: 298568 - DNA, 20 bp, Artificial Sequence
  Description of Artificial Sequence: Synthetic oligonucleotide
  Target: ATXN1; (+) strand; PAM type: YTN; PAM sequence: TTT
ttcttgcaacttttatcagg

SEQ ID NO: 298569 - DNA, 20 bp, Artificial Sequence
  Description of Artificial Sequence: Synthetic oligonucleotide
  Target: ATXN1; (+) strand; PAM type: YTN; PAM sequence: TTT
tcttgcaacttttatcaggg

SEQ ID NO: 298570 - DNA, 20 bp, Artificial Sequence
  Description of Artificial Sequence: Synthetic oligonucleotide
  Target: ATXN1; (+) strand; PAM type: YTN; PAM sequence: TTT
cttgcaacttttatcagggg

SEQ ID NO: 298571 - DNA, 20 bp, Artificial Sequence
  Description of Artificial Sequence: Synthetic oligonucleotide
  Target: ATXN1; (+) strand; PAM type: YTN; PAM sequence: TTC
ttgcaacttttatcaggggc

SEQ ID NO: 298572 - DNA, 20 bp, Artificial Sequence
  Description of Artificial Sequence: Synthetic oligonucleotide
  Target: ATXN1; (+) strand; PAM type: YTN; PAM sequence: CTT
gcaacttttatcaggggctg

SEQ ID NO: 298573 - DNA, 20 bp, Artificial Sequence
  Description of Artificial Sequence: Synthetic oligonucleotide
  Target: ATXN1; (+) strand; PAM type: YTN; PAM sequence: TTG
caacttttatcaggggctgt

SEQ ID NO: 298574 - DNA, 20 bp, Artificial Sequence
  Description of Artificial Sequence: Synthetic oligonucleotide
  Target: ATXN1; (+) strand; PAM type: YTN; PAM sequence: CTT
ttatcaggggctgtttgcct

SEQ ID NO: 298575 - DNA, 20 bp, Artificial Sequence
  Description of Artificial Sequence: Synthetic oligonucleotide
  Target: ATXN1; (+) strand; PAM type: YTN; PAM sequence: TTT
tatcaggggctgtttgccta

SEQ ID NO: 298576 - DNA, 20 bp, Artificial Sequence
  Description of Artificial Sequence: Synthetic oligonucleotide
  Target: ATXN1; (+) strand; PAM type: YTN; PAM sequence: TTT
atcaggggctgtttgcctaa

SEQ ID NO: 298577 - DNA, 20 bp, Artificial Sequence
  Description of Artificial Sequence: Synthetic oligonucleotide
  Target: ATXN1; (+) strand; PAM type: YTN; PAM sequence: TTA
tcaggggctgtttgcctaaa

SEQ ID NO: 298578 - DNA, 20 bp, Artificial Sequence
  Description of Artificial Sequence: Synthetic oligonucleotide
  Target: ATXN1; (+) strand; PAM type: YTN; PAM sequence: CTG
tttgcctaaaaacttgctgc

SEQ ID NO: 298579 - DNA, 20 bp, Artificial Sequence
  Description of Artificial Sequence: Synthetic oligonucleotide
  Target: ATXN1; (+) strand; PAM type: YTN; PAM sequence: TTT
gcctaaaaacttgctgctct

SEQ ID NO: 298580 - DNA, 20 bp, Artificial Sequence
  Description of Artificial Sequence: Synthetic oligonucleotide
  Target: ATXN1; (+) strand; PAM type: YTN; PAM sequence: TTG
cctaaaaacttgctgctcta

SEQ ID NO: 298581 - DNA, 20 bp, Artificial Sequence
  Description of Artificial Sequence: Synthetic oligonucleotide
  Target: ATXN1; (+) strand; PAM type: YTN; PAM sequence: CTA
aaaacttgctgctctagcca

SEQ ID NO: 298582 - DNA, 20 bp, Artificial Sequence
  Description of Artificial Sequence: Synthetic oligonucleotide
  Target: ATXN1; (+) strand; PAM type: YTN; PAM sequence: CTT
gctgctctagccaaaatgtt

SEQ ID NO: 298583 - DNA, 20 bp, Artificial Sequence
  Description of Artificial Sequence: Synthetic oligonucleotide
  Target: ATXN1; (+) strand; PAM type: YTN; PAM sequence: TTG
ctgctctagccaaaatgttt

SEQ ID NO: 298584 - DNA, 20 bp, Artificial Sequence
  Description of Artificial Sequence: Synthetic oligonucleotide
  Target: ATXN1; (+) strand; PAM type: YTN; PAM sequence: CTG
ctctagccaaaatgttttta

SEQ ID NO: 298585 - DNA, 20 bp, Artificial Sequence
  Description of Artificial Sequence: Synthetic oligonucleotide
  Target: ATXN1; (+) strand; PAM type: YTN; PAM sequence: CTC
tagccaaaatgtttttagca

SEQ ID NO: 298586 - DNA, 20 bp, Artificial Sequence
  Description of Artificial Sequence: Synthetic oligonucleotide
  Target: ATXN1; (+) strand; PAM type: YTN; PAM sequence: CTA
gccaaaatgtttttagcaca

SEQ ID NO: 298587 - DNA, 20 bp, Artificial Sequence
  Description of Artificial Sequence: Synthetic oligonucleotide
  Target: ATXN1; (+) strand; PAM type: YTN; PAM sequence: TTT
ttagcacaaaattctagcaa

SEQ ID NO: 298588 - DNA, 20 bp, Artificial Sequence
  Description of Artificial Sequence: Synthetic oligonucleotide
  Target: ATXN1; (+) strand; PAM type: YTN; PAM sequence: TTT
tagcacaaaattctagcaat

SEQ ID NO: 298589 - DNA, 20 bp, Artificial Sequence
  Description of Artificial Sequence: Synthetic oligonucleotide
  Target: ATXN1; (+) strand; PAM type: YTN; PAM sequence: TTT
agcacaaaattctagcaata

SEQ ID NO: 298590 - DNA, 20 bp, Artificial Sequence
  Description of Artificial Sequence: Synthetic oligonucleotide
  Target: ATXN1; (+) strand; PAM type: YTN; PAM sequence: TTA
gcacaaaattctagcaataa

SEQ ID NO: 298591 - DNA, 20 bp, Artificial Sequence
  Description of Artificial Sequence: Synthetic oligonucleotide
  Target: ATXN1; (+) strand; PAM type: YTN; PAM sequence: TTC
tagcaataacctcagagcta

SEQ ID NO: 298592 - DNA, 20 bp, Artificial Sequence
  Description of Artificial Sequence: Synthetic oligonucleotide
  Target: ATXN1; (+) strand; PAM type: YTN; PAM sequence: CTA
gcaataacctcagagctatc

SEQ ID NO: 298593 - DNA, 20 bp, Artificial Sequence
  Description of Artificial Sequence: Synthetic oligonucleotide
  Target: ATXN1; (+) strand; PAM type: YTN; PAM sequence: CTC
agagctatcttttctttgcc

SEQ ID NO: 298594 - DNA, 20 bp, Artificial Sequence
  Description of Artificial Sequence: Synthetic oligonucleotide
  Target: ATXN1; (+) strand; PAM type: YTN; PAM sequence: CTA
tcttttctttgccacttaat

SEQ ID NO: 298595 - DNA, 20 bp, Artificial Sequence
  Description of Artificial Sequence: Synthetic oligonucleotide
  Target: ATXN1; (+) strand; PAM type: YTN; PAM sequence: CTT
ttctttgccacttaatttta

SEQ ID NO: 298596 - DNA, 20 bp, Artificial Sequence
  Description of Artificial Sequence: Synthetic oligonucleotide
  Target: ATXN1; (+) strand; PAM type: YTN; PAM sequence: TTT
tctttgccacttaattttac

SEQ ID NO: 298597 - DNA, 20 bp, Artificial Sequence
  Description of Artificial Sequence: Synthetic oligonucleotide
  Target: ATXN1; (+) strand; PAM type: YTN; PAM sequence: TTT
ctttgccacttaattttacc

SEQ ID NO: 298598 - DNA, 20 bp, Artificial Sequence
  Description of Artificial Sequence: Synthetic oligonucleotide
  Target: ATXN1; (+) strand; PAM type: YTN; PAM sequence: TTC
tttgccacttaattttacca

SEQ ID NO: 298599 - DNA, 20 bp, Artificial Sequence
  Description of Artificial Sequence: Synthetic oligonucleotide
  Target: ATXN1; (+) strand; PAM type: YTN; PAM sequence: CTT
tgccacttaattttaccaag

SEQ ID NO: 298600 - DNA, 20 bp, Artificial Sequence
  Description of Artificial Sequence: Synthetic oligonucleotide
  Target: ATXN1; (+) strand; PAM type: YTN; PAM sequence: TTT
gccacttaattttaccaaga

SEQ ID NO: 298601 - DNA, 20 bp, Artificial Sequence
  Description of Artificial Sequence: Synthetic oligonucleotide
  Target: ATXN1; (+) strand; PAM type: YTN; PAM sequence: TTG
ccacttaattttaccaagag

SEQ ID NO: 298602 - DNA, 20 bp, Artificial Sequence
  Description of Artificial Sequence: Synthetic oligonucleotide
  Target: ATXN1; (+) strand; PAM type: YTN; PAM sequence: CTT
aattttaccaagagcaaaaa

SEQ ID NO: 298603 - DNA, 20 bp, Artificial Sequence
  Description of Artificial Sequence: Synthetic oligonucleotide
  Target: ATXN1; (+) strand; PAM type: YTN; PAM sequence: TTA
attttaccaagagcaaaaag

SEQ ID NO: 298604 - DNA, 20 bp, Artificial Sequence
  Description of Artificial Sequence: Synthetic oligonucleotide
  Target: ATXN1; (+) strand; PAM type: YTN; PAM sequence: TTT
taccaagagcaaaaagaagg

SEQ ID NO: 298605 - DNA, 20 bp, Artificial Sequence
  Description of Artificial Sequence: Synthetic oligonucleotide
  Target: ATXN1; (+) strand; PAM type: YTN; PAM sequence: TTT
accaagagcaaaaagaaggg

SEQ ID NO: 298606 - DNA, 20 bp, Artificial Sequence
  Description of Artificial Sequence: Synthetic oligonucleotide
  Target: ATXN1; (+) strand; PAM type: YTN; PAM sequence: TTA
ccaagagcaaaaagaaggga

SEQ ID NO: 298607 - DNA, 20 bp, Artificial Sequence
  Description of Artificial Sequence: Synthetic oligonucleotide
  Target: ATXN1; (+) strand; PAM type: YTN; PAM sequence: CTC
ttcattttgccattgcatgg

SEQ ID NO: 298608 - DNA, 20 bp, Artificial Sequence
  Description of Artificial Sequence: Synthetic oligonucleotide
  Target: ATXN1; (+) strand; PAM type: YTN; PAM sequence: CTT
cattttgccattgcatggca

SEQ ID NO: 298609 - DNA, 20 bp, Artificial Sequence
  Description of Artificial Sequence: Synthetic oligonucleotide
  Target: ATXN1; (+) strand; PAM type: YTN; PAM sequence: TTC
attttgccattgcatggcaa

SEQ ID NO: 298610 - DNA, 20 bp, Artificial Sequence
  Description of Artificial Sequence: Synthetic oligonucleotide
  Target: ATXN1; (+) strand; PAM type: YTN; PAM sequence: TTT
tgccattgcatggcaaaaat

SEQ ID NO: 298611 - DNA, 20 bp, Artificial Sequence
  Description of Artificial Sequence: Synthetic oligonucleotide
  Target: ATXN1; (+) strand; PAM type: YTN; PAM sequence: TTT
gccattgcatggcaaaaatg

SEQ ID NO: 298612 - DNA, 20 bp, Artificial Sequence
  Description of Artificial Sequence: Synthetic oligonucleotide
  Target: ATXN1; (+) strand; PAM type: YTN; PAM sequence: TTG
ccattgcatggcaaaaatgc

SEQ ID NO: 298613 - DNA, 20 bp, Artificial Sequence
  Description of Artificial Sequence: Synthetic oligonucleotide
  Target: ATXN1; (+) strand; PAM type: YTN; PAM sequence: TTG
catggcaaaaatgcacatta

SEQ ID NO: 298614 - DNA, 20 bp, Artificial Sequence
  Description of Artificial Sequence: Synthetic oligonucleotide
  Target: ATXN1; (+) strand; PAM type: YTN; PAM sequence: TTA
acttaactcttctatggcag

SEQ ID NO: 298615 - DNA, 20 bp, Artificial Sequence
  Description of Artificial Sequence: Synthetic oligonucleotide
  Target: ATXN1; (+) strand; PAM type: YTN; PAM sequence: CTT
aactcttctatggcagaaat

SEQ ID NO: 298616 - DNA, 20 bp, Artificial Sequence
  Description of Artificial Sequence: Synthetic oligonucleotide
  Target: ATXN1; (+) strand; PAM type: YTN; PAM sequence: TTA
actcttctatggcagaaata

SEQ ID NO: 298617 - DNA, 20 bp, Artificial Sequence
  Description of Artificial Sequence: Synthetic oligonucleotide
  Target: ATXN1; (+) strand; PAM type: YTN; PAM sequence: CTC
ttctatggcagaaatacaaa

SEQ ID NO: 298618 - DNA, 20 bp, Artificial Sequence
  Description of Artificial Sequence: Synthetic oligonucleotide
  Target: ATXN1; (+) strand; PAM type: YTN; PAM sequence: CTT
ctatggcagaaatacaaatg

SEQ ID NO: 298619 - DNA, 20 bp, Artificial Sequence
  Description of Artificial Sequence: Synthetic oligonucleotide
  Target: ATXN1; (+) strand; PAM type: YTN; PAM sequence: TTC
tatggcagaaatacaaatga

SEQ ID NO: 298620 - DNA, 20 bp, Artificial Sequence
  Description of Artificial Sequence: Synthetic oligonucleotide
  Target: ATXN1; (+) strand; PAM type: YTN; PAM sequence: CTA
tggcagaaatacaaatgaaa

SEQ ID NO: 298621 - DNA, 20 bp, Artificial Sequence
  Description of Artificial Sequence: Synthetic oligonucleotide
  Target: ATXN1; (+) strand; PAM type: YTN; PAM sequence: TTT
aagttacttttaggatttcc

SEQ ID NO: 298622 - DNA, 20 bp, Artificial Sequence
  Description of Artificial Sequence: Synthetic oligonucleotide
  Target: ATXN1; (+) strand; PAM type: YTN; PAM sequence: TTA
agttacttttaggatttccg

SEQ ID NO: 298623 - DNA, 20 bp, Artificial Sequence
  Description of Artificial Sequence: Synthetic oligonucleotide
  Target: ATXN1; (+) strand; PAM type: YTN; PAM sequence: TTA
cttttaggatttccgttgac

SEQ ID NO: 298624 - DNA, 20 bp, Artificial Sequence
  Description of Artificial Sequence: Synthetic oligonucleotide
  Target: ATXN1; (+) strand; PAM type: YTN; PAM sequence: CTT
ttaggatttccgttgactat

SEQ ID NO: 298625 - DNA, 20 bp, Artificial Sequence
  Description of Artificial Sequence: Synthetic oligonucleotide
  Target: ATXN1; (+) strand; PAM type: YTN; PAM sequence: TTT
taggatttccgttgactatc

SEQ ID NO: 298626 - DNA, 20 bp, Artificial Sequence
  Description of Artificial Sequence: Synthetic oligonucleotide
  Target: ATXN1; (+) strand; PAM type: YTN; PAM sequence: TTT
aggatttccgttgactatct

SEQ ID NO: 298627 - DNA, 20 bp, Artificial Sequence
  Description of Artificial Sequence: Synthetic oligonucleotide
  Target: ATXN1; (+) strand; PAM type: YTN; PAM sequence: TTA
ggatttccgttgactatctt

SEQ ID NO: 298628 - DNA, 20 bp, Artificial Sequence
  Description of Artificial Sequence: Synthetic oligonucleotide
  Target: ATXN1; (+) strand; PAM type: YTN; PAM sequence: TTT
ccgttgactatcttattttt

SEQ ID NO: 298629 - DNA, 20 bp, Artificial Sequence
  Description of Artificial Sequence: Synthetic oligonucleotide
  Target: ATXN1; (+) strand; PAM type: YTN; PAM sequence: TTC
cgttgactatcttatttttt

SEQ ID NO: 298630 - DNA, 20 bp, Artificial Sequence
  Description of Artificial Sequence: Synthetic oligonucleotide
  Target: ATXN1; (+) strand; PAM type: YTN; PAM sequence: TTG
actatcttattttttcataa

SEQ ID NO: 298631 - DNA, 20 bp, Artificial Sequence
  Description of Artificial Sequence: Synthetic oligonucleotide
  Target: ATXN1; (+) strand; PAM type: YTN; PAM sequence: CTA
tcttattttttcataatctg

SEQ ID NO: 298632 - DNA, 20 bp, Artificial Sequence
  Description of Artificial Sequence: Synthetic oligonucleotide
  Target: ATXN1; (+) strand; PAM type: YTN; PAM sequence: CTT
attttttcataatctgactt

SEQ ID NO: 298633 - DNA, 20 bp, Artificial Sequence
  Description of Artificial Sequence: Synthetic oligonucleotide
  Target: ATXN1; (+) strand; PAM type: YTN; PAM sequence: TTA
ttttttcataatctgacttc

SEQ ID NO: 298634 - DNA, 20 bp, Artificial Sequence
  Description of Artificial Sequence: Synthetic oligonucleotide
  Target: ATXN1; (+) strand; PAM type: YTN; PAM sequence: TTT
tttcataatctgacttcttg

SEQ ID NO: 298635 - DNA, 20 bp, Artificial Sequence
  Description of Artificial Sequence: Synthetic oligonucleotide
  Target: ATXN1; (+) strand; PAM type: YTN; PAM sequence: TTT
ttcataatctgacttcttgg

SEQ ID NO: 298636 - DNA, 20 bp, Artificial Sequence
  Description of Artificial Sequence: Synthetic oligonucleotide
  Target: ATXN1; (+) strand; PAM type: YTN; PAM sequence: TTT
tcataatctgacttcttgga

SEQ ID NO: 298637 - DNA, 20 bp, Artificial Sequence
  Description of Artificial Sequence: Synthetic oligonucleotide
  Target: ATXN1; (+) strand; PAM type: YTN; PAM sequence: TTT
cataatctgacttcttggat

SEQ ID NO: 298638 - DNA, 20 bp, Artificial Sequence
  Description of Artificial Sequence: Synthetic oligonucleotide
  Target: ATXN1; (+) strand; PAM type: YTN; PAM sequence: TTC
ataatctgacttcttggata

SEQ ID NO: 298639 - DNA, 20 bp, Artificial Sequence
  Description of Artificial Sequence: Synthetic oligonucleotide
  Target: ATXN1; (+) strand; PAM type: YTN; PAM sequence: CTG
acttcttggatatctatttt

SEQ ID NO: 298640 - DNA, 20 bp, Artificial Sequence
  Description of Artificial Sequence: Synthetic oligonucleotide
  Target: ATXN1; (+) strand; PAM type: YTN; PAM sequence: CTT
cttggatatctattttaatt

SEQ ID NO: 298641 - DNA, 20 bp, Artificial Sequence
  Description of Artificial Sequence: Synthetic oligonucleotide
  Target: ATXN1; (+) strand; PAM type: YTN; PAM sequence: TTC
ttggatatctattttaattc

SEQ ID NO: 298642 - DNA, 20 bp, Artificial Sequence
  Description of Artificial Sequence: Synthetic oligonucleotide
  Target: ATXN1; (+) strand; PAM type: YTN; PAM sequence: CTT
ggatatctattttaattctt

SEQ ID NO: 298643 - DNA, 20 bp, Artificial Sequence
  Description of Artificial Sequence: Synthetic oligonucleotide
  Target: ATXN1; (+) strand; PAM type: YTN; PAM sequence: TTG
gatatctattttaattcttt

SEQ ID NO: 298644 - DNA, 20 bp, Artificial Sequence
  Description of Artificial Sequence: Synthetic oligonucleotide
  Target: ATXN1; (+) strand; PAM type: YTN; PAM sequence: CTA
ttttaattcttttgattttg

SEQ ID NO: 298645 - DNA, 20 bp, Artificial Sequence
  Description of Artificial Sequence: Synthetic oligonucleotide
  Target: ATXN1; (+) strand; PAM type: YTN; PAM sequence: TTT
taattcttttgattttgaga

SEQ ID NO: 298646 - DNA, 20 bp, Artificial Sequence
  Description of Artificial Sequence: Synthetic oligonucleotide
  Target: ATXN1; (+) strand; PAM type: YTN; PAM sequence: TTT
aattcttttgattttgagaa

SEQ ID NO: 298647 - DNA, 20 bp, Artificial Sequence
  Description of Artificial Sequence: Synthetic oligonucleotide
  Target: ATXN1; (+) strand; PAM type: YTN; PAM sequence: TTA
attcttttgattttgagaaa

SEQ ID NO: 298648 - DNA, 20 bp, Artificial Sequence
  Description of Artificial Sequence: Synthetic oligonucleotide
  Target: ATXN1; (+) strand; PAM type: YTN; PAM sequence: TTC
ttttgattttgagaaaatgt

SEQ ID NO: 298649 - DNA, 20 bp, Artificial Sequence
  Description of Artificial Sequence: Synthetic oligonucleotide
  Target: ATXN1; (+) strand; PAM type: YTN; PAM sequence: CTT
ttgattttgagaaaatgtac

SEQ ID NO: 298650 - DNA, 20 bp, Artificial Sequence
  Description of Artificial Sequence: Synthetic oligonucleotide
  Target: ATXN1; (+) strand; PAM type: YTN; PAM sequence: TTT
tgattttgagaaaatgtaca

SEQ ID NO: 298651 - DNA, 20 bp, Artificial Sequence
  Description of Artificial Sequence: Synthetic oligonucleotide
  Target: ATXN1; (+) strand; PAM type: YTN; PAM sequence: TTT
gattttgagaaaatgtacat

SEQ ID NO: 298652 - DNA, 20 bp, Artificial Sequence
  Description of Artificial Sequence: Synthetic oligonucleotide
  Target: ATXN1; (+) strand; PAM type: YTN; PAM sequence: TTG
attttgagaaaatgtacatg

SEQ ID NO: 298653 - DNA, 20 bp, Artificial Sequence
  Description of Artificial Sequence: Synthetic oligonucleotide
  Target: ATXN1; (+) strand; PAM type: YTN; PAM sequence: TTT
tgagaaaatgtacatgtttg

SEQ ID NO: 298654 - DNA, 20 bp, Artificial Sequence
  Description of Artificial Sequence: Synthetic oligonucleotide
  Target: ATXN1; (+) strand; PAM type: YTN; PAM sequence: TTT
gagaaaatgtacatgtttgt

SEQ ID NO: 298655 - DNA, 20 bp, Artificial Sequence
  Description of Artificial Sequence: Synthetic oligonucleotide
  Target: ATXN1; (+) strand; PAM type: YTN; PAM sequence: TTG
agaaaatgtacatgtttgta

SEQ ID NO: 298656 - DNA, 20 bp, Artificial Sequence
  Description of Artificial Sequence: Synthetic oligonucleotide
  Target: ATXN1; (+) strand; PAM type: YTN; PAM sequence: TTT
gtaccaattctaaagtctca

SEQ ID NO: 298657 - DNA, 20 bp, Artificial Sequence
  Description of Artificial Sequence: Synthetic oligonucleotide
  Target: ATXN1; (+) strand; PAM type: YTN; PAM sequence: TTG
taccaattctaaagtctcag

SEQ ID NO: 298658 - DNA, 20 bp, Artificial Sequence
  Description of Artificial Sequence: Synthetic oligonucleotide
  Target: ATXN1; (+) strand; PAM type: YTN; PAM sequence: TTC
taaagtctcagccaactatt

SEQ ID NO: 298659 - DNA, 20 bp, Artificial Sequence
  Description of Artificial Sequence: Synthetic oligonucleotide
  Target: ATXN1; (+) strand; PAM type: YTN; PAM sequence: CTA
aagtctcagccaactattca

SEQ ID NO: 298660 - DNA, 20 bp, Artificial Sequence
  Description of Artificial Sequence: Synthetic oligonucleotide
  Target: ATXN1; (+) strand; PAM type: YTN; PAM sequence: CTC
agccaactattcaatatttt

SEQ ID NO: 298661 - DNA, 20 bp, Artificial Sequence
  Description of Artificial Sequence: Synthetic oligonucleotide
  Target: ATXN1; (+) strand; PAM type: YTN; PAM sequence: CTA
ttcaatattttcagcgattt

SEQ ID NO: 298662 - DNA, 20 bp, Artificial Sequence
  Description of Artificial Sequence: Synthetic oligonucleotide
  Target: ATXN1; (+) strand; PAM type: YTN; PAM sequence: TTC
aatattttcagcgatttagg

SEQ ID NO: 298663 - DNA, 20 bp, Artificial Sequence
  Description of Artificial Sequence: Synthetic oligonucleotide
  Target: ATXN1; (+) strand; PAM type: YTN; PAM sequence: TTT
tcagcgatttaggtaaatct

SEQ ID NO: 298664 - DNA, 20 bp, Artificial Sequence
  Description of Artificial Sequence: Synthetic oligonucleotide
  Target: ATXN1; (+) strand; PAM type: YTN; PAM sequence: TTT
cagcgatttaggtaaatctt

SEQ ID NO: 298665 - DNA, 20 bp, Artificial Sequence
  Description of Artificial Sequence: Synthetic oligonucleotide
  Target: ATXN1; (+) strand; PAM type: YTN; PAM sequence: TTC
agcgatttaggtaaatctta

SEQ ID NO: 298666 - DNA, 20 bp, Artificial Sequence
  Description of Artificial Sequence: Synthetic oligonucleotide
  Target: ATXN1; (+) strand; PAM type: YTN; PAM sequence: TTT
aggtaaatcttacttcaaat

SEQ ID NO: 298667 - DNA, 20 bp, Artificial Sequence
  Description of Artificial Sequence: Synthetic oligonucleotide
  Target: ATXN1; (+) strand; PAM type: YTN; PAM sequence: TTA
ggtaaatcttacttcaaatt

SEQ ID NO: 298668 - DNA, 20 bp, Artificial Sequence
  Description of Artificial Sequence: Synthetic oligonucleotide
  Target: ATXN1; (+) strand; PAM type: YTN; PAM sequence: CTT
acttcaaattcttactaaca

SEQ ID NO: 298669 - DNA, 20 bp, Artificial Sequence
  Description of Artificial Sequence: Synthetic oligonucleotide
  Target: ATXN1; (+) strand; PAM type: YTN; PAM sequence: TTA
cttcaaattcttactaacaa

SEQ ID NO: 298670 - DNA, 20 bp, Artificial Sequence
  Description of Artificial Sequence: Synthetic oligonucleotide
  Target: ATXN1; (+) strand; PAM type: YTN; PAM sequence: CTT
caaattcttactaacaatgc

SEQ ID NO: 298671 - DNA, 20 bp, Artificial Sequence
  Description of Artificial Sequence: Synthetic oligonucleotide
  Target: ATXN1; (+) strand; PAM type: YTN; PAM sequence: TTC
aaattcttactaacaatgcc

SEQ ID NO: 298672 - DNA, 20 bp, Artificial Sequence
  Description of Artificial Sequence: Synthetic oligonucleotide
  Target: ATXN1; (+) strand; PAM type: YTN; PAM sequence: TTC
ttactaacaatgccacatag

SEQ ID NO: 298673 - DNA, 20 bp, Artificial Sequence
  Description of Artificial Sequence: Synthetic oligonucleotide
  Target: ATXN1; (+) strand; PAM type: YTN; PAM sequence: CTT
actaacaatgccacatagta

SEQ ID NO: 298674 - DNA, 20 bp, Artificial Sequence
  Description of Artificial Sequence: Synthetic oligonucleotide
  Target: ATXN1; (+) strand; PAM type: YTN; PAM sequence: TTA
ctaacaatgccacatagtat

SEQ ID NO: 298675 - DNA, 20 bp, Artificial Sequence
  Description of Artificial Sequence: Synthetic oligonucleotide
  Target: ATXN1; (+) strand; PAM type: YTN; PAM sequence: CTA
acaatgccacatagtatacc

SEQ ID NO: 298676 - DNA, 20 bp, Artificial Sequence
  Description of Artificial Sequence: Synthetic oligonucleotide
  Target: ATXN1; (+) strand; PAM type: YTN; PAM sequence: TTA
tcatttttattctatcttat

SEQ ID NO: 298677 - DNA, 20 bp, Artificial Sequence
  Description of Artificial Sequence: Synthetic oligonucleotide
  Target: ATXN1; (+) strand; PAM type: YTN; PAM sequence: TTT
ttattctatcttatattaga

SEQ ID NO: 298678 - DNA, 20 bp, Artificial Sequence
  Description of Artificial Sequence: Synthetic oligonucleotide
  Target: ATXN1; (+) strand; PAM type: YTN; PAM sequence: TTT
tattctatcttatattagaa

SEQ ID NO: 298679 - DNA, 20 bp, Artificial Sequence
  Description of Artificial Sequence: Synthetic oligonucleotide
  Target: ATXN1; (+) strand; PAM type: YTN; PAM sequence: TTT
attctatcttatattagaag

SEQ ID NO: 298680 - DNA, 20 bp, Artificial Sequence
  Description of Artificial Sequence: Synthetic oligonucleotide
  Target: ATXN1; (+) strand; PAM type: YTN; PAM sequence: TTA
ttctatcttatattagaaga

SEQ ID NO: 298681 - DNA, 20 bp, Artificial Sequence
  Description of Artificial Sequence: Synthetic oligonucleotide
  Target: ATXN1; (+) strand; PAM type: YTN; PAM sequence: TTC
tatcttatattagaagatgg

SEQ ID NO: 298682 - DNA, 20 bp, Artificial Sequence
  Description of Artificial Sequence: Synthetic oligonucleotide
  Target: ATXN1; (+) strand; PAM type: YTN; PAM sequence: CTA
tcttatattagaagatggct

SEQ ID NO: 298683 - DNA, 20 bp, Artificial Sequence
  Description of Artificial Sequence: Synthetic oligonucleotide
  Target: ATXN1; (+) strand; PAM type: YTN; PAM sequence: CTT
atattagaagatggctttta

SEQ ID NO: 298684 - DNA, 20 bp, Artificial Sequence
  Description of Artificial Sequence: Synthetic oligonucleotide
  Target: ATXN1; (+) strand; PAM type: YTN; PAM sequence: TTA
tattagaagatggcttttaa

SEQ ID NO: 298685 - DNA, 20 bp, Artificial Sequence
  Description of Artificial Sequence: Synthetic oligonucleotide
  Target: ATXN1; (+) strand; PAM type: YTN; PAM sequence: TTA
gaagatggcttttaagccaa

SEQ ID NO: 298686 - DNA, 20 bp, Artificial Sequence
  Description of Artificial Sequence: Synthetic oligonucleotide
  Target: ATXN1; (+) strand; PAM type: YTN; PAM sequence: CTT
ttaagccaaaatgttatttt

SEQ ID NO: 298687 - DNA, 20 bp, Artificial Sequence
  Description of Artificial Sequence: Synthetic oligonucleotide
  Target: ATXN1; (+) strand; PAM type: YTN; PAM sequence: TTT
taagccaaaatgttattttc

SEQ ID NO: 298688 - DNA, 20 bp, Artificial Sequence
  Description of Artificial Sequence: Synthetic oligonucleotide
  Target: ATXN1; (+) strand; PAM type: YTN; PAM sequence: TTT
aagccaaaatgttattttct

SEQ ID NO: 298689 - DNA, 20 bp, Artificial Sequence
  Description of Artificial Sequence: Synthetic oligonucleotide
  Target: ATXN1; (+) strand; PAM type: YTN; PAM sequence: TTA
agccaaaatgttattttctt

SEQ ID NO: 298690 - DNA, 20 bp, Artificial Sequence
  Description of Artificial Sequence: Synthetic oligonucleotide
  Target: ATXN1; (+) strand; PAM type: YTN; PAM sequence: TTA
ttttcttacagttagtttga

SEQ ID NO: 298691 - DNA, 20 bp, Artificial Sequence
  Description of Artificial Sequence: Synthetic oligonucleotide
  Target: ATXN1; (+) strand; PAM type: YTN; PAM sequence: TTT
tcttacagttagtttgatat

SEQ ID NO: 298692 - DNA, 20 bp, Artificial Sequence
  Description of Artificial Sequence: Synthetic oligonucleotide
  Target: ATXN1; (+) strand; PAM type: YTN; PAM sequence: TTT
cttacagttagtttgatatg

SEQ ID NO: 298693 - DNA, 20 bp, Artificial Sequence
  Description of Artificial Sequence: Synthetic oligonucleotide
  Target: ATXN1; (+) strand; PAM type: YTN; PAM sequence: TTC
ttacagttagtttgatatgc

SEQ ID NO: 298694 - DNA, 20 bp, Artificial Sequence
  Description of Artificial Sequence: Synthetic oligonucleotide
  Target: ATXN1; (+) strand; PAM type: YTN; PAM sequence: CTT
acagttagtttgatatgcta

SEQ ID NO: 298695 - DNA, 20 bp, Artificial Sequence
  Description of Artificial Sequence: Synthetic oligonucleotide
  Target: ATXN1; (+) strand; PAM type: YTN; PAM sequence: TTA
cagttagtttgatatgctat

SEQ ID NO: 298696 - DNA, 20 bp, Artificial Sequence
  Description of Artificial Sequence: Synthetic oligonucleotide
  Target: ATXN1; (+) strand; PAM type: YTN; PAM sequence: TTA
gtttgatatgctatgctcac

SEQ ID NO: 298697 - DNA, 20 bp, Artificial Sequence
  Description of Artificial Sequence: Synthetic oligonucleotide
  Target: ATXN1; (+) strand; PAM type: YTN; PAM sequence: TTT
gatatgctatgctcacagag

SEQ ID NO: 298698 - DNA, 20 bp, Artificial Sequence
  Description of Artificial Sequence: Synthetic oligonucleotide
  Target: ATXN1; (+) strand; PAM type: YTN; PAM sequence: TTG
atatgctatgctcacagaga

SEQ ID NO: 298699 - DNA, 20 bp, Artificial Sequence
  Description of Artificial Sequence: Synthetic oligonucleotide
  Target: ATXN1; (+) strand; PAM type: YTN; PAM sequence: CTA
tgctcacagagaacctggct

SEQ ID NO: 298700 - DNA, 20 bp, Artificial Sequence
  Description of Artificial Sequence: Synthetic oligonucleotide
  Target: ATXN1; (+) strand; PAM type: YTN; PAM sequence: CTC
acagagaacctggctgtctt

SEQ ID NO: 298701 - DNA, 20 bp, Artificial Sequence
  Description of Artificial Sequence: Synthetic oligonucleotide
  Target: ATXN1; (+) strand; PAM type: YTN; PAM sequence: CTG
gctgtcttttggctgggatg

SEQ ID NO: 298702 - DNA, 20 bp, Artificial Sequence
  Description of Artificial Sequence: Synthetic oligonucleotide
  Target: ATXN1; (+) strand; PAM type: YTN; PAM sequence: CTG
tcttttggctgggatgttcc

SEQ ID NO: 298703 - DNA, 20 bp, Artificial Sequence
  Description of Artificial Sequence: Synthetic oligonucleotide
  Target: ATXN1; (+) strand; PAM type: YTN; PAM sequence: CTT
ttggctgggatgttcccagc

SEQ ID NO: 298704 - DNA, 20 bp, Artificial Sequence
  Description of Artificial Sequence: Synthetic oligonucleotide
  Target: ATXN1; (+) strand; PAM type: YTN; PAM sequence: TTT
tggctgggatgttcccagct

SEQ ID NO: 298705 - DNA, 20 bp, Artificial Sequence
  Description of Artificial Sequence: Synthetic oligonucleotide
  Target: ATXN1; (+) strand; PAM type: YTN; PAM sequence: TTT
ggctgggatgttcccagcta

SEQ ID NO: 298706 - DNA, 20 bp, Artificial Sequence
  Description of Artificial Sequence: Synthetic oligonucleotide
  Target: ATXN1; (+) strand; PAM type: YTN; PAM sequence: TTG
gctgggatgttcccagctaa

SEQ ID NO: 298707 - DNA, 20 bp, Artificial Sequence
  Description of Artificial Sequence: Synthetic oligonucleotide
  Target: ATXN1; (+) strand; PAM type: YTN; PAM sequence: CTG
ggatgttcccagctaaaaat

SEQ ID NO: 298708 - DNA, 20 bp, Artificial Sequence
  Description of Artificial Sequence: Synthetic oligonucleotide
  Target: ATXN1; (+) strand; PAM type: YTN; PAM sequence: TTC
ccagctaaaaatgagaaatc

SEQ ID NO: 298709 - DNA, 20 bp, Artificial Sequence
  Description of Artificial Sequence: Synthetic oligonucleotide
  Target: ATXN1; (+) strand; PAM type: YTN; PAM sequence: CTA
aaaatgagaaatcagagaca

SEQ ID NO: 298710 - DNA, 20 bp, Artificial Sequence
  Description of Artificial Sequence: Synthetic oligonucleotide
  Target: ATXN1; (+) strand; PAM type: YTN; PAM sequence: CTG
agtaggaacataggatgtgg

SEQ ID NO: 298711 - DNA, 20 bp, Artificial Sequence
  Description of Artificial Sequence: Synthetic oligonucleotide
  Target: ATXN1; (+) strand; PAM type: YTN; PAM sequence: TTA
agattgacctttatagaata

SEQ ID NO: 298712 - DNA, 20 bp, Artificial Sequence
  Description of Artificial Sequence: Synthetic oligonucleotide
  Target: ATXN1; (+) strand; PAM type: YTN; PAM sequence: TTG
acctttatagaatattttta

SEQ ID NO: 298713 - DNA, 20 bp, Artificial Sequence
  Description of Artificial Sequence: Synthetic oligonucleotide
  Target: ATXN1; (+) strand; PAM type: YTN; PAM sequence: CTT
tatagaatatttttatcatt

SEQ ID NO: 298714 - DNA, 20 bp, Artificial Sequence
  Description of Artificial Sequence: Synthetic oligonucleotide
  Target: ATXN1; (+) strand; PAM type: YTN; PAM sequence: TTT
atagaatatttttatcattc

SEQ ID NO: 298715 - DNA, 20 bp, Artificial Sequence
  Description of Artificial Sequence: Synthetic oligonucleotide
  Target: ATXN1; (+) strand; PAM type: YTN; PAM sequence: TTA
tagaatatttttatcattcc

SEQ ID NO: 298716 - DNA, 20 bp, Artificial Sequence
  Description of Artificial Sequence: Synthetic oligonucleotide
  Target: ATXN1; (+) strand; PAM type: YTN; PAM sequence: TTT
ttatcattcctaagagattg

SEQ ID NO: 298717 - DNA, 20 bp, Artificial Sequence
  Description of Artificial Sequence: Synthetic oligonucleotide
  Target: ATXN1; (+) strand; PAM type: YTN; PAM sequence: TTT
tatcattcctaagagattgg

SEQ ID NO: 298718 - DNA, 20 bp, Artificial Sequence
  Description of Artificial Sequence: Synthetic oligonucleotide
  Target: ATXN1; (+) strand; PAM type: YTN; PAM sequence: TTT
atcattcctaagagattgga

SEQ ID NO: 298719 - DNA, 20 bp, Artificial Sequence
  Description of Artificial Sequence: Synthetic oligonucleotide
  Target: ATXN1; (+) strand; PAM type: YTN; PAM sequence: TTA
tcattcctaagagattggaa

SEQ ID NO: 298720 - DNA, 20 bp, Artificial Sequence
  Description of Artificial Sequence: Synthetic oligonucleotide
  Target: ATXN1; (+) strand; PAM type: YTN; PAM sequence: TTC
ctaagagattggaatattca

SEQ ID NO: 298721 - DNA, 20 bp, Artificial Sequence
  Description of Artificial Sequence: Synthetic oligonucleotide
  Target: ATXN1; (+) strand; PAM type: YTN; PAM sequence: CTA
agagattggaatattcagca

SEQ ID NO: 298722 - DNA, 20 bp, Artificial Sequence
  Description of Artificial Sequence: Synthetic oligonucleotide
  Target: ATXN1; (+) strand; PAM type: YTN; PAM sequence: TTG
gaatattcagcatactaata

SEQ ID NO: 298723 - DNA, 20 bp, Artificial Sequence
  Description of Artificial Sequence: Synthetic oligonucleotide
  Target: ATXN1; (+) strand; PAM type: YTN; PAM sequence: TTC
agcatactaataattttctg

SEQ ID NO: 298724 - DNA, 20 bp, Artificial Sequence
  Description of Artificial Sequence: Synthetic oligonucleotide
  Target: ATXN1; (+) strand; PAM type: YTN; PAM sequence: CTA
ataattttctgatttaaata

SEQ ID NO: 298725 - DNA, 20 bp, Artificial Sequence
  Description of Artificial Sequence: Synthetic oligonucleotide
  Target: ATXN1; (+) strand; PAM type: YTN; PAM sequence: TTT
tctgatttaaatataagtag

SEQ ID NO: 298726 - DNA, 20 bp, Artificial Sequence
  Description of Artificial Sequence: Synthetic oligonucleotide
  Target: ATXN1; (+) strand; PAM type: YTN; PAM sequence: TTT
ctgatttaaatataagtaga

SEQ ID NO: 298727 - DNA, 20 bp, Artificial Sequence
  Description of Artificial Sequence: Synthetic oligonucleotide
  Target: ATXN1; (+) strand; PAM type: YTN; PAM sequence: TTC
tgatttaaatataagtagac

SEQ ID NO: 298728 - DNA, 20 bp, Artificial Sequence
  Description of Artificial Sequence: Synthetic oligonucleotide
  Target: ATXN1; (+) strand; PAM type: YTN; PAM sequence: CTG
atttaaatataagtagacat

SEQ ID NO: 298729 - DNA, 20 bp, Artificial Sequence
  Description of Artificial Sequence: Synthetic oligonucleotide
  Target: ATXN1; (+) strand; PAM type: YTN; PAM sequence: TTT
aaatataagtagacatcacc

SEQ ID NO: 298730 - DNA, 20 bp, Artificial Sequence
  Description of Artificial Sequence: Synthetic oligonucleotide
  Target: ATXN1; (+) strand; PAM type: YTN; PAM sequence: TTA
aatataagtagacatcacca

SEQ ID NO: 298731 - DNA, 20 bp, Artificial Sequence
  Description of Artificial Sequence: Synthetic oligonucleotide
  Target: ATXN1; (+) strand; PAM type: YTN; PAM sequence: TTA
atttcaccaaaaaaaatgtt

SEQ ID NO: 298732 - DNA, 20 bp, Artificial Sequence
  Description of Artificial Sequence: Synthetic oligonucleotide
  Target: ATXN1; (+) strand; PAM type: YTN; PAM sequence: TTT
caccaaaaaaaatgtttaag

SEQ ID NO: 298733 - DNA, 20 bp, Artificial Sequence
  Description of Artificial Sequence: Synthetic oligonucleotide
  Target: ATXN1; (+) strand; PAM type: YTN; PAM sequence: TTC
accaaaaaaaatgtttaagt

SEQ ID NO: 298734 - DNA, 20 bp, Artificial Sequence
  Description of Artificial Sequence: Synthetic oligonucleotide
  Target: ATXN1; (+) strand; PAM type: YTN; PAM sequence: TTT
aagttaatttatcaaaagga

SEQ ID NO: 298735 - DNA, 20 bp, Artificial Sequence
  Description of Artificial Sequence: Synthetic oligonucleotide
  Target: ATXN1; (+) strand; PAM type: YTN; PAM sequence: TTA
agttaatttatcaaaaggaa

SEQ ID NO: 298736 - DNA, 20 bp, Artificial Sequence
  Description of Artificial Sequence: Synthetic oligonucleotide
  Target: ATXN1; (+) strand; PAM type: YTN; PAM sequence: TTA
atttatcaaaaggaaggcag

SEQ ID NO: 298737 - DNA, 20 bp, Artificial Sequence
  Description of Artificial Sequence: Synthetic oligonucleotide
  Target: ATXN1; (+) strand; PAM type: YTN; PAM sequence: TTT
atcaaaaggaaggcagggaa

SEQ ID NO: 298738 - DNA, 20 bp, Artificial Sequence
  Description of Artificial Sequence: Synthetic oligonucleotide
  Target: ATXN1; (+) strand; PAM type: YTN; PAM sequence: TTA
tcaaaaggaaggcagggaaa

SEQ ID NO: 298739 - DNA, 20 bp, Artificial Sequence
  Description of Artificial Sequence: Synthetic oligonucleotide
  Target: ATXN1; (+) strand; PAM type: YTN; PAM sequence: CTG
ggtgcggtggctcacgcctg

SEQ ID NO: 298740 - DNA, 20 bp, Artificial Sequence
  Description of Artificial Sequence: Synthetic oligonucleotide
  Target: ATXN1; (+) strand; PAM type: YTN; PAM sequence: CTC
acgcctgtaatcccagcact

SEQ ID NO: 298741 - DNA, 20 bp, Artificial Sequence
  Description of Artificial Sequence: Synthetic oligonucleotide
  Target: ATXN1; (+) strand; PAM type: YTN; PAM sequence: CTG
taatcccagcactttgggag

SEQ ID NO: 298742 - DNA, 20 bp, Artificial Sequence
  Description of Artificial Sequence: Synthetic oligonucleotide
  Target: ATXN1; (+) strand; PAM type: YTN; PAM sequence: CTT
tgggaggccgaggcgggtgg

SEQ ID NO: 298743 - DNA, 20 bp, Artificial Sequence
  Description of Artificial Sequence: Synthetic oligonucleotide
  Target: ATXN1; (+) strand; PAM type: YTN; PAM sequence: TTT
gggaggccgaggcgggtgga

SEQ ID NO: 298744 - DNA, 20 bp, Artificial Sequence
  Description of Artificial Sequence: Synthetic oligonucleotide
  Target: ATXN1; (+) strand; PAM type: YTN; PAM sequence: TTG
ggaggccgaggcgggtggat

SEQ ID NO: 298745 - DNA, 20 bp, Artificial Sequence
  Description of Artificial Sequence: Synthetic oligonucleotide
  Target: ATXN1; (+) strand; PAM type: YTN; PAM sequence: CTG
aggtcaggagttcgagacca

SEQ ID NO: 298746 - DNA, 20 bp, Artificial Sequence
  Description of Artificial Sequence: Synthetic oligonucleotide
  Target: ATXN1; (+) strand; PAM type: YTN; PAM sequence: TTC
gagaccagcctgaccaacat

SEQ ID NO: 298747 - DNA, 20 bp, Artificial Sequence
  Description of Artificial Sequence: Synthetic oligonucleotide
  Target: ATXN1; (+) strand; PAM type: YTN; PAM sequence: CTG
accaacatggtgaaacccca

SEQ ID NO: 298748 - DNA, 20 bp, Artificial Sequence
  Description of Artificial Sequence: Synthetic oligonucleotide
  Target: ATXN1; (+) strand; PAM type: YTN; PAM sequence: CTC
tacaaaaacatacaaaatta

SEQ ID NO: 298749 - DNA, 20 bp, Artificial Sequence
  Description of Artificial Sequence: Synthetic oligonucleotide
  Target: ATXN1; (+) strand; PAM type: YTN; PAM sequence: CTA
caaaaacatacaaaattagc

SEQ ID NO: 298750 - DNA, 20 bp, Artificial Sequence
  Description of Artificial Sequence: Synthetic oligonucleotide
  Target: ATXN1; (+) strand; PAM type: YTN; PAM sequence: TTA
gctggctgtggtggagcatg

SEQ ID NO: 298751 - DNA, 20 bp, Artificial Sequence
  Description of Artificial Sequence: Synthetic oligonucleotide
  Target: ATXN1; (+) strand; PAM type: YTN; PAM sequence: CTG
gctgtggtggagcatgccta

SEQ ID NO: 298752 - DNA, 20 bp, Artificial Sequence
  Description of Artificial Sequence: Synthetic oligonucleotide
  Target: ATXN1; (+) strand; PAM type: YTN; PAM sequence: CTG
tggtggagcatgcctataat

SEQ ID NO: 298753 - DNA, 20 bp, Artificial Sequence
  Description of Artificial Sequence: Synthetic oligonucleotide
  Target: ATXN1; (+) strand; PAM type: YTN; PAM sequence: CTA
taatcccagctacttgggag

SEQ ID NO: 298754 - DNA, 20 bp, Artificial Sequence
  Description of Artificial Sequence: Synthetic oligonucleotide
  Target: ATXN1; (+) strand; PAM type: YTN; PAM sequence: CTA
cttgggaggctgaggcagta

SEQ ID NO: 298755 - DNA, 20 bp, Artificial Sequence
  Description of Artificial Sequence: Synthetic oligonucleotide
  Target: ATXN1; (+) strand; PAM type: YTN; PAM sequence: CTT
gggaggctgaggcagtagaa

SEQ ID NO: 298756 - DNA, 20 bp, Artificial Sequence
  Description of Artificial Sequence: Synthetic oligonucleotide
  Target: ATXN1; (+) strand; PAM type: YTN; PAM sequence: TTG
ggaggctgaggcagtagaat

SEQ ID NO: 298757 - DNA, 20 bp, Artificial Sequence
  Description of Artificial Sequence: Synthetic oligonucleotide
  Target: ATXN1; (+) strand; PAM type: YTN; PAM sequence: CTG
aggcagtagaatcgcttgaa

SEQ ID NO: 298758 - DNA, 20 bp, Artificial Sequence
  Description of Artificial Sequence: Synthetic oligonucleotide
  Target: ATXN1; (+) strand; PAM type: YTN; PAM sequence: CTT
gaactcgagagacagaggtt

SEQ ID NO: 298759 - DNA, 20 bp, Artificial Sequence
  Description of Artificial Sequence: Synthetic oligonucleotide
  Target: ATXN1; (+) strand; PAM type: YTN; PAM sequence: TTG
aactcgagagacagaggttg

SEQ ID NO: 298760 - DNA, 20 bp, Artificial Sequence
  Description of Artificial Sequence: Synthetic oligonucleotide
  Target: ATXN1; (+) strand; PAM type: YTN; PAM sequence: CTC
gagagacagaggttgcggta

SEQ ID NO: 298761 - DNA, 20 bp, Artificial Sequence
  Description of Artificial Sequence: Synthetic oligonucleotide
  Target: ATXN1; (+) strand; PAM type: YTN; PAM sequence: TTG
cggtaagccgagatcacgcc

SEQ ID NO: 298762 - DNA, 20 bp, Artificial Sequence
  Description of Artificial Sequence: Synthetic oligonucleotide
  Target: ATXN1; (+) strand; PAM type: YTN; PAM sequence: CTG
caccccagcctgggcaacaa

SEQ ID NO: 298763 - DNA, 20 bp, Artificial Sequence
  Description of Artificial Sequence: Synthetic oligonucleotide
  Target: ATXN1; (+) strand; PAM type: YTN; PAM sequence: CTG
ggcaacaagagtgaaactcc

SEQ ID NO: 298764 - DNA, 20 bp, Artificial Sequence
  Description of Artificial Sequence: Synthetic oligonucleotide
  Target: ATXN1; (+) strand; PAM type: YTN; PAM sequence: CTC
catctcaaaaaaaaaaaaag

SEQ ID NO: 298765 - DNA, 20 bp, Artificial Sequence
  Description of Artificial Sequence: Synthetic oligonucleotide
  Target: ATXN1; (+) strand; PAM type: YTN; PAM sequence: CTC
aaaaaaaaaaaaagaaagga

SEQ ID NO: 298766 - DNA, 20 bp, Artificial Sequence
  Description of Artificial Sequence: Synthetic oligonucleotide
  Target: ATXN1; (+) strand; PAM type: YTN; PAM sequence: TTA
gtgggtggatggatggatgg

SEQ ID NO: 298767 - DNA, 20 bp, Artificial Sequence
  Description of Artificial Sequence: Synthetic oligonucleotide
  Target: ATXN1; (+) strand; PAM type: YTN; PAM sequence: TTT
ttatgtgggcggttaagttc

SEQ ID NO: 298768 - DNA, 20 bp, Artificial Sequence
  Description of Artificial Sequence: Synthetic oligonucleotide
  Target: ATXN1; (+) strand; PAM type: YTN; PAM sequence: TTT
tatgtgggcggttaagttca

SEQ ID NO: 298769 - DNA, 20 bp, Artificial Sequence
  Description of Artificial Sequence: Synthetic oligonucleotide
  Target: ATXN1; (+) strand; PAM type: YTN; PAM sequence: TTT
atgtgggcggttaagttcaa

SEQ ID NO: 298770 - DNA, 20 bp, Artificial Sequence
  Description of Artificial Sequence: Synthetic oligonucleotide
  Target: ATXN1; (+) strand; PAM type: YTN; PAM sequence: TTA
tgtgggcggttaagttcaaa

SEQ ID NO: 298771 - DNA, 20 bp, Artificial Sequence
  Description of Artificial Sequence: Synthetic oligonucleotide
  Target: ATXN1; (+) strand; PAM type: YTN; PAM sequence: TTA
agttcaaaagttaagcaaaa

SEQ ID NO: 298772 - DNA, 20 bp, Artificial Sequence
  Description of Artificial Sequence: Synthetic oligonucleotide
  Target: ATXN1; (+) strand; PAM type: YTN; PAM sequence: TTC
aaaagttaagcaaaagtcat

SEQ ID NO: 298773 - DNA, 20 bp, Artificial Sequence
  Description of Artificial Sequence: Synthetic oligonucleotide
  Target: ATXN1; (+) strand; PAM type: YTN; PAM sequence: TTA
agcaaaagtcatatatagtc

SEQ ID NO: 298774 - DNA, 20 bp, Artificial Sequence
  Description of Artificial Sequence: Synthetic oligonucleotide
  Target: ATXN1; (+) strand; PAM type: YTN; PAM sequence: TTA
actttgaaaatcctttggct

SEQ ID NO: 298775 - DNA, 20 bp, Artificial Sequence
  Description of Artificial Sequence: Synthetic oligonucleotide
  Target: ATXN1; (+) strand; PAM type: YTN; PAM sequence: CTT
tgaaaatcctttggctttcc

SEQ ID NO: 298776 - DNA, 20 bp, Artificial Sequence
  Description of Artificial Sequence: Synthetic oligonucleotide
  Target: ATXN1; (+) strand; PAM type: YTN; PAM sequence: TTT
gaaaatcctttggctttccc

SEQ ID NO: 298777 - DNA, 20 bp, Artificial Sequence
  Description of Artificial Sequence: Synthetic oligonucleotide
  Target: ATXN1; (+) strand; PAM type: YTN; PAM sequence: TTG
aaaatcctttggctttccca

SEQ ID NO: 298778 - DNA, 20 bp, Artificial Sequence
  Description of Artificial Sequence: Synthetic oligonucleotide
  Target: ATXN1; (+) strand; PAM type: YTN; PAM sequence: CTT
tggctttcccacaagacact

SEQ ID NO: 298779 - DNA, 20 bp, Artificial Sequence
  Description of Artificial Sequence: Synthetic oligonucleotide
  Target: ATXN1; (+) strand; PAM type: YTN; PAM sequence: TTT
ggctttcccacaagacactc

SEQ ID NO: 298780 - DNA, 20 bp, Artificial Sequence
  Description of Artificial Sequence: Synthetic oligonucleotide
  Target: ATXN1; (+) strand; PAM type: YTN; PAM sequence: TTG
gctttcccacaagacactcc

SEQ ID NO: 298781 - DNA, 20 bp, Artificial Sequence
  Description of Artificial Sequence: Synthetic oligonucleotide
  Target: ATXN1; (+) strand; PAM type: YTN; PAM sequence: CTT
tcccacaagacactccacac

SEQ ID NO: 298782 - DNA, 20 bp, Artificial Sequence
  Description of Artificial Sequence: Synthetic oligonucleotide
  Target: ATXN1; (+) strand; PAM type: YTN; PAM sequence: TTT
cccacaagacactccacaca

SEQ ID NO: 298783 - DNA, 20 bp, Artificial Sequence
  Description of Artificial Sequence: Synthetic oligonucleotide
  Target: ATXN1; (+) strand; PAM type: YTN; PAM sequence: TTC
ccacaagacactccacacag

SEQ ID NO: 298784 - DNA, 20 bp, Artificial Sequence
  Description of Artificial Sequence: Synthetic oligonucleotide
  Target: ATXN1; (+) strand; PAM type: YTN; PAM sequence: CTC
cacacaggattttatgtata

SEQ ID NO: 298785 - DNA, 20 bp, Artificial Sequence
  Description of Artificial Sequence: Synthetic oligonucleotide
  Target: ATXN1; (+) strand; PAM type: YTN; PAM sequence: TTT
tatgtatactgcacaatcct

SEQ ID NO: 298786 - DNA, 20 bp, Artificial Sequence
  Description of Artificial Sequence: Synthetic oligonucleotide
  Target: ATXN1; (+) strand; PAM type: YTN; PAM sequence: TTT
atgtatactgcacaatcctt

SEQ ID NO: 298787 - DNA, 20 bp, Artificial Sequence
  Description of Artificial Sequence: Synthetic oligonucleotide
  Target: ATXN1; (+) strand; PAM type: YTN; PAM sequence: TTA
tgtatactgcacaatccttt

SEQ ID NO: 298788 - DNA, 20 bp, Artificial Sequence
  Description of Artificial Sequence: Synthetic oligonucleotide
  Target: ATXN1; (+) strand; PAM type: YTN; PAM sequence: CTG
cacaatcctttactgcactt

SEQ ID NO: 298789 - DNA, 20 bp, Artificial Sequence
  Description of Artificial Sequence: Synthetic oligonucleotide
  Target: ATXN1; (+) strand; PAM type: YTN; PAM sequence: CTT
tactgcacttttcatgtaca

SEQ ID NO: 298790 - DNA, 20 bp, Artificial Sequence
  Description of Artificial Sequence: Synthetic oligonucleotide
  Target: ATXN1; (+) strand; PAM type: YTN; PAM sequence: TTT
actgcacttttcatgtacac

SEQ ID NO: 298791 - DNA, 20 bp, Artificial Sequence
  Description of Artificial Sequence: Synthetic oligonucleotide
  Target: ATXN1; (+) strand; PAM type: YTN; PAM sequence: TTA
ctgcacttttcatgtacact

SEQ ID NO: 298792 - DNA, 20 bp, Artificial Sequence
  Description of Artificial Sequence: Synthetic oligonucleotide
  Target: ATXN1; (+) strand; PAM type: YTN; PAM sequence: CTG
cacttttcatgtacactgaa

SEQ ID NO: 298793 - DNA, 20 bp, Artificial Sequence
  Description of Artificial Sequence: Synthetic oligonucleotide
  Target: ATXN1; (+) strand; PAM type: YTN; PAM sequence: CTT
ttcatgtacactgaagtgtg

SEQ ID NO: 298794 - DNA, 20 bp, Artificial Sequence
  Description of Artificial Sequence: Synthetic oligonucleotide
  Target: ATXN1; (+) strand; PAM type: YTN; PAM sequence: TTT
tcatgtacactgaagtgtga

SEQ ID NO: 298795 - DNA, 20 bp, Artificial Sequence
  Description of Artificial Sequence: Synthetic oligonucleotide
  Target: ATXN1; (+) strand; PAM type: YTN; PAM sequence: TTT
catgtacactgaagtgtgat

SEQ ID NO: 298796 - DNA, 20 bp, Artificial Sequence
  Description of Artificial Sequence: Synthetic oligonucleotide
  Target: ATXN1; (+) strand; PAM type: YTN; PAM sequence: TTC
atgtacactgaagtgtgata

SEQ ID NO: 298797 - DNA, 20 bp, Artificial Sequence
  Description of Artificial Sequence: Synthetic oligonucleotide
  Target: ATXN1; (+) strand; PAM type: YTN; PAM sequence: CTG
aagtgtgataactattgggt

SEQ ID NO: 298798 - DNA, 20 bp, Artificial Sequence
  Description of Artificial Sequence: Synthetic oligonucleotide
  Target: ATXN1; (+) strand; PAM type: YTN; PAM sequence: CTA
ttgggttagactacaagaaa

SEQ ID NO: 298799 - DNA, 20 bp, Artificial Sequence
  Description of Artificial Sequence: Synthetic oligonucleotide
  Target: ATXN1; (+) strand; PAM type: YTN; PAM sequence: TTG
ggttagactacaagaaagaa

SEQ ID NO: 298800 - DNA, 20 bp, Artificial Sequence
  Description of Artificial Sequence: Synthetic oligonucleotide
  Target: ATXN1; (+) strand; PAM type: YTN; PAM sequence: TTA
gactacaagaaagaactcaa

SEQ ID NO: 298801 - DNA, 20 bp, Artificial Sequence
  Description of Artificial Sequence: Synthetic oligonucleotide
  Target: ATXN1; (+) strand; PAM type: YTN; PAM sequence: CTA
caagaaagaactcaatggaa

SEQ ID NO: 298802 - DNA, 20 bp, Artificial Sequence
  Description of Artificial Sequence: Synthetic oligonucleotide
  Target: ATXN1; (+) strand; PAM type: YTN; PAM sequence: CTC
aatggaagaacacatgtaaa

SEQ ID NO: 298803 - DNA, 20 bp, Artificial Sequence
  Description of Artificial Sequence: Synthetic oligonucleotide
  Target: ATXN1; (+) strand; PAM type: YTN; PAM sequence: CTG
tacattcaaaccattcctct

SEQ ID NO: 298804 - DNA, 20 bp, Artificial Sequence
  Description of Artificial Sequence: Synthetic oligonucleotide
  Target: ATXN1; (+) strand; PAM type: YTN; PAM sequence: TTC
aaaccattcctcttttaaaa

SEQ ID NO: 298805 - DNA, 20 bp, Artificial Sequence
  Description of Artificial Sequence: Synthetic oligonucleotide
  Target: ATXN1; (+) strand; PAM type: YTN; PAM sequence: TTC
ctcttttaaaattaagtatt

SEQ ID NO: 298806 - DNA, 20 bp, Artificial Sequence
  Description of Artificial Sequence: Synthetic oligonucleotide
  Target: ATXN1; (+) strand; PAM type: YTN; PAM sequence: CTC
ttttaaaattaagtattgta

SEQ ID NO: 298807 - DNA, 20 bp, Artificial Sequence
  Description of Artificial Sequence: Synthetic oligonucleotide
  Target: ATXN1; (+) strand; PAM type: YTN; PAM sequence: CTT
ttaaaattaagtattgtatc

SEQ ID NO: 298808 - DNA, 20 bp, Artificial Sequence
  Description of Artificial Sequence: Synthetic oligonucleotide
  Target: ATXN1; (+) strand; PAM type: YTN; PAM sequence: TTT
taaaattaagtattgtatca

SEQ ID NO: 298809 - DNA, 20 bp, Artificial Sequence
  Description of Artificial Sequence: Synthetic oligonucleotide
  Target: ATXN1; (+) strand; PAM type: YTN; PAM sequence: TTT
aaaattaagtattgtatcac

SEQ ID NO: 298810 - DNA, 20 bp, Artificial Sequence
  Description of Artificial Sequence: Synthetic oligonucleotide
  Target: ATXN1; (+) strand; PAM type: YTN; PAM sequence: TTA
aaattaagtattgtatcact

SEQ ID NO: 298811 - DNA, 20 bp, Artificial Sequence
  Description of Artificial Sequence: Synthetic oligonucleotide
  Target: ATXN1; (+) strand; PAM type: YTN; PAM sequence: TTA
agtattgtatcactacagtt

SEQ ID NO: 298812 - DNA, 20 bp, Artificial Sequence
  Description of Artificial Sequence: Synthetic oligonucleotide
  Target: ATXN1; (+) strand; PAM type: YTN; PAM sequence: TTG
tatcactacagttaaacggg

SEQ ID NO: 298813 - DNA, 20 bp, Artificial Sequence
  Description of Artificial Sequence: Synthetic oligonucleotide
  Target: ATXN1; (+) strand; PAM type: YTN; PAM sequence: CTA
cagttaaacggggggattag

SEQ ID NO: 298814 - DNA, 20 bp, Artificial Sequence
  Description of Artificial Sequence: Synthetic oligonucleotide
  Target: ATXN1; (+) strand; PAM type: YTN; PAM sequence: TTA
aacggggggattagataaag

SEQ ID NO: 298815 - DNA, 20 bp, Artificial Sequence
  Description of Artificial Sequence: Synthetic oligonucleotide
  Target: ATXN1; (+) strand; PAM type: YTN; PAM sequence: TTA
gataaagataagtaaaatat

SEQ ID NO: 298816 - DNA, 20 bp, Artificial Sequence
  Description of Artificial Sequence: Synthetic oligonucleotide
  Target: ATXN1; (+) strand; PAM type: YTN; PAM sequence: TTG
gtgttttccagcaagtatta

SEQ ID NO: 298817 - DNA, 20 bp, Artificial Sequence
  Description of Artificial Sequence: Synthetic oligonucleotide
  Target: ATXN1; (+) strand; PAM type: YTN; PAM sequence: TTT
tccagcaagtattacttcat

SEQ ID NO: 298818 - DNA, 20 bp, Artificial Sequence
  Description of Artificial Sequence: Synthetic oligonucleotide
  Target: ATXN1; (+) strand; PAM type: YTN; PAM sequence: TTT
ccagcaagtattacttcatt

SEQ ID NO: 298819 - DNA, 20 bp, Artificial Sequence
  Description of Artificial Sequence: Synthetic oligonucleotide
  Target: ATXN1; (+) strand; PAM type: YTN; PAM sequence: TTC
cagcaagtattacttcattc

SEQ ID NO: 298820 - DNA, 20 bp, Artificial Sequence
  Description of Artificial Sequence: Synthetic oligonucleotide
  Target: ATXN1; (+) strand; PAM type: YTN; PAM sequence: TTA
cttcattctgttgtaatagt

SEQ ID NO: 298821 - DNA, 20 bp, Artificial Sequence
  Description of Artificial Sequence: Synthetic oligonucleotide
  Target: ATXN1; (+) strand; PAM type: YTN; PAM sequence: CTT
cattctgttgtaatagtaag

SEQ ID NO: 298822 - DNA, 20 bp, Artificial Sequence
  Description of Artificial Sequence: Synthetic oligonucleotide
  Target: ATXN1; (+) strand; PAM type: YTN; PAM sequence: TTC
attctgttgtaatagtaagc

SEQ ID NO: 298823 - DNA, 20 bp, Artificial Sequence
  Description of Artificial Sequence: Synthetic oligonucleotide
  Target: ATXN1; (+) strand; PAM type: YTN; PAM sequence: TTC
tgttgtaatagtaagcttct

SEQ ID NO: 298824 - DNA, 20 bp, Artificial Sequence
  Description of Artificial Sequence: Synthetic oligonucleotide
  Target: ATXN1; (+) strand; PAM type: YTN; PAM sequence: CTG
ttgtaatagtaagcttcttt

SEQ ID NO: 298825 - DNA, 20 bp, Artificial Sequence
  Description of Artificial Sequence: Synthetic oligonucleotide
  Target: ATXN1; (+) strand; PAM type: YTN; PAM sequence: TTG
taatagtaagcttctttaac

SEQ ID NO: 298826 - DNA, 20 bp, Artificial Sequence
  Description of Artificial Sequence: Synthetic oligonucleotide
  Target: ATXN1; (+) strand; PAM type: YTN; PAM sequence: CTT
ctttaactttaatgaatatt

SEQ ID NO: 298827 - DNA, 20 bp, Artificial Sequence
  Description of Artificial Sequence: Synthetic oligonucleotide
  Target: ATXN1; (+) strand; PAM type: YTN; PAM sequence: TTC
tttaactttaatgaatatta

SEQ ID NO: 298828 - DNA, 20 bp, Artificial Sequence
  Description of Artificial Sequence: Synthetic oligonucleotide
  Target: ATXN1; (+) strand; PAM type: YTN; PAM sequence: CTT
taactttaatgaatattaac

SEQ ID NO: 298829 - DNA, 20 bp, Artificial Sequence
  Description of Artificial Sequence: Synthetic oligonucleotide
  Target: ATXN1; (+) strand; PAM type: YTN; PAM sequence: TTT
aactttaatgaatattaaca

SEQ ID NO: 298830 - DNA, 20 bp, Artificial Sequence
  Description of Artificial Sequence: Synthetic oligonucleotide
  Target: ATXN1; (+) strand; PAM type: YTN; PAM sequence: TTA
actttaatgaatattaacaa

SEQ ID NO: 298831 - DNA, 20 bp, Artificial Sequence
  Description of Artificial Sequence: Synthetic oligonucleotide
  Target: ATXN1; (+) strand; PAM type: YTN; PAM sequence: CTT
taatgaatattaacaaatgt

SEQ ID NO: 298832 - DNA, 20 bp, Artificial Sequence
  Description of Artificial Sequence: Synthetic oligonucleotide
  Target: ATXN1; (+) strand; PAM type: YTN; PAM sequence: TTT
aatgaatattaacaaatgta

SEQ ID NO: 298833 - DNA, 20 bp, Artificial Sequence
  Description of Artificial Sequence: Synthetic oligonucleotide
  Target: ATXN1; (+) strand; PAM type: YTN; PAM sequence: TTA
atgaatattaacaaatgtac

SEQ ID NO: 298834 - DNA, 20 bp, Artificial Sequence
  Description of Artificial Sequence: Synthetic oligonucleotide
  Target: ATXN1; (+) strand; PAM type: YTN; PAM sequence: TTA
acaaatgtactgttgttaaa

SEQ ID NO: 298835 - DNA, 20 bp, Artificial Sequence
  Description of Artificial Sequence: Synthetic oligonucleotide
  Target: ATXN1; (+) strand; PAM type: YTN; PAM sequence: CTG
ttgttaaagttaaaggaact

SEQ ID NO: 298836 - DNA, 20 bp, Artificial Sequence
  Description of Artificial Sequence: Synthetic oligonucleotide
  Target: ATXN1; (+) strand; PAM type: YTN; PAM sequence: TTG
ttaaagttaaaggaactgta

SEQ ID NO: 298837 - DNA, 20 bp, Artificial Sequence
  Description of Artificial Sequence: Synthetic oligonucleotide
  Target: ATXN1; (+) strand; PAM type: YTN; PAM sequence: TTA
aagttaaaggaactgtagga

SEQ ID NO: 298838 - DNA, 20 bp, Artificial Sequence
  Description of Artificial Sequence: Synthetic oligonucleotide
  Target: ATXN1; (+) strand; PAM type: YTN; PAM sequence: TTA
aaggaactgtaggatctcct

SEQ ID NO: 298839 - DNA, 20 bp, Artificial Sequence
  Description of Artificial Sequence: Synthetic oligonucleotide
  Target: ATXN1; (+) strand; PAM type: YTN; PAM sequence: CTG
taggatctcctattgagttc

SEQ ID NO: 298840 - DNA, 20 bp, Artificial Sequence
  Description of Artificial Sequence: Synthetic oligonucleotide
  Target: ATXN1; (+) strand; PAM type: YTN; PAM sequence: CTC
ctattgagttcataatgtgg

SEQ ID NO: 298841 - DNA, 20 bp, Artificial Sequence
  Description of Artificial Sequence: Synthetic oligonucleotide
  Target: ATXN1; (+) strand; PAM type: YTN; PAM sequence: CTA
ttgagttcataatgtggtaa
